United States Patent 7,629,444 (NUCLEOTIDE AND AMINO ACID SEQUENCES FROM XENORHABDUS BOVIENII STRAIN XS85831 AND USES THEREOF) - sequence listing, part 3

SEQ ID NO: 8011 - protein, 73 aa, Xenorhabdus bovienii
  Peptide sequence Name=Xb4151_4152.C435.gene87.pep
LISPQRGAISSDSESLHFTSLSTIIDCPHVRASLDTSHTSLSFLHLYLRYLHSSLLTKNDFPTTFSFSNREIY

SEQ ID NO: 8012 - protein, 202 aa, Xenorhabdus bovienii
  Peptide sequence Name=Xb4151_4152.C435.gene88.pep
  Gene classification: Gene name=RibA; Function=GTP cyclohydrolase II; Function class=H Coenzyme metabolism
  Homolog annotation: Query=6..200bp; Hit=2..196bp; Blast score=352; Percent Identity=82.0; E value=1e-97; Homolog= ribA COG0807
MNTKTQLKRVAEATLPTPWGEFLMIGFEEIKTGRDHVALVFGDISGNEPVLSRIHSECLTGDALFSLRCDCGFQLEAAFSQISKEGKGVLLYHRQEGRNIGLLNKIRAYALQDKGVDTVEANHQLGFAADERDFTLCSDMYKLLGINAIRLLTNNPKKVEIMVDAGINIVERVPLVVGRNPKNAYYLDTKASRMGHLLSQSN

SEQ ID NO: 8013 - protein, 40 aa, Xenorhabdus bovienii
  Peptide sequence Name=Xb4151_4152.C435.gene89.pep
MLICSFLSHYSIYLPTNTPILTQIATSYAPVYICKNLFIV

SEQ ID NO: 8014 - protein, 104 aa, Xenorhabdus bovienii
  Peptide sequence Name=Xb4151_4152.C435.gene90.pep
  Gene classification: Function=Predicted membrane protein; Function class=S Function unknown
  Homolog annotation: Query=1..93bp; Hit=1..93bp; Blast score=110; Percent Identity=67.0; E value=2e-25; Homolog= yciS COG3771
VKYFLILLLALIVFVISVTLGANNDQVVTFNYLIAKGDYSISTLLSVLFAIGFILGWGICGGFYLRVCVSLRRAKRKIKRLEAQLEQPAESSVKTASPVVLTKE

SEQ ID NO: 8015 - protein, 389 aa, Xenorhabdus bovienii
  Peptide sequence Name=Xb4151_4152.C435.gene91.pep
  Gene classification: Function=Predicted N-acetylglucosaminyl transferase; Function class=G Carbohydrate transport and metabolism
  Homolog annotation: Query=1..388bp; Hit=1..388bp; Blast score=536; Percent Identity=72.0; E value=1e-152; Homolog= yciM COG2956
MLELLFLLLPIAAAYGWYMGRRSAQQDKQQSADRLSRGYVDGVNFLLSNQQDKAVDLFLDMLKEDSSAFEAHLTLGNLFRSRGEVERAIRIHQSLMESASLTFEQRLLAIQQLGRDYMAAGVYDRAENMFIQLVDEADFCENAFNSLLSIYQSTSDWNKAIDVSEKLVKLGKHHFREEIAHFYCELALQYMGSDASTEAVGYLNKAAQADKNCARVSIMFGRIYIAQKEYTKAAELLKRILEQDKQLVSESLPMLEECYQNLSQPEEWEAFVQCCVEEKCGAIAELYLADIIEKKEGRDIAQNYINRQLERHPTMRLFYRLMDYHLADAEEGRAKESLLLLRNMVGEQIRTKPDYRCHKCGFTSRSLYWHCPSCRSWDTIKPIRGLDGQ

SEQ ID NO: 8016 - protein, 40 aa, Xenorhabdus bovienii
  Peptide sequence Name=Xb4151_4152.C435.gene92.pep
MKSKHVRNETCINENTQILPLIIVTLSLPIQTPDWFDSVP

SEQ ID NO: 8017 - protein, 246 aa, Xenorhabdus bovienii
  Peptide sequence Name=Xb4151_4152.C435.gene93.pep
  Gene classification: Gene name=PyrF; Function=Orotidine-5'-phosphate decarboxylase; Function class=F Nucleotide transport and metabolism
  Homolog annotation: Query=14..241bp; Hit=14..241bp; Blast score=333; Percent Identity=75.0; E value=7e-92; Homolog= ZpyrF COG0284
MTSHTAQTLGKQIDSPVIVALDYDNQDAALAFVDKIDPQSCRLKVGKEMFTLNGPQFIQVLHQRGFEVFLDLKFHDIPNTTARAVAAAAELGVWMVNVHACGGARMMTAAKEALLPYGKDAPLLIAVTVLTSMEQSDLLGVGIDMTPAQHAERLAILTKQCGLDGVVCSAHEAQQLKAVCGQEFQLVTPGIRPEGAEAGDQRRIMTPPQAVQAGVDYMVIGRPITRAENPALALQQINYSIGIVHG

SEQ ID NO: 8018 - protein, 107 aa, Xenorhabdus bovienii
  Peptide sequence Name=Xb4151_4152.C435.gene94.pep
  Gene classification: Gene name=SUI1; Function=Translation initiation factor (SUI1); Function class=J Translation, ribosomal structure and biogenesis
  Homolog annotation: Query=2..107bp; Hit=4..109bp; Blast score=142; Percent Identity=78.0; E value=5e-35; Homolog= yciH COG0023
MDNNSRLVYSTDIGRVQEEKIKPSRHKGDGIVRIQRQTSGRKGKGVCIITGIDADDQTLAKLAAELKKKCACGGSVKEGEIEIQGDKRDLLKQLLEAKGMTVKLAGG

SEQ ID NO: 8019 - protein, 296 aa, Xenorhabdus bovienii
  Peptide sequence Name=Xb4151_4152.C435.gene95.pep
  Gene classification: Gene name=PenP (BS); Function=Beta-lactamase class A; Function class=M Cell envelope biogenesis, outer membrane
  Homolog annotation: Query=27..295bp; Hit=39..304bp; Blast score=214; Percent Identity=44.0; E value=1e-55; Homolog= BS_penP COG2367
MLLSSLRLTRISATIFPLLGALITFPIHATTQQNQITNQLSALEKNANGRLGVVLIDTADHSTITYRAHERFPLCSTSKMMAVSALLKKSETNEGLLNQRIHYQQSDIVEYSPITEKHLKDGMTLAKLSAATIQYSDNTAMNLLIDQLGGTHDVTRFARSIGDNEFRLDRKEPELNMVTPDDERDTTTPQAMADSLYKLALGNTLAATQRAQLVEWLKGNTTGGASIRAGVPDNWIVGDKTGRCDYGSTNDIAVIWPDKNKAPLILVTYFTQPNDKDAEAHPDVLAAAARIMTQER

SEQ ID NO: 8020 - protein, 513 aa, Xenorhabdus bovienii
  Peptide sequence Name=Xb4151_4152.C435.gene96.pep
  Gene classification: Gene name=VacB; Function=Exoribonucleases; Function class=K Transcription
  Homolog annotation: Query=1..513bp; Hit=132..644bp; Blast score=699; Percent Identity=66.0; E value=0; Homolog= Zrnb COG0557
MRRHPLKGDRGFQAEITGYIIKGDDHYAPWWVTLTRHSLQREAPTMPDCQLDDGSLERIDLTALDFVTIDSATTEDMDDALHIVKNNDGSLKLSIAIADPTAYIKADSELDKIAYQRSFTNYLPGFNIPMLPRELSDDLCSLRPKARRPALVCQVSILEDGQLGDDMQFFAAWVESKFKLAYDDVSDWLEHQTGWKPESEAVTTQITLLQEMCERRNQWRHQYALVFKERPDYRFVLDKGGNVVDIVIDQRRSANRIVEEAMITANLCAAKILRDKLGFGIYNVHTGFEPTQIDQVVDVLKENGIEAEANALLELDGFCQLRRELDQQPTQFLDSRIRRFQTFAEIRPEPGPHFGLGFDAYATWTSPIRKYSDIINHRLLKAIIQQTEEEKPSEEVCLQLTERRRANRMAERDVGDWLYARFLHPHAGTDKTFSAEIVDITRGGLRIRLVDNGAIAFVPGSFLHAVRDELQCSQETGSVLIKGEAVHRLNDIINVRIEEVRMETRNIVARPVA

SEQ ID NO: 8021 - protein, 61 aa, Xenorhabdus bovienii
  Peptide sequence Name=Xb4151_4152.C435.gene97.pep
LVEAFLTRFGGRVQKKENDNRLRVIPDHALVKDTSFVVLLIKSPIILRMAIGQWLKCAVIH

SEQ ID NO: 8022 - protein, 82 aa, Xenorhabdus bovienii
  Peptide sequence Name=Xb4151_4152.C435.gene98.pep
  Gene classification: Gene name=VacB; Function=Exoribonucleases; Function class=K Transcription
  Homolog annotation: Query=1..72bp; Hit=1..72bp; Blast score=131; Percent Identity=83.0; E value=1e-31; Homolog= rnb COG0557
MFQNNPLLAQLKQQLYSQTLRVEGLVKGTEKGFGFLEVDGQKSYFIPPPQMKKVMHGDRITAAIHADKEKESLNQKPWLRHF

SEQ ID NO: 8023 - protein, 47 aa, Xenorhabdus bovienii
  Peptide sequence Name=Xb4151_4152.C435.gene99.pep
MELLSIILDNSFTRIRGMEQVTSYQNTQNCLKRSIITQLISAESESL

SEQ ID NO: 8024 - protein, 70 aa, Xenorhabdus bovienii
  Peptide sequence Name=Xb4151_4152.C435.gene100.pep
MSSNLVVGGSFLQLMVKRVIDSCWLENGSARSLIKDFPIQYMSLWVIYLCRCSTWYFVTRFYQHTHTDLQ

SEQ ID NO: 8025 - protein, 210 aa, Xenorhabdus bovienii
  Peptide sequence Name=Xb4151_4152.C435.gene101.pep
  Gene classification: Gene name=Nth; Function=Predicted EndoIII -related endonuclease; Function class=L DNA replication, recombination and repair
  Homolog annotation: Query=1..210bp; Hit=1..210bp; Blast score=369; Percent Identity=84.0; E value=1e-102; Homolog= nth COG0177
MNQQKRIAILTRLQNNNPQPTTELAFNSPFELLISVLLSAQATDVSVNKATTKLYPVANTPQTILNLGVDNLKEYIKTIGLYNTKAENVIKTCRILLEKHQGEVPEDRAALEALPGVGRKTANVVLNTAFGWPTIAVDTHIFRVCNRTQFAPGKNVDEVERTLLKVVPDEFKLDCHHWLILHGRYTCIARKPRCGSCIIEDLCEYADKTE

SEQ ID NO: 8026 - protein, 235 aa, Xenorhabdus bovienii
  Peptide sequence Name=Xb4151_4152.C435.gene102.pep
  Gene classification: Gene name=NqrD; Function=Na+-transporting NADH; Function class=C Energy production and conversion
  Homolog annotation: Query=1..227bp; Hit=1..229bp; Blast score=296; Percent Identity=74.0; E value=1e-80; Homolog= ZydgQ COG1347
MSETKKLLSQGLWKNNSALVQLLGLCPLLAVSSTATNALGLGLATTLVLLSTNVAVSALRHWVPHEIRIPIYVMIIASVVSAVQMLINAFAFGLYESLGIFIPLIVTNCIVIGRAEAYASKNSIYNSTIDGLAMGLGATFSLFVLGAIREILGNGTIFDGADLLLGSWAKSLRLEIMHMDSPFLLAILPPGAFIGLGLMLAGKYIIDKRIKNRADNQARRYDNVEKGCGSHITKS

SEQ ID NO: 8027 - protein, 208 aa, Xenorhabdus bovienii
  Peptide sequence Name=Xb4151_4152.C435.gene103.pep
  Gene classification: Gene name=NqrC; Function=Na+-transporting NADH; Function class=C Energy production and conversion
  Homolog annotation: Query=1..206bp; Hit=1..205bp; Blast score=278; Percent Identity=65.0; E value=4e-75; Homolog= ydgP COG2869
MLETMRRHGITLAIFAACTTGLTAIVYSLTKDRIAEQAALQHKILLDQVVPPTLYNNNMQDECYVVTADALGNKQPHRLYLARKNGSPVAAAIESTAPDGYSGAIQLLVGADFSGNVFGVRVTEHHETPGLGDKIDTRISNWIYSLSDKKVISDNDPHWAVKKDGGEFDQFTGATITPRAVINAAKRTTLYLKTIPAQLSSLPTCGTE

SEQ ID NO: 8028 - protein, 359 aa, Xenorhabdus bovienii
  Peptide sequence Name=Xb4151_4152.C435.gene104.pep
  Gene classification: Gene name=NqrB; Function=Na+-transporting NADH; Function class=C Energy production and conversion
  Homolog annotation: Query=14..359bp; Hit=4..350bp; Blast score=407; Percent Identity=61.0; E value=1e-114; Homolog= ydgO COG1805
MKFRPVKTDNNQLKVASSPFTHNQKSTSQLMLWVVLAAVPGIAVQTYLFGYGTLFQILLAVITALLAESVAISMKKQVIAPFLKDNSALVTGLLLGISLPPLAPWWLIVLGTFFAIIIAKHLYGGLGQNPFNPAMVGYVVLLISFPVQMTSWLPPVSFQALTLTPWDCLMVIFTGHTPDGSTLIHLQQGIDGLSQATPLDSFKTGRLTHNIDEVLQQPMLQGTLVGIGWQWVNVAYLVGGLIMLNRKVISWQIPTAFILALCTCALLSWLIDPTRYSPPLLQIFSGATMLGAFFIATDPVSASTTSKGRLIYGAIIGMLIWVIRVYGGYPDAIAFAVLLANICVPLIDHYTQPRAYGHK

SEQ ID NO: 8029 - protein, 668 aa, Xenorhabdus bovienii
  Peptide sequence Name=Xb4151_4152.C435.gene105.pep
  Gene classification: Gene name=NqrA; Function=Na+-transporting NADH; Function class=C Energy production and conversion
  Homolog annotation: Query=1..477bp; Hit=1..477bp; Blast score=649; Percent Identity=66.0; E value=0; Homolog= Z2636_1 COG1726
MFNLFNLLNKNKIWDFEGGIHPPEMKLQSSRTPLRYAPIPDELIIPLQQHLGPEGELLVKVGDKVLKGQPLTVGTGRTVPVHASTSGTITAIEPCVTAHPSGLKELCVRLYPDGKDKWCERIQTTDYTSLNTSTLLQRIQQAGIAGLGGAGFPTASKLQGSRHDLKTLIINAAECEPYITADDRLIQEHANEVIEGIRILMHLLNPERVLIGIEDNKPEAIDALNTALNGDDSIVVRVIPTKYPSGGAKQLTKILTGKEVPSGGRSSDIGVLMQNVGTVMAIKRAIIDGEPLIERIVTLTGEAVTAPGNFWARLGTPVQFLLQQAGFKAKSEQMVIMGGPLMGFTLPDLNVPVVKISNCILAPSIQEMEPKTVEEACIRCGLCVEACPAGLLPQQLYWFSRGQEHKKAKNHHLFDCIECGACAYVCPSNIPLVQYYRQEKAEIRAIDAETRRSAEAKIRFEAKQSRMEQEKLAREERHKKSAVQVDSKDQSAIQAALSRVKEKQKNAGEAINVQAGKLPDNEAAIAARKARKEQLRTRQAEKPATITVNTEPATPTESDDLRKAALAAAIARVKAKKATQSEVVTTSQKDSPNNADDKQDPRKAAVAAAIARAKAKKAAQNQSEPTPQQEDITAVPEEIDPRKAAVAAAIARVKAKKAALEKQETPTE

SEQ ID NO: 8030 - protein, 205 aa, Xenorhabdus bovienii
  Peptide sequence Name=Xb4151_4152.C435.gene106.pep
  Gene classification: Function=Predicted alternative beta subunit of Na+-transporting NADH; Function class=C Energy production and conversion
  Homolog annotation: Query=1..188bp; Hit=1..188bp; Blast score=276; Percent Identity=72.0; E value=1e-74; Homolog= ydgM COG2878
MMSLWIAIGVLSLLGLAFGLILGFAARRFKVEEDPIVEKIDNLLPQSQCGQCSYPGCRPYAEAITNNGEMINKCAPGGEQVMLKMAELLGVDPQPLDGDDSVQNPARKVAFIDEENCIGCTKCIQACPVDAIIGANRAIHTVVEDLCTGCDLCVAPCPTDCITMIPVATTTSNWKWDLNSIPVRNIPINPIFVSPTKPVEVKANV

SEQ ID NO: 8031 - protein, 193 aa, Xenorhabdus bovienii
  Peptide sequence Name=Xb4151_4152.C435.gene107.pep
  Gene classification: Gene name=NqrE; Function=Na+-transporting NADH; Function class=C Energy production and conversion
  Homolog annotation: Query=1..192bp; Hit=1..192bp; Blast score=247; Percent Identity=88.0; E value=4e-66; Homolog= ydgL COG2209
MTEYLLLFIGTVLVNNFVLVKFLGLCPFMGVSKKLETAIGMGLATTFVLTLASISSWLINTFILVPLDLVYLRTLSFILVIAVVVQFTELVVRKTSPALYRLLGIFLPLITTNCAVLGVALLNVNQSHNFLQSAIYGFSAAVGFSLVMVLFAAIRERLAVANIPAPFRGSSIGLITAGLMSLAFMGFSGLVKF

SEQ ID NO: 8032 - protein, 39 aa, Xenorhabdus bovienii
  Peptide sequence Name=Xb4151_4152.C435.gene108.pep
MTEIAPPCDETSGAMITIDCGGCYRSCVKVIFTRWERLI

SEQ ID NO: 8033 - protein, 146 aa, Xenorhabdus bovienii
  Peptide sequence Name=Xb4151_4152.C435.gene109.pep
  Homolog annotation: Query=1..146bp; Hit=1..146bp; Blast score=157; Percent Identity=71.0; E value=2e-38; Homolog= gi|37526277|ref|NP _929621.1| hypothetical protein [Photorhabdus luminescens subsp. laumondii TTO1] gi|36785708|emb|CAE14690.1|
MYQSNDYYRINGWLLAPAAYLIMTLIAASLMLLLYLITLIYRNEAIHQVDGNFTTMWYISVLTTAMMWCFTLWVLKLLFIHSKRFPRIFIIWLMVSVLIAIKTFAFSPISDEMAIRSLLWPLLAAAVFVPYIKRSHRVKMTFTQDR

SEQ ID NO: 8034 - protein, 348 aa, Xenorhabdus bovienii
  Peptide sequence Name=Xb4151_4152.C435.gene110.pep
  Gene classification: Gene name=MviM; Function=Predicted dehydrogenases and related proteins; Function class=R General function prediction only
  Homolog annotation: Query=1..345bp; Hit=14..358bp; Blast score=454; Percent Identity=63.0; E value=1e-128; Homolog= Z2629 COG0673
MSDFLKVGLVGYGYASKTFHAPLIAGTSNVELAAISSSDTEKVRKDWPTVTVVSSPEALFSDPNIDLIVIPTPNDTHYPLAQKALAAGKHVVVDKPFTITVEEAEALKEQAEEANLLLSVFHNRRWDAGFLTVKSLIQENRLGKLKYYESHFDRYRPVVRQRWREAAGAGGGIWYDLGPHLLDQAVQLFGKPHAITVNLGMIRPNAEAVDYFHAQLNYPDLNVVLHATTVAAAESPIYILHGMEGSYVKYGLDTQEERLKAGERPPRTDWGYDIRDGSVTMSQGDDLITQIIPTLPGNYGAYYAAIRDAIVAGKSNPVTADEAILIMKLIEAGEKSAKEQRTILIDWE

SEQ ID NO: 8035 - protein, 325 aa, Xenorhabdus bovienii
  Peptide sequence Name=Xb4151_4152.C435.gene111.pep
  Gene classification: Function=Predicted Na+-dependent transporter; Function class=R General function prediction only
  Homolog annotation: Query=9..323bp; Hit=7..320bp; Blast score=343; Percent Identity=64.0; E value=1e-94; Homolog= ZyfeH COG0385
MSWWQKLRIDPFLVTLITVVIIATLFPCEGESKKWFQYLTTAAIALLFFMHGAKLSRGAILAGIGHWRLHLVIFLSTFVLFPILGMGLYFIVPEWLSPTVYMGFLYLCALPATVQSAIAFTSVAKGNVAAAICSASASSLLGVFVSPLLVGLLIQTNDGHTDTWKAIKDIILQLMVPFIVGHLSRPLIASWVEKHKKLVNSTDRSSILLVVYVAFSEAVVEGIWHKIDAYSLMIIGVVCCVLLTMILMINVYSSRLFGFSKEDEITIVFCGSKKSLANGVPMANVLFPAPMVGVMLLPLMIFHQIQLMVCAVLARRYARRPKKAD

SEQ ID NO: 8036 - protein, 333 aa, Xenorhabdus bovienii
  Peptide sequence Name=Xb4151_4152.C435.gene112.pep
  Gene classification: Gene name=Add; Function=Adenosine deaminase; Function class=F Nucleotide transport and metabolism
  Homolog annotation: Query=1..331bp; Hit=1..331bp; Blast score=483; Percent Identity=74.0; E value=1e-136; Homolog= add COG1816
MIDIRLPLTDLHRHLDGNIRPETILELARQYNIPLPAYELEALRPHVQITENEPNLISFLQKLDWGVTVLADLDACRRVAIENVEDAVNAGLDYAELRFSPYYMAMKHQLPVEGVVEAVIDGVHSASQQLDVQIRLIGILSRTFGEKACTQELSGLLAHKQHITALDLAGDELGFPGYLFEQHFIQARDAGWNISVHAGEAAGAESIWHAIRELGATRIGHGVKAITDPALMDYLAKHGIGIESCLTSNLQTSTVNSLSTHPLKQFLAHGILASINTDDPAVEGIEIHHEYNVAAPAAGLSPEQIRQAQINGLKTAFLSEAEKQALKTKAANR

SEQ ID NO: 8037 - protein, 483 aa, Xenorhabdus bovienii
  Peptide sequence Name=Xb4151_4152.C435.gene113.pep
  Homolog annotation: Query=1..480bp; Hit=1..481bp; Blast score=467; Percent Identity=51.0; E value=1e-130; Homolog= gi|37526263|ref|NP _929607.1| hypothetical protein [Photorhabdus luminescens subsp. laumondii TTO1] gi|36785693|emb|CAE14654.1
MKKSLVAVGVIVALGAVWTGASWYTGKQIEGRLNNIIKTVNTQLAKSFPESAIELQTKDFQRGVFSSDVRLILKIKDGVKNADIKPNEEIIFKSSIGHGPLPISDLKKFNLVPKMASIHSELEQSKVTKTLFEATKGKSLLTMETKIGYSSSLSTNIDFIPVDYTAKNGNKLVFSGAKIDAEIARDLSNFKFNVNSDRLIFSSPSKHEELTLKGVGFKGDNKKGKFDLYLGDQNYNIDEITLSSTSDDSFSLKGMKITSKVGETDKNLNLNVSYGIDGLKLKNMDLGSGQLVIGMNNLDGQSIRKFSQAYNDATAKSLTSEALSTDSVSNKVIENAHLLFNNSPQFSLEPMTWKNSKGESSVNFKLALKNIPENKDSLISMGPEEMIRTLLQELSLDVKIPKPMLIESITQAKILDGKTKEAAEAEATQEVQMIASQGVSFKILTDDNNVIGLKLHYASDKVELNDKKSDLHQFLLDNHLIGS

SEQ ID NO: 8038 - protein, 48 aa, Xenorhabdus bovienii
  Peptide sequence Name=Xb4151_4152.C435.gene114.pep
VEIPSFLCIQHYGSMRSVFNIDMGLNSLIRYFSNFPITMNSQVFFYSR

SEQ ID NO: 8039 - protein, 392 aa, Xenorhabdus bovienii
  Peptide sequence Name=Xb4151_4152.C435.gene115.pep
  Gene classification: Gene name=ManA; Function=Phosphomannose isomerase; Function class=G Carbohydrate transport and metabolism
  Homolog annotation: Query=1..392bp; Hit=1..389bp; Blast score=460; Percent Identity=57.0; E value=1e-129; Homolog= ZmanA COG1482
MLKMTNQIQHYDWGSKTALTDIYGIKNPNNQPMAELWMGAHPKCSSQVTDPETGEIIALNALIAQEPGKYLGEKVFEQFQRLPFLFKVLCAAQPLSIQVHPDKSSAETGFDRENAAGIPLNSPQRNYKDDNHKPELVYALTPFKAMNAFRPLSDIAQLLGHVSAAHPDIQAFIHNPTESHLSFLFSQLLTMQGEQKRLAIAVLKSVLNNREGEPWDTIRKVAAFYPDDNGLFTPLLLNIVELKPGQAMFLYARTPHAYLEGVALEVMANSDNVLRAGLTSKHIDVAELMANLDFVSKPADTLLTLPKQEKDALNYPVPVNDFYFSVYNVSEQPITLENDSASVLFCFEGQIIISSDEQQQQLRLFSGESVFLSAIEKNLTVHGNGKIAKVSN

SEQ ID NO: 8040 - protein, 59 aa, Xenorhabdus bovienii
  Peptide sequence Name=Xb4151_4152.C435.gene116.pep
MRVAAITISLAHRIIEYAGSKFADKLVGILLSCHKVIIHNATQSCLLYCCHINKFSFLL

SEQ ID NO: 8041 - protein, 487 aa, Xenorhabdus bovienii
  Peptide sequence Name=Xb4151_4152.C435.gene117.pep
  Gene classification: Gene name=FumC; Function=Fumarase; Function class=C Energy production and conversion
  Homolog annotation: Query=24..487bp; Hit=1..464bp; Blast score=758; Percent Identity=82.0; E value=0; Homolog= ZfumC COG0114
MPTNLSANFDPAYSIILCAKEIVMAATRIEKDSMGPIEVPADQLWGAQTQRSLEHFRISQEKMPVALIHALALTKQAAASVNMDLGLLPKERSDAIIAAAKEVLEGKHPTEFPLAIWQTGSGTQSNMNMNEVLANRGSEILGGQRGNERLIHPNDDVNKSQSSNDVFPTAMHVAAVIGLSEQLLPELKTLQKTLADKAAAFKDIVKIGRTHLQDATPLTLGQEVSGWAAMLTHNLKHIEDSIPHVCELALGGTAVGTGLNTHPEYAVRVAKKISELSGQPFVTSPNKFEALATCDALVHSHGALKGLAASLMKIANDVRWLASGPRCGIGEISIPENEPGSSIMPGKVNPTQCEAMTMLCAQVMGNDVAINIGGASGNFELNVFRPMVIDNFLQSIRLLADGMRSFNDHCAVGIEPNHDRITQLLNESLMLVTALNTHIGYDKAAEIAKKAHKDGLTLKQSAMQLGYLTDAEFDAWVRPEDMVGSMK

SEQ ID NO: 8042 - protein, 308 aa, Xenorhabdus bovienii
  Peptide sequence Name=Xb4151_4152.C435.gene118.pep
  Homolog annotation: Query=1..308bp; Hit=1..308bp; Blast score=442; Percent Identity=73.0; E value=1e-123; Homolog= Pa|Phot5-550b01.q1k _g8| 3843 - 4769 396 308 aa, chain -
MNKYFSIESLTSSFKKQEEKLAELVRLLMDYPLIDARVFELPQIEKGEEHEQITEIAVNPLQGNNALNLGLHFYQKLFIHHNHPNISSKAASRLPGALCFSVSHQQYKTAMSVINEVNQLKAELENIVTKESGVNKEQRFEFVHDHLRGLITLNAYRTITPLVNPDSINFGWANKNIINKITKQQVLEQLEKSYNSGRAVPPYSSDQWAALVALEITDIKKLSDDVILKIKRPVKVQPITRVWYSELQKQVQYACPLPIIAFYTDDCEIKPKIGTLSNYNANAIKHRYKPKAKPLELVIPRLHLYREI

SEQ ID NO: 8043 - protein, 301 aa, Xenorhabdus bovienii
  Peptide sequence Name=Xb4151_4152.C435.gene119.pep
  Homolog annotation: Query=91..296bp; Hit=15..219bp; Blast score=84; Percent Identity=29.0; E value=2e-15; Homolog= gi|15800101|ref|NP _286113.1| orf, hypothetical protein [Escherichia coli O157:H7 EDL933] gi|15829679|ref|NP_308452.1| hypothe
MWRLQTIFSYNIHISITTKGADLQQNIQKSLINNKKKNVCCETFHCCDKNQKGITDFLKSLNKYSCNTYKKNCSLYIVDKVGANTAPGLFKMKKLVKPVNSFEKVVDTLLPYSELIASDLPTQGKLLRVENEFAKLFLLQQGYVNIRRVDDGLIIATVFSPYIIGLSFYSGSDVYYSIELGPHCRLYQLPRINAFNAIKKHDLYREWMRIISYKMAFLYARDVSIFRPGAKEVVCSLLSRLITLPAEFHENTSVIKYIEQRCTLSRSCIQRVLSSLKRENYIEMVDGHLVKINSLPIHSYY

SEQ ID NO: 8044 - protein, 422 aa, Xenorhabdus bovienii
  Peptide sequence Name=Xb4151_4152.C435.gene120.pep
  Gene classification: Gene name=ProP; Function=77 Permeases of the major facilitator superfamily; Function class=G Carbohydrate transport and metabolism
  Homolog annotation: Query=24..419bp; Hit=18..413bp; Blast score=462; Percent Identity=63.0; E value=1e-130; Homolog= ynfM COG0477
VNTAPSVSEESAVPDVESDVKINQRREKEQRYIQRDDAVYLRVTLSFFAVGLATFALLYFVQPILPILSEEFNVSPASSSLALSLSTGMLSLGLLITGPLSDALGRKNVMVMSLATAAIFTLLSTVVTSWNGLLVVRALIGLSLSGVAAVAMTYLSEEIHPSYVALSIGLYVSGNSLGGMSGRLITGVIADYFPWRFAVILLGSFALISAIAFWKMLPPSKNFRSSSLKPKTLFINLKLHFRDQGLPLLFAEAFLLMGCFVTMFNYIGYRLLGAPYHYNQTIIGLLSIVYLTGTYSATKAGILTNKYGRGKVLLVAISMMLIGGFITICSSIWTVMLGMMVLTTGFFAAHSVASGWVGWRAKRAKAQASSLYLFCYYAGSSVAGTLGGVFWLYFQWNGVAIFMSLLTTIALYLGLKLKKLEK

SEQ ID NO: 8045 - protein, 305 aa, Xenorhabdus bovienii
  Peptide sequence Name=Xb4151_4152.C435.gene121.pep
  Gene classification: Gene name=LysR; Function=Transcriptional regulator; Function class=K Transcription
  Homolog annotation: Query=3..288bp; Hit=1..284bp; Blast score=295; Percent Identity=54.0; E value=5e-80; Homolog= ynfL COG0583
MSINIELRHLRYFIAVAEELHFGRAAERLNISQPPLSQQIHALETRIKAQLLARNNRNVSLTPAGNMFLKEAYQILTQVDAAATKAARMQQGELGEISIGFTSTTPFMRKVTLSLRQFREHYSDVAIHMHQMNTKQQIAPLQTGRIDIGIMRNTLLPDSLEHRLLFSERFMLAVYDGHPLLNYADEGISLEMLSGYPLVFFERDVGTALYDEIISLLANAGVTPMISQEAGEAMTILGLVAAGLGISIITESFTRMKIDGVQYLHLANAPACSEVWLVNHKNRQNSAAVDRLTNLLISNIVDEIC

SEQ ID NO: 8046 - protein, 406 aa, Xenorhabdus bovienii
  Peptide sequence Name=Xb4151_4152.C435.gene122.pep
  Gene classification: Gene name=NagC; Function=Transcriptional regulators; Function class=K Transcription
  Homolog annotation: Query=6..406bp; Hit=6..406bp; Blast score=458; Percent Identity=55.0; E value=1e-129; Homolog= Zmlc COG1940
VSVDIQPRHIDQIKQTNIGLVYRLIDQYGPISRIALSKKSQLAPASITKITRELIDAHLIKEAEFPDLSFRGRPAVGLKIDSKGWQFLCIRINKGSVVFGLRDLSNNLRIEEERPFSFSLNQSFLDCIVDEIDDFFFRHQSCLERLTAISITTNAIIDPNSGIIHSSPYYDIQNIPLGTFLHQRTGLPTFLQHSITAWTIAESLYGAGENCQNIIQIVIDDNVGAGVITAGQMLHAGNHSVVEIGHTQVDPDGERCYCGNTGCLETVVGIKNILVKVHRLAENHPDSLLYSISPLTIDSLCQAANQGDLLATNIIHDVGERIGRIMAIMVNIFNPEKILIGSPLNGAQNILYPAIQQQIAQLSLPGYSQQVNIVATQFDNTGTLPAASLIKQSLYSGELLIELMQG

SEQ ID NO: 8047 - protein, 222 aa, Xenorhabdus bovienii
  Peptide sequence Name=Xb4151_4152.C435.gene123.pep
  Gene classification: Gene name=BioD; Function=Dethiobiotin synthetase; Function class=H Coenzyme metabolism
  Homolog annotation: Query=1..217bp; Hit=5..224bp; Blast score=255; Percent Identity=54.0; E value=2e-68; Homolog= ynfK COG0132
MLTRLFVTGTDTNIGKTVVTRALLQVFNREGTTAVGYKPIATEKQETPEGIRNHDALVIHKSSPVQVSYEEINPIIWESNYEEGNQINFVQMTKSLKNLSQKADRVIIEGNGGWRLLLQDDSFYSDWVVQEKLPVILVVGIQAGCVSHAILTAQSIINDGVPLIGWIANRINPGLAHYAKTLDRLRYHIPAPQLGEIPYLLRPEERDLSCYLDVSAIFKFDN

SEQ ID NO: 8048 - protein, 131 aa, Xenorhabdus bovienii
  Peptide sequence Name=Xb4151_4152.C435.gene124.pep
  Homolog annotation: Query=34..113bp; Hit=4..83bp; Blast score=87; Percent Identity=55.0; E value=4e-17; Homolog= Pa|Phot5-550b01.q1k _g25| 19991 - 20272 212 93 aa, chain -
LGTQYKTLSGSQYRSSDQTLIDQTPTSINKEMMVKKILLTGALFFALAPFAVQASQKTTCESLREIISQKIIDNHVSKEDFRLEVVPNDQVVEGSGKVVGSCDYGKQKIVYIRLSHTTGSHATSDAKEAQK

SEQ ID NO: 8049 - protein, 139 aa, Xenorhabdus bovienii
  Peptide sequence Name=Xb4151_4152.C435.gene125.pep
MLSFVRLVLQREQAQKTRHQSVGSFSPSSPYLLMSVFGLSRFDRKTCIEIQTTFCIGFPISIHVGTFQTGISIINVHLILIKLFFFTFVNFFAKASLFIPFFFLLTSHFFAHRILTAPINGYASTTRCTRRRKCWSLPQ

SEQ ID NO: 8050 - protein, 70 aa, Xenorhabdus bovienii
  Peptide sequence Name=Xb4151_4152.C435.gene126.pep
LLIEFSPPPLMVTQVLLDVQGAENAGVCHNNGNNRATAETVLAIKELWTFIFKPLSQNYQLKLPQNNSVF

SEQ ID NO: 8051 - protein, 251 aa, Xenorhabdus bovienii
  Peptide sequence Name=Xb4151_4152.C435.gene127.pep
  Gene classification: Gene name=DltE (BS); Function=Short-chain dehydrogenases of various substrate specificities; Function class=R General function prediction only
  Homolog annotation: Query=3..249bp; Hit=1..247bp; Blast score=366; Percent Identity=72.0; E value=1e-101; Homolog= ydfG COG0300
MTMIVFVTGATSGFGEAIVRRFIKHGSVVIATGRRQDRLDRLKTELGENFHPIQLDVRDRNAIEKVVQELPDVLRNVDVLVNNAGLALGLEPAHKANPDDWETMIDTNTKGLVNMTRALLPNMVQINHGHVINIGSTAANWPYAGGNVYGATKAFVKQFSLGLRADLQGKNIRVTDIEPGLVGGTEFSQVRFKGNDEKVSKTYDGAEALTPDDIAEAVFWVATLPSRVNINTLEMMPVCQSFAGLSVHRNS

SEQ ID NO: 8052 - protein, 31 aa, Xenorhabdus bovienii
  Peptide sequence Name=Xb4151_4152.C435.gene128.pep
MTKILKLCNYRGITIMPLKLYIGSHNLYYVK

SEQ ID NO: 8053 - protein, 311 aa, Xenorhabdus bovienii
  Peptide sequence Name=Xb4151_4152.C435.gene129.pep
  Homolog annotation: Query=48..208bp; Hit=1..165bp; Blast score=86; Percent Identity=35.0; E value=5e-16; Homolog= gi|18309658|ref|NP _561592.1| hypothetical protein [Clostridium perfringens] gi|18144335|dbj|BAB80382.1| hypothetical protein [
LDSRRHAIRPSHQLRSEIIHLIRRKLSLFIRGIFPIADFNIFLGFFVMPWTFSHPAAVFPLKSFPGGRLLNLPALITGSLSPDFFYSVGLYDVATVAHHLPGWFYTAFPLCLLIFLIVRLLSYPLSVLFPISFARYEKPDYKDRVAFVLSLFIGAVTHIGWDAFTHDKGFFVELIPLLQFRVFHSITNGQGISIYKILQHLSSLLGLLYLTMKYWRYQKKLDLSVQKMNKRKLYHLIGIGFISGFLTCPLALFLSWEVSGINMSRFIFKELTLSVPVFFIILVFISLWIRYYFSKIKPVQSKSIGIPIDNT

SEQ ID NO: 8054 - protein, 64 aa, Xenorhabdus bovienii
  Peptide sequence Name=Xb4151_4152.C435.gene130.pep
MIVFTHISVNPVVKVSRQEDGKNSGSYSHTYRFLFVVLIQLHNFWTADVMQYVHLISSGLRSYI

SEQ ID NO: 8055 - protein, 316 aa, Xenorhabdus bovienii
  Peptide sequence Name=Xb4151_4152.C435.gene131.pep
  Gene classification: Gene name=LysR; Function=Transcriptional regulator; Function class=K Transcription
  Homolog annotation: Query=9..290bp; Hit=8..289bp; Blast score=244; Percent Identity=44.0; E value=7e-65; Homolog= mlr2579 COG0583
MRKNDHFSGIIAFVMTAQLGSFTAAAERLGLTKSAVGKSLNRLEERLGLKLFQRSTRSLSLTPEGDIFLQSCQNAIAILEQAEAGIASHITSPIGRLRIDLPAAFGRQRILPILLNITKEYPELTLSVSFSERFVDVIEDGIDLVIRIGELADSSGLIARRLTTQKLVICATPDYLQRRGIPTSSDELNQHHCIVGFRRHQPFHWCLRITNSNNKNITPPPTYELADGDAMLTAVLAGCGLAQLPLWMVNRYLKSGELKTVLPEYSGAEVPISAIWPKNRHLLPKIRYVMLSILLLQQQKKVYWMNNNELLNNRFI

SEQ ID NO: 8056 - protein, 174 aa, Xenorhabdus bovienii
  Peptide sequence Name=Xb4151_4152.C435.gene132.pep
  Gene classification: Gene name=AraJ; Function=Arabinose efflux permease; Function class=G Carbohydrate transport and metabolism
  Homolog annotation: Query=2..162bp; Hit=237..397bp; Blast score=69; Percent Identity=26.0; E value=2e-12; Homolog= PA2219 COG2814
MFSSFSYISDYLTKVTYLSNSMIAIFLILFGASGYMGNFIFSRLLQKNTVRTTYAYTFLFILVYLLVWLLGFSPFVMVLLIIFWGIFHSSGLIVSQTWLMHEASEAPEFANSLYIAFSNLGITLGAMAGGFVISHYGVHSIVLTGILFLIFSFFSIYIKNRATVANQTSDKTII

SEQ ID NO: 8057 - protein, 227 aa, Xenorhabdus bovienii
  Peptide sequence Name=Xb4151_4152.C435.gene133.pep
  Gene classification: Gene name=AraJ; Function=Arabinose efflux permease; Function class=G Carbohydrate transport and metabolism
  Homolog annotation: Query=9..226bp; Hit=5..222bp; Blast score=123; Percent Identity=32.0; E value=2e-28; Homolog= PA4355 COG2814
MTNKSFFLLMTLTIAVFGVITTEVSVIGLLPQLERQLNITPIQVGYLVSVYAIVVAIAGPVITLLLLRYNRKYVLLCILFIFIASNIIYATENTFNIILIFRILPALTHALFFSIALVIAANSVPKEKSADAVATVFSGVALGMVLGMPLSSFIAEYISLSAAFYFGSVTCLIAFIGVVYFIPSLPVNQQINILEQVTVLKKTKLWISIATVTFIFSAMFSSFSYVF

SEQ ID NO: 8058 - protein, 40 aa, Xenorhabdus bovienii
  Peptide sequence Name=Xb4151_4152.C435.gene134.pep
VRLKCTRICRLTVIQMKVSPNIGTITGLTDNFFSTNSRRK

SEQ ID NO: 8059 - protein, 43 aa, Xenorhabdus bovienii
  Peptide sequence Name=Xb4151_4152.C435.gene135.pep
LNYCQSTNTSTFQPHLRLSLPLKALEAADLQQLAELLNELELV

SEQ ID NO: 8060 - protein, 144 aa, Xenorhabdus bovienii
  Peptide sequence Name=Xb4151_4152.C435.gene136.pep
  Gene classification: Gene name=WecD; Function=Histone acetyltransferase HPA2 and related acetyltransferases; Function class=K Transcription
  Homolog annotation: Query=1..142bp; Hit=1..140bp; Blast score=132; Percent Identity=48.0; E value=2e-31; Homolog= VCA0382 COG0454
MEITVFFPEYIEALRILYLESRKVTFTWLNTDNYQLTDFDKDTEGEMIYIAVENGKILGFISVWAQNHFIHHLYVSTEYHRCGIGTQLLDFVKSKYPHQLSLKCLVKNHKAINFYEFNGFIKKAKSSDGLAGNYYLMVFSDQKS

SEQ ID NO: 8061 - protein, 139 aa, Xenorhabdus bovienii
  Peptide sequence Name=Xb4151_4152.C435.gene137.pep
  Homolog annotation: Query=11..138bp; Hit=6..133bp; Blast score=116; Percent Identity=45.0; E value=7e-26; Homolog= gi|16767436|ref|NP _463051.1| putative cytoplasmic protein [Salmonella typhimurium LT2] gi|16422741|gb|AAL23010.1| putative cy
MKIHQLMEVIENKYPAAESWVFGDSIEMYDKLSALVAKGTKTATSCSYHAYKQVNEEIEIGNEYIVLNGKNLPVCVVRVTAVHLTQFSAMTTELAWKEGEGDRSLHRWRMEHKCSFEREGTFSPDMEVVVIEFGVIEVL

SEQ ID NO: 8062 - protein, 53 aa, Xenorhabdus bovienii
  Peptide sequence Name=Xb4151_4152.C435.gene138.pep
MLLLTTTSNQLYDLPLILSIEKYERCFSPLISQILLSKTVDHQPTRIQFTQPH

SEQ ID NO: 8063 - protein, 36 aa, Xenorhabdus bovienii
  Peptide sequence Name=Xb4151_4152.C435.gene139.pep
LITNQLVSSSHNPINRQKCFNKTGRNAVRLTPNRGN

SEQ ID NO: 8064 - protein, 143 aa, Xenorhabdus bovienii
  Peptide sequence Name=Xb4151_4152.C435.gene140.pep
  Homolog annotation: Query=5..141bp; Hit=6..162bp; Blast score=77; Percent Identity=34.0; E value=3e-14; Homolog= gi|37527393|ref|NP _930737.1| hypothetical protein [Photorhabdus luminescens subsp. laumondii TTO1] gi|36786827|emb|CAE15893.1|
LLSLFRLSQRRIPALIASLAILMLFIGPVVSKTLEHRRDSIKSEAHHNMPMSGMQNSNNHHYASSVNGHDMHHGASHTHTGLMDDIACGYCQLLINLPLLTWVFIPFIWLALTISRTPPVRFFLGSAIQLFYGESQPRAPPLN

SEQ ID NO: 8065 - protein, 682 aa, Xenorhabdus bovienii
  Peptide sequence Name=Xb4151_4152.C435.gene141.pep
  Gene classification: Gene name=CirA; Function=Outer membrane receptor proteins, mostly Fe transport; Function class=P Inorganic ion transport and metabolism
  Homolog annotation: Query=14..682bp; Hit=39..723bp; Blast score=760; Percent Identity=55.0; E value=0; Homolog= PA3790 COG1629
MSTTQLFRVSPLTAALAVILFMPASSLAATGEDNNDKEIKDTQTVNDRESVIIVTAPAISPLTIATSPKTPRQPVPASDGSDYLKTIPGFSQIRNGGTNGDPVFRGMFGSRLRMLVDDGEILGSCPSRMDAPSSYISPESYDVLSLVKGPQTVLWGAGNSAGTVRFERTRPQFDKLGAQGNISTVAASNGRWDGNADLSFGNELGYVRLSGNKSRSNDYKDGDSNRVPSRWDKWNTDIAVGWTPDDDTLLELTAGQGDGKARYAGRSMDGSKFKRESFGVRFEKSNISDVFDKFETNFYYNYTNHIMDNYSLRTPSPMSMGGHGSHGGGKHGGHGMGAMELDRRTMGGRMMGTWIWEDFKLQSGVDTQSNTHRNKYDTVWVKDARYRNYGIFSELTWDATEQSKAIGGARLDRVLVDNYVKAAERTATLPSGFIRLEHNLTEVPLMFYAGVGYTERFPDYWELFSSKSGNNVFRDLKTEKTTQLDIGAQYHGQYFSGWVSAYVGKVNDFILFRYSPTDRTKNKANNVDATIMGGEMGASYQLSDHWKTDASLAYSWAKNTSDHRPLPQTPPLEARFGLTWEHGDWTSSGLLRVVSSQNRVSINEGNVVGKDFDRSAGFAILSANTTYKVTKNVQVSAGIDNIFDRTYSEHLNLAGSNNFGYSGNTPVNEPGRTYWARVNVKF

SEQ ID NO: 8066 - protein, 163 aa, Xenorhabdus bovienii
  Peptide sequence Name=Xb4151_4152.C435.gene142.pep
  Gene classification: Gene name=MarR; Function=Transcriptional regulators; Function class=K Transcription
  Homolog annotation: Query=4..152bp; Hit=5..156bp; Blast score=122; Percent Identity=45.0; E value=1e-28; Homolog= mlr3448 COG1846
MKYDHVDRLLIQWEQQRPDLDPSPMGVIGRLVRVNKIIEQRLQHAFKAHGLSAIEFDILATLRRYNTPITPTEMYQSVMLTSGAMSTRIEHMVQRGLIERIANEEDRRSCKVFLTPEGKTLIDNAVESHLENERAILQPLTEEEQEQITILLRHWLLTNESAT

SEQ ID NO: 8067 - protein, 37 aa, Xenorhabdus bovienii
  Peptide sequence Name=Xb4151_4152.C435.gene143.pep
VIVLHSFSLLIYSNKKILDKNRLGYYFNLPLNKDTLY

SEQ ID NO: 8068 - protein, 295 aa, Xenorhabdus bovienii
  Peptide sequence Name=Xb4151_4152.C435.gene144.pep
  Gene classification: Gene name=RhaT; Function=7 Permeases of the drug/metabolite transporter (DMT) superfamily; Function class=G Carbohydrate transport and metabolism
  Homolog annotation: Query=3..286bp; Hit=4..311bp; Blast score=78; Percent Identity=29.0; E value=7e-15; Homolog= sll0355 COG0697
MQETRIHSNILLTALAPIVWGSTYIVATEIIPPNMPLLASTVRALPAGILLLLICRTVPKGMWWLRLTVLGLLNIGAFFYFLFVAAGYLPGGMASLIMSCQPVIVIFLSAYLLRTSLTRKHFFSAILGLIGITLLVMNSATSLNWQGIIAGFAGCSCMALGIVLTKYWNRPVNLSLLSFTGWQLTLGGLMLLPIAIYTEGVPQQLTPTNIIGYGYLCLIGAVLAYIIWFRGIEKLPVVSISFLGFLSPLSACVLGFVFLKQTFSLLQFFGACTIIVSVWLSIPRNQTQKSNNSTI

SEQ ID NO: 8069 - protein, 198 aa, Xenorhabdus bovienii
  Peptide sequence Name=Xb4151_4152.C435.gene145.pep
  Gene classification: Function=Predicted flavoprotein; Function class =R General function prediction only
  Homolog annotation: Query=2..148bp; Hit=3..144bp; Blast score=58; Percent Identity=29.0; E value=4e-09; Homolog= BH2050 COG0431
MKLTLISGSQRPDSRSQRVASYLQELSREYGFTDIYLLDLSNVELPFHDGYTTDISAESHPWQAFAPNLRESDAFIFITPEWHGMATPALKNFLLYCSVTELGHKPALLASVSASMNGVYPLSELRMTGFKNNHVCFLPDHLIFRQSEDLISTDLACGNAEFEARAKYTLKLLKAYAEALKQVREVIGEESKNYPYGM

SEQ ID NO: 8070 - protein, 35 aa, Xenorhabdus bovienii
  Peptide sequence Name=Xb4151_4152.C435.gene146.pep
MAIFKSKKVCFLNKNAKNTVYCVFIQLLCFSASKT

SEQ ID NO: 8071 - protein, 230 aa, Xenorhabdus bovienii
  Peptide sequence Name=Xb4151_4152.C435.gene147.pep
  Homolog annotation: Query=2..204bp; Hit=3..206bp; Blast score=89; Percent Identity=27.0; E value=5e-17; Homolog= gi|27479673|gb|AAO17200.1| Orf34 [Photorhabdus luminescens]
MSQWKEKDIFKLFSQYDNILEEQYGFTAISNFIKQHRSINKVLDLGCGSGELIPFLTSIASQVVGADISEHALENAREKHKNSGATFIYASELPNYINNNSKFDAVISSFLLCTLNTEDSIKLLLRQVNDALIEHGYYIVFSFNLNAIGVDFGTFKTGEEGKIYHDGEALPVSMRTKSGEQFTFNDTFWSFSKLITLSEEMGFSLYQQSILTIPQFTISPFTIFVLKKKN

SEQ ID NO: 8072 - protein, 1016 aa, Xenorhabdus bovienii
  Peptide sequence Name=Xb4151_4152.C435.gene148.pep
  Gene classification: Gene name=AprE (BS); Function=Subtilisin-like serine proteases; Function class=O Posttranslational modification, protein turnover, chaperones
  Homolog annotation: Query=28..572bp; Hit=28..556bp; Blast score=202; Percent Identity=31.0; E value=1e-51; Homolog= PA3535_1 COG1404
MKKNNQLRPIFLGITLLFWQLPTGSVIAATEYHEQGKKGVPDSWLSDEFKNQWGLASIGAHYAYARGYTGKGINVGVLDQSVTNHSEFADKLKIIAPSDIWSYSYDPYSDLISFGAHGNHVSGTIAANRDGKEMHGVAFDAGLVTAKFLQNDYNRTEAMIQSDARIINNSWGVRPRYFVGRDGKPIRWPDGTIAYYPVTLKQLINYVSPIKEKLNELSRSPLPVTGEPLASDAGMLRAARQGKLMVFAAGNANNYNVTWLHAGMPYFFPDALKNYLSVTNLKENDVIAPSSTSCGYTASYCLAAPGTKIYSSTGDFVSKSGGKIDEDALKKGELEIDPTYDSYTGTSMAAPHVAGAAAVLMQRFPYMTAAQIADVIKTTATDLGTPGLDDLYGWGKLNLKDAINGPKMFITKQDIPAKYYIEGSYTETQFIANIAGIGSLIEPGTTVQRVCNSIECAYDYWSNDISGHGGLTKTGSGALLLTGASTYSGPTWVNQGLLLVNGSITSDVTVQRDATLSGKGTIGSLTAYNGANVAPGNTDAALNVDREVIFETGSRYQVTLMLDGNSDRILSNDMAGLEGGEVQVTLENRGNLLSQQKVHSLLGQQYNILQARNGIYGQFDTVSQGHLFLDIPLNYQSDRALLDIKRNTTEFASLATTANGRSVAKAADMLNSDHPVHESILMVNSAAQASQAFSQLSGQVHADIAAAQINSSRYLRDTLNTRLRQANGGATSQEIKADTDGAWVQIMGNWQRASGNNEVSGYRMSNYGVLLGVDKDLSSDWRLGVATGYTRSSLHGGDNASARSDNYHLALYGSKQIDALALRAGVAYSWHRFDTERSVAFGDQSDDLKAKYGARTGQLFTEAGYGIKTSWLNLEPFANLTYVNFHSNRINEQGGAAALHGDKKSQNATFSTLGLRADQKWKIERESQRELHVGVYGELGWQHRFGNINRGTKLGFSNSNTMFTVNSVSAGRDAAVVKAGTELDIGKNTTLALGYNGVLSGSHKDNGVFLNANWRF

SEQ ID NO: 8073 - protein, 173 aa, Xenorhabdus bovienii
  Peptide sequence Name=Xb4151_4152.C435.gene149.pep
  Homolog annotation: Query=10..172bp; Hit=5..167bp; Blast score=189; Percent Identity=68.0; E value=2e-47; Homolog= gi|37527226|ref|NP _930570.1| hypothetical protein [Photorhabdus luminescens subsp. laumondii TTO1] gi|36786660|emb|CAE15724.1
MSDNMPQYITIIKDTPIWVWILLVFLVIRGIKALSSREMSIWRIFLLPSVFLVWGIHSVLTETYFSNLSLVMMGIGLIFGTTIGWILWRSQPRLRKKTHSNLIIRPGTPLTLIVIIITFVSKFIMTALLSIYPILLHSLHYNLFFGLLSGLLDGIFCGGTLNLFISWCKNKSS

SEQ ID NO: 8074 - protein, 425 aa, Xenorhabdus bovienii
  Peptide sequence Name=Xb4151_4152.C435.gene150.pep
  Gene classification: Gene name=AraJ; Function=Arabinose efflux permease; Function class=G Carbohydrate transport and metabolism
  Homolog annotation: Query=35..418bp; Hit=10..386bp; Blast score=274; Percent Identity=49.0; E value=1e-73; Homolog= PA5548 COG2814
MIPFYPSPTQLSNVVTVTFISPRLYIFPIFIKGGQSMPPRFILSVLALAVFFIGTTEFMLSPMLKPLAGVFKTTLDNVAWLVSGYAFSYALAAPFFGWLSDRVNRRRLLLISLLFLMFDGLALTFAQNLSTAIGLRIFGGIASAALIPTTFALIAELFPLQKQASAMGLVMLGMTAGIAGGPIFAGILTELFDWRAPFLVNAAGCLLVFVLGRTCIPIQAPVERIKHQMVTFKSMFQWVRQKNLMIFLIAKGFWNGTAVSALILAGEVLRKHYEIGTGTIGISISTFGIGLGLGNLSVGMVKRLGLRDELILLLAIVLLSSATTAFMLMPLSLPFSLSCLIVWGSALGLAAPISTVILANRAKQHKGQVLAVSESLNNLMILLLFPIAAMLMTHHGIAVTMLMLGFILIISIVLTIRDLLSDTVT

SEQ ID NO: 8075 - protein, 347 aa, Xenorhabdus bovienii
  Peptide sequence Name=Xb4151_4152.C435.gene151.pep
MFTTNPKYLAGKLRRLEMYIEKGQENRIKRLVRQSNAEYTKGHELKPAKPMLIRAGIAGGLPFNSLTTDVVVGCLPESMACYGMCFAAISSWENGIDFGKRVDNQLDETVFVTDLNALPHSQKYVRCGWNSDPSWNWSVSTRMAELAREAGLLMIFITKAFRKMPDDIIQRLVAAKAEVRVSVSALDTNEQLRLRLGVIEHYRRAGGIVIPIVLTTFFKDIVLMERQNNIVEWMVENDYPAAENSLRFPHNAKVSELVDPHNVRPLEKGDEFWSGRLYPEKLSFPTTTTIPDSYQGIDTGYLSDLQLDEINKLFIDPVKTHQEIMQSKLPLSSPKMCGVSDTRRLTE

SEQ ID NO: 8076 - protein, 257 aa, Xenorhabdus bovienii
  Peptide sequence Name=Xb4151_4152.C435.gene152.pep
  Homolog annotation: Query=17..223bp; Hit=61..278bp; Blast score=77; Percent Identity=25.0; E value=2e-13; Homolog= gi|22988776|ref|ZP _00033837.1| COG2175: Probable taurine catabolism dioxygenase [Burkholderia fungorum]
MKNQASSMTTGISVYGLLVFNNQKMDDDALVNFALRVGDGRLEEPARKISLTDNRKHIAYLTNLCDEKGEKLGFSGNNTDFWHSDQEFRINPASVSILYGESVKCQGGNTSFASTSAAHLGYSIDEISTLNTLWSTRQPAVSHDNVPHITVAHPVIIENKQTKKQYVYISENAIKFLDNDQPLPHSEALKQAILEKILSSDNIYSHQWVDGDLLLYDNSQLLHRRECFTGDRFIKALKIYPDVHYQSEIPGREIKEA

SEQ ID NO: 8077 - protein, 349 aa, Xenorhabdus bovienii; identical to SEQ ID NO: 5796
  Peptide sequence Name=Xb4151_4152.C435.gene153.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 8078 - protein, 54 aa, Xenorhabdus bovienii
  Peptide sequence Name=Xb4151_4152.C435.gene154.pep
MGALKTPPLTVAIHERGNFIPIHWLKNLDYLITSDNKLYHASFNTLTALNLNFS

SEQ ID NO: 8079 - protein, 31 aa, Xenorhabdus bovienii
  Peptide sequence Name=Xb4151_4152.C435.gene155.pep
MISILIYNLFISLKMVFNGGSKNSPTDSSDT

SEQ ID NO: 8080 - protein, 272 aa, Xenorhabdus bovienii
  Peptide sequence Name=Xb4151_4152.C435.gene156.pep
  Gene classification: Gene name=MhpC; Function=Predicted hydrolases or acyltransferases (alpha/beta hydrolase superfamily); Function class=R General function prediction only
  Homolog annotation: Query=22..270bp; Hit=59..302bp; Blast score=80; Percent Identity=28.0; E value=1e-15; Homolog= DR0791 COG0596
MVATHDDIQTRYANISVLDTGGSGLPVLLIHGNSSCKEIFRHQIEYLKGDYRVLALDLPGHGKSSDASDPREAYSMPGYARTIMEVLDKMDIDKVVVFGWSLGGHIGLEMLALNPKMIGLMICGTPPVAVGKENIARGFCQSKQMRLTGKAEFTDEDVRNFACETNGVNAPHEPFMIEAVARTDGLARQYMFEAFISPQATDQKLLAETSEVPLAIVNGVGDPFINHDYINGLNYRNLWQGQVFNLSGVDHAPFWEAPDIFNPILAEFLKDL

SEQ ID NO: 8081 - protein, 103 aa, Xenorhabdus bovienii
  Peptide sequence Name=Xb4151_4152.C435.gene157.pep
  Homolog annotation: Query=1..103bp; Hit=234..336bp; Blast score=168; Percent Identity=81.0; E value=2e-41; Homolog= gi|37527658|ref|NP _931002.1| hypothetical protein [Photorhabdus luminescens subsp. laumondii TTO1] gi|36787093|emb|CAE16168.
MQIRAALPEQLQQQWPSIQSVIEVVSKRSVKDQPSCRDSRWYVSSLPLDAEIAAKTIRRHWSVENKLHWVLDVTFREDALSLKDPDGAAQMVLFNRMALNVIK

SEQ ID NO: 8082 - protein, 87 aa, Xenorhabdus bovienii
  Peptide sequence Name=Xb4151_4152.C435.gene158.pep
  Homolog annotation: Query=1..30bp; Hit=167..196bp; Blast score=63; Percent Identity=93.0; E value=6e-10; Homolog= gi|37527658|ref|NP _931002.1| hypothetical protein [Photorhabdus luminescens subsp. laumondii TTO1] gi|36787093|emb|CAE16168.1|
MDALHCQKETLGLINQRGGDFIVGLKGNQKNSMSLLNRILLHLMTTINGLNLQRKIAVMDGKNSVMSCKSVLHYLSNFSNSGLQYKV

SEQ ID NO: 8083 - protein, 39 aa, Xenorhabdus bovienii
  Peptide sequence Name=Xb4151_4152.C435.gene159.pep
MVTSAPSRASHLINCLATEPSLPLLSAAQWSRATPDSTS

SEQ ID NO: 8084 - protein, 41 aa, Xenorhabdus bovienii
  Peptide sequence Name=Xb4151_4152.C435.gene160.pep
MILDIYRYRYRYTNGLSQSIGNDAMHETDYSIQSIVRTERD

SEQ ID NO: 8085 - protein, 34 aa, Xenorhabdus bovienii
  Peptide sequence Name=Xb4151_4152.C435.gene161.pep
MWNLQLKIKIKKQIKMRKFRLFSLKTIQYYSGCK

SEQ ID NO: 8086 - protein, 36 aa, Xenorhabdus bovienii
  Peptide sequence Name=Xb4151_4152.C435.gene162.pep
MLFFLYSLSIIRPILIILENVFFEHLRNKYKFIHKK

SEQ ID NO: 8087 - protein, 1792 aa, Xenorhabdus bovienii
  Peptide sequence Name=Xb4151_4152.C435.gene163.pep
  Homolog annotation: Query=14..1595bp; Hit=21..1591bp; Blast score =580; Percent Identity=30.0; E value=1e-164; Homolog= gi|20455388|sp|Q8X8V7|YEEJ_ECO57 Hypothetical protein yeeJ
MDKEYRKNSILKQGVFIRRVAWFNIVLQSFFPIAGSMVPVISARADNEIQSIPSDFDSRWHIIQKNESLEYIAKKYDSTVNEIKENNLYFVSAENDMPLTVGSKLLIPPKNKWLNSPNHQNESQIKENQFANIATQAGRFLQNNPNRDSAVELARSVATRKVNADIEQWFRQFGHARIQLNTDKNFSLKGSQFDLLFPLWDQKENLVFNQTSLHRTDNRTQANLGIGWRHFEPDYMLGSNTFFDYDLSRRHTRAGLGVEYWRDYLKLSANSYFRLSGWKDSPDFEDYQERPANGWDIRAEGYLPQYPQLGAKLAYEQYYGDQVALFGKENRQSQPHAFTAGLTYTPVPLITIGAEKRQGKSGKNDDRLNLQINYQFGVPWLQQISSDAVSRLRSLANNRYGLVDRNNHIVLEYQKKEVIWFHLDQTISGYAGEEKPLNISVSAKYGLERIDWELAELTASGGKIENDGGHYRILLPDYQYSHADPTSVAATDDHKVKNTYSVSAVAIDKKGNRSNSVHMQVIVSSAAINTANSLFSPEISELAAEGKSTQKLTLTIKDKMNQPVDVNVEEITLKIESSHKTRDSHSSQVSDFQRIAVGQYVVTVTAGTRTETLTLTPSVRNQALAATKITVKADVKTAHISENQLTIEQNSAKADGQSENRIQLVVNDEFGNPVPDYEVKFSSDDDVDIGKSAITDKNGRITMPVKSEVAGSKLINITVGEHVTQAEVIFVADSDTASIQNSDLIITPALSVADGQTKQTITAKVTDKQGNPVSNIKVIFEADNQAVIATQEVITDEQGIAQTTMTSLKSGTVMVTGTVNHNQNQTQRKTELVGHKATALIKEVKTESDLYVADGKTSVTVNAVVTDENGNPLQSVAVDWKSNRDSNSVEIHQSQSFTDENGIARTTITSKKAYEVQITASTNATSGTSTPILFKADPDNGEVTDLSQGLQHVASPGSKTEISTRITDQFGNPLPGVEVRWRTDSPDAHVTSTSITDENGKASTELEADKAGDIKVWASLSNGKEVSTEITIVADQQTAVVTLASEGNKMQAVADDQDSITLIAKVVDANQNPLKGIPVTWHSLSAKNKLRDNVSDTNDAGEARNVISGTRAGTTTIEAVLQNKGKTDLKVTFTAIKLGENNVNQDDFQINSSFKLVNQSIVADGSSKAQAILVLKDKYGNPVPGYNQKIAYSSSNNSSITFHNQQESEPGIYTVLIAGKQEGTFPIDARLGSLEFSDSLGFVANQTTAEIDTVTVLRTTALQADGLENVTIQAQVKDSNGNTALPGVYVGWQTSLGTLSSPLSPTNEKGIAEITLSSRQAGNARVTAVLGSGQKTADNPVTFIAGGVSGDKSSLEVSKSIAVTDEDIVQVKVIARDEHDNLLTGLQDKIAMRSTSDLQITDAPVFKEIEYGIYIADIKGKIAGDTQLIAEIGGTGVKQQAELTLTGNSKTAKPKDAENAIDVTSNKIIAGNSVTYSITLTDSNGNSLGKGIPVFWSADAASTLLQQMTTTDEQGVAQVTLHRDKAGTAKVTALLSSGGQYLAPAVEFTPADIDPAHSTFMADKRQIGSDAKEQAILTVKLADKFGNAISGKTVNIHLPNPLKGFVVTPTLMQDNGDGTYSASATAKNKGSQEIQAAVEGKSIGQSLTVSVGAITPDLRFANATQQVTYTKRYAHSQKVVDGGIPAGIRQMWTSSADDVATVDDSGKVTLWKAGTATITVQTGTNGQYHSSTASYTLKLRRQHLNCSIRSSRLSLFGMMAKIMPSRQVLQIRMWMLRPYCNRRISPVTIMVW

SEQ ID NO: 8088 - protein, 507 aa, Xenorhabdus bovienii
  Peptide sequence Name=Xb4151_4152.C435.gene164.pep
VESRDSDHHGTDRNEWSISFVYSQLYIEVKKATPQLQHQIKQIVAVWNDGKNYAVTPSFANQDVDAQALLQQANFSSHNNGVVKVDKQGNLSMVKPGNTTITIKTPETNQFTASTADVAYVLNKGKVDISFDEAVVQDWVAGNSKIQQPFQLPVHAKERWESGNKEVIEVSRDGLWSKKGTGSATMTLYVEQNDYYMSSHGGYDVELYDKPEVDIKSVEYPNEGKLVSVSSSENWTPAFTDDGISITWNALNSNKYKPINKMRVEMEDANSGKLLDYKDYTYQEISSSKLHKTTFVPKPEYFGISVRIKLTARGFIGLNTVVSSNNLPVRHLKPHQIWSSVEVSSRYNIFALFFNLSEVKTCRSLFIDRAHSIYLDVIDGYIDFGGKKLLVPMYVSYKATIRKFKDSDLVTQDLDKANLSGNASRAAYKAKVIDGNDNKLLPAHRLIHGDCWMNHSGGYRINLHVKYAGEEYKYLAKRTHGYGGNGDGVYDSDGNRDINIDNEFYLE

SEQ ID NO: 8089 - protein, 70 aa, Xenorhabdus bovienii
  Peptide sequence Name=Xb4151_4152.C435.gene165.pep
  Homolog annotation: Query=Organism:..not_definedbp; Hit=..bp; Blast score=; Percent Identity=; E value=; Homolog= Pa|Phot4-329h03.q1k _g10| 12601 - 13431 412 276 aa, chain -
VICDQAQSEIPLAIVNGAGDPFINHDYINGLNYRNLWQGQVFNLAGVDHAPFWEAPDIFNPILAEFLKVL

SEQ ID NO: 8090 - protein, 34 aa, Xenorhabdus bovienii
  Peptide sequence Name=Xb4151_4152.C435.gene166.pep
MPVIAEISLNKTKNSRSGSHQAIKELLKIQPESG

SEQ ID NO: 8091 - protein, 33 aa, Xenorhabdus bovienii
  Peptide sequence Name=Xb4151_4152.C435.gene167.pep
MLVLLKVLFCLCLYLYLYLYLYLYLYLYLIDNI

SEQ ID NO: 8092 - protein, 50 aa, Xenorhabdus bovienii
  Peptide sequence Name=Xb4151_4152.C435.gene168.pep
LDYRLFYFKRLRFHIFVSVVKSVIREANKKSVRFCERSLNRLMSSWGRHG

SEQ ID NO: 8093 - protein, 3578 aa, Xenorhabdus bovienii
  Peptide sequence Name=Xb4151_4152.C435.gene169.pep
  Gene classification: Gene name=EntF; Function=Non-ribosomal peptide synthetase modules and related proteins; Function class=Q Secondary metabolites biosynthesis, transport and catabolism
  Homolog annotation: Query=42..1099bp; Hit=1..1044bp; Blast score=761; Percent Identity=42.0; E value=0; Homolog= PA2399_2 COG1020
MNINEQTLDKLRQAVLQKKIKERIQNSLSTEKYQIQPRTDSQQALPLSWAQQRLWFLAQLDPAAQTAYHIPAGLHLQGQLNQNALQATLDSLVARHEILRTTIAMVEGKAQQIIGDADCGFTLTVQDISQLPETEQQATVEEYTQSEASHPFDFEHGPLIRGRLLKLSQDSHILLLTQHHIISDGWSINVLMQELSTLYHTFDQGLPNPLPPLTLQYADYALWQRQWLQGEVLEKQLDYWCSALQDAPALLTLPTDRPRPAQQSYAGGSVEITFPATLKAQLKTLGQRHGTTLFMTLLAGWAVLLSRISGQKDLVIGTPVANRQHRELEPLLGFFVNTLALRVQLHDNPTVSELLAQVKAHTLSAYVHQDLPFEQLVEALKPPRSLSHSPIFQVMLSQENTPGQQNVELPGLTISELELPENSSHFDLSLSLNETENGLVGGLEYARDLFDPASIERMVGYLTTLLTAMTADDTLRVESLPLLMPQERTRLLVDFNETTVAYPNDILLHQMVEQQVERTPDAIALIWEDAQLSYAELNQRANQLAHALIDFGVQPDDRVAICAERSPDMIIGMLGILKAGAGYIPLDTEYPAERLAYILSDSAPKLLLTQQHLQARLAVDGLPVWRLDDASHLNAVVQLPTHNPEQYQPELQPQHLAYIIYTSGSTGLPKGVMIEHRNVVNFVHSQCQINELKSTDRVLQFASVSFDTAVSEVFPTLSIGAALILRPAHIRIPDAAFGHFLQEQRISIAELPTAFWHQWVQEMKAGRSSFSSHLRSVTVGGEKAEHRHFVSWQSMPETRNCRWLDTYGPTETTVIATALTLNNHAARSFCAAETLSIGRPIANTRIYILDTQGQPVPIGVTGEIYIGGAGVARGYLNRPELTAERFVSDPFSEQPNARMYRTGDLGCWRPDGTIVYLGRNDFQVKIRGFRIELGEIEAQLADCSGVSDAVVVAREEGAGDKRLVAYIVPKSDVTLDAASLREQLSTRLMEHMLPSAFVMLEAFPLNPNGKVDRKALPAPDRTAIISREYQAPQGETEQQLAAVWQNLLELEQIGRQDNFFELGGHSLLVVSLIEQLRQRGLTVSVSAVFSAPTLAAMAAHLTDDAASDTHTQAIPPNLIPDDCQSITPEMLPLVTLTQDNIDQLVTRVSGGAANIQDIYPLGPLQEGILFHHMLETTGDTYLDSQLMTFDSRQRLDAFLLALQQVIDRHDILRSAVHWHGQPEPVQVVYRQAPLSVIALALSPEEDAEQQLRRHTDSRFIRMDVTQAPLMSANIAKDPHSETWLLSLLHHHLVCDHLSLELIFNEIQTLLLGQGEHLQPALPYRNFIAQTRSVPVEKHQAYFQQLLSDVDEPTLPFGLLDVQASNNEIAEAVLTLDDELAQRIRDCARQQGVSAAVLFHIAWAQVLAQCSNREDVVFGTVLLGRLQGGEDTTRVLGMFINTLPVRITLQDRSVQQTVQEAYQQLSQLLAHEQAPLAVAQRCSGIPVSLPLFNSLLNFRHSSDDDEQDLSLAWEGIQTLSGEERSNYPLSLDVDAFDDGFALTAQCSQQIDPARINAYMDIALKGLVAALQNQPEQSIQSLNILPSAERSQLLVDFNNTTVAYPQDKLLAQLFEQQVEHTPDAIALIWEGAQLSYAELNQRANQLAHALIAFGVQPDDRVAICIERNLDMVIGMLGILKAGAGYVPLDPEYPAERLAYILSDSAPKLLLTQQHLQARLPVEDLTVWQLDEASHLNTVAPQPTDNPDPRQLGLHPHHLAYIIYTSGSTGLPKGVMIEHHNVVNFTYAQCQTSELKSTDRVLQFASVSFDTAVSEIFPTLAVGATLILRPAHIRIPDATFSQFLQEQAISVADLPTAFWHQWVQEMKAGRSGFSSHLRSVTVGGEKAEHRHFVTWQSMPETRHCRWIDTYGPTETTVSATALALDDPASYGMDTLSIGHPLINTYIYILDTRGQPVPIGVTGEIYIGGAGVARGYLNRPELTAERFVSDPFREQPHARMYRTGDLGCWRPDGTIVYLGRNDFQVKIRGFRIELGEIEAQLAACAGVSDAVVMAHEEGSGDKRLVAYLVPQSDVTLDTADLREQLSTHLAEYMLPSAFVILDTFPLNPNGKLDRKALPAPDHAASVSREYQAPQGETEQQLATVWQTLLGLEQVGRHDNFFELGGHSLLVVSLIEQLRQRNLMLDVSSVFSSPTLAAMAVRLTASDSDGSTGVSVPPNLITDDCQAITPEMLPLVALTQTNINQIVTQVPDGISNIQDIYPLGPLQEGILFHHLLETEGDTYLDNLLMTFDSRPRLDAFLLALQQVFHRHDILRSAILWDDLPQPVQVVYRQAPIPVTELTLSPEEDAEQQLRRYVDPRSVRMDITQAPLMSASFAKDPHSETWFLALLHHHLVCDHQSLEMIFNEVQAIMIGQSDDLPPSLPYRNFIAQTRAVPLEKHQDYFRQLLGDVDEPTLPFGLQEVYGEDSHILEAEFDLDTSFAQTLRECARQQGVSAAVLFHVAWAQVLAQCSGRDDVVFGTVLLGRLQGVAGADQTLGMFMNTLPIRIKLSTFNVQQVVQQTYRLLSELLEHEQAPLAMAQNCSGVTPPLPLFSSLLNYRHNQDDTQQTTLTAWEGIGLLNVDERTNYPLSLSVDDTAQGFTLVAQCVPELDPMRINHFMNTVLQGLVESLKNSPEQTCLQLNILPQEERTQLLRTFNNTREAYPQDQLIHQLIEQQVERSPTATALIYDDNQLSYDELNRRANQLAHSLIAFGVRPDDRVAICVERGLEMVIGLLAIMKAGAGYIPLDPEYPAERLSYMLSDSQPSVLLTQHSLQTRLSETNTPILILDSDEYQANIIHQPECNLPAADLGITSHNLAYVLYTSGSTGRPKGVMVEHIGVVNLLLSMKDRLQISVDDTLLTATTIGFDVAALELYLPLCNGSTCVIAPSLTARDPEQLAELIAARNIKVMQATPTTWRMLLDSGWTGAAIKATSGGEALPHELAQRLKEKVSGLWNLYGPTETTICSTASGNLQTEPESRYTTPQITIGHPVANTQIYILDKHGHPVPVGVAGEIYIGGIGVTRGYFNRPDLTAERFVDDPFSDEANTSADRRMYKTGDLGRWLPDGNIDYLGRNDFQVKIRGFRIELGEIEARLLACADIREAVVMVREDTANDKRLVAYLVLQPETSLNLEKLRETLQASLASYMVPNAFVTLDSFPQTPNGKLDRQALPLPDDSAVIAQIGYEPPVGETENIIADVWQDSLGLERVGRHDHFFELGGHSLLTLQVVVRLRQALGLDIAIRDLLIHPTISELAAYLQAKNSLSAPLAQQKNIVTIRKGNGNSSLFLIHPAGGDVQYAYDLAPYIDDKAQSIYGIIASDTFGEENAQLTISKIAEEYVTCLRQMQIQGPYDLAGWSIGGTIAYEMACQLTAAGEAVNFVGLFDSGASYQDAFSLEEKQAGLPFNETATLLEVLPENMPASLHDQIQRLANNHDCSAILMLAQQNDLLPASENIRQQLHLYHNISVAAYHYIPSTAAVNVTLFRATEENDQSSHALGWEAVIPKERLTVIPINGSHESIMEQPHIQDVGKVLLSAMTTPRGH

SEQ ID NO: 8094 - protein, 3321 aa, Xenorhabdus bovienii
  Peptide sequence Name=Xb4151_4152.C435.gene170.pep
  Gene classification: Gene name=EntF; Function=Non-ribosomal peptide synthetase modules and related proteins; Function class=Q Secondary metabolites biosynthesis, transport and catabolism
  Homolog annotation: Query=878..2165bp; Hit=1..1276bp; Blast score =944; Percent Identity=43.0; E value=0; Homolog= PA2400 COG1020
MNDNELISLPLAERKRLLELAKAAKLTRQQTQKTEIHAQPRDGNVPLSWAQQRLWFLTQLDPAAQTAYHMSAGLNLQGHLNQNALQAALDQIVARHEILRTTIVDVEGQPQQIIGSTDRGFALSVQDFSQLPSTEQQTAVEECAQREALHPFDFTQGPLIRGRLLRLAEESHVLLLTQHHIISDGWSVNILMQELSTLYQAFCQDRADPLPALTLQYADYALWQRQWLQDNVLEKQLDYWRSELQGAPVILELPTDKPRPTQQSYAGSRVDITLPPALSTELKAFSQRHGITLFMTLLAGWAVLLSRISGQHDLVIGSPVANRQRHELEPLIGFFVNTLALRIQLGDNPSVSELLARVKNHALGAYAHQDLPFEQLVEALKPPRSLGHSPIFQVMLALDNTLGQQHFELDGLHLHELPRTRDSAYFDLTLTLNDTEQGLVGDLEYARDLFEHASIERMVGYLQTILSAMVADDSLRIDDLPLLTSPQRTQLLANFNDTAIPYPKNALIHQLFEQQVDNTPDKIALVWGETQLSYSELNQRANQLAHGIMASGVHPDDRVAICAERSLDMVIGLMGILKAGASYIPLDPNHPTERLAYMLSDSQPVLMLTQQHLKARLPVTNIPVWALDSEEHQTYIADQPKDNIDASQTGLTPQNLAYVLYTSGSTGLPKGVMIEHQNVVHLIHSQFQMSKLTPQDRVLQFASFGFDNSVAEIFPTLAIGATVVLRPDHIKVPDTEFITFLQNQSITVVDLPTAFWHLWAQEISAGYSWPPEQLRSVAAGGEKAEHRHLVTWLSSPGTQKCRWINTYGPTETTVNATSIVIDKDDLCTYEDIPIGRPIANTRIYILDQRGQPVPIGVNGEIHISGSGVARGYLNRPELTAERFIQDPFSDIPGARMYKTGDLGRWLPDGTISYSGRNDFQVKIRGFRIELGEIEARLADCTGVKDAVVVVREDDSGDKRLVAYLIPQPGATLNAASLREQLSVNLASYMLPSAFVTLDTFPLNQNGKIDRPALPAPDRSASVSREYAEPQGEIEQQLAEIWQNLLGLERVGRYDNFFELGGHSLLTVQVASRLRQSLNIEITLQDLFTQSVLADLAQSLVTATQSTQPMILPANREQTLPLSWTQQRLWFLAQLDPAAQTAYNMSGGLHLQGHLNQNALKAALDRIVARHEILRTTIVQTEGKARQIIGDADGGFSLTVRDLSQLSSSAQQATIEEYAQFEASHPFNFAQGPLIRAQLLKLGEQQHVLLLTQHHIISDGWSLNVLMNELSALYQAFGQGQADPLPALVIQYADYAVWQRQWLQGERLEKQLSYWRNELQDAPTLLELPTDKVRPSVQSYHGDQVTFTLSPELNAGLRALSQRHGATLFMTLLAGWGILLSRLSGQPDLVIGTPVANRQYSELEPLIGFFANTLALRIKLEDNPTISALLARVKAHALEAYAHQDLPFEQLVEVLQPPRSLSHSPIFQVMLALDNTSSKQSFELAELSLSPLALTRNSAHFDLTLALSDTENSLTCELEYASDLFERSSIERMAGYLQNLLAAMVADDNLRVADLPLLMSYERTQLLTDFNDTAVTYPQDKLLAQLFEQQVEHTHNAIALIWEGAQLSYAELNQRANQLAHALIAFGVQPDDRVAICIERNLDMVIGMLGILKAGAGYVPLDPEYPAERLAYILSDSAPKLLLTQQHLQARLPVEDLTVWQLDEASHLNTVALQPTDNPDPRQLGLHPHHLAYIIYTSGSTGLPKGVMIEHHNVVNFTYAQCQTSELKSTDRVLQFASVSFDTAVSEIFPTLAVGATLILRPAHIRIPDATFSQFLQEQAISVADLPTAFWHQWVQEMKAGRSGFSSHLRSVTVGGEKAEHRHFVTWQSMPETRHCRWIDTYGPTETTVSATALALDDPASYGMDTLSIGHPLINTYIYILDTRGQPVPIGVTGEIYIGGAGVARGYLNRPELTAERFVSDPFREQPHARMYRTGDLGCWRPDGTIVYLGRNDFQVKIRGFRIELGEIEAQLAACAGVSDAVVVAHEEGSGDKRLVAYLVPQSDVTLDTADLREQLSTHLAEYMLPSAFVILDTFPLNPNGKLDRKALPAPDHAASVSREYQAPQGETEQQLATVWQTLLGLEQVGRHDNFFELGGHSLLVVSLIEQLRQRNLMLDVSSVFSSPTLAAMAARLIVKTSDGSAGTHVQNVPPNLITDGCQAITPEMLPLVALTQDNIDQIIAKIPDGVANIQDIYPLGPLQEGILFHHLLETTGDTYLDNQLMTFDSRPRLDTFLLALQQVINRHDILRSAVHWNGLPEPVQVVYRQAPLSIAELTLSPELDAEQQLRDATDSRSVRMDLTQAPLLSIKLAKDPHSETWFLALLHHHLVCDHLSLEMIFNEVQAILLGQDDSLSPSLPYRNFIAQTRTVPLEKHQDYFRQLLGDVDEPTLPFGLLDIQGNPDEHSEITEANFILDNELARRIRDCARQQGVSAAVLFHVAWAQVVAQCSGRDDVVFGTVLLGRLQGGSGADQVLGMFINTLPVRVLLQERTVRQTVQDTYRQLSTLLEHEQTPLAIAQRCSRVQAPQPLFNSLLNFRHSQRDDKQSASPAWEGIQILSGEERSNYPLSLDVDDFDDGFALTAQCNRHVNPLRINTYMDTVLRELVAALQNVSEQSIQSLAILPPDERTRLLVDFNNTAASYPQNVLLHQPFEQQAERTPDAIALIWEDVQLSYAELNQRANQLAHHLIASGVQPDDRVAICIERNLDMVISMLGILKAGAGYVPLDPAYPAERLAYILSDSAPKLLLTQQHLQVRLAVEDLPVWRLDDADHLSTVAQQPTDNPDSRQLGLYPQHLAYIIYTSGSTGLPKGVMIEHRNVVNFTYAQCQVSELKSTDRVLQFASVSFDTAVSEIFPTLAVGATLILRPAHIQVPDASFSHFLQEQAITIVDLPTAFWHQWVQEMKAGRSGFSSLLRSVTVGGEKAEHRHYLTWQSMPETRHCRWIDSYGPTETTVITTALALDNHTGDKPTAGSSCMTETLSIGRPIANTRIYILDARGQPVPIGVTGEIYIGGAGVARGYLNRPELTTERFVSDPFSEQPHARMYRTGDLGCWQPDGTIVYLGRNDFQVKLRGFRIELGEIESQLAACPGVKDAVVVAREEDAGDKRLVAYVIPQPDASLDAVSLREQLSNHLTEYMLPSAFVILDTFPLTPSGKLDRKALPAPDRSASASHEYEAPQGEIELQLAAIWQTLLGLEQVGRHDNFFELGGNSLSIMRLSTHLREEFHLEIPIADIFHHSTLYKLAELILSRQIETFFAQDIESVQKELENLSEEELLAMLNGDQQ

SEQ ID NO: 8095 - protein, 1138 aa, Xenorhabdus bovienii
  Peptide sequence Name=Xb4151_4152.C435.gene171.pep
  Gene classification: Gene name=EntF; Function=Non-ribosomal peptide synthetase modules and related proteins; Function class=Q Secondary metabolites biosynthesis, transport and catabolism
  Homolog annotation: Query=61..1110bp; Hit=6..1021bp; Blast score=679; Percent Identity=38.0; E value=0; Homolog= PA2402_3 COG1020
MIFLAEKQIILTLFIPDFLVIDLDSSFIFCFISSQTFLFSYAHKKGSYKMNHPEKLKPFALSEAQSSRWFQYQINPSQRGRNNGAFCARVKGLNVQDLENALNHLIKRHPMLRASFGLYDGELGYRIAENSEIKIQTHDALHLSEDTLQQLVLDDCRHVLDLENPLRFYASWYQCNAQESVMVLTFDHLVVDGWSYWLLLEELGMILTSQELEPISEHSYQDYVSWQQKWLNSKNAKKQQQFWGNNLAGDLSTLSWPMKIGSVQNRADNNVAPPATDKITAFGRIPDDLALKLCAMASEYGNSLFAIFLTAYQILLHRYTAQDDIVIGSMMPGRSQAKWGKLVGEFVNPVALRGQINGNITVREHILQTAKTIRQAIENQRYPFTKILEQFKLQRTADTHPIFQTLMTFQKPRYISELPTLWMDNDSSTTVHWGNAELRPFPHPLYADTPVPLMVNMMEVNQQIRCHFHYDPQVFDAELINQLIKNLIILLTAMADNQQQSIDSLPLMAEQERRQVLYDFNKTDKPFPQHALIHQLFEQQVERTPDTIALICGDKALSYTELNQQANRLAHALIKAGIRPDNRVSICMERSLDMVIGLLGILKAGAAYVPLDPEYPTDRLGYILSDSDPALLLIHHGLQDHLPMTTMPVWVLESEEYQTNIASQPTDNPVATDLGLTSRNLAYVLYTSGSTGLPKGVMNEHRGVVNRLLWAQGEYQLTQHDRVLQKTPFSFDVSVWEFFLPLLAGAQLVMARPGGHKEALYLLDEIETRDITTLHFVPSMLQSFIHLTPAGRCPSLRQILCSGEALSYSLQQQCLTHFAHSELHNLYGPTEAAIDVTSWRCVPDQHIGLVPIGRPIDNTQIYILDKHYQPVPIGVVGEIYIAGAGVARGYLNKPELTTERFIQDPFGQHPDMRMYKTGDIGRWLADGSIDYLGRNDFQVKIRGNRIELGEIEARLAQSDGVQDVIVIAREYDAGDTRLVAYLIPQSGVTLSIPALREQVGSNLPDYMIPSAFVMLDAFPLTLNGKLDRKALPAPDHSAVLTREYAAPQGETEEQLADIWQKLLKIDRVGRNDNFFELGGHSLLILQLQSRISEIFDVELSIQQLFAHPTICQLEEHIIDAQLLQFDAESLQDLYKTMG

SEQ ID NO: 8096 - protein, 551 aa, Xenorhabdus bovienii
  Peptide sequence Name=Xb4151_4152.C435.gene172.pep
  Gene classification: Gene name=MdlB; Function=ABC-type multidrug/protein/lipid transport system, ATPase component; Function class=Q Secondary metabolites biosynthesis, transport and catabolism
  Homolog annotation: Query=13..536bp; Hit=12..542bp; Blast score=338; Percent Identity=34.0; E value=9e-93; Homolog= PA2397 COG1132
MTLIAYLYRQSWILLLLSTISALISGFAGASVVSTISRGITETVQLNSFLWSFFGICILFFITKTLSEVILSHLTQATIYSLRLSLSTKILRAPYKKLNKLGRHGLLAVLTKDVDVFIQSFMLAPTAFGNITLIFACFGYLAWVSWQLFVILILLCLVIMYIFYLLEKRPIRLMTEMRDQVDRLYLNFQSLIDGSKELQLNTQKGDAFIDKVISPGAKKFKEICIKATTGYAWVLNASSIAFYMIIGIMVFVVPIWLPQDPASLVTVTLTVLFLAGPISEVVGAIPELREAEISLNKMRQLDNDLDEGQENQSVQGDTPNPFLSEKPLVLELKDIVHHYTTDKEDRQFMLGPLSLKISQGEIVFIVGGNGSGKTTLAMMLVGLFEQESGSIWLNGVKMDTSNNVHYRQFFSAVFSNYHLFDQLLNTGTDVTEKATHYIQALNMGHKVKIIDGKFSTTELSAGQRKRLALVAAYLEDRPLYLFDEWAADQDPVFKRLFYTELLPELRSRGKTVIVISHDDAYFDIAERVIKLEDGNIKEINNHNHETITEIK

SEQ ID NO: 8097 - protein, 194 aa, Xenorhabdus bovienii
  Peptide sequence Name=Xb4151_4152.C435.gene173.pep
  Gene classification: Gene name=MdaB; Function=Putative NADPH-quinone reductase (modulator of drug activity B); Function class=R General function prediction only
  Homolog annotation: Query=3..190bp; Hit=1..188bp; Blast score=249; Percent Identity=59.0; E value=1e-66; Homolog= PA2580 COG2249
MIMTHILVVNSAKEFGESKGELNNTLTEIIKDHLTGMGHEIQITHVDKGYDIQAEVDKFIWADSIIYQMPGWWMEAPWILKKYVDEVFSAGDGTLFQDDGRTRSDLTKKYGSGGLSQGKNYMFSVTWNAPLESFEDPEQFFEGKGIDNVYYPFHKANQFLGMSPLPTFACYDVVKQPQIAQDIERLKIHLSDCY

SEQ ID NO: 8098 - protein, 37 aa, Xenorhabdus bovienii
  Peptide sequence Name=Xb4151_4152.C435.gene174.pep
MMINPSPSNDLDKTINAKTISLWRIRQRLEITGHPSG

SEQ ID NO: 8099 - protein, 307 aa, Xenorhabdus bovienii
  Peptide sequence Name=Xb4151_4152.C435.gene175.pep
  Gene classification: Gene name=AraC; Function=AraC-type DNA-binding domain-containing proteins; Function class=K Transcription
  Homolog annotation: Query=7..305bp; Hit=25..326bp; Blast score=224; Percent Identity=40.0; E value=9e-59; Homolog= PA2047 COG2207
MKALHHPSGATEIEIQLQQLIGKIASLTRPNTYAVKTAIPEMTLCHLEQPTTPVGWLYEPSIMIIVQGKKRITIGGCSYCCDASQFMVTSTDIPTITQVCTASKEEPFFAMMLQFNIQEASELLIENHVAIRQDSPDTCGLAVTPVTAELLVCFNRLLDLLSTPEDIPVLSPLIQKEIVYRLLKSELGGRLQQMASQESPSHQISKTINWLKDHFADSVKVEQLAQIARMSPSSFHHHFKAVTSMSPLQYQKWLRLNEARRILLTQHHNVSATAFQVGYESPSQFNREYSRLFGEPPCRDIKRLRVR

SEQ ID NO: 8100 - protein, 38 aa, Xenorhabdus bovienii
  Peptide sequence Name=Xb4151_4152.C435.gene176.pep
MGDVMLSFSTPSFIAINTQNFYSLLLLSISLELESLYQ

SEQ ID NO: 8101 - protein, 33 aa, Xenorhabdus bovienii
  Peptide sequence Name=Xb4151_4152.C435.gene177.pep
MIKSLNHLILHYPCLILQFIIFTDINFPILTIC

SEQ ID NO: 8102 - protein, 32 aa, Xenorhabdus bovienii
  Peptide sequence Name=Xb4151_4152.C435.gene178.pep
MYFYKSIGASIFLVLYLCFLKDKKEYVHDQIK

SEQ ID NO: 8103 - protein, 31 aa, Xenorhabdus bovienii
  Peptide sequence Name=Xb4151_4152.C435.gene179.pep
MLQQVVLLEVTVGASMGATKYIVSSVIKGGA

SEQ ID NO: 8104 - protein, 38 aa, Xenorhabdus bovienii
  Peptide sequence Name=Xb4151_4152.C435.gene180.pep
LLYSQKHLQSCALPIDTKIAYYLLIDNIIRYIYRYFSK

SEQ ID NO: 8105 - protein, 368 aa, Xenorhabdus bovienii
  Peptide sequence Name=Xb4151_4152.C435.gene181.pep
  Gene classification: Gene name=AsnS; Function=Aspartyl/asparaginyl -tRNA synthetases; Function class=J Translation, ribosomal structure and biogenesis
  Homolog annotation: Query=95..368bp; Hit=1..274bp; Blast score=258; Percent Identity=49.0; E value=5e-69; Homolog= SPy0559 COG0017
MFIFYTRKIMISDNTIKKPLSGNVSQRRSLTNTMKSKQSWKNPESHFESAIFDPWYKSITKIHSLISAKTGGFFSSRELSPVLLPVTTGSISSPMGLGSDSIPVKINLGGVDTYLADSMQFLLEYVLRLNDKGVYYLMPTFRGEEQDKRHLNQFYHAESEIIGSLDDVIELASSYVTYLCDYFLENERALLSQFTDELEHLRKLSMLKGNIPRVRFTDAVELLNNDSRYFSEHESEFKQITNEGEQKLIELFDGAVWLTHFPSLSVPFYQADASEQGYSLTADLLMGIGETLGAGERNTYAENVVENLNVRKVSREEYEWYIRMRELMPLRTSGFGMGVERFILWLINHDDIRDCQLLPRIHGENILP

SEQ ID NO: 8106 - protein, 38 aa, Xenorhabdus bovienii
  Peptide sequence Name=Xb4151_4152.C435.gene182.pep
MLFIPPGGLFVSLTIPIMGKYLMVGIDSKVKCFIFHLS

SEQ ID NO: 8107 - protein, 259 aa, Xenorhabdus bovienii
  Peptide sequence Name=Xb4151_4152.C435.gene183.pep
  Gene classification: Gene name=SmtA; Function=SAM-dependent methyltransferases; Function class=Q Secondary metabolites biosynthesis, transport and catabolism
  Homolog annotation: Query=7..177bp; Hit=16..188bp; Blast score=86; Percent Identity=31.0; E value=2e-17; Homolog= HI0095 COG0500
MIGIVRETNRPPGGMNSIRRIAQNAFLNSKTEVLEVGTATGVTAIELAKLTYCKITAIDIDENNLSVACNRAIKENVSKLISFEKRDATDTKFEDKTFDMVFCGNVTSYFDDKVKAIKEYDRVLKDNGLIAAIPMYYIKKPKDSLVDEVSEAIDVKISPLYKKDWIEFFNLPGYELVSCENFVFDDISNAKVEEYVNIIFKQQHLEELDPEIRTALYKRYSYFMHLFRTNLSHMGFSLMLLRKVTFPTEPELFTASPID

SEQ ID NO: 8108 - protein, 324 aa, Xenorhabdus bovienii
  Peptide sequence Name=Xb4151_4152.C435.gene184.pep
  Gene classification: Gene name=LdcA; Function=Uncharacterized proteins, homologs of microcin C7 resistance protein MccF; Function class=S Function unknown
  Homolog annotation: Query=49..302bp; Hit=58..312bp; Blast score=134; Percent Identity=33.0; E value=2e-31; Homolog= VCA0439 COG1619
MAKITIVAPANTMCNLDTKMIDVGLKNLSNLGYVVSINDESFFDTENIAGTTAQRASSINRAILSENTDIIMAVFGGYNCNDLLEHIDFIELHRTNKVLIGYSDITALLNAYYAVTGGVSFHGPGFGTFCNPSLPAETVNGFTKALRLTNIEERLIQPQMTASDLWFLKSGFGPREWKSHPEWRTINEGEIKGILIGGNIESLVNLIGTKYCPDFDNKILLLESGFNTDPSQFRMWVSHLKACGIFDKISGLLIGNFTECSRKRFSPSYLDNLISEFVPEIVPTLVNFSSSHTDPILTLPIGGFIHMKLSNKQNEICMSVPEIP

SEQ ID NO: 8109 - protein, 251 aa, Xenorhabdus bovienii
  Peptide sequence Name=Xb4151_4152.C435.gene185.pep
  Gene classification: Gene name=Udp; Function=Uridine phosphorylase; Function class=F Nucleotide transport and metabolism
  Homolog annotation: Query=76..209bp; Hit=62..196bp; Blast score=68; Percent Identity=28.0; E value=4e-12; Homolog= VCA0134 COG2820
MNNNLIVDPNKFISYLRASGYLQVESVPKTVIMVFLESLMEHCKEIYDLNKIEGFNAGELYVLSDNESVGIFYCRGIGAPVAVINLEELIAFGVQNFIVVGTAGALNPNLSIADIVLCDSALRDEGTSKHYVSDGQISLPTEKWHKDLKLCFSKHIPSITEGRTWTTDAPYRETKSKVTSLQQQGVLCVEMEASALFVVAGFHKVNIASAFVISDSLADLKWTPGFFSNKVTDSLICLIKHSINFLHNKKD

SEQ ID NO: 8110 - protein, 196 aa, Xenorhabdus bovienii
  Peptide sequence Name=Xb4151_4152.C435.gene186.pep
  Homolog annotation: Query=1..191bp; Hit=1..188bp; Blast score=166; Percent Identity=45.0; E value=2e-40; Homolog= Pa|Phot4-291a08.p1k _g13| 14692 - 15270 327 192 aa, chain -
MLDIVEFGHINIVVDDIDDATRFYQSLFRFELVQSFPHFQNSGFAKGAGFLEGSEQVVVAINFLKIPNTTVYLEIISYINPKPINPPQTFLPNELGGPRHIALRVRDIASAYEKIKSFPGVSLINPNSDYKPFQLDPVCPDDFTFANAELESDLDLKLKSSTISSSISFVYFTDKFGVMWELEEEPTGADDPALSV

SEQ ID NO: 8111 - protein, 137 aa, Xenorhabdus bovienii
  Peptide sequence Name=Xb4151_4152.C435.gene187.pep
  Gene classification: Gene name=GloA; Function=Lactoylglutathione lyase and related lyases; Function class=E Amino acid transport and metabolism
  Homolog annotation: Query=1..125bp; Hit=1..125bp; Blast score=170; Percent Identity=58.0; E value=5e-43; Homolog= NMB0340 COG0346
MRIAHTMLRVSNLVQSIKFYTKILNMDLLVCKDFPDGKFTIAYVGYGGEFDSALIELTHNWETNKYELGNGFGHIAIYTDDVFAICDRIIASGGNVVRMPGPKKYGSTIIAFATDPDGYKIEFVECEKEIKKSPNEK

SEQ ID NO: 8112 - protein, 821 aa, Xenorhabdus bovienii
  Peptide sequence Name=Xb4151_4152.C435.gene188.pep
  Gene classification: Gene name=LeuS; Function=Leucyl-tRNA synthetase; Function class=J Translation, ribosomal structure and biogenesis
  Homolog annotation: Query=5..821bp; Hit=1..873bp; Blast score=906; Percent Identity=49.0; E value=0; Homolog= PA3987 COG0495
MSMKINKTYSARDVEKEAQSYWSSAKTFLADEHNPGEKFYSLCMFPYPSGNIHMGHVRNYSIGDAIIRYQKMCGKNVFQPMGWDAFGLPAENAAIKNNTHPASWTYKNINNMRKQLKQMGYGYDWSREIATCSPDYYRWEQWLFLRLYEKGLAYKKKSVVNWDPVDETVLANEQVINGRGWRSDALVEKREISQWFLKITDYAEELLDGLNHLEEWPVQVKTMQKNWIGKSTGVQVSFKIKGTGNTVEVFTSRPDTIFGCSFIALAPDHSFARELSEREPDIKLFADKCMQMSTAESDLATLTKKGIQTDCIAINPLNGEEVPIWIANYILSSYGTGAIMGVPAHDERDHEFAGLYDLPVKHVIKPVDKESANIEGLFTGKGILINSGEFNGLVSDDAIEGVTQKLREIKAGTFETKYRLRDWGVSRQRYWGAPIPIIYCDDCGTVPVPENDLPVVLPKEFEFTDKSNVLKNIPEFYNVKCPSCGKCAVRETDTFDTFVESSWYSARFTCADQPNMMLDERADYWAPVDLYIGGIEHAILHLLYARFIHKVMRDEGLLTSDEPFVRLFTQGMVLKDGSKMSKSKGNVVNPQDYIDNYGADTLRLFMMFSAPPEQQLEWSDSGVDGAHRFIKKLWNTVHGHAEHCMPKIIHSSGIVTIEQKNLRRKLHETLKKVTDVMETRLSFNTAIAAVMELINTYNKFTVNSETDKAVVKEVLDNVVIMLSPIIPHVTHVLWHVLGHDNALITEEWPKVDELAIVQDTVTIAVQVNGKLRAQHLISVDASEEMIKDKLFTLKEVQKHIEGKTVKRTVIVPNRLVNIVTS

SEQ ID NO: 8113 - protein, 383 aa, Xenorhabdus bovienii
  Peptide sequence Name=Xb4151_4152.C435.gene189.pep
  Gene classification: Gene name=ProS; Function=Prolyl-tRNA synthetase; Function class=J Translation, ribosomal structure and biogenesis
  Homolog annotation: Query=38..351bp; Hit=32..359bp; Blast score=61; Percent Identity=22.0; E value=1e-09; Homolog= BB0402 COG0442
VRLTKQLFLEKYRLPKILNQNSTMSLLSSGPFYQMVEKGIPLFLPIGNKILTAIERCCIKEAEKFEFNHIDMTQIIPTDILSLGEQFHDGFLDQFVFLKGKMERYHLLSTPEPLLLNFLKEGLQSYRQLPIKMMFSAKFYRQLSQVQGILKTREFRMLAGACLHERVSEKELAIEFFHKYTLHLANVFSIPIEFTYNEESKFYEYFYIHTDGEELFNDVSAVSLAMAYEYGQEKKVIARYCSNSNRNMNAQFVTYGLGLQRLFFVILDCYRDNKGFNLPKPVRPFDIAIIPLRDEDISRCLEFANCLQIPPDRMLIDDRCKTQVFEKERFADYLGIPQKLFISNQEVFVKNRDTGTFLKEVFQLSDIKKESCSFFNIQPYAQN

SEQ ID NO: 8114 - protein, 43 aa, Xenorhabdus bovienii
  Peptide sequence Name=Xb4151_4152.C435.gene190.pep
MIILCASRTVLLIFIARKIIYIESVLCIWLDIKETTAFFFNIG

SEQ ID NO: 8115 - protein, 414 aa, Xenorhabdus bovienii
  Peptide sequence Name=Xb4151_4152.C435.gene191.pep
  Gene classification: Gene name=ProP; Function=77 Permeases of the major facilitator superfamily; Function class=G Carbohydrate transport and metabolism
  Homolog annotation: Query=39..359bp; Hit=35..338bp; Blast score=71; Percent Identity=25.0; E value=1e-12; Homolog= TVN0256 COG0477
MTMINKMIGAISIYRGLSSNIYFIAIARFILGLGNFILPFMMLLLTEKLDYSVIIAGSLTMGVTGSYFIGSILGGKFSDSMGHKRVLVFGELVGSLILIVCGFFVYNPIVIPLFLFGTYFFFGLALPASNALVADLSNHRNRDAVMSLSYLAFNLGSAVGPLLAGYLFWSYTSWIFWGNGLAALIGILTVLFGVNSSVKERGTCQTQLLNIELEKPVIGTVWTVLSERPRIIFFTFFCSLMWVVMNQMTMASPLYLNYIFDTHGPILFGQLCTFSCLVVVAITPILMKLTASKSDIISLAYSSVIFAVGYLVVMSSPTIPMQFIAWFFLSAGEILLYTKEGIYLANQSPKSHRGRIQSFSTCMRNILLMPSFVLIGFTIDKFGYQYTWLLIVSIAMLAAFGFMAMDKKYESLRT

SEQ ID NO: 8116 - protein, 31 aa, Xenorhabdus bovienii
  Peptide sequence Name=Xb4151_4152.C435.gene192.pep
MTKGVRLLYYTNTLSLSSNLNIRLVSLKSPP

SEQ ID NO: 8117 - protein, 54 aa, Xenorhabdus bovienii
  Peptide sequence Name=Xb4151_4152.C435.gene193.pep
LTRPNTYAAKTAIPEMTLCHLEQPTTPVGWLYEPSIMIISSPFKAVTSMRLSVC

SEQ ID NO: 8118 - protein, 74 aa, Xenorhabdus bovienii
  Peptide sequence Name=Xb4151_4152.C435.gene194.pep
MSFQGSRFWLHMYWVASSWLFSRLIVVTEFQFLLHRIGDVMISFSTPSFIAINTQNFYSLLLLSISLELESLYQ

SEQ ID NO: 8119 - protein, 33 aa, Xenorhabdus bovienii; identical to SEQ ID NO: 8101
  Peptide sequence Name=Xb4151_4152.C435.gene195.pep

SEQ ID NO: 8120 - protein, 43 aa, Xenorhabdus bovienii
  Peptide sequence Name=Xb4151_4152.C435.gene196.pep
LPLCSLYSLTPATQLSMFREIRSLAAATHIEIHRNIYSEAIPV

SEQ ID NO: 8121 - protein, 959 aa, Xenorhabdus bovienii
  Peptide sequence Name=Xb4151_4152.C435.gene197.pep
  Gene classification: Gene name=RhsA; Function=Rhs family protein; Function class=M Cell envelope biogenesis, outer membrane
  Homolog annotation: Query=64..406bp; Hit=429..761bp; Blast score=72; Percent Identity=24.0; E value=2e-12; Homolog= rhsD COG3209
VIQDTGERLRHDYDPATRTAQITLLAEGLRFGKTTVVYNVRHQPVTITRYDSQGQLYSQQIHHYDGLGRLRATIDELGQKTEYIYDLFSRVSAIKHSDGTVIRKNYAPFSAGNLLTQIEAGGHVLGTRDFDSLQRNISTSCGGRTYHYAYQGSNLYPSQSTDPLGHTVTHQYEPLLGNALTKVEAEGIEQRFSYDPKTGTMTQASASQIATHEMSYTASGQLSQTRYHFEDGQAGVARSVDYTYSPIGLMTDYKDVTEKKCHMRFDSFGRPIARRDLDIEIALIYDTASRVNSWTVHDKQHNQKLTITLSFDDFGREVNRQIRTKTDTLTLEQSYNVKGQVTCRSTRSQASGLLRQETYTYDPARSWLKEYHCTGSESPRDAYGFGIARQHFAYDVLGNIQTCVTILEDGSSDTATFTYSEADPCQLHGITHTHPGYPATITLAYDKAGRLIRDEVGRHLTYDALGRLTSVRLNAAISHYAYDAANCLVLQHIGTKKTYELYYQGATRVAEILRESGVATRLLHAHGETVATVTGPEVHLLGTDKHSSVLLSHKGDGAETRYRYSPYGQQAENERATGLPAYNGERLDPVWGTYHLGNGYRTYNPVLMRFTAPDNLSPFGAGGINSYAYCLNDPINRTDPSGHMSLGGILGIVFGTVGLAVGIVLAIPTGGASLSIGGAVLAGLGFAADATGIASVVTEDSDPHASAILGWVSMGFGVVSMGAGAISGLVTGMRRAGHRMITSFSHGMSGRRVPETQLIKHNEYTLTFQSMLNEDRVFQIENPVNSGAYTLSVDINGLDTNTILRLDRSGFEILSTNGATRMISNVYLVPSKPPVLLNITEDNYLNLYGQFIKSDTRYGSTSLINQSRHLQNLLRATGRHISDDLIRDMDFLWSHHRFRYDFNRWLHFEMLEKSNIIGEYMTEIRLQSSASDIFNSFVPNIAAIPVIPAIPAIPAIPGP

SEQ ID NO: 8122 - protein, 141 aa, Xenorhabdus bovienii
  Peptide sequence Name=Xb4151_4152.C435.gene198.pep
MMDLLAIKLPLTVITCNGDGLVTYIIYHGCFAKTQPFGQQGNLCSPGSRIIIMPETFPSILYHKISLSPVIIFKTLTGRDLRDRTSPLTDGQPVMTGYISLYAPRCHRPLQTPNASPVSPALSPVSPADKHAPVHQSGYRI

SEQ ID NO: 8123 - protein, 465 aa, Xenorhabdus bovienii
  Peptide sequence Name=Xb4151_4152.C435.gene199.pep
  Homolog annotation: Query=1..331bp; Hit=173..514bp; Blast score=248; Percent Identity=42.0; E value=2e-64; Homolog= gi|2950331|emb|CAA75844.1| hypothetical protein [Coxiella burnetii]
LLNIHYELGSYTRITVWPNTSESYDIQLLFNNEYMVSIQKGTAGQMLKWKMDYDTDNRFLTQVLSPTGLKEIVDYNSNGHQLPDNASLPALPYVTRHTQSPGNGSDIVRTYEYTNFNFLGYGAVGNWDRNEDYLYNILTDYQYGSTESWLEGKTQRHITRSYNNYHLLTSEVIQQNDCQRHHKTKYYAQIGVDFVDQLPQFQMPESAIVSFNEAANGENHQTQFDDSGNPTVQIAPDGTRTDWTYYPASGETGACPPDPHGFVRFVKSKTVTPGQCSPEGINEEAPVYKTIYRYAQLPARPGSPLSYAVVRTYQGIFSAGRLLLERQTHYVNEVASPHHGRLQRVDETVHSIQDGGQSWTSQQVFSYVLQGEALVQGIQWTGHDQLSIATQRTQSRSSGKLWHGMDAQGRTTRYHYDTFGRILKRINNEGTDYAREITYVYAIEDAGTVTTTQTDVWGNQMRYPL

SEQ ID NO: 8124 - protein, 96 aa, Xenorhabdus bovienii; identical to SEQ ID NO: 5468
  Peptide sequence Name=Xb4151_4152.C435.gene200.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 8125 - protein, 92 aa, Xenorhabdus bovienii; identical to SEQ ID NO: 6203
  Peptide sequence Name=Xb4151_4152.C435.gene201.pep

SEQ ID NO: 8126 - protein, 71 aa, Xenorhabdus bovienii; identical to SEQ ID NO: 6562
  Peptide sequence Name=Xb4151_4152.C435.gene202.pep

SEQ ID NO: 8127 - protein, 50 aa, Xenorhabdus bovienii
  Peptide sequence Name=Xb4151_4152.C435.gene203.pep
MIGEIQINPPIATYMSPARLSDLRRINYIFGVNGTSKTTISCVIGHVLNG

SEQ ID NO: 8128 - protein, 407 aa, Xenorhabdus bovienii
  Peptide sequence Name=Xb4151_4152.C435.gene204.pep
  Gene classification: Gene name=HsdS; Function=Restriction endonuclease S subunits; Function class=L DNA replication, recombination and repair
  Homolog annotation: Query=3..407bp; Hit=10..422bp; Blast score=116; Percent Identity=25.0; E value=5e-26; Homolog= hsdS COG0732
VSWPQAKLDDVISFIRGVTFKPDDLVEPLSSNSTVVMRTKNVQVEGLEQSDLIAIPSELVKRKEQALCEGDILISSANSWELVGKASYVPKLNYQATAGGFISIVRAKQRVIDSRYLYHWISSPSTQHRIRHCGRQTTNISNLDVGRFKDLEIPLPPLTEQKRIAAILDKAGAIRRKRQQAIQLANEFLRAVFLDMFGDPVTNPKGWEVRPLVDGIKSIISGWSAKGESYPCNEGEYGVLKISAVTSGKFNPQENKFVYEKDIPADKKLVFPKKGDLLFSRANTRDLVAATCIVPKDNNNVFLPDKLWNVKTSENILLPEYLNYLIWEPRFKGKLTSQATGTSGSMLNISKGKFETTDAIFPDLPLQKKFRSIYWRVQKYIDSLNASLDGCDASFSSLSQKAFSGEI

SEQ ID NO: 8129 - protein, 534 aa, Xenorhabdus bovienii
  Peptide sequence Name=Xb4151_4152.C435.gene205.pep
  Gene classification: Gene name=HsdM; Function=Type I restriction -modification system methyltransferase subunit; Function class=L DNA replication, recombination and repair
  Homolog annotation: Query=21..534bp; Hit=23..483bp; Blast score=165; Percent Identity=27.0; E value=1e-40; Homolog= Z5947 COG0286
MLTGQIRNDIDNLWGKFWTGGITNPLTVIEQISYLMFARMLDMQEDMAERKANRTGKDFDRLFPNTPEGQLLRWKNFKNLSGKELHKHLKQNVFPYFAKLGKKSDEQDGLGNDGSAIEALGHIGEYMQDADLEIKNESVLVSAVEMVDELPLTQSDVKGDIYEYLLSKLTTAGINGQFRTPRHIIDAMIELINPQPTDTVCDPACGTAGFLTRIMEYLNRVHSSEFGILEDDDGNKHYTGDLLEPYRDHINKKMFWGFDFDTTMLRVSSMNMALHGVNGANILYQDSLSKSIKENFPQQEENFFDVILANPPFKGSLDETNTNPDVLGLVKTKKTELLFVAHILRALKLGGRAAVIVPDGVLFGSSKAHQQLRQELIENNQLEGIVSLPSGVFKPYTGVSTAILMFTKGGSTERVWFYDLQTDSYSLDDKRTPLKGEGSNDLPEAIAKWKQYIALVERNALAKDINKAFGDKTQKAFVVDAKDIVDNKFDLSINRYKEVVYEEEAFEDPKTILNKLKTLESEIMADLDALEGML

SEQ ID NO: 8130 - protein, 40 aa, Xenorhabdus bovienii
  Peptide sequence Name=Xb4151_4152.C435.gene206.pep
LNSSLNDFLLFLIRLALRLAHCPVPCFPTGLALSLKPTHP

SEQ ID NO: 8131 - protein, 612 aa, Xenorhabdus bovienii
  Peptide sequence Name=Xb4151_4152.C435.gene207.pep
  Gene classification: Function=Uncharacterized BCR; Function class=S Function unknown
  Homolog annotation: Query=85..588bp; Hit=34..533bp; Blast score=436; Percent Identity=48.0; E value=1e-122; Homolog= PM1267 COG1322
MQSLEWTTKLMIIASVAGLVLAAFGYLLAMVLLGRKNTELNTQLQQADQALKLANTQNQKYQDELKQLGITLHEKELSESKLQTQQTNAKVTEQRLNDALAERKGELASLQKTLEELRGQHHSTEKQLETAQADNRALKEQAQDLRDRLEKCEQNVQQERTLVSQLKDELAQEGKKAKELEASNTEAREQLKDVKQTLVDQQQRYDQIQEHYQSLSNEYTELKTTLERKEEHFKEQMQQLSETKQSLTKEFENLANKIFEEKGKTFTHTSQASIDTMLKPFREQIEGFQKRINEVHDASLQGNTSLNAEIKKVLEIGLQMSKEANNLTSALKGDSQKRGAWGEAQLRRTLEMSGLMEEAHYEVQGSFRDAEGKQKQTDYLIKLPDGKHIIIDSKVALNAYDRAVGAESPEEYQLAMSEHVKAVRRHIDDLAFKDYTNLVGMRSPSFVLMFMPIEPAYIEALKDNKNLFEYGYKKGIVLVSHTTLIPILRTVSNLWMIERSNAEAREISEKAGDIYNSVCTVAERLSKLGGTLSTVSNHYNSTVKALVGQQGLYGKVDRFSQLSAKVSKSLPHLEAAHIDFETERLTLIVEPIDEQTKEQVKDPADEPMDELA

SEQ ID NO: 8132 - protein, 1146 aa, Xenorhabdus bovienii
  Peptide sequence Name=Xb4151_4152.C435.gene208.pep
  Gene classification: Gene name=HsdR; Function=Restriction enzymes type I helicase subunits and related helicases; Function class=L DNA replication, recombination and repair
  Homolog annotation: Query=1..749bp; Hit=5..861bp; Blast score=171; Percent Identity=26.0; E value=6e-42; Homolog= hsdR COG0610
MQVWTEYMDKIILMKSANFEFLRPENDFLANLGSFAEAVLHIDPGSALTRLRSFAEVLTKAIYKEELLPHMPQSNFYELIKNPVFEDCVSKSLIHQINFLRIQGNDTAHGAEGELRNAQMALGTAHQLAMYMGIKYYNKKKDQIPSFVDIKDPTATLNQLQKSVSSYEKELQKQQEELERVIEQLERERTRNIDKLEPPAKSDRQKRRQQSQLVADSLQWNEAKTRALLIDAMLLQAGWDIQNPDQVSHEFEVIFPNNPSGKGYVDYVLWGDNGHPLAVIEAKKSGNTNLQAGREQARLYADAFEHMGYQRPVIFYSNGYETFIWDDHQYNTYRPVYGFYSKDSLDYLIYQRHYRAAELEKFNPELSIADRPYQIEAIKTVAAHFQSQRRKALIIQATGTGKTRVAIALAELLLRTGWAKRALFLCDRKELRVQADDAFKQNLPSEPRCVIGETNKIDKSARIYIATYPGMMNRFSQLDVGFFDLIIADESHRSIYNKYRDLFDYFDALQVGLTATPVKFISRNTFDMFDCETTDPTFEFGLDAAINNEPPYLVPFRVKDLTTDFLRDGIHYNNLTEEQKRQLEEDLGEEEARNTTIAGKDIGRKIFSEDTDRIILENLINNGIKDETGSLVGKTIIFAQRQDHAEHLEELFCKLYPQYGTKVCKVIHNSIPHVESLIKEFKKADNEFRIAISVDMLDTGIDVPEVVNLVFAKPVKSWVKFWQMIGRGTRLRHNLFGPGKHKTEFLIFDHYANFAFFEEEYQEPEDTGGKSLLQTTFESRIELAQAALQRNHAAAFDAAIELLRADINDLPDTSIAVKRELRVVHQLQQTDLLKRFDAKTQHQLANHIAPLMSARVLRDKHATYLDKLMATIERCLVEQASCFDDGRELLLAELNKLAVNIQAVRQKDVVIAEVRSAEFWQNPTIDKLEKARKELRGIMKYRQTVSGGLYAIPATKTGDTGLQLKEREVTIAGANEAMIYRRRLKDILDQMIAANPTLQKIRKGESIAEPELKTLTSTILTSHPSVSLEVLNEFYGRTADQLHLTVREIIGLDSQAIEDHFKSFLHAHPTLTAQQVRFMNLLKNYIAQHGSIRIEKLYDAPFTSVSHEGIDGVFTADDVGELITVLKPFIKAEPKLLGSQPESTQE

SEQ ID NO: 8133 - protein, 522 aa, Xenorhabdus bovienii
  Peptide sequence Name=Xb4151_4152.C435.gene209.pep
  Gene classification: Gene name=AtoC; Function=Response regulator containing CheY-like receiver, AAA-type ATPase, and DNA-binding domains; Function class=T Signal transduction mechanisms
  Homolog annotation: Query=182..520bp; Hit=104..444bp; Blast score =243; Percent Identity=40.0; E value=5e-64; Homolog= PA4547 COG2204
LRLWINFAAYLNVRWLICWSSRMCKAKPHTLVSWIGGNDLKATGSTGADGQALGPIAATLTAQAFDAVELLYNYPEDQVRSYLAWLQELVTTPICAHAISLSSPVNFGEIYVQANQQLSKLTVEGCELSLLLSPGTPAMQAVWILLGKTHYPCQFYQSSLEQGVQQVDIPFEVSAEYLPAAKSIDSAKISQLAEASAPINAAFDNIVTRNPRMQSLKAQAQILAEREVPVLIYGESGTGKELFARAIHNASHRANKPFVPVNCGAIPTELVDSVLFGHKKGAFTGALADKAGLFEQANGGTLFLDEFGELEPSIQVRLLRVLQEGTFIPVGGTKEQKVDVRLITATHRNLIEAVSNGSFREDLFYRVAVGVLHLPPLRERDGDLSLLADSLVKAMSIHDSMLRHKKISPDAKNLILQCPWRGNVRELQSTLLRAALWCQGDDITAADIRQALFHMPEPETGLMNMDISQGIDIQCIIGSVAATYIRKALDHSGQNKTRSAQLLGLKNYQTLNNWMEKYGISQ

SEQ ID NO: 8134 - protein, 69 aa, Xenorhabdus bovienii
  Peptide sequence Name=Xb4151_4152.C435.gene210.pep
MIRCHLARLMGERKMKISDVLRETGLSRNTVTLMYKESAQKIDIEALDKLCRLFECEVADMLEFTDVQG

SEQ ID NO: 8135 - protein, 92 aa, Xenorhabdus bovienii
  Peptide sequence Name=Xb4151_4152.C435.gene211.pep
  Homolog annotation: Query=1..89bp; Hit=150..238bp; Blast score=116; Percent Identity=62.0; E value=1e-25; Homolog= Pa|Phot2-74c09.q1k _g4| 1777 - 2502 295 241 aa, chain -
MKTEGITLITHVRRNMKAKFLSLWDRVMLRTRFLIETVNDQLKNISQIEHSRHRSVVGFLLEVVSGLIAYTFQPKKPSLGLRDSEIGMLKQN

SEQ ID NO: 8136 - protein, 56 aa, Xenorhabdus bovienii
  Peptide sequence Name=Xb4151_4152.C435.gene212.pep
LGCLNKTEVFQIEHSRHRSQLGFLLEVAAGLIAYIFQPKKPSLNLRDNEIAIFKRS

SEQ ID NO: 8137 - protein, 796 aa, Xenorhabdus bovienii
  Peptide sequence Name=Xb4151_4152.C435.gene213.pep
  Gene classification: Gene name=AprE (BS); Function=Subtilisin-like serine proteases; Function class=O Posttranslational modification, protein turnover, chaperones
  Homolog annotation: Query=258..565bp; Hit=151..415bp; Blast score=60; Percent Identity=25.0; E value=7e-09; Homolog= BS_aprX COG1404
MTEQYKHLSIAKESLQNPRRTRQFNIPRTPRADLRLHGSMLSEQLRGITQLATPQIPGKDNDGRYMLKLQYTGMLDIAHLDRHGIEFVSQEDKTICIAFADERGIALFEEHLSQLGHGHITYQQILTALDSVDVWSSEDRKSWSVRHYGFPELESFGLDVELWPIETTRHPSRERICEEFENWLQENMIHRLDRINLDSLLMYRVRVNCEQAEKLLAHRDVRMVDLLPSSGISYEKLNRDINVIPAHIPSPSPDAAKVCILDSGINTAHPLLRSAIAESASFVVNEDEFDHCGHGTAVAGIALYGDVEACDASNFWQPSVWLYNGKLLNSQGEFDTSTIETTLTEAVEYFVDLGCRIFNLSLGNANAPYDGKHIRGIAYVLDVLARRHNILFVVSAGNFSGSSDPDVPQESWRAEYPSYLIHNSSVIIDPAPALNVLTTGSYARHNATFDAQRRADEISHLSPAGEFQPSPFTRHGPSVKGAFKPEIVAHGGNFAVPMRNDGGQWREHAKGLGVLSCHHQFQGSTFFSEQSGTSFSAPYITHLAGRLLNEYPDMSANMLRAMLVNHAVLTPQMENTFSEEVVECYKAESATRNRSIIRDVVGYGVVEEDSLYRSSEEVVVMMCDEQIVNNTHQFFELPLPASFLRTQRAVRELHITLAYSPAVRTTRLDYAATQISYRLIKGTSLQDVQQYFNHDVQDGTKSRNDDAASNRSVTAQQRDHCTVQSSSWTFKRRSPDEKWFVVVTRNDREWGAPLNSQHESYALVVTATDRENAEANLYAEIEARIREQERSRARVS

SEQ ID NO: 8138 - protein, 328 aa, Xenorhabdus bovienii
  Peptide sequence Name=Xb4151_4152.C435.gene214.pep
  Gene classification: Gene name=SpoVK (BS); Function=ATPases of the AAA+ class; Function class=O Posttranslational modification, protein turnover, chaperones
  Homolog annotation: Query=100..317bp; Hit=171..396bp; Blast score =134; Percent Identity=37.0; E value=1e-31; Homolog= AF0477 COG0464
MANGKVLRQLIKAGATGDVATFRRVSEVIIEEERQKQHHLLANDLEHILYGDHTIQTSRVPAAPQMPVDKERGLPLLDIKQPSRSLNEIVLPESSSDAIEEILEENRRADVLRSYGMKAVSKVIFFGPPGCGKTLAAEVVACELDMPLAIVRLDTLVSSYLGETAANLRQIFDFISQYPMVVLFDEFDAIGKERGDSGDHGELRRVVNAVLQMMDAYQGKSLILAATNHEHILDSAIWRRFDDAIEFPLPDKHQLLELMKLKLRGIRRQFELEDDAVLSLFIGKSGADLERIVRRAIKRMILRSQEFLTLKDLKNALLRENVNKTRQG

SEQ ID NO: 8139 - protein, 78 aa, Xenorhabdus bovienii
  Peptide sequence Name=Xb4151_4152.C435.gene215.pep
MLFLSFFLNDHFRNTTEGRDITCRPSFYKLSENLTVCHFFPPTNQCAQNLAFSLASPHPYKKLALPRFFELLQLFSAF

SEQ ID NO: 8140 - protein, 32 aa, Xenorhabdus bovienii
  Peptide sequence Name=Xb4151_4152.C435.gene216.pep
LCQADITHINLRGERLKYRTFRSFLLKSRKKL

SEQ ID NO: 8141 - protein, 55 aa, Xenorhabdus bovienii
  Peptide sequence Name=Xb4151_4152.C435.gene217.pep
MPTVFIWTSRNIQLFSVTQFVANFASQSYIRRLAIIPIYCAMVKSEPCLLIRLTD

SEQ ID NO: 8142 - protein, 94 aa, Xenorhabdus bovienii
  Peptide sequence Name=Xb4151_4152.C435.gene218.pep
  Gene classification: Function=Transposase; Function class=L DNA replication, recombination and repair
  Homolog annotation: Query=1..81bp; Hit=251..329bp; Blast score=69; Percent Identity=48.0; E value=6e-13; Homolog= PA2319 COG3547
LVPRQASSGGKTQLGKITKNSNRYLRCILIHGARAAMQRRTLRHDALGDWMQSLVNRRGFNKACVAYANKCKCARICWSIMVNNDVFQVSKAFA

SEQ ID NO: 8143 - protein, 255 aa, Xenorhabdus bovienii
  Peptide sequence Name=Xb4151_4152.C435.gene219.pep
  Gene classification: Function=Transposase; Function class=L DNA replication, recombination and repair
  Homolog annotation: Query=31..255bp; Hit=10..235bp; Blast score=142; Percent Identity=39.0; E value=4e-34; Homolog= PA2319 COG3547
MMMRLNEFLAKLIIPNHHAVQITFTKRQHALAKSIFQLCLLDGNHVVFNKKVTRNRLLDAVRQMESGTLVAMEACSTAHYWGRMVGHLGFEVCLIPPQHVKAFVKNHKNDANDALAICEAANRPDMNFVPVKNLSQQDLCALHHVRQSLVQKRVATSNQIRGLAAEYGIVFPQRSAALRQSLYEALEDASNGLTVIARRILKQLYEDWLILLQRTEEIEETLKLLSSQTAQWQQLQSIPGIGSLITSAFIAYVGD

SEQ ID NO: 8144 - protein, 253 aa, Xenorhabdus bovienii
  Peptide sequence Name=Xb4151_4152.C435.gene220.pep
  Gene classification: Function=Predicted transposase; Function class=L DNA replication, recombination and repair
  Homolog annotation: Query=1..248bp; Hit=1..247bp; Blast score=177; Percent Identity=38.0; E value=1e-44; Homolog= mll8100 COG3293
MLRTMLTDPVWDKLSALMQHTGLVYHKAEHRLILEGILYRMRTGIPWRDLPLEFGRWNTVFVRFNAGSKKGVLNLIFKGLSGLADREWLFIDGSIVRAHQHSAGAATNEEEAIGKSRGGRSTKLHLAVDSQGLPVHFELSGGQTHDIKQAESLVNNSPASDFVIADKGYDSDAFRNIVEQTGATPVIPYRKNSRKSEKPIDKGLNRYRHLVENAFARIKHFRAIATRYDKLERNYASMLALAFTLVWLPMWAD

SEQ ID NO: 8145 - protein, 36 aa, Xenorhabdus bovienii
  Peptide sequence Name=Xb4151_4152.C435.gene221.pep
MLFHFGTIDAMWDVHLIRLGCAQIIDSVISSLIWYN

SEQ ID NO: 8146 - protein, 43 aa, Xenorhabdus bovienii
  Peptide sequence Name=Xb4151_4152.C435.gene222.pep
MVTGEDVIFGRCITRILRVNKLYWSTQGLLLWSLEYEQSNLEF

SEQ ID NO: 8147 - protein, 305 aa, Xenorhabdus bovienii
  Peptide sequence Name=Xb4151_4152.C435.gene223.pep
  Homolog annotation: Query=1..301bp; Hit=1..301bp; Blast score=328; Percent Identity=57.0; E value=7e-89; Homolog= gi|16763053|ref|NP _458670.1| hypothetical protein [Salmonella enterica subsp. enterica serovar Typhi] gi|29144536|ref|NP_80787
MAQGSTRSKVEQFRKAFITHARQAGGSFVTVADRERMARQFLDYLKNNGIKLRQMDSLKVKYIERYMAERKANNLSHRTLQNEMSVLRAILAQAGKHKLVDPDNARLSNRALGIADTSRKGTKMALAPAAFRDIFQQVEQKDRSVAAVMQLEYVLGLRTKEAVEAYKSLATWKKALENGHTSVRVVFGTKGGRSRQTTILDRAALQHAIAYAEQEQAGHSGKLIDKPTITQAIDRYRYIVRRAGLSGNKAPHSMRYHFAQQSGEHYIAQGFSEREALALVSMDLGHGDGRGRYIRQVYYQNIEGE

SEQ ID NO: 8148 - protein, 47 aa, Xenorhabdus bovienii
  Peptide sequence Name=Xb4151_4152.C435.gene224.pep
MTIVYQSNNRVVNGLFLVVSLSNAGFKSVVKPDRTCSGRWPLCGVTW

SEQ ID NO: 8149 - protein, 68 aa, Xenorhabdus bovienii
  Peptide sequence Name=Xb4151_4152.C435.gene225.pep
VLFTTGLSRNTGRAFFASFRKTLTCVLNTDNKRPDLCTAIARKDQRASMISASTVMRGHLRNSAEITK

SEQ ID NO: 8150 - protein, 54 aa, Xenorhabdus bovienii
  Peptide sequence Name=Xb4151_4152.C435.gene226.pep
MYRNLALPCRLREFCFRHSEEVILAGDQITGSHIQDGSLCIRPGQMSLLSSLTN

SEQ ID NO: 8151 - protein, 31 aa, Xenorhabdus bovienii
  Peptide sequence Name=Xb4151_4152.C435.gene227.pep
LRFDVECPAYTLFSLRKISLSEMIKGTFDPA

SEQ ID NO: 8152 - protein, 140 aa, Xenorhabdus bovienii
  Peptide sequence Name=Xb4151_4152.C435.gene228.pep
MTNTDKKDKSKKSQKQSSHFIPYKTTYDLRLNKREPNLINILMQIQGYEYGFLTVLGVRPLSQRGNHKNSAIYVVRCRCGKYAVRTLKAIRNPANVTDMCEHCLHLYNLRCRNLFLTEGKEVGLSELTGIKYKKTLEIKE

SEQ ID NO: 8153 - protein, 75 aa, Xenorhabdus bovienii
  Peptide sequence Name=Xb4151_4152.C435.gene229.pep
VAITAIDINFGHTSSLKSRKHITATNHLIHDPMVEPIEASPFMIMKINRAGPGLPIQFGFFAIELIMKAVKLEHL

SEQ ID NO: 8154 - protein, 124 aa, Xenorhabdus bovienii; identical to SEQ ID NO: 7388
  Peptide sequence Name=Xb4151_4152.C435.gene230.pep

SEQ ID NO: 8155 - protein, 96 aa, Xenorhabdus bovienii; identical to SEQ ID NO: 5468
  Peptide sequence Name=Xb4151_4152.C435.gene231.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 8156 - protein, 302 aa, Xenorhabdus bovienii
  Peptide sequence Name=Xb4151_4152.C435.gene232.pep
  Homolog annotation: Query=1..294bp; Hit=120..418bp; Blast score=190; Percent Identity=39.0; E value=3e-47; Homolog= Pa|Phot3-163e06.p1k _g25| 30856 - 32115 701 419 aa, chain -
MTQKVTLDSIRALQAAMEGKLDKSQSGADIPNKPEFVKNLGLGNALKVGDYGVGSNNLSNKIAGYLWDVGGNQPSGFYGYSPSSHKDEVWGSFIKLRWNDGNQQYLVFPNFGGNAMRIVRFSGGNSWSDYTVWTTGNADFDGNGFLKKTSPIIQIHPDGTFTTNDESEGATVTRLGLGHYKLSGILGYNSDGAWGVHGGISVPRDVNGNELVYVDDKVLPDGAIEIRVTHRQNAHMPARLQNRRIKSQDEQTHYTDDEACDLPAGTRLDVRVQMPEDSIWNQKQVLAPDPQQEYSVTSVVNK

SEQ ID NO: 8157 - protein, 129 aa, Xenorhabdus bovienii
  Peptide sequence Name=Xb4151_4152.C435.gene233.pep
  Homolog annotation: Query=1..127bp; Hit=1..123bp; Blast score=140; Percent Identity=57.0; E value=4e-33; Homolog= gi|37528189|ref|NP _931534.1| hypothetical protein [Photorhabdus luminescens subsp. laumondii TTO1] gi|36787626|emb|CAE16733.1|
MKILLSIKPEFVEKILEGTKKYEFRKGIFKNSSVKSVVIYATKPVGKVVGEFNIEHILEDTPSSLWRITKQNSGISKIFFDEYFKRRNKAFAIQIGYVQKYDYPISLDELSEQLGKRITAPQSYCYLPN

SEQ ID NO: 8158 - protein, 301 aa, Xenorhabdus bovienii
  Peptide sequence Name=Xb4151_4152.C435.gene234.pep
  Homolog annotation: Query=1..299bp; Hit=72..369bp; Blast score=231; Percent Identity=42.0; E value=1e-59; Homolog= gi|34335034|gb|AAQ65009.1| unknown [synthetic construct]
MYLKIEHGIIDDVTPPISLGKHLKIGTFKFNPKGTLRGQRFLKKIFDNALSYGVDDIYVTVFEEHNYLIRLFKLYGFNECAIKETENGKEIVLLKCMKDTCSTGDVLSDYPFILNTDKQNKFLLAIYPEFHTNLFPDSRLITESPDILKDISHTNSIRKVYICGMKGVLSLKPYDILVIYRTSDGRSAAYYNSVVSSICVVENVQNITNFSSEDAFIDYCIKYSVFTKEQLQAFYIHKKYPFIITFTYNLALPKRLNRASLIENVGLDPNDRWGILRLTDEQFHRIITLSETDENIIIDKA

SEQ ID NO: 8159 - protein, 33 aa, Xenorhabdus bovienii
  Peptide sequence Name=Xb4151_4152.C435.gene235.pep
MDLLHGFTRNQIVPLSKLTFCSMKMKKLMALCI

SEQ ID NO: 8160 - protein, 42 aa, Xenorhabdus bovienii
  Peptide sequence Name=Xb4151_4152.C435.gene236.pep
MLIRKCLICEIMDIINSLRDQLYAINLKMRVLKSGSYQSTEW

SEQ ID NO: 8161 - protein, 349 aa, Xenorhabdus bovienii; identical to SEQ ID NO: 5796
  Peptide sequence Name=Xb4151_4152.C435.gene237.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 8162 - protein, 64 aa, Xenorhabdus bovienii
  Peptide sequence Name=Xb4151_4152.C435.gene238.pep
MSPAFNNNGDEVRLAVILRENNDLAGEIMLRLTNKESQQGEIYPSSLKMLDFSFVSDHDCAHEN

SEQ ID NO: 8163 - protein, 63 aa, Xenorhabdus bovienii
  Peptide sequence Name=Xb4151_4152.C436.gene1.pep
  Homolog annotation: Query=1..47bp; Hit=68..115bp; Blast score=86; Percent Identity=87.0; E value=9e-17; Homolog= gi|22124244|ref|NP _667667.1| hypothetical [Yersinia pestis KIM] gi|21957009|gb|AAM83918.1|AE013632_6 hypothetical [Yersinia pes
MSGSALLSHGETPHYHRRYGVSLLSSAWDQVGPPRYGRQTNSVFNPEQAAVFHLKLRLSLSAS

SEQ ID NO: 8164 - protein, 221 aa, Xenorhabdus bovienii
  Peptide sequence Name=Xb4151_4152.C436.gene2.pep
  Gene classification: Gene name=GntR (BS); Function=Transcriptional regulators; Function class=K Transcription
  Homolog annotation: Query=9..150bp; Hit=39..179bp; Blast score=68; Percent Identity=29.0; E value=4e-12; Homolog= mlr7144 COG1802
MTMKKENSPQILSKKIAETIRNKLVIGELLPGQRLSEAILSEQLEISRNTLREVFRVLTQEGLLKHQPNRGVFVAIPDIASIIDIYQVRRLIECQALTQAYSMHPSVAKMKEAVTSAQLYRNNQNWVGVGTANMHFHTAIVELTDSKRLITFYRNISAELRLAFGLLNDPELLYAPYIDKNAHILELLDSGQTELAAKKMKDYLELSERTVLAAYTRKNNE

SEQ ID NO: 8165 - protein, 44 aa, Xenorhabdus bovienii
  Peptide sequence Name=Xb4151_4152.C436.gene3.pep
VIKVQYRSLFQHQLSRKVPRCIISVQYIPYNNPMSVTCWLSGNM

SEQ ID NO: 8166 - protein, 416 aa, Xenorhabdus bovienii
  Peptide sequence Name=Xb4151_4152.C436.gene4.pep
  Gene classification: Gene name=PutP; Function=1 Na+/proline, Na+/panthothenate symporters and related permeases; Function class=E Amino acid transport and metabolism
  Homolog annotation: Query=23..406bp; Hit=1..377bp; Blast score=306; Percent Identity=50.0; E value=3e-83; Homolog= BH1820 COG0591
MAIQETVKQETVNFVVNRRSSLMAAVFLMATSAIGPGFITQTATFTATMGAAFAFGILASILIDFVVQQNIWRIVTLTKMQSADIANAAIPGSGYLLAALVMFGGLVFNVGNIAGAGLGLNALIGLEPKWGGLLSALMAIYIFASRRAGVAIDRIIVVLGVVMIGLTLFVAIVSNPPVGEALRQTVLPDDINFATITTIVGGTVGGYICYAGAHRLLDKGMTGVENIDAVSSAATKGILAVGLMRYFLFLAILGVVASGVTLDIASETANPASQAFQVVAGEFGLRIFGLILWSAAITSVIGAAYTSISFARVFKKQLTDRHLNIITLCFITLSLAVYLLIGTPPAALLVFAGGFNGLILPLGLTIFVYVGWKRADLMGGYHYPRWLLWSGVVTCVLTWYMGAMSISSIFAFLKAA

SEQ ID NO: 8167 - protein, 255 aa, Xenorhabdus bovienii
  Peptide sequence Name=Xb4151_4152.C436.gene5.pep
  Gene classification: Function=Uncharacterized proteins, homologs of lactam utilization protein B; Function class=R General function prediction only
  Homolog annotation: Query=5..252bp; Hit=4..251bp; Blast score=271; Percent Identity=55.0; E value=6e-73; Homolog= ML0333 COG1540
MIKAIDLNSDLGESFGQWKMGNDAKMLGIVSSANVACGFHAGDPVGILQTLKSAKENQVAIGAHISYPDLVGFGRRNMDIASHELTADVIYQIGALQGLALAAGTSVRYVKPHGALYNTIANNERQALAVIEGILVIDPNLALVGLAGSNILRLAQEKGLKTIAEAFADRAYTAEGELVSRREAGAVLHDVNLVAQRMLQLVTEGGVDSIDGKFTPIKADSICVHGDSPGALDMAKQVKKVLQQAGITIQSFIHA

SEQ ID NO: 8168 - protein, 532 aa, Xenorhabdus bovienii
  Peptide sequence Name=Xb4151_4152.C436.gene6.pep
  Gene classification: Gene name=DUR1; Function=Allophanate hydrolase subunit 2; Function class=E Amino acid transport and metabolism
  Homolog annotation: Query=229..517bp; Hit=8..287bp; Blast score=186; Percent Identity=41.0; E value=7e-47; Homolog= ML2550 COG1984
LRFLLVNFNTILVELSGLPETLALFDSLSIVPVLGIEEIIPAARTLMIRFRPTKISIHQLVAEIGHRDLHECSHPQGKQIEIPVHYNGDDLAEVAEILGCTAQDVIRQHTENEYTVAFSGFAPGFAYMVSDMAQWNIPRRQTPRTRIPAGAVALAGEFSGIYPQASPGGWQIIGITTERMWDLSRPDPALLQPGYRVNFRDAGRATVTVSLSETSRTNPVFQSETSRYLEIRSVGLQTLFQDLGRFGKSGLGISESGAMDKSALRSANRIVGNSSEQACLEIVQGGFKAVACGQMMVAVTGALCPIEIKTPQGELIHVSAYKPIDLSDGDEIILGRPDAGTRSYLAVRGGFTIPSVLSSRSFDTLSHIGPEPLKAEDKLVVGTTSHCAAVSFSETLAFVMPNKNEIVVLDVLLGPRTDWFTQESIDLLRNQIWQVTPQSNRIGLRLNGECSLSRIKCQELPSEGTCAGAIQIPASGQPVLFLSDHPLTGGYPVIASVAHYHLDLAGQIPVNAKIRFNPIIQFHELSGSEDLR

SEQ ID NO: 8169 - protein, 592 aa, Xenorhabdus bovienii
  Peptide sequence Name=Xb4151_4152.C436.gene7.pep
  Gene classification: Gene name=AccC; Function=Biotin carboxylase; Function class=I Lipid metabolism
  Homolog annotation: Query=14..459bp; Hit=11..457bp; Blast score=558; Percent Identity=64.0; E value=1e-159; Homolog= ML0726_1 COG0439
MNTIVNNVNKNPNKVLIANRGEIAVRIIRACRDYGVQTIAVYADADINAQHVQLADEAYGLSGNSPAATYLNIPRLLAIAKQSGATMVHPGYGFLSERAEFARAVMDAGLIWIGPNPETIDELGDKVNARKIAHKVGAPLVVGTSEPVKDAQEVVAFAEEHGLPIAIKAAFGGGGRGLKVAWRLDEVAELYHSAVREATAAFGRGECFIEQFLDKPRHIEAQIIADKQGHVVVVGTRDCSLQRRNQKLVEEAPAPFLTQQQRERIHQAAKAICAEANYVGAGTVEFLLSADGTLSFLEVNTRLQVEHPVTEETAGIDLVIEQLRIAEGHPLSIQETPVPRGHSFEFRINAEDAGKGFLPMSGVISEFTPPSGPGIRLDSGVISGSTIPATLDSLMAKLIVTGTTREQAISRARRALREFRIRGVASVLPFHQAVMEHPDFVSDEIFNVHTRWIETDFANEIEALPRQIVTEDNSITRTYIEIDGRRHELGLSADLFAGFSHLAPVREQQSSQSAIKEKMPADSRQVKAPISGILHSWIVKEGEQVNEGELIAVMEAMKMEVQINAHRAGKITFCVQAGDYQDAESTLAHIEY

SEQ ID NO: 8170 - protein, 77 aa, Xenorhabdus bovienii
  Peptide sequence Name=Xb4151_4152.C436.gene8.pep
  Homolog annotation: Query=3..61bp; Hit=3..61bp; Blast score=69; Percent Identity=62.0; E value=2e-11; Homolog= gi|11139509|gb|AAG31733.1|AF264949_1 unknown [Erwinia amylovora] gi|11139516|gb|AAG31737.1|AF264951_1 unknown [Erwinia amylovora]
LVKTISQKVARESLGFPEFFEGGVYVTKNGVSELFVQTANERDAELQERVLERQVHALLKLINTEALYRHQILHSLQ

SEQ ID NO: 8171 - protein, 117 aa, Xenorhabdus bovienii
  Peptide sequence Name=Xb4151_4152.C436.gene9.pep
  Gene classification: Gene name=FrdD; Function=Fumarate reductase subunit D; Function class=C Energy production and conversion
  Homolog annotation: Query=1..117bp; Hit=2..119bp; Blast score=157; Percent Identity=72.0; E value=2e-39; Homolog= frdD COG3080
MNQRPKRSDEPIFWGLFGAGGMWSAIVGPAMVLLLGFLIPLGLAPEALSYDRVLTFCQSFIGRIFLLLMISLPLWCGMHRLHHGMHDLQIHIPASKGVFYGTAAILSVVALIGVFTL

SEQ ID NO: 8172 - protein, 137 aa, Xenorhabdus bovienii
  Peptide sequence Name=Xb4151_4152.C436.gene10.pep
  Gene classification: Gene name=FrdC; Function=Fumarate reductase subunit C; Function class=C Energy production and conversion
  Homolog annotation: Query=7..137bp; Hit=1..131bp; Blast score=178; Percent Identity=73.0; E value=2e-45; Homolog= frdC COG3029
MREERVMTTKRKPYVRGMESHWWHKLSFYRFYMIREGTAIPAIWFSLLVLYGLFALKDGPESWAGFVSFLQHPAVLVINIITLLATLLHTKTWFELAPKALNIIVKNEKMSPEPIIKLLWAITIIATAVILGVALFY

SEQ ID NO: 8173 - protein, 260 aa, Xenorhabdus bovienii
  Peptide sequence Name=Xb4151_4152.C436.gene11.pep
  Gene classification: Gene name=FrdB; Function=Succinate dehydrogenase/fumarate reductase Fe-S protein; Function class=C Energy production and conversion
  Homolog annotation: Query=17..260bp; Hit=1..244bp; Blast score=447; Percent Identity=85.0; E value=1e-126; Homolog= frdB COG0479
MVVKPQHKINNRRSRRMAEMKNLKMEVMRYNPEIDSEPHFVTYEVPYDEQTSLLDALGYIKDNLAPDLSYRWSCRMAICGSCGMMVNRVPKLACKIFLRDYPQGMKIEALGNFPIERDLVVDMTHFIESLEAIKPYIIGNDRKPADGPNVQTPAQMAKYHQFSGCINCGLCYAACPQFGLNPEFIGPAAVTLAHRYNLDNRDHGKKERMPQINSDNGVWSCTFVGYCSEVCPKHVDPAGAIQQSKAESAKDFLISMLKPQ

SEQ ID NO: 8174 - protein, 609 aa, Xenorhabdus bovienii
  Peptide sequence Name=Xb4151_4152.C436.gene12.pep
  Gene classification: Gene name=SdhA; Function=Succinate dehydrogenase/fumarate reductase, flavoprotein subunits; Function class=C Energy production and conversion
  Homolog annotation: Query=12..594bp; Hit=1..583bp; Blast score=997; Percent Identity=83.0; E value=0; Homolog= frdA COG1053
LNHPLEQWRSAVQTFNADLAIIGAGGAGLRAAIAAAEANPQLKIALISKVYPMRSHTVAAEGGSAAVTQSHDSYDFHFNDTVSGGDWLCEQDVVEYFVKHCPTEMIQLEQWGCPWSRKEDGSVNVRRFGGMKIERTWFAADKTGFHMLHTLFQTSLKYPQIQRFDEHFVLDILVDEGQVRGLVALNMMEGTKVQIRANAVIMATGGAGRVYRYNTNGGIVTGDGMGMAFRHGIPLRDMEFVQYHPTGLPGSGILMTEGCRGEGGILVNKDGYRYLQDYGMGPETPLGQPENKYMELGPRDKVSQAFWHEWQAGRTIATPRGDVVHLDLRHLGEKKLLERLPFICELAKAYVGVDPVKEPIPVRPTAHYTMGGIETNPQCETRIKGLFAIGECASVGLHGANRLGSNSLAELVVFGRLAGEEAVRHIQQTTPANENALDAQARDIENKLNKLLNQKGIESWAKIRDELGISMEEGCGIYRTPELMQKTMDKITELKERFRHIEITDRSSVFNTDLLYTIELGFGLDVAECMAHSAMNRKESRGAHQRLDAGCTERDDENFLKHTLAFYNPEGAPRLEYSDVKITISKPAKRVYGGEAAAQDKQQKEQANG

SEQ ID NO: 8175 - protein, 55 aa, Xenorhabdus bovienii
  Peptide sequence Name=Xb4151_4152.C436.gene13.pep
MILLIFIIRIISYINNLKNHRKVIYITLFWQNPTKPAFISNLLSLQLAILNPYKK

SEQ ID NO: 8176 - protein, 48 aa, Xenorhabdus bovienii
  Peptide sequence Name=Xb4151_4152.C436.gene14.pep
MFTKKLFFMSRCFPHEGQGYSVHFYSGEWQVKMIFTNLMLKICLVDLI

SEQ ID NO: 8177 - protein, 325 aa, Xenorhabdus bovienii
  Peptide sequence Name=Xb4151_4152.C436.gene15.pep
  Gene classification: Function=Truncated, possibly inactive Class II lysyl-tRNA synthetase; Function class=J Translation, ribosomal structure and biogenesis
  Homolog annotation: Query=1..320bp; Hit=11..330bp; Blast score=514; Percent Identity=78.0; E value=1e-146; Homolog= yjeA COG2269
MNEVTDWQPSAPIANLLKRAKILAEIRRFFADRGVLEVETPTMGQATITDIHLVPFQTRFVGPGAADGLTLYLMTSPEYHMKRLLTAGSGSIYQMGRSFRNEEAGRHHNPEFTMLEWYRPHYDMYRLMNEVDDLLQQILECESAESLSYQQVFIRYLEIDPLTASKEKLREVAAKLDLSNIADQEEDRDTLLQLLFTMGVETHIGLEKPTFIYHFPASQASLAEISKEDHRVAERFEVYFKGMELANGFRELTDSHEQRLRFVQDNRKREAMGLPVMPIDERLLKALEHGMPECAGVALGVDRLIMLALGAERISEVIAFPAGIS

SEQ ID NO: 8178 - protein, 47 aa, Xenorhabdus bovienii
  Peptide sequence Name=Xb4151_4152.C436.gene16.pep
LPFLLGFPDATISVRGFLSNDFIAEGAASGCTFIALHLSNCSAVAAI

SEQ ID NO: 8179 - protein, 363 aa, Xenorhabdus bovienii
  Peptide sequence Name=Xb4151_4152.C436.gene17.pep
  Gene classification: Gene name=UgpQ; Function=Glycerophosphoryl diester phosphodiesterase; Function class=C Energy production and conversion
  Homolog annotation: Query=12..358bp; Hit=11..357bp; Blast score=561; Percent Identity=77.0; E value=1e-160; Homolog= ZglpQ COG0584
MWRTPMQTPIKAIMAGLLLASSMSGIAHAADKIVIAHRGASGYLPEHTLPAKAMAYAQGADYLEQDLVMTQDNELIVLHDHYLDRVTDVAERFPNRARADGRYYAIDFTLPEIKSLRFTEGFDIEGGKKVQSYPGRFPMGKSDFSIHTFQEEIEFIQGMNKSTGKNIGIYPEIKAPWFHHQEGKDITAKVLEVLKQYGYTKKSDKVYLQCFDANELKRIKNELEPKMGMDLKLIQLIAYTDWKETYEQKQDGSWVNYSYDWMFKPGAMKEVAKYADGIGPDYHMLIANDSTPNNIKLTGLVQEAHASHLAVHPYTIRVDQLPKYATSGNQLFDIVFDKANVDGAFTDFPDLAVKFLEKRHEHK

SEQ ID NO: 8180 - protein, 51 aa, Xenorhabdus bovienii
  Peptide sequence Name=Xb4151_4152.C436.gene18.pep
LNNHHILLAVLKKQAKKITSFLFKIFITIHYYKCGELQCKPLSKPSWQVCC

SEQ ID NO: 8181 - protein, 47 aa, Xenorhabdus bovienii
  Peptide sequence Name=Xb4151_4152.C436.gene19.pep
LGLAINFSSNRSIRSSTAVNFTCYYRLCGGNLLASYTSDFLLMFILA

SEQ ID NO: 8182 - protein, 451 aa, Xenorhabdus bovienii
  Peptide sequence Name=Xb4151_4152.C436.gene20.pep
  Gene classification: Gene name=UhpC; Function=Sugar phosphate permease; Function class=G Carbohydrate transport and metabolism
  Homolog annotation: Query=1..445bp; Hit=1..445bp; Blast score=766; Percent Identity=88.0; E value=0; Homolog= ZglpT COG2271
MLSIFRPAPHKARLPAQEIDPLYRRFRWQIFMGIFFGYAAYYLVRKNFGLAMPHLAEQGFSKGDLGFALSGISIAYGISKFIMGSVSDRSNPRIFLPAGLILAAAVMLFMGFVPWATSSIAVMFVLLFLCGWFQGMGWPPCGRTMVHWWSQKERGGIVSIWNCAHNVGGGLPPLLFMLGMAWFQDWKAAFYMPAFAAILVAIIVFSLMRDTPQSCGLPPIEEYKNDYPPDYTDKNEKELTAKEIFLQYILPNKLLWMIAIANVFVYLLRYGILDWSPTYLKEVKHFAMDKSSWAYFLYEYAGIPGTLLCGWMSDKVFRGNRGATGVFFMTLVTIATIVFWLNPAGNPNIDMICMLVIGFLIYGPVMLIGLHALELAPKKAAGTAAGFTGLFGYLGGSVAASIIVGYTVDFFGWDGGFMVMIGGSALSVVLLLFVMLSENKHKQEIARIASQ

SEQ ID NO: 8183 - protein, 30 aa, Xenorhabdus bovienii
  Peptide sequence Name=Xb4151_4152.C436.gene21.pep
MTFGVSELPSLSDDDVKRRIFINYFLYRRK

SEQ ID NO: 8184 - protein, 32 aa, Xenorhabdus bovienii
  Peptide sequence Name=Xb4151_4152.C436.gene22.pep
MKFYAIYFYDSVECRHKVFAISEYRRKLNIND

SEQ ID NO: 8185 - protein, 47 aa, Xenorhabdus bovienii
  Peptide sequence Name=Xb4151_4152.C436.gene23.pep
LSSGENVCSVNAVCNIALCVCVFIMMFSFCLPFYFITFYDEWRHQCC

SEQ ID NO: 8186 - protein, 1078 aa, Xenorhabdus bovienii
  Peptide sequence Name=Xb4151_4152.C436.gene24.pep
  Gene classification: Gene name=EntF; Function=Non-ribosomal peptide synthetase modules and related proteins; Function class=Q Secondary metabolites biosynthesis, transport and catabolism
  Homolog annotation: Query=26..619bp; Hit=449..1033bp; Blast score =312; Percent Identity=33.0; E value=2e-84; Homolog= BS_dhbF COG1020
MNTHTHKAILHTAFTEQTFSPDDNINSSNISHRIAALEPWFDNVPSRLAKLAKTIPNDIAVSDPYETLVFGELQQRVENAANILHQYGVKMGSNVAIAAERGIPWFVTMLAVWRIGAVYIPLNTMMPEKRLNDILASLSESVLVSDDTVSAGLKASTLIPLHALLNNTREIINDEITENIDMPALGDHPAYVMFTSGSTGLPKAVQVQHDNLAACLCAFGKLLSVNQHDCMLTLTTFSFDISLMELLLTVVHGGSIYITSIDTQRDAMALSQILSDPQFTFAQATPVTWLMALNAGWKPRSELSMLCGGEALSQDLADQLTASGGTLWNLYGPTETTIWSTAFRMRKGDKVQLGGPIPGTTITIVDKYLRPVPKGTVGEILIGGLGVTAGYRNNPTETAKRYVPDMTQRGKRAYLTGDMARMLEDGSLIYMGRQDDQVKVRGYRIELGEIETALRKQNGVQDAIIRVIGSGDLAKIQAFVLFDPNRVVSEDWVHETQISLREVLHEAWIPAEYYRIPYIPLTSSGKRDRKRLDEVAERLNASYDVVLPQTETEKQVYAIWRDLLATDVLGVTDNFFQVGGHSILVARMVERIEKAFSLRIPISGIYVEPTVARISSILDEMIEAYQANPANAGGVYHSEALIQQHAETLRKDVYLKESVCPDGLPHANWYQPDTVLLTGATGYLGLHLLEQLLKQTAARIICLCRDSDEEHARDRIKAGFDKYQIDVVNGLERVDVIIGDLGQPRFGLLPETWAQLAENVDVIYHNGALVNFIYPYSALKSINVDGTRTALEFACTARLKHFHYVSSVNALFATESPRPFMEDDRTMSESVRDPSGYSGSKWVSEGIINIARKRGVPVSIYRPGLILGHTLTGAAQGNDYLVASLKGYLAMGFYPEHGLLLDIVPVDYVAASLVHISSQPESDGKFFNLFNPVQVSIRQFFDWVQEFGYVLNPIPFNEGKEKILALDDTHPLYPLIPLIRDMTEKPYRALDPAYVHEIHPELELKQTLALLANTDIKCPVITAGYVHQVLQYLIDTGFLPAALPENFKPEAYLGTANRKRSHELDSRREQQKKVFGLA

SEQ ID NO: 8187 - protein, 51 aa, Xenorhabdus bovienii
  Peptide sequence Name=Xb4151_4152.C436.gene25.pep
MNWIVVVNSRKKYSVWPEAYVLPVGWVAVGMTGSKEECLNHIAGIWPKPTN

SEQ ID NO: 8188 - protein, 44 aa, Xenorhabdus bovienii
  Peptide sequence Name=Xb4151_4152.C436.gene26.pep
MPFIFLPLYVCFEFVFVPYQTTTVDFKYILPLKQTPLIPRPSVS

SEQ ID NO: 8189 - protein, 366 aa, Xenorhabdus bovienii
  Peptide sequence Name=Xb4151_4152.C436.gene27.pep
  Gene classification: Gene name=GldA; Function=Glycerol dehydrogenase and related enzymes; Function class=C Energy production and conversion
  Homolog annotation: Query=1..365bp; Hit=14..376bp; Blast score=409; Percent Identity=58.0; E value=1e-114; Homolog= ZgldA COG0371
MLKVIQSPSKYIQGPGALSHIGQYTKILADHVFVIADNFVMSLIGDAVSKSLEAHAVTSHFEIFNGECSRGEIKRLSDISASHQCQAVIGIGGGKTLDTAKAIAHACRLPVIISPTIASTDAPTSALSVLYTELGEFDGYLLYPQNPNIVLMDTRIIAKAPVRLLVAGMGDALATYFEARANSAAHKPTMAGGATSNTGLALAKLCYDTLLAEGYKAKLAVEAGVSTPAVENIIEANTYLSGIGFESAGLAAAHAIHNGFTVLEECHHLYHGEKVAFGTLAQLMLENSPNEELETVLDFCVQVGLPVTLEQLGLRDSEKLHQKIMEVAKASCAEGETIHNMPFKVTPEQVYAAIMAADRMGMDWLY

SEQ ID NO: 8190 - protein, 222 aa, Xenorhabdus bovienii
  Peptide sequence Name=Xb4151_4152.C436.gene28.pep
  Gene classification: Function=Uncharacterized ACR; Function class=S Function unknown
  Homolog annotation: Query=8..207bp; Hit=8..207bp; Blast score=259; Percent Identity=78.0; E value=2e-69; Homolog= ZyhhQ COG1738
MFHLTTQQKATALIWLSLFHILIITSSNYLVQLPVSIFGFHTTWGAFTFPFIFLATDLTVRIYGAPLARKIILTVMLPALLISYFISALFFQGTWQGFGTLGTFNLFVARIAAASFMGYVLGQILDVGVFNRLRQKRRWWIAPTAAMFFGNLLDTLAFFFIAFYRSSDAFMATHWVEIALVDYAFKLFICMLFFLPAYGVLLNLILKFSFSHSTDKTLVKNH

SEQ ID NO: 8191 - protein, 138 aa, Xenorhabdus bovienii
  Peptide sequence Name=Xb4151_4152.C436.gene29.pep
  Gene classification: Gene name=SirA; Function=Predicted redox protein, regulator of disulfide bond formation; Function class=O Posttranslational modification, protein turnover, chaperones
  Homolog annotation: Query=55..133bp; Hit=1..79bp; Blast score=125; Percent Identity=72.0; E value=2e-29; Homolog= sirA COG0425
MNGVREPKKTNFLCLNDQVKRIIRALRNKSKVRQLMIFCNIIHRHSVFEPTEIVMSNVFANPDKTLDTQGLRCPEPVMMIRKIVRHMDAGQTLLIIADDPATTRDIPGFCRFMEHALIAQETGQTPYRYLIKKNENVA

SEQ ID NO: 8192 - protein, 762 aa, Xenorhabdus bovienii
  Peptide sequence Name=Xb4151_4152.C436.gene30.pep
  Gene classification: Gene name=ZntA; Function=Cation transport ATPases; Function class=P Inorganic ion transport and metabolism
  Homolog annotation: Query=46..756bp; Hit=33..730bp; Blast score=791; Percent Identity=63.0; E value=0; Homolog= ZzntA COG2217
MFSIFKKHKQSQHGSLSHKNKDHKHSHGVHGKEDKSSHNAHEHDRGHCSHDHAPTIQDTTPLELTANQRFNWIIHGMDCPSCAGKIENAVKKLPEAKQVRVLFTTEKLVVDADSDIRAAVEQAVKQAGFEIKQTDSTIRLPPAANHWKTFSPILILIALMVISWGITKINPPAGQIAFIVTTLIGLYPVATKAIKLIRSGTPFAIETLMSVAAIGALFIDATAEAAMVILLFKVGEVLESYAAGRARRGVSALMALVPEQALRVTGGEKKTVPAADLRPGDIIEIAPGARLPTDAELLSPFASFDESALTGESIPVERQQGEKVAAGCLSVDSAVQMRVFSEPGHNAIDRILQLIEEAEERRAPIERFIDRFSRIYTPLIILFSVLVVVIPPLLLAEPWETWIYRGLTLLLIGCPCALVISTPAAITSALAAATRRGALIKGGAALEQLGSVTTIALDKTGTLTEGKPRVTEIEPVENISVETLLALAGAVESGSHHPLAKAILNAAENKGVTVVEAEHRKALAGIGVEGRLSGQKILVAAPGRLPENTLSTAWKQRVTELESNGKTAVAVVQGEQFVGLIAMQDTLRQDAIDAIRALKKQGVNAVMLTGDNPRAAAAIAAQLGIDYRAGLLPEDKVKAVTELNEKHHTMMVGDGINDAPAMKAASIGVAMGSGTDVALETADAALTHNRLTGLPEMIALSRTTHYNIRQNITIALGLKAIFLITSLLGITGLWMAVLADSGATALVTANAIRLLRVKSQKR

SEQ ID NO: 8193 - protein, 47 aa, Xenorhabdus bovienii
  Peptide sequence Name=Xb4151_4152.C436.gene31.pep
MFFEYGEHRRPLNRVNSNGLQFTLHSGVSSRVKLKTMNFFDDLCFLK

SEQ ID NO: 8194 - protein, 89 aa, Xenorhabdus bovienii
  Peptide sequence Name=Xb4151_4152.C436.gene32.pep
  Gene classification: Function=Predicted membrane protein; Function class=S Function unknown
  Homolog annotation: Query=1..88bp; Hit=1..89bp; Blast score=79; Percent Identity=50.0; E value=6e-16; Homolog= yhhL COG3776
MFIQLGKVIMVLVWGIMIFNLIHPFPKPLRYFMDIAMVFTVIMHAFQLLLLKNSQPKDQKFSVFLQTKIFFFGVFELLTWQKKQRQDKK

SEQ ID NO: 8195 - protein, 199 aa, Xenorhabdus bovienii
  Peptide sequence Name=Xb4151_4152.C436.gene33.pep
  Gene classification: Function=N6-adenine-specific methylase; Function class=L DNA replication, recombination and repair
  Homolog annotation: Query=3..193bp; Hit=2..192bp; Blast score=271; Percent Identity=68.0; E value=3e-73; Homolog= ZyhhF COG0742
MTKKSQSASLGQIRIIGGKWRGRKLPVPDSEGLRPTTDRVRETLFNWLMPIIQEARCLDCFSGSGALGIEALSRNASHATLLEYDRHVAKQLSANLALLKAENANVVQGNTLQYLNQTGTPFDVVFLDPPFRKGMLVETINLLEANGWLAEESWIYVEAESESTATEAPANWQLHREKIAGQVAYRLYIRRQQSGDRSA

SEQ ID NO: 8196 - protein, 39 aa, Xenorhabdus bovienii
  Peptide sequence Name=Xb4151_4152.C436.gene34.pep
MCGFRGKLINMFLHSHFLYPPSIMQIASDDKCLNYINYD

SEQ ID NO: 8197 - protein, 53 aa, Xenorhabdus bovienii
  Peptide sequence Name=Xb4151_4152.C436.gene35.pep
LINLPRNPHIDMCCDVMKMLDWILSPLEPIAAGVVVEKQSVCGDRFLAYPNKY

SEQ ID NO: 8198 - protein, 465 aa, Xenorhabdus bovienii
  Peptide sequence Name=Xb4151_4152.C436.gene36.pep
  Gene classification: Gene name=FtsY; Function=Signal recognition particle GTPase; Function class=N Cell motility and secretion
  Homolog annotation: Query=1..465bp; Hit=1..497bp; Blast score=470; Percent Identity=62.0; E value=1e-132; Homolog= ftsY COG0552
MAEEQKKGFFSWFGRGRQEKKQQEEQLEQDKSAAEEAEQQRLAEEAARRAAEEAEQQRLAEEAARRAAEEAEQQRLAEEAARRAAEEAEQQRLAEEAARRAAEEAEQQRLAEEAAHHAAEEAEQQRLAEEAARRAAEEAEQQRLIEESSILPKEQDRPSKEGFFARLKRSLVKTRQNLGSGFLGLFSGKKIDDDLFEELEEQLLVADVGVETTRKIINNLTAHASRKELKDAEALYTKLKEEMSDILAKVDKPLDIEGKSPYVILMVGVNGVGKTTTIGKLARQYQSQGKSVMLAAGDTFRAAAVEQLQVWGERNKIPVIAQHTGADPASVIFDAIQSAKAKGVDILIADTAGRLQNKSHLMEELKKIVRVMRKLDEETPHEIMLTLDACTGQNAVSQAKLFHEAVGLTGISLTKLDGTAKGGVIFAIADQFDIPIRYIGVGEGIEDLRPFKADDFIEALFARED

SEQ ID NO: 8199 - protein, 221 aa, Xenorhabdus bovienii
  Peptide sequence Name=Xb4151_4152.C436.gene37.pep
  Gene classification: Gene name=FtsE; Function=Predicted ATPase involved in cell division; Function class=D Cell division and chromosome partitioning
  Homolog annotation: Query=1..218bp; Hit=1..218bp; Blast score=372; Percent Identity=86.0; E value=1e-103; Homolog= ftsE COG2884
MIRFEQVSKAYLGGRQALQGVDFHLLPGEMAFLTGHSGAGKSTLLKLICGIERPSAGHIWFGGHDISRLKTRETPFLRRQIGMIFQDHHLLLDRTVYENVAMPLIISGASAEDIRRRVSAALDKVGLLDKAKNFPIQLSGGEQQRVGIARAVVNKPTVLLADEPTGNLDGELSEGIMRLFEEFNRVGVTVLMATHDVALIERRNYRILTLNQGRMQGGHHG

SEQ ID NO: 8200 - protein, 326 aa, Xenorhabdus bovienii
  Peptide sequence Name=Xb4151_4152.C436.gene38.pep
  Gene classification: Gene name=FtsX; Function=Cell division protein; Function class=D Cell division and chromosome partitioning
  Homolog annotation: Query=8..326bp; Hit=33..352bp; Blast score=377; Percent Identity=61.0; E value=1e-105; Homolog= ftsX COG2177
MVKNVRHSAKKMTPPKPKSKSLKGGWRVQQRYAWKSTLSDMLRQPLATLLTIMVIAISLTLPSVFYIVWKNVNQAVEQWYPVPQLTVYLDKSLNDGGARQVIEQLKVIDGVKSVNYLSREEAENEFRAWSGFAGALNLLEENPLPAVAIISPQMDFQDSTVLTTLRDRVSQIKGIEEVRMDESWFTRLTALANLIGQIAAVIGILMVVALLLVIGNSVRLSIFSRRETINVMKLIGATDGFILRPFLNGGVLLGGLGAIFSLILSSLLVWKLSNVVTDVAGVFGTTFKLYGLGWDESLLLVLISGMIGWLAAWFATIQHLRRFRPE

SEQ ID NO: 8201 - protein, 63 aa, Xenorhabdus bovienii
  Peptide sequence Name=Xb4151_4152.C436.gene39.pep
LRHGLRLFSIYAVSGRNESICWSSGELLGCITVEEIVVESTVSNLYPYSYHLDDLNMSSMMVK

SEQ ID NO: 8202 - protein, 285 aa, Xenorhabdus bovienii
  Peptide sequence Name=Xb4151_4152.C436.gene40.pep
  Gene classification: Gene name=RpoD; Function=DNA-directed RNA polymerase sigma subunits (sigma70/sigma32); Function class=K Transcription
  Homolog annotation: Query=1..285bp; Hit=1..284bp; Blast score=447; Percent Identity=83.0; E value=1e-126; Homolog= rpoH COG0568
MTKEMQTLALVPQGSLEGYVRASNAYPMLSAEEEKELAERLHYQGDLDAAKKLILSHLRFVVHVARSYSGYGLPQADLIQEGNIGLMKAVRRFNPEVGVRLVSFAVHWIKAEIHEYVLRNWRIVKVATTKAQRKLFFNLRKAKQRLGWFNQDEVDLVAKELGVTSKDVREMESRMSAQDMAFDMSSNDDSHDSQPVAPVLYLQDKASDFADGIEEDNWENHAADKLSMAIEGLDERSQDIIRARWLDDDNKSTLQELADKYGVSAERVRQLEKNAMKKLRLAIEA

SEQ ID NO: 8203 - protein, 407 aa, Xenorhabdus bovienii
  Peptide sequence Name=Xb4151_4152.C436.gene41.pep
  Gene classification: Function=Glycerate kinase; Function class=G Carbohydrate transport and metabolism
  Homolog annotation: Query=30..401bp; Hit=1..372bp; Blast score=407; Percent Identity=62.0; E value=1e-113; Homolog= HI0091 COG1929
MGFLISSVSTSIFGVGVAGQKHQSIEDIAMKIVIAPDSFKESLSALQVAEAIEQGFREIFPQAAYIKLPMADGGEGTVESLVAATGGQIISCSVTDPLGQPVDAFFGLLGDGKTAVIEMAAASGLHLVPMEQRNPLITTSYGTGELILAALEHGAQKLILGIGGSATNDGGAGMMQALGAQLWDGDCRILPLGGAALTRLESIDLSGLDPRLSQLEITVACDVKNSLCGESGASAIFGPQKGATPEMVKALDSALHHYGMKIESLTDKKVIDVAGTGAAGGMGASLLGCLGAKLQSGIEIVINTLKLEEAIQGADLVITGEGRMDSQTIQGKTPIGVARVAKKFGIPTIALVGGMSCDYHVVHQHGLDAVFSIVPGACSLSDALANSTDNLRVTARNVASVWRMAYS

SEQ ID NO: 8204 - protein, 133 aa, Xenorhabdus bovienii
  Peptide sequence Name=Xb4151_4152.C436.gene42.pep
  Homolog annotation: Query=1..130bp; Hit=1..130bp; Blast score=163; Percent Identity=55.0; E value=6e-40; Homolog= Pa|Phot4-308d07.p1k _g12| 12091 - 12489 194 132 aa, chain +
MKLTIKPISVLSQQDKIDLKKIWPEQDTQEWEVLLAGDQKLFVAQFNGRLLAAVKVTLNSSTGILEDFCVREVTRRRGVGAYLLEQVKAAFPEINRWEWSLNHFPDIHAPALRDFMDACDFRYDAQNNAYYYE

SEQ ID NO: 8205 - protein, 40 aa, Xenorhabdus bovienii
  Peptide sequence Name=Xb4151_4152.C436.gene43.pep
MRSPLKALERYCSPRKEPVPKQILFKEWYDVLLICSGINF

SEQ ID NO: 8206 - protein, 30 aa, Xenorhabdus bovienii
  Peptide sequence Name=Xb4151_4152.C436.gene44.pep
MLNIYVAEGMSNPKKAYILCLYSPLFIAKY

SEQ ID NO: 8207 - protein, 595 aa, Xenorhabdus bovienii
  Peptide sequence Name=Xb4151_4152.C436.gene45.pep
  Gene classification: Function=Uncharacterized BCR; Function class=S Function unknown
  Homolog annotation: Query=22..574bp; Hit=6..570bp; Blast score=144; Percent Identity=24.0; E value=4e-34; Homolog= VCA0110 COG3519
VVILTTCRFKEKESVVKSFEYYYQQEFDYLRQLAKIVSEEKPHLRDVLGGGDPDVERLFEGASVLTARLKHNIEDGFPELTRPLLQKLRAQPLKGLPATSIIQFDSHGQGDSDFSIPAGTEVYTEAGQPFVMCRPCPIAPLTLVSREIIHQIQATKIILKFRYTGKDAEWQTRPISLFLSSDEPVADILMLGLMQYYTDTELHHNGQVYKAQGERFEARSGASRLTLSSAKDDNWAPQLLIESLYLPHINQFVDLPLPVMAKQLKLAEHREFSVELTLNTLLPLSAEQIESAFQLHCVPVVNMKRNCQVTLPFAAETARYPLPLALNQGILHIAGIELKNEPGSEEEHRGGEYLFYPASLLTGMERYHSEYDNAGFYGLETAHDEWNGVRYQVVFYDSEGKLMHKPPEREFICHFYGFEQNLPPLISGVISLGGENVPEILQLKNITPTSRTYPPITDSLRYWHFLSHYATGSYALESVRSVRQLLQDFDLYPEGDRPVSRSIRRMIDGISNITAKWGDRLIRGRPVRCLLITLEMDESAYTSAGEMYRFANALYQFFPFCLAQGSWLRMRVISQPSGTQWYLSPSMLEGYRSIM

SEQ ID NO: 8208 - protein, 669 aa, Xenorhabdus bovienii
  Peptide sequence Name=Xb4151_4152.C436.gene46.pep
  Gene classification: Gene name=VgrG; Function=Uncharacterized BCR; Function class=S Function unknown
  Homolog annotation: Query=1..622bp; Hit=1..617bp; Blast score=370; Percent Identity=36.0; E value=1e-102; Homolog= VCA0018 COG3501
MDGLVFTCRIGRLPQTTFQVVDFSLQEGLSQLFHLTMTVVSSLNNVALSEQLGTSASLTVIRDGVTERTVNGIVAGAEQGNTDGLRTYYTFIVRPEMWLMTLNQDSRIFHYQSVPDILARLLKEHRIKAESKFYKDHQQHAIREYTTQKRESAYDFWCRLAAEEGIMFWFEEDKLFYSNSHLGMLAALTLTYNVQANTDNSDSTAWQWNYGEYLCPDETRHKDNNFLRPSYPLQHTAALEKGMGHSVFESYGRFQKDAEGRPFTQLRLEQLQNQSKVGKAVTNCIKLRPGRIFMLQSHPIGAMNDSWQIVTVSHQGHQPQASGEAGEGTTLTNQISFIPGRQDWRPPFRYKPLADGDEVATVVGPEGEEIYVDKHGAIKVHFHWNRYDEADDRASCWVRVAQGWNGDGYGFMAIPRIGQEVIVSYLNGDIDRPIVTGCTYNGRNRPPLDLPAEKTRTTFKTRTHKGEGFNELRFEDAKGSEEIYIHAQKDQLIEINYDKTQRVGHDESHHVLNNRKHEIGNDEFIRIMHEQHIQIDLNQFETITKDRKTRINNNWQENIFADHRQEVGRDKTAKINNNYTLNVVNNIQSLTKVHTLQASESVLIKGKAGSIKLDGSGVTITGKITLQGEVSVTGGSPGTVPSLSGSANEGLVMAEDCREKARKQQESSE

SEQ ID NO: 8209 - protein, 403 aa, Xenorhabdus bovienii
  Peptide sequence Name=Xb4151_4152.C436.gene47.pep
MSWIPDYAEHWVVDYAYTTPQGEPDSARAIVHAASQPQALSALAEYVLQAGDSPGQYQSIQPLPEYLAASAEVELPLLRQFRQGVERNARVIPLNEHNNNPLLPAARGVLQFAVTETLPASARGQYRYMVIDATVYRRVMGSFIVPDLMVSNLRWESLFQGETQITLEDSAPYLVELTDDPTVHSAFQHKITRPITPEPGIFIDSDQPFPVIRNHLRKFTYLRNEQHQSWVFYRFYVPQGLLPLLRSLPDEQLMHFMRPIMQIGYFDSQTGQYYALSVAENSLNQEKTAPVAINRSLVDILAGQTQARAVTQIVKFIAETQPELSAEQQEQLPAFVVQQANLACLAGFAHQRSILYLVAGRSLARGNEALWQRAWQHACAEAQAQEVRALACYEYCFKNRALS

SEQ ID NO: 8210 - protein, 1041 aa, Xenorhabdus bovienii
  Peptide sequence Name=Xb4151_4152.C436.gene48.pep
MEKSILTSAGDALETAAKKVAETFEKMVDEAKARIPHELDMDTVVRPCDANIRPVYPVRYAYMNFFGDTWIDAQLPPPISTFIDPDDDSLSASVLGGYSIRMPRPGWIYVKEEGAIKTRGSQQNGNLLIFKFSPEIVTLEGKRGMVTKYTKYEQKAGSSSWEEIHPASGTAGLGYPFLAIDKDVTQISLIYSEVELAKSVLNKMDNDKNFRKNAMQFVDLDSEVSDYAIDARQEHFDGLVEDFKDPEKQFQAYKNQLSDPLLHAADLGDITTEGSFFMDADMEMRYIDSLICPYYKDKAKIVVLHDPVGYQRDILMAYMLLNLWELSYSATNMYPLTIGNFVEILAASKNKEVKKCVEECIHQENWKTWWPKLTTPIKSVKDRKKEILEFYKCFSESEMIAGKLGGLTHYFKNFFSVSDKKDIYTEGDAKEFERFCILHAELMEPLKHSEEGLLAMESIIAGPLAIDGNSAWEVALNGIVNSLGHDGVDKGSIARFLNRGIDIILSVVGNLLARLYVFTTELSYKGVLHLHVLSVKQVTHKLVPKILDYFGLEIKQGHYLELTEKEYYTFLKKIEEYENQGVSGEIKKGMAHAESGLKRFVGKKVFDWSNRLDNYNNNIKIKIPLIKFKRPELNPQFKFFYNANKSAGYLLSSGLSGLDLLMKSYMLYKLTSMSRFDKNAPFNANRLPYYYVSSYANTILGGLIAAKGVSAIGGDAIKVAASLAGKLNSPAAKALLDSASRRLLLESALITKWVNSGLIATGFVSGVLSYYDAYNSFSFGNDKEAYSHISIGTGSIIMAVGWSMAVAASEVTFGVSLLIALGASLMLGGTFAAIYFNWIDLETLLSNCFWGNGSKYAFWSTSEKRLSLENQFKRIKIIDKEIKDIYLVEFQEFLNIFIKPTLNIENNKQGKVIYKFILPNFKWGKSDIYHEVIPSALSDGYSDPDASIIERGYSRHHYSVVKDNFDKAIDIARKNRENLIYDEESGLTTLTVEVDEKYSVYMKVFWYYKPTEDTVSPLHYKLGKEPILENAVYGYEDEVLR

SEQ ID NO: 8211 - protein, 318 aa, Xenorhabdus bovienii
  Peptide sequence Name=Xb4151_4152.C436.gene49.pep
MSKLIKKLFRVKTLPTEPLSTFGTPVLEQKLILLDNKTVKRAGFLDSINSKECHFRHNLIRARKEIIIPVFVGFMLGFSFFINDNIKAWNASEKTILLLLKSAKENYGEQFYLNSEASASTKLLKIVSNNKKVSLMEYLYISYSKDSIYGEERARRSLILDSSFGLFFLSANILIISIFLRLRKPANFIIDHERQLFYTWKKGKVYVSRYKELGVAFANNILHFKCYGLNEKNELTYQFFIPYLSLFNSDEDKIYILAFMSKYLLQGKEAVSSVDFKRQEQLPWFRKQIKPADWETQITAILAELDRFWPPKGATEPK

SEQ ID NO: 8212 - protein, 226 aa, Xenorhabdus bovienii
  Peptide sequence Name=Xb4151_4152.C436.gene50.pep
MAKDNEIKLSRISTVCDPLLKENIGILDKEQLENEGVFELINDKNCVIINEINNHRIHIIVPALIGFLLGFCFFVSDYINEWKCNEKGYLRTLKYAKKYYGENFYLNSKIPEYMKAYEYISDAESVSLLQYFHIRYTDSGFYKKSTVRYDLLLEGGFFLFFLTANSFLLYLLFFSHKVAPLVIDREKKIFYTWGKEKLFLLFTINWEKSQHWKMRFMDMKMRYYVK

SEQ ID NO: 8213 - protein, 322 aa, Xenorhabdus bovienii
  Peptide sequence Name=Xb4151_4152.C436.gene51.pep
MSILIKKIFKKIFRVKAPPTEPLFTFGDPVLEQKLILLDNKTVKRAGFLDAINSKECHFRHNLIRARKEVIVPLMIGFMLGLGFFINDFVKGWKANEEDLLWSVQNAKKRYGEQFYLNPNAPAYTKSLRVISDDKKISLTEYLYISYSKDSYYGEEMARRYLIIDASFGLFFLSANILIISIFLRLRKPANFIIDHERQLFYTWKKGKVYVSRYKELGVAFANNILHFKCYGLNEKNELTYQFFIPYLSIFNSDEDKVYILAFMSKYLLQGKEAVSSVDFKRQERLPWFRKQIKPADWETQITAILAELDRLEPPKGATEPK

SEQ ID NO: 8214 - protein, 62 aa, Xenorhabdus bovienii
  Peptide sequence Name=Xb4151_4152.C436.gene52.pep
LSHRKGRLNLNNRWKNINTVSYIFSRKNSTEKYYNYLGAILKDSNVFDKNPINKIGMFNLIL

SEQ ID NO: 8215 - protein, 44 aa, Xenorhabdus bovienii
  Peptide sequence Name=Xb4151_4152.C436.gene53.pep
LPFSVTALLCCSFLRTRLYNIDYRISQSLWLTQLAYSTKKYLNT

SEQ ID NO: 8216 - protein, 33 aa, Xenorhabdus bovienii
  Peptide sequence Name=Xb4151_4152.C436.gene54.pep
MLLLKKAIFLLMKKIHLSANSYLIATEFLISFL

SEQ ID NO: 8217 - protein, 36 aa, Xenorhabdus bovienii
  Peptide sequence Name=Xb4151_4152.C436.gene55.pep
LSQKDKFNTETILSVFSSEICSNPMQRSRWDLLLYQ

SEQ ID NO: 8218 - protein, 625 aa, Xenorhabdus bovienii
  Peptide sequence Name=Xb4151_4152.C436.gene56.pep
  Gene classification: Gene name=ChiA; Function=Chitinase; Function class=G Carbohydrate transport and metabolism
  Homolog annotation: Query=146..590bp; Hit=156..587bp; Blast score =139; Percent Identity=30.0; E value=8e-33; Homolog= VCA0027_1 COG3325
MANKYTYTSSKAMSDISDVIGDPLTAWNQQEGGRVYNVIFNSNVYTNTYWVERWHVPGQSGQKSSPHNAWQYVRAATAEEINTHGNPTDGTINPTEEIPSPVLQSDRYTEETYEKVKYKPDGSGTNLSYTATRVCKPMYNQYERDPAKPKLSAYITDWCQYDARLDDKNENPEDRGRGFNLSTIDPTTYDKLIFSFLGICGDIGVKKEKVKEVWDGWNSQTDQKITEGHIVPLDPYGDLGTARNVGLPESSKNTSINAGTFLPYYQQSKAAGLLGGLRELQKRARAAGHKLELAFSIGGWSLSSYFSKMAENEGQRTVFINSVVDFFERFPMFSCVDIDWEYPGAEGDVHNIISENDGKNYALLVKELRTALDNRFGTGSKEISIACSGVKAKLAKSNIAELVKNGLDNIFLMSYDFFGTGWANYIGHHTNLYSPNEPDPNGEYDLSAEAAINYLHQDLGIPLSIINLGYANYGRSGKGAKLETRLYDKPGDALGTMEKGAPEFFDIVNNYMDSEHTLSTGKNGFVLMTDTNADADFLFSEKQGHFISLDTPRTVKQKGEYVTGHQLGGIFSWSGDQDCGLLANAAREGMGYIAKSNHETIDMGPLYNPGQPYYLKSLRELKSSR

SEQ ID NO: 8219 - protein, 1368 aa, Xenorhabdus bovienii
  Peptide sequence Name=Xb4151_4152.C436.gene57.pep
  Homolog annotation: Query=1..1366bp; Hit=1..1361bp; Blast score=1957; Percent Identity=73.0; E value=0; Homolog= Pa|Phot3-136c07.q1k_g4| 2977 - 7068 2215 1363 aa, chain -
MSNSIEAKLQEDLRDALVDYYLGQIVPKGKDFQFYRDKIKNVDDLYDFLLLDTQVSSKVITSRVSHVTQSIQQYINRIVLNLEPGLSMTQEETYDWQEFANRYGYWSANQQLRLYPEIYVDPTLRLTKTEFFFQLESVLNQGKLTDNVAQKAVLGYLNNFEEVSNLEIISGYEDGIDLANDKTYFIAKTRTQPYRYFWRTLDMKQRNTDSNELYPTAWSEWKPISVPLENARNGVVRPVIMNNRLYISWFEVSKEEEKNKNDESKTIIRYRTKLNLAHLGFDGTWSSGTTVREEVLDDAMDKMIAVLDRTGKEDRLVLVAFTRRHGIENKVPYDYDVVFSYICDNMLMASTDLPPSSTKLSDQDDYGDKLVWFFFRDPQNGGMDEFKQLILYPVHINRQWPIEKERKFEGKLGDEQDFDLKADYVEDSLDMYLTAISTYKYDFSLSKNILYCIWLEDKNKNRCWLNYQVLTKEDFERGEIKLSTRVKRCHSDDLSDITIVTGFSLPKANADDIGGRIRVILSVGKLVREKFQIKQTKQTQYLQFPENPPTPVWYTDKQIRLNTLFAKELVSKASQKLDLVLSWDTQNLPEESISGSGTEPIDLKGANGIYFWELFFHMPFMVAWRFNVEQRYEEANRWLKYIFDPYENEDQPALKQGKPRYWNSRPLIDEPKKNYSLMQPSDPDAIASGEPIHYRKAIFYFLVRNLIDDGDMEYRKLQPTARTIARLSYATASSLLGRRPDVQLASFWQPLSLEDALYRYDNSELRQLEMQSQPLPHIPVVHDNTIRALDNDLFMKPINNELTAIWDRMENRIYNLRHNLTLDGKEINMALYDGKISPRDLMNLRYQRVVTARNASRMNFKTPNYRFEPMLARARAGVETLIQFGGTLLSLLERKDSLSFEKFQMLQNSDLYRFSIDLQQQEININQASLEVLQVSKKSAQERHEHFKGLYDENISSTEQQVIELQSQSASALLAAQTLRTGAAALDMLPNIYGLAVGGSRWGAALSAAAEMVMIKHQSDSIKADSLNVSESYRRRRQEWEMQYKQAEWEVNSIDQQINVQNLQLTASMKRLAQVEAEQQKSLALLDYFSSRFTNESLYTWMISQLSNLYLQAYDAVSSLCLSAEASLQYELDSEQTFIEGSSWNDLYQGLMSGETLKLALQRMERAYVEQNSRLQEITKTISLKALRKTAWENDLATLRQHSPITFNLQESDFAKDYPNLANRRIKSVSVSLPMLIGPYEDICAQLSLGVNTRMVKADIQTMEKLVKEGINADSPYLARSIHPNQQISLSTGINDSGMFTLNFDDERFLPFEGAGVESSWTFGFTNNSQNLDSLTDVILHVRYTAKIGSSAFGKAVQKLLVEQKITD

SEQ ID NO: 8220 - protein, 1184 aa, Xenorhabdus bovienii
  Peptide sequence Name=Xb4151_4152.C436.gene58.pep
  Homolog annotation: Query=1..1184bp; Hit=1..1183bp; Blast score=1404; Percent Identity=61.0; E value=0; Homolog= Pa|Phot3-136c07.q1k_g5| 7061 - 10612 1933 1183 aa, chain -
MDKNHDYSDEQQNMKKVSPLLAAVAEIPLPEIALPEKYSLTTVKQHNTPSSVSLVDSLRNLGYHSIFDIVRLSKQRFIKRHNESLAGHAEIIFDKAVSMANQLVQHYRQNPLRQYDGQTAAFLSTATDNQNASEQTGKLPDYSGLFPEPWDDFCQPDAIESLDSPANYLLDLYKFIQQIEVDGTNQATLLASRRSDISYLMLDSDALYKELRALTIVNDVLSESARIYIDQTGEANKPVNQVLGETRFPFTLPYNLPTQQINRGLAESKNELGTVIRQVDTHFPWHTEISKYDQILLAYSQLSNEQISLLTEAAPFSENLLSRDQLIKAYYSSSTTELVPDKDISRHAYIVAQDDSVEGPTKLVENSPSAYDRISITCKNQADKTISVKLRAENVLTYYRVKARMEPFDNSPPFSRQLKLTYVESDNSDIGNLDDGPYFGNMTIYAATPKEIPSGENQPTGPIDGVIFQAMSYRLAIAKSGTSSSELSPQANDFFINNYGLSEEESAQLKKIAIFGDQTGTQATHIENLFSSGNYQPIVSPNVHFSNPIFFNRQSTATFPAAYHYGGVYINAGQRDTLEIIRADNGREIKAVSNFRYDRLNRFIRLQRWLGLPYHQLDLLLASGIKAEADNLDMRITDNVLKELGLFRHLNTQYQVTPEMFAGWLHQITPFSTSDSVPFFDQIFNQTKLFDQPLTLDDEVFNYTATQGDDAKTVKQLCAGLGISTVTFQLIAPMVESALTPTQDTLTGQLRRNLDVVSRLYRLVSIPRIFGLSTEDGVFLIDILTGNHRYLAQQPIFTADSTRQDDILIVIMKMEAVSRWLAKTKITAAKLSLMLGQTVLPVVPTDSMVTFFKGIAVGLSDSVLLSSSDFTRPELVTINWWELLTAEGGLLNAQGLVLDIPPEWDKTDEIQIREKVKALFKEGKTPQDNVINIVTQLLIQAKNAQENLLSSAIAAEYGVEKSLVPLQLRWLGSNVYLVLEMILTGVPETAAEISHQFTDLTYSLLIYTQIISTLKINKNLLLLRLTKPEWLGLSNSKTSNALSLDEIYLLTRYQDLVNNANQNEDKIHDYFSYANKPQANGKAVKNNEDESEKCAEILADILGWHADEIHLACTLRGLTPPQAKNLLHIDWLRRLQQLAVTTSLSVKTLWDAGTLTLNTDFSLYQSVGEAVMAALKAQGDNENV

SEQ ID NO: 8221 - protein, 38 aa, Xenorhabdus bovienii
  Peptide sequence Name=Xb4151_4152.C436.gene59.pep
MVILFSYSAVHQNNRDSCPFLLSHFNYSAIFIKPSLIK

SEQ ID NO: 8222 - protein, 546 aa, Xenorhabdus bovienii
  Peptide sequence Name=Xb4151_4152.C436.gene60.pep
  Gene classification: Gene name=ChiA; Function=Chitinase; Function class=G Carbohydrate transport and metabolism
  Homolog annotation: Query=210..510bp; Hit=258..587bp; Blast score =139; Percent Identity=31.0; E value=9e-33; Homolog= VCA0027_1 COG3325
MDNTEKDTESKLVYKTDPGYQHPSPVQGYGKEATQKTYQLNGYDPATSTDILTYTATRMAKTVFNTYHDDDEFSIACYFTDWAQYDGRAVEASPSDEVFRNQGGRSADLTRIKGDSTNGSPFKKLIFSFAGIVGDEGPKGNIILKAAKDWGFGADEAETLKNYTGWPIPIDPWGDVSTYFNCGFDSGASGAAKDVYNQEKATGLLGGFNSLKKADPNLEVSVSIGGWSMSGAFYEICRSDAYRKQFIDGVKNLFCRFSMFNHIDIDWEYPGSAGMGNPFDKDDYVYYKKLIEELTAAKIPNLQGISIAASADPQKIDDAHIPELMEAGVTGINLMTYDFFTLGDGKLSHHTNLYRNKNDQHSKYSIDDAVQHLITQGVDKKKIFIGYAGYTRNAKGANITSKSPLQGTYNGQGNIVGTFESAVIEWTDIIYNYVDFENGIGRNGYEIIQDNVAKADYLYNQDLKVFMSLDTPRSVREKARYVKEKGLGGLFIWSGDQDNGLLTNAAHEGLGRPVKKSVIDMSPFYFDNDDLPSYDKPKEPQCKDCV

SEQ ID NO: 8223 - protein, 36 aa, Xenorhabdus bovienii
  Peptide sequence Name=Xb4151_4152.C436.gene61.pep
MLSIISSMLSIPVHSKILQIKNNTSIFYCLHIKKIV

SEQ ID NO: 8224 - protein, 42 aa, Xenorhabdus bovienii
  Peptide sequence Name=Xb4151_4152.C436.gene62.pep
VATISIVGILICFQSACFSVVCGLFGYGHKPRVIGASLADAV

SEQ ID NO: 8225 - protein, 43 aa, Xenorhabdus bovienii
  Peptide sequence Name=Xb4151_4152.C436.gene63.pep
MRPEKLVRSLLYSLIQSGKSEASGFPDYFIYTSKDYPSHQPSP

SEQ ID NO: 8226 - protein, 100 aa, Xenorhabdus bovienii
  Peptide sequence Name=Xb4151_4152.C436.gene64.pep
  Gene classification: Gene name=HipB; Function=Predicted transcriptional regulators; Function class=K Transcription
  Homolog annotation: Query=8..68bp; Hit=17..77bp; Blast score=61; Percent Identity=44.0; E value=2e-10; Homolog= CC2330 COG1396
MVDANTLVGKRICTKRKELGITATALAKQIGISQQQLSRYERGTNRININHLVVISKQLGTPISWFFEECFKDEKEDSTVNKLTDQYIPIAETVIGKNGR

SEQ ID NO: 8227 - protein, 43 aa, Xenorhabdus bovienii
  Peptide sequence Name=Xb4151_4152.C436.gene65.pep
MALSRIIFLALQNGLAFSSPVAPIVTPDPPFCFSDIHLVFLMT

SEQ ID NO: 8228 - protein, 40 aa, Xenorhabdus bovienii
  Peptide sequence Name=Xb4151_4152.C436.gene66.pep
MQGDIKTKNTTRVIEAPLILVRALFLQHVNKKGHVIKKTK

SEQ ID NO: 8229 - protein, 37 aa, Xenorhabdus bovienii
  Peptide sequence Name=Xb4151_4152.C436.gene67.pep
MAYSHFRVLSRCGCFFDSHGWWFSIFYNKNNMIIIFL

SEQ ID NO: 8230 - protein, 61 aa, Xenorhabdus bovienii
  Peptide sequence Name=Xb4151_4152.C436.gene68.pep
MKGIILLPRSVPVCLQISLHPAICQIRFRCDLTWCIGSILRSVISPYKNATMSKRTPQTTM

SEQ ID NO: 8231 - protein, 92 aa, Xenorhabdus bovienii
  Peptide sequence Name=Xb4151_4152.C436.gene69.pep
MAGWRDIWRQTGTDLGSRMIPFIFQITASLAPSHIVIYVTGDSFTYYCAAYCLTRHAGRRYRRPVLSAVLSPVSDDDDKSLPFGTGKQTLLM

SEQ ID NO: 8232 - protein, 307 aa, Xenorhabdus bovienii
  Peptide sequence Name=Xb4151_4152.C436.gene70.pep
  Homolog annotation: Query=1..305bp; Hit=1..305bp; Blast score=517; Percent Identity=82.0; E value=1e-145; Homolog= Pa|Phot3-222e10.p1k _g79| 55361 - 56284 2180 307 aa, chain -
MKINPVMPLIRLFREEDSTGVSALFRVVYGEDYVYPEVYLPTMLSRYNAARHWYSAVAIQNGQVLGHATLWRNGRCPSSAELSLIAVHPQARGQGIATALGRYLCDQAKEMGLGMLTIKQVSSHNHSQRLAQNLGFHTTGLLPDYVISPFDQARPESIVLGCLPLQRWPFPELHWPVNWQTWLTSVTQIFGQEPLKPAVPIDTGTRIASHGGRLEVWIETQTTERVKEVTELPAHKLIYVKLPVGEETLHAVQILQQAGFACTGFVPGHHHRWEMLLVRGHSRKELTLSCQFAHNLHQQSLFACAER

SEQ ID NO: 8233 - protein, 423 aa, Xenorhabdus bovienii
  Peptide sequence Name=Xb4151_4152.C436.gene71.pep
  Gene classification: Gene name=PaaK; Function=Coenzyme F390 synthetase; Function class=H Coenzyme metabolism
  Homolog annotation: Query=2..417bp; Hit=20..440bp; Blast score=73; Percent Identity=24.0; E value=3e-13; Homolog= BH0195 COG1541
MTLSLHDLVEYARHHAPFFRDLYSDLPQSGWALTDLPLIDPAAYWQQSQPLENWPVLTGPINSGHIFKTGGSTSEGRLSVFSRSEWQAFVRSFGQGLAQQLQSGDRVANLFFAGDLYTSLLFIHGALSHSPVPVVEYPFTCSVEDQALADAIVSLGINVLAGVPVQLLRFASTLQRSGQFMPNIDRLLYGGESLFPEQLALLNIVFPNARISSIGCASVDAGLIGAASPDCHHGEHRVFDEDSIVEIIDESNGQPITESGRNGMLVVTNLQRRLMPVIRYPTGDLACWCEGSGRLNRKFALQGRAGSAHRIRVSTLSLFPDQIARLLQQQKGILAWQLLLSRQDGIDKITLLLASDSPQMPSTTSIHQALVTAQPAMAELCSQGGLQVEVASCALENMVTHPRSGKLIRVVDHRCYNAEEKTA

SEQ ID NO: 8234 - protein, 801 aa, Xenorhabdus bovienii
  Peptide sequence Name=Xb4151_4152.C436.gene72.pep
  Gene classification: Gene name=PaaK; Function=Coenzyme F390 synthetase; Function class=H Coenzyme metabolism
  Homolog annotation: Query=438..720bp; Hit=56..342bp; Blast score=86; Percent Identity=26.0; E value=1e-16; Homolog= AF1671 COG1541
MYLVNGEVISNLEPAATLADLKNRLADALACPPTVQEVLDCAERFANNLDTLATDFALDSATISTLRHFCRRDALEEKLRHELGEQPFSLRRFDYTQPRFETWQPLGLVVHITPANAPLLPFMAVLESLLVGNINWLRPSSSDNGLNARILAEFLRHDLSGKLASYVSVMPLPSDQLSELLACADAVSAWGSNAALTAIRSQLRPGCRWIDWGHRISFAYLDPMVASNADYDALADDVCRFDQQACSSPQCLLVDSTDENVLRKVADAVASALERRAPEWPALQPDIQEAAEISSQMAFLRLDHTFADVAGSVTEGAGWRVAWTQRRELAASPLYRTLQIRPVPRAQLINVLLPWRPYLQSCGLIAGEHELPALSRQLLAAGVSRICQPGAMHEGYEGEPHDGVYALTRLARRVSVSVKAEQLPNHVTLDKLSVRPPDLAGLPIMGKAQFQQSGTTPKAQVFFRSGGSTGAPKLAGFSHRDYHIQMQAAADGLFSAGLDPAQDRVINLLYGGNLYGGLLSFFTVLDKLSVPHYPMGGPIDDDFSQILQVIITQGVNTLVGMPSTIYQLFEREEAALRAYGGVRKIFAGGEHVSEERRQFLSSFGVQVIRSAIYGSVDAGPLGHACTCCNEGEFHLLSDIQWLEILDLDSEQPVQSGETGRLVFTPLAREGQVVQRYEVGDLGHWLPETCTCGLPTPRFRLKGRHGGLIRVGSIFVNPTALSADLAFPVQWLVGNLDKGGEYIHVLADGDINQVRQHLLRHEMLNQVVSSELLQLEITSTPAGQFRRHSQSGKTPLVLDYRA

SEQ ID NO: 8235 - protein, 376 aa, Xenorhabdus bovienii
  Peptide sequence Name=Xb4151_4152.C436.gene73.pep
  Homolog annotation: Query=1..376bp; Hit=1..376bp; Blast score=696; Percent Identity=88.0; E value=0; Homolog= gi|37528019|ref|NP _931364.1| hypothetical protein [Photorhabdus luminescens subsp. laumondii TTO1] gi|36787456|emb|CAE16553.1| unn
LTSLAYVDALCSLDHPYRADSDCDQLFDAAMRELTQYHCENSPGYYQWLKANGLDAQKLEKLHDWSHLPPIFANYFKHQLLLSHTGIDALELTSSGTTGQKSRMRYDTRSIQAAQRMVERIFEYYGWNTPQQPCNYILLSYEPAGAITLGTAYTDQYLCQYAPVSQACYALRHNGKSNEFDPFGVIRALQEFAAQGLPVRFLGFPAFLWFTLERMREMNLPPLQLHPESLVFLGGGWKTHADKAISRSELYRRLHEQLGIPDERCRDGYGSVEHPVPYVECQNHHFHVPSYARAYVRDTASMAVQPYGKPGFLHLISPYITSSPAHSIVVSDLAVLHPAAECGCGLATDWFELLGRAGISKNRSCAIAASELIKES

SEQ ID NO: 8236 - protein, 58 aa, Xenorhabdus bovienii
  Peptide sequence Name=Xb4151_4152.C436.gene74.pep
LVTIAIGTIGMIKRTKGVNISKRSQKSSPEKERKKGKLPSIISKLIYHPASKKGLIIH

SEQ ID NO: 8237 - protein, 52 aa, Xenorhabdus bovienii
  Peptide sequence Name=Xb4151_4152.C436.gene75.pep
MLITFSNIKKYFLDSNNIRYRLSIFVYHNAMINSEYSSSINRNIEYVSYSLD

SEQ ID NO: 8238 - protein, 251 aa, Xenorhabdus bovienii
  Peptide sequence Name=Xb4151_4152.C436.gene76.pep
  Gene classification: Gene name=Exo; Function=5'-3' exonuclease (including N-terminal domain of PolI); Function class=L DNA replication, recombination and repair
  Homolog annotation: Query=2..248bp; Hit=33..279bp; Blast score=364; Percent Identity=68.0; E value=1e-101; Homolog= exo COG0258
MIHLLIVDALNLIRRIHAVQGSPCAPACEHALKQLITHSSPTHAVAVFDEDDRGHSWRHQLLPDYKAGRSAMPDDLQQEMPLIKQAFNALGVACWHAEGHEADDLAATLATKVTSTGHRVTIVSTDKGYCQLLSPTIQIRDYFQKRWLDLPFVEREFGVSPAQLPDYWGLSGISSSKIPGVQGIGPKTAAILLQQAGSLDNLFQYLEAQPDKWRNKLATHKEMAYISREVASLRTDLSLNGNLQQLRLDHR

SEQ ID NO: 8239 - protein, 44 aa, Xenorhabdus bovienii
  Peptide sequence Name=Xb4151_4152.C436.gene77.pep
MRRIKFSASTIKRCIMVVMLRPWIDSLASVSLGFNEDVTYLMIS

SEQ ID NO: 8240 - protein, 445 aa, Xenorhabdus bovienii
  Peptide sequence Name=Xb4151_4152.C436.gene78.pep
  Gene classification: Function=Predicted Rossmann fold nucleotide -binding protein; Function class=R General function prediction only
  Homolog annotation: Query=1..443bp; Hit=11..452bp; Blast score=724; Percent Identity=79.0; E value=0; Homolog= ygdH COG1611
MDLLSQLEVDTLKHTASSDLYRLFRNCSLAVLNSGSQTDNSKELLSKHEDFDINVLRRERGVKLELVNPPKDAFVDGKIIRSLRANLFAVLRDILFVHAQIDHAQKVHHLNMENGMHITNTIFSILRNAKALHLSEDPNMIVCWGGHSINEKEYLYGRKVGNELGLRELNICTGCGPGAMEAPMKGAAVGHAQQRYQKSRFIGITEPSIIAAEPPNPLVNELIIMPDIEKRLEAFVRIAHGIIIFPGGVGTAEELLYLLGILMNPDNKDQVLPLILTGPKESADYFHVLDQFIVNTLGEQARQYYRIIMDDPSEVARVMKKTMPQVKEHRRSTGDAYSFNWSLKISHDLQHPFEPFHSNMANLNLHPNQPSEKLASALRCAFSGIVAGNVKEAGIHAIEKDGAFKIHGDVDIMRCMDELLKDFVRQDRMKLPGGTAYEPCYEIIK

SEQ ID NO: 8241 - protein, 281 aa, Xenorhabdus bovienii
  Peptide sequence Name=Xb4151_4152.C436.gene79.pep
  Gene classification: Function=Enzyme related to GTP cyclohydrolase I; Function class=R General function prediction only
  Homolog annotation: Query=140..281bp; Hit=3..145bp; Blast score=234; Percent Identity=75.0; E value=6e-62; Homolog= yqcD_2 COG0780
MSLYQDNQALAQLTLGKPTPYRDHYDPTLLQAVPRSMNREPLGLFPDNLPFHGADIWTLYELSWLNTRGVPQVAIGHVSLNAASVSLIESKSFKLYLNSFNQTRFADWDTVQKTLQQDLSVCANGEVNVVLHPLHDFSQQPIAEFEGKCIDNQDIEIDDYQFSRDYLNGAATGSVVDEILVSHLLKSNCLITHQPDWGSVQIRYKGPKIDQEKLLRYLVSFRHHNEFHEQCVERIFNDLIALCAPEKLTVYARYTRRGGLDINPWRSNEAFIPETGRLARQ

SEQ ID NO: 8242 - protein, 31 aa, Xenorhabdus bovienii
  Peptide sequence Name=Xb4151_4152.C436.gene80.pep
MMATEIDCSVSRNFKGSYFYCTLFTVLTELA

SEQ ID NO: 8243 - protein, 110 aa, Xenorhabdus bovienii
  Peptide sequence Name=Xb4151_4152.C436.gene81.pep
MKSLHYHKIKVSLIDIIKNNIYNTSSDIFLLFLYYLNKYSIKNMNICLNCYPDKITNRINKLKNRKRSEYHIMTHIIDGKKQIHNSIENKRLSLAQKSYANSVSTVNNVQ

SEQ ID NO: 8244 - protein, 52 aa, Xenorhabdus bovienii
  Peptide sequence Name=Xb4151_4152.C436.gene82.pep
VLLSHWRSYDSFIHHFKFITLYRLFLYSFQQNNNRKMMPSFHQLVQINKILK

SEQ ID NO: 8245 - protein, 183 aa, Xenorhabdus bovienii
  Peptide sequence Name=Xb4151_4152.C436.gene83.pep
  Homolog annotation: Query=1..179bp; Hit=1..179bp; Blast score=275; Percent Identity=74.0; E value=2e-73; Homolog= Pa|Phot2-87c03.q1k _g105| 69039 - 69590 2630 183 aa, chain +
MISNVTEALSDFTRRYVELWQEETGLPPVSSDLYGVPSSCIERTGDGVVYWLPKLFSVHEKLSKVETALDIRLQDSIHDYYVTQLAGDMTASFEGQNLSLIQVWSDDDFIRLQENLIGHLVTQKRLKLSPTAFIATIDSDMGMISVCNLTGQVVLEQFGKPERTILSADLASFLSVIKPATSL

SEQ ID NO: 8246 - protein, 35 aa, Xenorhabdus bovienii
  Peptide sequence Name=Xb4151_4152.C436.gene84.pep
MTEAATTSLEGNKNITDMISAENLRQDKMKQKEGR

SEQ ID NO: 8247 - protein, 108 aa, Xenorhabdus bovienii
  Peptide sequence Name=Xb4151_4152.C436.gene85.pep
  Gene classification: Function=Uncharacterized BCR; Function class=S Function unknown
  Homolog annotation: Query=1..85bp; Hit=1..85bp; Blast score=82; Percent Identity=51.0; E value=5e-17; Homolog= PM0478 COG3098
MNIEQQILLKLQLIEADMKAAGLWRSHPPKPEAFESTEPFSLDTMSAEEWLQWVLIPRMRAMIEQNANLPTAFDITPYFEEVYKEEAERYLPLLEHLRELDSLFTQDI

SEQ ID NO: 8248 - protein, 250 aa, Xenorhabdus bovienii
  Peptide sequence Name=Xb4151_4152.C436.gene86.pep
  Gene classification: Gene name=RluA; Function=Pseudouridylate synthases, 23S RNA-specific; Function class=J Translation, ribosomal structure and biogenesis
  Homolog annotation: Query=1..244bp; Hit=1..244bp; Blast score=323; Percent Identity=66.0; E value=1e-88; Homolog= yqcB COG0564
MLDIIYQDDHIVAVNKPAGWLVHRSWLARHETVFVMQTLRDQIGQHVFPVHRLDKPTSGVLLMALSSEVARTLSQQFECHHIQKTYHAIVRGYVEGDGIIDYALMEELDKIADKFADTDREAQSAITHYRSLAKVECPVEIGRYPTSRFSLLELMPKTGRKHQLRRHMSHLRHPIIGDTTHGDLRQNRGVVKYYQTGRLMLHASQLQLAHPVTGEDLLLTARWEASWQHLLEQFGWQGIVPELECPTTHE

SEQ ID NO: 8249 - protein, 164 aa, Xenorhabdus bovienii
  Peptide sequence Name=Xb4151_4152.C436.gene87.pep
  Gene classification: Gene name=FldA; Function=Flavodoxins; Function class=C Energy production and conversion
  Homolog annotation: Query=15..163bp; Hit=1..149bp; Blast score=191; Percent Identity=63.0; E value=3e-49; Homolog= yqcA COG0716
MNERSTNRLKRSIFMAKIGVFVGTVYGNALAVAEEAQQILQQQGHDVEVFEDATLTQWQEYQQQVVLVVTSTTGQGNLPDNIQPLYSDMNDKLGHQPDLRYGVIALGDSSYDFFCGGGRTFDKLLQEQGAKRVGEVLLIDGIDVVEPEVFAQNWVEEWGALLTE

SEQ ID NO: 8250 - protein, 128 aa, Xenorhabdus bovienii
  Peptide sequence Name=Xb4151_4152.C436.gene88.pep
  Homolog annotation: Query=1..128bp; Hit=1..128bp; Blast score=197; Percent Identity=89.0; E value=3e-50; Homolog= gi|37524669|ref|NP _928013.1| hypothetical protein [Photorhabdus luminescens subsp. laumondii TTO1] gi|36784094|emb|CAE12963.1|
MYDNLKSLGITHPEDIDRYSLRQEANNDILKIYFRKDKGEFFAKSVKFKYPRQLKTISDDNSAQGYKEVKEINTNLRYVIEELDQICRHDQVEVDLKHKILDDLRHLEHVVANKIAEIEADLEKLTRK

SEQ ID NO: 8251 - protein, 274 aa, Xenorhabdus bovienii
  Peptide sequence Name=Xb4151_4152.C436.gene89.pep
  Gene classification: Gene name=DapD; Function=Tetrahydrodipicolinate N-succinyltransferase; Function class=E Amino acid transport and metabolism
  Homolog annotation: Query=1..274bp; Hit=1..274bp; Blast score=480; Percent Identity=90.0; E value=1e-136; Homolog= dapD COG2171
MQQLQSIIDNAFENRTNITPGTVDEATRSAVNQVIQMLDSGKLRVAEKIAGQWVTHQWLKKAVLLSFRINDNQVIEGAESRYFDKVPMKFADYDQARFEKEGFRVVPPAAVRQGAYIARNSVLMPSYVNIGAYVDEGTMVDTWATVGSCAQIGKNVHLSGGVGIGGVLEPLQANPTIIEDNCFIGARSEIVEGVIVEEGAVISMGVYIGQSTKIYDRETGEIHYGRVPAGSVVVSGNLPSKDGSYSLYCAVIVKKVDAKTRGKVGLNELLRNID

SEQ ID NO: 8252 - protein, 884 aa, Xenorhabdus bovienii
  Peptide sequence Name=Xb4151_4152.C436.gene90.pep
  Gene classification: Gene name=GlnD; Function=UTP; Function class=O Posttranslational modification, protein turnover, chaperones
  Homolog annotation: Query=11..883bp; Hit=17..889bp; Blast score=1215; Percent Identity=69.0; E value=0; Homolog= glnD COG2844
MSVDITFAHAPIPPLSPVEFSLDDLQCPVLKQHVDEFQLWLQQAFKAGISPEALISARSDYIDRLLTRLWQAHGFDQNTSLSLIAVGGYGRRELHPLSDIDLLILSESQLTEDQAHNIGQFITLLWDIRLEVGHSVRTFEECLHEGLSDLTVATNLIESRLICGDLPLFLRLQKHIFSDDFWPSSTFFAAKLREQWERHQRYHSTSYNLEPDIKSSPGGLRDIHTLLWVARRHFGAASLDEMVDFGFLTREERNELNECQNFLWRIRFALHLVVTRYDNRLLFERQFNVAQLLGYEGERNQPVERMMKNFYRVTRRVSELNDMLLQLFDEAILTLQPDEKPRPLNEAFQLRGDLIDLSDETLFIQDPTSILKMFYHMAEHREIKGIYSTTLRQLRYARRNLKHPLCELPEARKLFMDILRHPRAVKNALIPMHRHSVLGAYMPLWSNIVGQMQFDLFHAYTVDEHTLRVLQKLESFADENNRVIHPLCVELYPRIPQPELLRLAAFFHDIAKGRNGDHSELGAKDAFTFARQHGLTTREAELVEWLVRDHLLMSVTAQRRDIQDPDVIQQFAGQVKNKNRLNYLLCLTVADICATNSKLWNSWKQSLIRELYFATETQLRQGIQNTPDLRERVRHNRLQALALLRQERADEEQLHNIWSRCHADYFLRHTPDQLAWHAGHLIQHQSAEPMVLISTAFSHGGTEIFIWCQDRPSLFAAVVGELDRRNLSVHDAQIFTNRDEMAMDTFIVLEPNGHPLALDRHEPIRRALLKVVNDPHPKAPKARNLPAKLRHFDVPTKVSFLPTQNARRSYMELVALDQPGLLARVGNIFAELGVSLHGARITTIGERVEDFFILADKDHQELDNKIKGELSERLTEALNTKDKV

SEQ ID NO: 8253 - protein, 63 aa, Xenorhabdus bovienii
  Peptide sequence Name=Xb4151_4152.C436.gene91.pep
LINEALVHKLSPRASLSANNVCSSHVFLIIGFCICQLISPLHTRPFLPCLLWNFPSMIFSAQY

SEQ ID NO: 8254 - protein, 36 aa, Xenorhabdus bovienii
  Peptide sequence Name=Xb4151_4152.C436.gene92.pep
MYKGFVYQRRLIYVISANDCKIAPAGNYSLISTAEI

SEQ ID NO: 8255 - protein, 270 aa, Xenorhabdus bovienii
  Peptide sequence Name=Xb4151_4152.C436.gene93.pep
  Homolog annotation: Query=155..257bp; Hit=4..105bp; Blast score=71; Percent Identity=34.0; E value=2e-11; Homolog= gi|23105093|ref|ZP _00091551.1| COG0052: Ribosomal protein S2 [Azotobacter vinelandii]
MRFFFFAQCHDFTAIFGDYDGVLILSRPAVIFGFDCPAIFHGADTGIAGIDHRFNRERHPFLQYNAAIISVIMEYVGFFVEDPADTMTAVFADDRVILPFHILLDRFAKAAQADAGFYHFQRKVQAFLGNAAQTLTLNSRFADNEHFGGIAVKFLFDDSDINVDDIAFFQHLVIAGNTVTNHIIDGDAYGFRETVIAKTGRNCLLFIGNMIVANTIKLTSGHTNLNVRFDHFQNFGCQTSGNAHFLDVFICFDRNSHEIGPFKSELYPTA

SEQ ID NO: 8256 - protein, 44 aa, Xenorhabdus bovienii
  Peptide sequence Name=Xb4151_4152.C436.gene94.pep
MPARFIPQTAPKFQHLLPLSGRQIYQRLLADILWTDTITTSIFP

SEQ ID NO: 8257 - protein, 241 aa, Xenorhabdus bovienii
  Peptide sequence Name=Xb4151_4152.C436.gene95.pep
  Gene classification: Gene name=RpsB; Function=Ribosomal protein S2; Function class=J Translation, ribosomal structure and biogenesis
  Homolog annotation: Query=1..241bp; Hit=1..241bp; Blast score=450; Percent Identity=91.0; E value=1e-127; Homolog= rpsB COG0052
MATVSMRDMLQAGVHFGHQTRYWNPKMKPFIFGARNKVHIINLEKTVPMFNSALAELNKIASRKGKILFVGTKRAACEAIKEEALGCDQYFVNHRWLGGMLTNWKTVRQSIKRLKDLEVQSQDGTFDKLTKKEALMRTRELGKLENSLGGIKDMGGLPDALFVIDAEHEHIAIKEANNLGIPVFAIVDTNSDPDGVDFIIPGNDDAIRAVKLYLGAVATAVRDGRSQDLAVQAEEGLVDAE

SEQ ID NO: 8258 - protein, 33 aa, Xenorhabdus bovienii
  Peptide sequence Name=Xb4151_4152.C436.gene96.pep
VTGPLTNIFQYLVNKGSRMSMPYYSASTRPSSA

SEQ ID NO: 8259 - protein, 285 aa, Xenorhabdus bovienii
  Peptide sequence Name=Xb4151_4152.C436.gene97.pep
  Gene classification: Gene name=Tsf; Function=Translation elongation factor Ts; Function class=J Translation, ribosomal structure and biogenesis
  Homolog annotation: Query=1..285bp; Hit=1..283bp; Blast score=365; Percent Identity=74.0; E value=1e-101; Homolog= tsf COG0264
MADITAALVKELRERTGAGMMECKKALVEANGDIELAIDNMRKSGQAKAAKKAGRVAAEGVILVEVAADAKYAGIVELNCETDFVAKDSGFLAFGKEVIAAVMADKNADIDALKAQFEEQRANLVAKIGENINIRRVTILEGDAVGSYLHGARIGVLVSAEGASEELIKHVAMHVAASKPEYVNPTDVPADVVAREHQIQMDIAMQSGKPREIAEKMVSGRMNKFTGEISLTGQNFVMDPSKTVGDLMKENNAKVINFIRFEVGEGIEKVEADFAAEVAAMSKQS

SEQ ID NO: 8260 - protein, 242 aa, Xenorhabdus bovienii
  Peptide sequence Name=Xb4151_4152.C436.gene98.pep
  Gene classification: Gene name=PyrH; Function=Uridylate kinase; Function class=F Nucleotide transport and metabolism
  Homolog annotation: Query=1..240bp; Hit=1..240bp; Blast score=421; Percent Identity=90.0; E value=1e-118; Homolog= pyrH COG0528
MATNAKPVYQRILLKLSGEALQGAEGFGIDASVLDRMAQEVKELVELGIQVGVVIGGGNLFRGAGLAEAGMNRVVGDHMGMLATVMNGLAMRDALHRAYVNARLMSAIPLNGVCDNYSWAEAISLLRHGRVVIFSAGTGNPFFTTDSAACLRGIEIEADVVLKATKVDGVYSSDPAKDTEAVLYSKLTYQEVLERELKVMDLAAFTLARDHSIPIRVFNMNKPGALRRVVMGESEGTLISHG

SEQ ID NO: 8261 - protein, 205 aa, Xenorhabdus bovienii
  Peptide sequence Name=Xb4151_4152.C436.gene99.pep
  Gene classification: Gene name=Frr; Function=Ribosome recycling factor; Function class=J Translation, ribosomal structure and biogenesis
  Homolog annotation: Query=21..205bp; Hit=1..185bp; Blast score=258; Percent Identity=76.0; E value=3e-69; Homolog= PM1987 COG0233
MISYVDIRGLQNNQIPRVCNVINEIKKDAQDRMEKSVEALKNQISKIRTGRASPSLLDGISVDYYGSATPLRQIASVVAEDARTLAITVFDRSMTPAIEKAIMASDLGLNPSSAGTIIRVPLPALTEERRKDLIKVVRGDAEQGRVSVRNIRRDANDKVKALLKDKEISEDEERRSQDEIQKLTDSFIKKIDEALASKETELMDF

SEQ ID NO: 8262 - protein, 47 aa, Xenorhabdus bovienii
  Peptide sequence Name=Xb4151_4152.C436.gene100.pep
LPFHEYNAAVLAALFFASHFFLRRWTYRSRRLKLLTFYVSRILRVLK

SEQ ID NO: 8263 - protein, 398 aa, Xenorhabdus bovienii
  Peptide sequence Name=Xb4151_4152.C436.gene101.pep
  Gene classification: Gene name=Dxr; Function=1-deoxy-D-xylulose 5 -phosphate reductoisomerase; Function class=I Lipid metabolism
  Homolog annotation: Query=1..393bp; Hit=1..393bp; Blast score=532; Percent Identity=70.0; E value=1e-151; Homolog= ZyaeM COG0743
MKRLTILGSTGSIGKSTLSVVRNNLDKFQVVALVAGKNIEIMAQQCLEFRPQYAAMADAHSATVLRQLLQEQGSQTEVLSGREAICDLAALDDVDQVMSAIVGVAGLLPTLAAIRKGKQVLLANKEALITSGRLFMQAVNQYQAQLLPIDSEHNAIFQSLPESVQHNLGNASLKQHGISSIILTGSGGPFRRTPLETLLDVTPDEACAHPVWSMGRKISVDSATMMNKGLEYIEARYLFNASADEIEVLLHPQSVIHSMVRYQDGSIIAQLGTQDMCTPIAYAMAYPNRIVSGVKPLDFTELSTLTFEALDYRRYPCLKLAIDACHEGQAATTALNAANEETVSAFLKDGIRFTDIAMINRLVVEKLNLPEPESIEEVLEIDKVARELAKETIKACSK

SEQ ID NO: 8264 - protein, 69 aa, Xenorhabdus bovienii
  Peptide sequence Name=Xb4151_4152.C436.gene102.pep
MKKPCQHLPRLFLGHGPNESLYLWHTLRKRVTNIELAIITTIIYPRTIPFAKTQTNIYLLAKFAIWSRP

SEQ ID NO: 8265 - protein, 231 aa, Xenorhabdus bovienii
  Peptide sequence Name=Xb4151_4152.C436.gene103.pep
  Gene classification: Gene name=UppS; Function=Undecaprenyl pyrophosphate synthase; Function class=I Lipid metabolism
  Homolog annotation: Query=1..226bp; Hit=25..250bp; Blast score=345; Percent Identity=73.0; E value=2e-95; Homolog= yaeS COG0020
MDGNGRWAKQRGKLRVFGHRAGVKAVRVAVSFSVKHNIESLTLYAFSSENWNRPQQEVSSLMELFVFALDNEVKSLHKHNVKLSVIGDISRFSSRLQERIRRSVELTAGNTGLQLNIAANYGGRWDLVQGVKQIAEKIRANELEPEEITEATVGSVINLSEQPEVDLVIRTGGEHRISNFLLWQIAYAELYFTDILWPDFDETVFEGAINAFVKRERRFGGTIPDDAEVGS

SEQ ID NO: 8266 - protein, 287 aa, Xenorhabdus bovienii
  Peptide sequence Name=Xb4151_4152.C436.gene104.pep
  Gene classification: Gene name=CdsA; Function=CDP-diglyceride synthetase; Function class=I Lipid metabolism
  Homolog annotation: Query=37..281bp; Hit=1..245bp; Blast score=251; Percent Identity=58.0; E value=5e-67; Homolog= cdsA COG0575
LLKYRLLTTLILIPIVIAALFLLPPSGFGLVVITVSVLAAWEWGQFAGLFTQAKRITLAVLFAVGLLALQYSLSDFSHLIEKPQIVYLLWAGMIWWAAAILLVTTYPASASIWKSSTALRLLFGVLTIVPFYCGMMVLRTQGYENNTYHGAWWLLYAMLLVWGADSGAYVFGRTLGKHKMAPRVSPGKTLEGLVGGVLTAALISWLFGKFAPVPVMPENLLLISAVVVIASVFGDLTESMFKRESGIKDSSLLIPGHGGVMDRVDSLTAAVPVFAGLVLLISSGFGL

SEQ ID NO: 8267 - protein, 450 aa, Xenorhabdus bovienii
  Peptide sequence Name=Xb4151_4152.C436.gene105.pep
  Gene classification: Function=Predicted membrane-associated Zn -dependent proteases 1; Function class=M Cell envelope biogenesis, outer membrane
  Homolog annotation: Query=1..449bp; Hit=2..449bp; Blast score=596; Percent Identity=69.0; E value=1e-170; Homolog= yaeL COG0750
MDILWNLAAFIVALGILITVHEFGHFWVARRCGIYVERFSIGFGKALWRRTDKQGTEYVIALIPLGGYVKMLDERVESVSPERRHMAFNNKTIGQRAAVVSAGPIANFILAVIAYWLVFVIGVPSVRPVVLDVKPDSIAAQANILPGMELKTVDGIETFDWNSVRLALVSKVGESFVSMDVMPMDAAASMQKTLDLRDWAFDPSKQDVLLSLGIMPVVPRISSQVENVYPDSPAEKAGLQRGDRIVKVNGQNVDVWHTFVSFIRKNPNVPLKLDVARANSIIPLSLTPEVRRLSNGREEGFAGAELHVIPLADEYKVIQQYGAFSAIYQAGDKTWQLMKLTVNMIGKLIVGDVKLNNLSGPISIAKGAGVSADSGLVYYLMFLALISVNLGIINLFPLPVLDGGHLLFLAIEKIKGGPVSERVQDFSYRIGTILLVLLMGLALFNDFSRF

SEQ ID NO: 8268 - protein, 811 aa, Xenorhabdus bovienii
  Peptide sequence Name=Xb4151_4152.C436.gene106.pep
  Gene classification: Function=Predicted outer membrane protein; Function class=M Cell envelope biogenesis, outer membrane
  Homolog annotation: Query=19..811bp; Hit=1..810bp; Blast score=1183; Percent Identity=71.0; E value=0; Homolog= yaeT COG0729
MISPASKVGDRLGKRITTMAMKKLLIASLLFGSATAYSSDGFVVRDIHFEGLQRVTSGAALLNMPVRVGDTISDEDISRTIHTLFATGNFEDVRVLRDGNTLVVQVKERPTIASITFSGNKSVKDDMLKKNLESSRVSVGEALDRTMLSNMEKGLEDFYYSVGKYNATVKAVVTPLPRNRIDLKLIFSEGISAQIQQINIVGNKAFSTNELLNRFQLRDDIPWWNFMADQKYQKQKLAGDLETLRSFYLDRGYARFNIDSTQVNLTPDKKGIYITVNINEGAQYKIASVDLNGNLAGYQSEATKLTNIQPGSLYNGTEVTSMEKAIKNLLGRYGYAYPRVITQPEINDTDKTVKLHVNVDAGNRFYVRKIRFEGNDISRDSVLRREMRQMEGAWLGSDRVEQGKERLDRLGFFETVNVDTERVSGSPDLVDVVYKVKERNTGSMNFGVGFGTESGMSFQVGLQQENWLGTGNSVGISASKNDYSTSADLSFTDPYFTVDGVSLGGRVYYNDFRADDAELSGYTNKAYGTEGILGFPLNENNRLAMRLGYAHNSLSNMRPQAAMWRYLKKMGKEPPLKGKASFDSNDFPLTFSWIYGNFDRGFFPTSGFKSSVDAKVALPGSDNQYYKLTWSATGYYPIDDKNSWIMMGRTRMGYGGGLGGKEMPFYENFYAGGSNSVRGFRSNNIGPKAIYLGENKEPEKNSPSRDAVGGNALATASFELITPTPFLDAKYANTVRTSFFVDAGTVWDTNWNNISPGLPDYSKPNNIRVSAGIALQWLSPLGPLTFSYGKPIKEYEGDRAEQFQFNIGGTW

SEQ ID NO: 8269 - protein, 165 aa, Xenorhabdus bovienii
  Peptide sequence Name=Xb4151_4152.C436.gene107.pep
  Gene classification: Gene name=HlpA; Function=Outer membrane protein; Function class=M Cell envelope biogenesis, outer membrane
  Homolog annotation: Query=1..165bp; Hit=1..161bp; Blast score=109; Percent Identity=55.0; E value=1e-24; Homolog= hlpA COG2825
VKKVLCAASFGIALAFSAGVQAADKIGVVNVGEIIQKLPAREAAVKQLDSEFKGRISELQSMEADMQTKVQKLQRDGSTMKASERTKLEKEVMAQRNDYAQKAQSLDNDSRRRQMEEQNKLLTRIHDAVKVVAGKEGYDVVLDANTVLYSVSGKDITADVLKQVK

SEQ ID NO: 8270 - protein, 342 aa, Xenorhabdus bovienii
  Peptide sequence Name=Xb4151_4152.C436.gene108.pep
  Gene classification: Gene name=LpxD; Function=UDP-3-O-[3 -hydroxymyristoyl] glucosamine N-acyltransferase; Function class=M Cell envelope biogenesis, outer membrane
  Homolog annotation: Query=1..336bp; Hit=1..336bp; Blast score=523; Percent Identity=78.0; E value=1e-148; Homolog= ZlpxD COG1044
MVSIRLADLAQQLNAQLHGDGDIVITSIAPMYSANSEQITFLSDSRYTDKLAECQAAAVVLRESDLTHCKVAALVVDNPYLAYARMAQIMDTTPQPAQDIHPSAVIFSEVQLGKNVAVGANAVVESGVILGDNVIVGAGCFIGKNTRIGAGTRLWANVSVYHNVEIGEQCLIQSGTVIGSDGFGYANDRGNWIKIPQLGSVVIGDRVEIGASTTIDRGALDNTVIGNGVIIDNQCQIAHNVIIGDNTAVAGGVTMAGSLKIGRYCMIGGASVINGHIEICDKVTVTGMGMVMRPITEPGVYSSGIPLQPNKVWRKTAALVMNINEMNKRLKSVERQREGENE

SEQ ID NO: 8271 - protein, 62 aa, Xenorhabdus bovienii
  Peptide sequence Name=Xb4151_4152.C436.gene109.pep
LQSTIITHLNTLPVYIRIIVLTTRPALTPNAELSGRPQKIKTQPKNVCMITRFHLHAGVLQI

SEQ ID NO: 8272 - protein, 353 aa, Xenorhabdus bovienii
  Peptide sequence Name=Xb4151_4152.C436.gene110.pep
MWVICRLKLNFYSGFFQRSSATVKRFIGITDCMQRFFIKSTALQAFNIQPERCGMVSLCNDIRRDILRNTRATAYHNMRANLTELMDSCHSTDNDVIAQNDMPTQRAVIRNDTAITNHAIMGNVGVNHQQIVTANFSQTATLNGATMNRCAFTNTVTITDLNASRLTLIFEILIYFTNRGKLINLVITANFGDPVDHNMGFNFSPFTDLNLRTDIAKWANTDIATNNCTLFNNGRGMNNSSLINHILSLTTASTHHFSFASHFSIDFCYALKTRNTATFFNKFNFQNHLITWQNRTLETSAIDSGKVIQLTRSQRANAFECQNSGCLSHCFKDQDAWKNWLTRKMPLKEWFIK

SEQ ID NO: 8273 - protein, 394 aa, Xenorhabdus bovienii
  Peptide sequence Name=Xb4151_4152.C436.gene111.pep
  Gene classification: Gene name=LpxB; Function=Lipid A disaccharide synthetase; Function class=M Cell envelope biogenesis, outer membrane
  Homolog annotation: Query=12..393bp; Hit=1..382bp; Blast score=597; Percent Identity=80.0; E value=1e-171; Homolog= lpxB COG0763
MKDTPLATFSSVNNQRPLTIALVAGETSGDILGAGLIRALKAQIPDAHFVGVAGPLMQAEGCEAWYEMEELAVMGIVEVLGRLPRLLKIRKDLTARFTALKPDVFVGIDAPDFNITLEGRLKQRGIRTIHYVSPSVWAWRQKRVFKIGRATDLVLAFLPFEKAFYDRFSVPCKFIGHTMADSMPLQTDKMAAREALGVPLNAHCLAILPGSRHAEVEMLSADFLRTVQLLRKILPDLHVLVPLVNAKRHQQFQRIKDEIAPDLSVHMLDGNAGKAMIASDATLLASGTAALECMLAKCPMVVGYRMKPFTFWLAKRLVKTPYVSLPNLLAGKELVKELLQDECEPQALSEALLPLLQGGADVEALKQTFLHLHESIRCDADEQAAQAVLELARR

SEQ ID NO: 8274 - protein, 196 aa, Xenorhabdus bovienii
  Peptide sequence Name=Xb4151_4152.C436.gene112.pep
  Gene classification: Gene name=RnhB; Function=Ribonuclease HII; Function class=L DNA replication, recombination and repair
  Homolog annotation: Query=1..195bp; Hit=2..196bp; Blast score=300; Percent Identity=81.0; E value=5e-82; Homolog= rnhB COG0164
MDFVYPQANLIAGVDEVGRGPLVGAVVTAAVILDPAKPITGLMDSKKLTEKRREALYLEIKEKALCWSLGRAEPEEIDQLNILHATMLAMQRAVEGLAITPDYVLIDGNRCPALPMSALAVIKGDSLVAEISAASILAKVTRDREMAELGKQFPDYGFAQHKGYPTALHLEKLALLGATEHHRKSFAPVKRALGLG

SEQ ID NO: 8275 - protein, 1160 aa, Xenorhabdus bovienii
  Peptide sequence Name=Xb4151_4152.C436.gene113.pep
  Gene classification: Gene name=DnaE; Function=DNA polymerase III alpha subunit; Function class=L DNA replication, recombination and repair
  Homolog annotation: Query=1..1160bp; Hit=1..1160bp; Blast score=2044; Percent Identity=84.0; E value=0; Homolog= ZdnaE COG0587
MTEPRFVHLRVHSDYSMIDGLAKTGSLIKKVAKLDMPAFAITDFTNLCGLVKFYGSAHSAGIKPIIGADFYVESDLLGDEYAHLTILARNNEGYQNLTFLISEAYQKGYGAIGPTIKQEWLIKYKAGLILLSGGRMGDVGKFLLRGNRAMADQCLDFYQEHFPDSYYLELIRTGRQDEENYLHAAVEVAAEKNLPVVATNDVCFLESDDFEAHEIRVAIHDGYTMADPKRPKNYSPQQYLRSEQEMCELFSDIPEALQNSVEIAKRCNVTIRLGEYFLPQFPTGDMSTEDYLVEKSKQGLEDRLNFLYPDPQIRAEKRSEYDERLDIELEVINQMGFPGYFLIVMEFIQWSKDNGVPVGPGRGSGAGSLVAYALKITDIDPLAFDLLFERFLNPERISMPDFDVDFCMEKRDQVIDHVADMYGRDAVSQIITFGTMAAKAVIRDVGRVLGHPYGFVDRISKLVPPDPGMTLEKAFAAEPQLPEIYEADEEVRVLIDMARKLEGVTRNAGKHAGGVVIAPTKITDFSPIYCDPEGLNPVTQFDKNDVEYAGLVKFDFLGLRTLTIINWALDMVNARRTHKNLEPIDITAIPLDDQISFDMLQRSETTAVFQLESRGMKDLIKRLRPDCFEDMIALVALFRPGPLQSGMVDNFIDRKHGREELSYPDVEWQHESLKPVLEPTYGIILYQEQVMQIAQVLAGYTLGGADMLRRAMGKKQPEEMAKQRSVFEEGAISQGINGELAIKIFDLVEKFAGYGFNKSHSAAYALVSYQTLWLKAHYPAEFMAAVMTADMDNTEKVVGLVDECWRMGLKVLPPDINSGLYHFHVNDESEIVYGIGAIKGVGEGPIEAILEARQKEGHFKELFDLCARVDTKKLNRRVMEKLIMSGAFDRLGPHRAALMSSLEDALKAADQHAKAEAIGQTDMFGVLAEKPEQVELSYASTPKWPEQVVLDGERETLGLYLTGHPITSYLKEIERYTNGLRLKDVSPTPRGQVTTVVGLVLASKILTTKRGNRIGICTLDDRSGRLEIMLFSDALERYQHLLEQDKILIATGQVSFDDFSGGLKMTVRELMDISEAREKFARGIAISLSDRQINKQLFNRLRGVLEPHRSGTIPVHLYYQRVDARARLRFGATWRVTPTDTLLTDLRTLLGNEQVELEFD

SEQ ID NO: 8276 - protein, 319 aa, Xenorhabdus bovienii
  Peptide sequence Name=Xb4151_4152.C436.gene114.pep
  Gene classification: Gene name=AccA; Function=Acetyl-CoA carboxylase alpha subunit; Function class=I Lipid metabolism
  Homolog annotation: Query=1..318bp; Hit=1..318bp; Blast score=552; Percent Identity=86.0; E value=1e-157; Homolog= accA COG0825
MSLNFLDFEQPIAELEAKIDSLTAVSRQDEKLDINLDEEVQRLREKSLELTRKIFSDLGAWQISQLSRHPLRPYTLDYIQRVFTDFEELAGDRAYADDKAIVAGLARLDGRPVMVIGHQKGRETKEKIRRNFGMPSPEGYRKALRLMELAERFKLPIITFIDTPGAYPGVGAEERGQSEAIARNLREMSRLSVPVICTVIGEGGSGGALALSVGDKVNMLQYSTFSTISPEGCASILWKSAEKAPLAAEAMGNTAPRLKELKLIDSVIPEPLGGAHRNYDAIAQALKAQLLADFADLDHLNSEELVNRRYERLMQYGYC

SEQ ID NO: 8277 - protein, 51 aa, Xenorhabdus bovienii
  Peptide sequence Name=Xb4151_4152.C436.gene115.pep
VLISLPINNKTGGNTEVLSLPSTVHLQITILKIKLDCNKNSFQDLAVTVLH

SEQ ID NO: 8278 - protein, 305 aa, Xenorhabdus bovienii
  Peptide sequence Name=Xb4151_4152.C436.gene116.pep
  Gene classification: Gene name=RhaT; Function=7 Permeases of the drug/metabolite transporter (DMT) superfamily; Function class=G Carbohydrate transport and metabolism
  Homolog annotation: Query=8..280bp; Hit=5..270bp; Blast score=95; Percent Identity=28.0; E value=6e-20; Homolog= PAB0461 COG0697
MDKYKYIIYAFSCVLIWSFVPSISRLGQKGMDHFQYLFWSNILSVLAVFFVAVLMGRNLKQLLFIPFPVMFKVLILGTLDCFFYLLLYYGYSIENGVAVLVVQYSWPLMIIGLSFLLLKEKLSIRQMIGITLGFIAVVITFTQGNITRIAVEHPQALLLVFSGAFCFALMSVLSKHFAIDPYINTFWVFACSTLVSAVFLLVFSSFNWPVGDSLMPTLLNGIILNGVSYIIWFKAMNSPDSPKIASILFLSPVLSMIWLILFFGDAFVPAYVVGLVLVIISGLLCISAKTEPATQNKLSDDLIED

SEQ ID NO: 8279 - protein, 449 aa, Xenorhabdus bovienii
  Peptide sequence Name=Xb4151_4152.C436.gene117.pep
  Gene classification: Gene name=MesJ; Function=Predicted ATPase of the PP-loop superfamily implicated in cell cycle control; Function class =D Cell division and chromosome partitioning
  Homolog annotation: Query=15..444bp; Hit=8..429bp; Blast score=407; Percent Identity=52.0; E value=1e-113; Homolog= mesJ COG0037
MINTHIPLLTMLIDQLGRHKKVLVGFSGGLDSTVLLHLLVQLRYQSHSGVIRDQIELRAIHIHHGLNPKADKWVEHCRQICADWKVDFRVEKVSLDIRQNGIEAAARDARYQAFQHELQQGEILVTAQHLDDQAETFLLALKRGSGPAGLSSMPSSMPFSGTTLIRPLLNASRAELETYAQTQRLQWIEDDSNQDDRYDRNFLRLHIMPLLNQRWPHFPQSASRSASLCGEQEQLLDELLNESLNELITPEGAIAISPLVDCSEAKRNALLRRWFNQHGVKMPAREQLQKIWSEVALSRQDAEPRFRLGQHDVRRYRQQLWLVPQCQSLAGTLLEWDIAQELRLPDGLGMLVLSEESGINVRMPDRNERVTIRFGVQGNISIVGRRHSRHSKKLWQELGIAPWLRERTPLLYYDEKLVAALDVFVTKEGQPLAEKEILSIKWDRMPYSA

SEQ ID NO: 8280 - protein, 30 aa, Xenorhabdus bovienii
  Peptide sequence Name=Xb4151_4152.C436.gene118.pep
MRAFFSNDYFYLRLVFPAMTPAICSFITVV

SEQ ID NO: 8281 - protein, 40 aa, Xenorhabdus bovienii
  Peptide sequence Name=Xb4151_4152.C436.gene119.pep
MRTLCVILCINVSFLNTVRSSNAQCSITIVPISGLLKLMM

SEQ ID NO: 8282 - protein, 85 aa, Xenorhabdus bovienii
  Peptide sequence Name=Xb4151_4152.C436.gene120.pep
  Homolog annotation: Query=1..85bp; Hit=1..85bp; Blast score=129; Percent Identity=72.0; E value=1e-29; Homolog= Pa|Phot2-87c03.q1k _g144| 99893 - 100159 1337 88 aa, chain -
MSIDTEYQPINCDDYDNLELACQHQLHLHIQLQGGGIFEGKASKLILRKKVEYILVESNEETRELRLDHIISFSNPEIGTIVIEH

SEQ ID NO: 8283 - protein, 32 aa, Xenorhabdus bovienii
  Peptide sequence Name=Xb4151_4152.C436.gene121.pep
LIFFPMHFEIRYSNVNLVKKSSCFTWYGRYEY

SEQ ID NO: 8284 - protein, 233 aa, Xenorhabdus bovienii
  Peptide sequence Name=Xb4151_4152.C436.gene122.pep
  Gene classification: Gene name=CutF; Function=Uncharacterized lipoprotein NlpE involved in copper resistance; Function class=M Cell envelope biogenesis, outer membrane
  Homolog annotation: Query=4..209bp; Hit=1..211bp; Blast score=160; Percent Identity=39.0; E value=1e-39; Homolog= ZcutF COG3015
MKMMMNKKILLAVGVLTAVGCQNKVASQDNATLQENTLQNKLQTAERVFTGVVPCADCTGIETTLQLSSDGSYILGQIYLEAKNEENTFFETGHWIKSGKKIDLTHEDGKKSYYQMKGENLVMLDIDGEPIQSNFNYELGKVTPKKMAGEYSYIADSATFTECRTGKHYDASENIDLERGYSATGVEGGEPVYVEVEGYYSLRPSMEDGMFDHALIQTGKIHFDKSASCQTRK

SEQ ID NO: 8285 - protein, 573 aa, Xenorhabdus bovienii
  Peptide sequence Name=Xb4151_4152.C436.gene123.pep
  Gene classification: Gene name=ProS; Function=Prolyl-tRNA synthetase; Function class=J Translation, ribosomal structure and biogenesis
  Homolog annotation: Query=1..571bp; Hit=1..571bp; Blast score=981; Percent Identity=82.0; E value=0; Homolog= ZproS COG0442
MRTSQYLLSTLKETPADAEVVSHKLMLRAGMTRKLASGLYNWMPTGVRVLKKVENIVREEMNNAGAIEVSMPVVQPADLWQESGRWEQYGPELLRFEDRGARPFVLGPTHEEVITDLVRNEVTSYKQLPLNLFQIQTKFRDEVRPRFGVMRSREFIMKDAYSFHTSQESLQETYDKMYDAYSKIFTRIGLDFRAVLADTGSIGGSASHEFQVLADSGEDDIAFSTESNYAANIELAEAVMPSHERAVPSEDMHLVETPNAKTIAELVEQFNLPIEKTVKTLIVHAAKESSHQLVALLVRGDHELNEIKAEKLPLVASPLSFATEEEIRAVVQAGPGSLGPVNLPMPVIIDRSVSVMSDFGAGANVDDKHYFGINWERDLPLPEIADIRNVLEGDASPDGQGTLLIKRGIEVGHIFQLGTKYSDALKATVQNEDGHNQVVSMGCYGIGVTRIVAAAIEQNHDDRGIIWPDAIAPFQVALLPMNMHKSYRVKEVAEKLYADLRANGIDVIFDDRKERPGVMFADMELIGVPHTLVIGDRNLDNGEVEYKYRRNGDKQMLKLEGIIEYLKEQIKQH

SEQ ID NO: 8286 - protein, 48 aa, Xenorhabdus bovienii
  Peptide sequence Name=Xb4151_4152.C436.gene124.pep
LASTHSKFPLDSKLLLGDKIVPPNPENKDKPLVYQRVCYVKRGFNGVQ

SEQ ID NO: 8287 - protein, 241 aa, Xenorhabdus bovienii
  Peptide sequence Name=Xb4151_4152.C436.gene125.pep
  Gene classification: Function=Uncharacterized ACR; Function class=S Function unknown
  Homolog annotation: Query=7..241bp; Hit=1..235bp; Blast score=327; Percent Identity=67.0; E value=5e-90; Homolog= yaeB COG1720
MIKKTLMADFHFTQIGTIHSPYKEKFAIPRQPGLVEDGAGQLELLAPYNQIDAIRGIEQFSHLWIIFVFHQTMNGGWNPLVRPPRLGGNAKMGVFATRSTFRPNPIGMSLVELKGIQCQNNRVILELGSLDLVDGTPVIDIKPYLPFAESRPEARAGFAQKAPDTGMEVSFLPIAEHQLSSHQANYPHLRRFISQILAQDPRPAYRKKEQENRIYAVHILDFNVRWQIRDAMTEVVSIEHR

SEQ ID NO: 8288 - protein, 130 aa, Xenorhabdus bovienii
  Peptide sequence Name=Xb4151_4152.C436.gene126.pep
  Homolog annotation: Query=1..130bp; Hit=1..132bp; Blast score=131; Percent Identity=54.0; E value=2e-30; Homolog= Pa|Phot2-87c03.q1k _g148| 103742 - 104140 1892 132 aa, chain -
MRMLPICFITLFMVGCTSLSTQVEKPTQTGSKLKHQPAKKSKVSSYVQLYTKTEELLGTPFKNLGIVFGESCRTTRQDPPASIAVARKNMLVKAASLKADAVLLHQCAILSNHNCYQTAICEGSALLTTK

SEQ ID NO: 8289 - protein, 39 aa, Xenorhabdus bovienii
  Peptide sequence Name=Xb4151_4152.C436.gene127.pep
LGEPNAFYRSFMYRHSQSPTHRPYQNKDSTRCVCYLSVS

SEQ ID NO: 8290 - protein, 271 aa, Xenorhabdus bovienii
  Peptide sequence Name=Xb4151_4152.C436.gene128.pep
  Gene classification: Gene name=NlpA; Function=ABC-type uncharacterized transport systems, periplasmic component; Function class=R General function prediction only
  Homolog annotation: Query=1..271bp; Hit=1..271bp; Blast score=399; Percent Identity=71.0; E value=1e-111; Homolog= yaeC COG1464
MSVKLKSIVAISALLGTLILAGCDQEPRDPDHIKVGVIVGPELEVAEVAKKVAKEKYGLDVELITFNDYVLPNESLNKGDIDVNVFQHKPFLDQQVKERNYKLTIVGNSFIYPIAAYSRKIKSLGELENGNQITIPNDPTNQGRALLLLQKQGLITLKEGVGLLPTVLDIINNPKDLDIVELEAPQLPRSLDDQKIAFAIINNAYAGQVGLTPEQDGLFVEDKDSPYVNIIVSREDNKDAENVQKFVKAYQSEEVEQAAQRIFKGGALKGW

SEQ ID NO: 8291 - protein, 217 aa, Xenorhabdus bovienii
  Peptide sequence Name=Xb4151_4152.C436.gene129.pep
  Gene classification: Function=Permease component of an uncharacterized ABC transporter; Function class=R General function prediction only
  Homolog annotation: Query=1..217bp; Hit=1..217bp; Blast score=249; Percent Identity=82.0; E value=2e-66; Homolog= yaeE COG2011
MSDGMIFLLFKGVWETLVMTFVSGFFGFVIGLPIGVLLYVTRAGQIMENITLYRILSALVNIGRSIPFIILLVWMIPFTRLIVGTSIGLQAAIVPLTVGAAPFIARMVENALLEIPPGLIEAARAMGATPLQIVKKILLPEAQLSLINAATITLITLVGYSAMGGAVGAGGLGQIGYQYGYIGYNAPVMNTVLALLIVLVFLIQLGGDRLIIAVNHK

SEQ ID NO: 8292 - protein, 343 aa, Xenorhabdus bovienii
  Peptide sequence Name=Xb4151_4152.C436.gene130.pep
  Gene classification: Gene name=Abc; Function=Uncharacterized ABC-type transport system ATPase component; Function class=R General function prediction only
  Homolog annotation: Query=1..343bp; Hit=1..343bp; Blast score=527; Percent Identity=75.0; E value=1e-150; Homolog= Zabc COG1135
MIKLTQINKVFQLGTRSINALSNINLHVPQGQIYGVIGSSGAGKSTLIRCVNMLERPTSGKVLVNGQDLTSMSNRELTHARRHIGMIFQHFNLLSSRTVFGNVALPLELDNTPKNEINKRVSELLELVGLSDKHDAYPANLSGGQKQRVAIARALANSPKILLCDEATSALDPATTRSILELLKDINRRLGLTILLITHEMDVVKRICDQVAVINAGLLIEQDVVSEIFSHPKTPVAQEFIKSTLHIDIPESYLKKLKPECTPDSLPLLKLEFTGKSVDAPLISMAVRRFNIDVSILSSQMDYAGGVKFGVMLAELGGEYSSIESTIEFLKEHHVKVEVLGYV

SEQ ID NO: 8293 - protein, 39 aa, Xenorhabdus bovienii
  Peptide sequence Name=Xb4151_4152.C436.gene131.pep
LGLIIWILIPYHLSYLILLASIRRARAHYFRCFSKIIIS

SEQ ID NO: 8294 - protein, 37 aa, Xenorhabdus bovienii
  Peptide sequence Name=Xb4151_4152.C436.gene132.pep
MNSFDTESVTNFPVPICNYSKIDKWLLYQVNSVKKLR

SEQ ID NO: 8295 - protein, 212 aa, Xenorhabdus bovienii
  Peptide sequence Name=Xb4151_4152.C436.gene133.pep
  Gene classification: Gene name=RhtB; Function=Putative threonine efflux protein; Function class=E Amino acid transport and metabolism
  Homolog annotation: Query=9..208bp; Hit=2..206bp; Blast score=124; Percent Identity=35.0; E value=9e-29; Homolog= BH2932 COG1280
MLSNYWGEFLGLAMIHFLAVVAPGPDFAVTIQQSVKFGRLAGVCTAIGIGAGISVHVVYTLVGISSLMHSTPWLMEMAKLVGSLYIIWLGIKFIKSKPVNPDTLESKNIIQTSQSKWQAFLMGFMTNALNPKATLFFLAVFTTVVSINTPILIQVFYGLWMCIANTVWFVLVSVIFSNVLIRNKFMEKGYWFERVMGIVLISFAIRLLFISV

SEQ ID NO: 8296 - protein, 256 aa, Xenorhabdus bovienii
  Peptide sequence Name=Xb4151_4152.C436.gene134.pep
  Homolog annotation: Query=1..256bp; Hit=1..256bp; Blast score=371; Percent Identity=64.0; E value=1e-102; Homolog= gi|23059930|ref|ZP _00084864.1| hypothetical protein [Pseudomonas fluorescens PfO-1]
MIIETDRLNSACIEKLAKQEILAIRIKKFIPTSLAEKISEKILGKGFDKYLNAPSIGRIGMAFYETENKALRVADYFENVLNNINELRQRCSPYLSPIDQLRCVLDEVWPAGAQLETLYGKKMYVGLSRVVEPGVTFLAHHDIFAKDAPDSFRAKSLQAQFAANVYLSMPNEGGALQVWKNKLSPEEFDSMRRDSYGIEPSLLGKPALEVQPDAGELLIFNAQCMHAVTAGIGSSRLSLSCFIGYRGEAAPLSFWS

SEQ ID NO: 8297 - protein, 33 aa, Xenorhabdus bovienii
  Peptide sequence Name=Xb4151_4152.C436.gene135.pep
MKFESVASYKPLYNVLFRIFMFLYLFIFINVFI

SEQ ID NO: 8298 - protein, 44 aa, Xenorhabdus bovienii
  Peptide sequence Name=Xb4151_4152.C436.gene136.pep
MCNTIYIWIKNAQFSLVQVLKSISFKSINQKIIIYALYMNAFHL

SEQ ID NO: 8299 - protein, 43 aa, Xenorhabdus bovienii
  Peptide sequence Name=Xb4151_4152.C436.gene137.pep
MQKGCRGNGNNIKLQTTVDVKVTIILQMKRVHIESINDYFLVN

SEQ ID NO: 8300 - protein, 30 aa, Xenorhabdus bovienii
  Peptide sequence Name=Xb4151_4152.C436.gene138.pep
LSVNPSRHFCFPSYRECCHKFGLKQTNLEP

SEQ ID NO: 8301 - protein, 101 aa, Xenorhabdus bovienii
  Peptide sequence Name=Xb4151_4152.C436.gene139.pep
MLSQIWPETDESRTLIFEFSRPIVSSPTGFYADKAPGCQGGELLPLELLIDDFTSIFIDKMNLHQMFCNIEAKRSIFHGWFFLLSGSNKLHVFRHYKVGNL

SEQ ID NO: 8302 - protein, 83 aa, Xenorhabdus bovienii
  Peptide sequence Name=Xb4151_4152.C436.gene140.pep
MPHLSLPTLWLGCVRYIPCHCEYTSITRNLNNNIEQIFAIVFSYSIMSNYKIFYYFKSQSVLLALLLIYIIVILNSSDKYTIL

SEQ ID NO: 8303 - protein, 39 aa, Xenorhabdus bovienii
  Peptide sequence Name=Xb4151_4152.C436.gene141.pep
MGHSMEFVIQSKSQFMASHVFATLILIHCWFASIYPESQ

SEQ ID NO: 8304 - protein, 68 aa, Xenorhabdus bovienii
  Peptide sequence Name=Xb4151_4152.C436.gene142.pep
MGDPTTFRSGREFSTYLGLVPRQTGTGGRVKPVNVNGSVKLGLLLDSSGQVQTSLRRGHICSLRLRID

SEQ ID NO: 8305 - protein, 59 aa, Xenorhabdus bovienii
  Peptide sequence Name=Xb4151_4152.C436.gene143.pep
  Gene classification: Function=Predicted transposase; Function class=L DNA replication, recombination and repair
  Homolog annotation: Query=13..59bp; Hit=20..66bp; Blast score=61; Percent Identity=63.0; E value=2e-10; Homolog= mll8100 COG3293
MDIDRTLLAPIHSKRAGRPHAEHRRVMNGMFWVLCSGTLWRDLPECYGPWKTVYNRFNR

SEQ ID NO: 8306 - protein, 35 aa, Xenorhabdus bovienii
  Peptide sequence Name=Xb4151_4152.C436.gene144.pep
MGLGKRSITDLTVDQNRALSIRYLIGYCPFWMKKV

SEQ ID NO: 8307 - protein, 43 aa, Xenorhabdus bovienii
  Peptide sequence Name=Xb4151_4152.C436.gene145.pep
MAAIFARVKMFCSRQEKSDTITKAISSSTGVKSLLAVCNRVKL

SEQ ID NO: 8308 - protein, 60 aa, Xenorhabdus bovienii
  Peptide sequence Name=Xb4151_4152.C436.gene146.pep
MMGFEELIMFQTAKETFDKSVIPTCPDIPLACSYVITAEQVPVLLACILAPSITMKNTAL

SEQ ID NO: 8309 - protein, 295 aa, Xenorhabdus bovienii
  Peptide sequence Name=Xb4151_4152.C436.gene147.pep
  Homolog annotation: Query=5..295bp; Hit=1..291bp; Blast score=394; Percent Identity=64.0; E value=1e-108; Homolog= gi|24372594|ref|NP _716636.1| transposase, putative [Shewanella oneidensis MR-1] gi|24346617|gb|AAN54081.1|AE015545_3 transpos
MHNLVDLFCHVDDFCKLFMPQWQKYLIESGQCQRLRPTRMTTSEIMTIIIAFHMSHQRDFKHFYIGFMTVYHKKDFPSLLSYTRFLEVMPTVLAPLSSFFTHLKGQPTGLEFIDSTRIKVCHNLRIPRHQVFKGAAARGKGTMGWFYGFKLHIIVNHLGEIVATKLTSANVDDRTPVKALSKGLLDKLYADKGYISKALTEELEMEGITLVTGQRKNMKPKLLAAWDRAMLAKRFIIETINDQLKNITQIEHSRHRSLHGFMLNLLGGLIAYCLKPKKPSLNLSNTEKTGLQVMA

SEQ ID NO: 8310 - protein, 46 aa, Xenorhabdus bovienii
  Peptide sequence Name=Xb4151_4152.C436.gene148.pep
MHSGFLSEKFLFWSKDLITEPAFSSLLFCFSYPEFRLSNTHSLKPG

SEQ ID NO: 8311 - protein, 173 aa, Xenorhabdus bovienii
  Peptide sequence Name=Xb4151_4152.C436.gene149.pep
  Gene classification: Gene name=Tra5; Function=Putative transposase; Function class=L DNA replication, recombination and repair
  Homolog annotation: Query=5..171bp; Hit=13..179bp; Blast score=106; Percent Identity=35.0; E value=1e-23; Homolog= mlr6150 COG2801
MQSHFPFANICRVMKVSRSTFYAWQAKPVRLLSDEQQALNRKATALFKESRESLGYRMLAKKLRKEGLTISDYRTRELMNQRGLSVRQRQRYRAPRKDKAISTACNLLNRNFNPLAPNEVWAGDITYLKTPEGWLSLAIVMDLYSRRTVGWQISTEIDTTLISQALMNAYYLT

SEQ ID NO: 8312 - protein, 97 aa, Xenorhabdus bovienii
  Peptide sequence Name=Xb4151_4152.C436.gene150.pep
VERLTFITRHILANGKWLCMFLYEPTFYSSSPAKKALAFFKISFSIFSCLFSLRSCNNSCRSSGVKALGLDCSTSCFRHVYRSFVGIPKVSAACGTV

SEQ ID NO: 8313 - protein, 36 aa, Xenorhabdus bovienii
  Peptide sequence Name=Xb4151_4152.C436.gene151.pep
LFNISSECLTIVPLVSYHKVRRRYCALINSDTLVKE

SEQ ID NO: 8314 - protein, 42 aa, Xenorhabdus bovienii
  Peptide sequence Name=Xb4151_4152.C436.gene152.pep
MGLPESNIFVQSQQDTINWREITPAHWHWHLSLYGYPCGSSK

SEQ ID NO: 8315 - protein, 185 aa, Xenorhabdus bovienii
  Peptide sequence Name=Xb4151_4152.C436.gene153.pep
  Gene classification: Gene name=HisB; Function=Histidinol phosphatase and related phosphatases; Function class=E Amino acid transport and metabolism
  Homolog annotation: Query=1..185bp; Hit=1..185bp; Blast score=286; Percent Identity=73.0; E value=1e-77; Homolog= yaeD COG0241
VTQSIPAVFLDRDGTINIDHGYVHEIDNFQFIDGTIEAMLELKKMGYALVLVTNQSGIAREMFTEDQFLQLTEWMDWSLADRGVDLDGIYYCPHYPEGSADAYKKNCHCRKPQPGMLLDAQKELSIDMSASYMVGDKIEDMLAANAANVGTKVLVRTGKAVTEAVEQAADLVINSLIDLPNAHKK

SEQ ID NO: 8316 - protein, 39 aa, Xenorhabdus bovienii
  Peptide sequence Name=Xb4151_4152.C436.gene154.pep
IRFELGPFRQLFCELFTQVIIIQAKRLFLPIFYAHLEDL

SEQ ID NO: 8317 - protein, 35 aa, Xenorhabdus bovienii
  Peptide sequence Name=Xb4151_4152.C437.gene1.pep
TLAKKPSYPKVSVLSRKRWNARQKKFGLHATSKNN

SEQ ID NO: 8318 - protein, 104 aa, Xenorhabdus bovienii
  Peptide sequence Name=Xb4151_4152.C437.gene2.pep
  Gene classification: Gene name=EmrE; Function=Membrane transporters of cations and cationic drugs; Function class=P Inorganic ion transport and metabolism
  Homolog annotation: Query=1..104bp; Hit=51..154bp; Blast score=122; Percent Identity=72.0; E value=5e-29; Homolog= ZsugE COG2076
MSWLILLVAGLLEVVWAVGLKYTQGFSRLMPSLITISAMMVSIGLLAYSMKNLPAGTAYAVWTGIGAVGTAIFGIMVFGEPANSARILSLGLIVAGIIGLKLAS

SEQ ID NO: 8319 - protein, 67 aa, Xenorhabdus bovienii
  Peptide sequence Name=Xb4151_4152.C437.gene3.pep
VYLRPTAHTTSSKPATRRINQDIPFSLYQKGNGVVPDEMIFIRVVPDNNKKCRWIITSLSDSRNDSS

SEQ ID NO: 8320 - protein, 68 aa, Xenorhabdus bovienii; identical to SEQ ID NO: 6354
  Peptide sequence Name=Xb4151_4152.C437.gene4.pep

SEQ ID NO: 8321 - protein, 159 aa, Xenorhabdus bovienii
  Peptide sequence Name=Xb4151_4152.C437.gene5.pep
  Gene classification: Function=Transposase; Function class=L DNA replication, recombination and repair
  Homolog annotation: Query=13..153bp; Hit=204..344bp; Blast score=113; Percent Identity=48.0; E value=7e-26; Homolog= CC2740 COG3547
VGTIDLHAHYLYLVEQLTELETALEQELRRDETGQRLQTIPGVGPITASVLSSQLGDGKQYGCSRDFAASTGLVPRQYSTGGKNTLLGISKRGDKNLRRLLVQCARVFIQRIDYQSGRLAEWVKAQLERKHSNVVACALANKLARIAWAITTRQTVFER

SEQ ID NO: 8322 - protein, 68 aa, Xenorhabdus bovienii; identical to SEQ ID NO: 6354
  Peptide sequence Name=Xb4151_4152.C437.gene6.pep

SEQ ID NO: 8323 - protein, 346 aa, Xenorhabdus bovienii; identical to SEQ ID NO: 6355
  Peptide sequence Name=Xb4151_4152.C437.gene7.pep
  Gene classification: Function=Transposase; Function class=L DNA replication, recombination and repair
  Homolog annotation: Query=15..344bp; Hit=2..335bp; Blast score=241; Percent Identity=43.0; E value=7e-64; Homolog= PA2319 COG3547

SEQ ID NO: 8324 - protein, 188 aa, Xenorhabdus bovienii
  Peptide sequence Name=Xb4151_4152.C437.gene8.pep
  Gene classification: Gene name=Efp; Function=Translation elongation factor P/translation initiation factor eIF-5A; Function class=J Translation, ribosomal structure and biogenesis
  Homolog annotation: Query=1..188bp; Hit=1..188bp; Blast score=340; Percent Identity=84.0; E value=4e-94; Homolog= Zefp COG0231
MATYSTNEFRSGLKIMLDGEPCAILESEFVKPGKGQAFARVRLRKLISGKLLEKTFKSTDSVESADVVDMNLTYLYNDGEFWHFMNNETFEQLAADEKSVGDSTKWLIDQAECILTLWDGRPISVTPPNFVELEIIETDPGLKGDTAGTGGKPATLSTGAVVKVPLFVQIGEVIKVDTRSGEYVSRVK

SEQ ID NO: 8325 - protein, 343 aa, Xenorhabdus bovienii
  Peptide sequence Name=Xb4151_4152.C437.gene9.pep
  Gene classification: Gene name=KamA; Function=Lysine 2,3-aminomutase; Function class=E Amino acid transport and metabolism
  Homolog annotation: Query=1..342bp; Hit=1..342bp; Blast score=513; Percent Identity=72.0; E value=1e-145; Homolog= yjeK COG1509
MAHIITHIPPVREVWLKQLADVITDPDELLQLLSLNTHAMLKEGNEAKRLFPLRVPRAFAARMKKGDPHDPLLLQVLTAQEEFETHPGFSTDPLEEQHSAVPGLLHKYRNRALLLVKGGCAVNCRYCFRRHFPYEDNKGNKNNWQLALDYIEQHPELDEIIFSGGDPLMAKDHELDWLMTRLESISHIKRLRIHTRLPVVIPDRITLSLCNRFEKSQLQIIMVTHINHANEIDNTFRDKMMWLKQAGVTLLNQSVLLRNVNDSADTLADLSNTLFDAGILPYYIHILDKVQGAAHFLVGDEEAKAIMRELLTKISGYLVPCLAREIGGEPSKTPLDLGLKQKS

SEQ ID NO: 8326 - protein, 46 aa, Xenorhabdus bovienii
  Peptide sequence Name=Xb4151_4152.C437.gene10.pep
MASVAIRHVQERTTPETKTYTEPTMLCHVFLAAALTDCLLNQTITL

SEQ ID NO: 8327 - protein, 120 aa, Xenorhabdus bovienii
  Peptide sequence Name=Xb4151_4152.C437.gene11.pep
  Homolog annotation: Query=5..120bp; Hit=67..180bp; Blast score=148; Percent Identity=65.0; E value=2e-35; Homolog= gi|22124524|ref|NP _667947.1| hypothetical protein [Yersinia pestis KIM] gi|21957320|gb|AAM84198.1|AE013663_4 hypothetical pro
MGKDMRIKILLGASILLLAGCVTNNQLTAAGSNVRFVDTQPGSECQRLGEVIGMQSNWLNGIDNESSSMRNAANDLRNKAAELGGNVIYGANSPLSRTENLLGIFVPLDSKMVGQVYKCP

SEQ ID NO: 8328 - protein, 548 aa, Xenorhabdus bovienii
  Peptide sequence Name=Xb4151_4152.C437.gene12.pep
  Gene classification: Gene name=GroL; Function=Chaperonin GroEL (HSP60 family); Function class=O Posttranslational modification, protein turnover, chaperones
  Homolog annotation: Query=1..532bp; Hit=1..532bp; Blast score=810; Percent Identity=88.0; E value=0; Homolog= groL COG0459
MAAKDVKFGNDARGKMLRGVNVLADAVKVTLGPKGRNVVLDKSFGSPVITKDGVSVAREIELEDKFENMGAQMVKEVASKANDAAGDGTTTATVLAQSIVTEGLKAVAAGMNPMDLKRGIDKAVIAAVEELKKLSVPCSDSTAIAQVGTISANSDETVGKLIAEAMDKVGKEGVITVEEGTGLEDELDVVEGMQFDRGYLSPYFINKPEAGSIELENPYILLVDKKISNIRELLPVLEGVAKASKPLVIIAEDVEGEALATLVVNNMRGIVKVAAVKAPGFGDRRKAMLQDIATLTNGTVISEEIGLELEKATLEDLGQAKRIVINKDTTIIIDGVGEAAAIAARVTQIRQQIEESTSDYDREKLQERVAKLAGGVAVIKVGAATEVEMKEKRARVDDALHATRAAVEEGVVAGGGVALVRAAAAISALTGDNEDQNVGIRVALRAMEAPMRQIVENAGEEPSVVVNNVKASQGNHGYNAATEEYGDMIEMGILDPTKVTRSALQFAGSIAGLMITTEAMITDLPRDDKADLGGAGGMGGMGGMGGMM

SEQ ID NO: 8329 - protein, 97 aa, Xenorhabdus bovienii
  Peptide sequence Name=Xb4151_4152.C437.gene13.pep
  Gene classification: Gene name=GroS; Function=Co-chaperonin GroES (HSP10); Function class=O Posttranslational modification, protein turnover, chaperones
  Homolog annotation: Query=1..97bp; Hit=1..97bp; Blast score=150; Percent Identity=91.0; E value=2e-37; Homolog= groS COG0234
MNIRPLHDRVIVKRKEVESKSAGGIVLTGSAASKSTRGEILAVGNGRILENGEMKALDVKVGDIVIFNEGYGVKAEKIDNEDVLIMSESDILAIVEA

SEQ ID NO: 8330 - protein, 168 aa, Xenorhabdus bovienii
  Peptide sequence Name=Xb4151_4152.C437.gene14.pep
  Gene classification: Gene name=FxsA; Function=Protein affecting phage T7 exclusion by the F plasmid; Function class=R General function prediction only
  Homolog annotation: Query=1..147bp; Hit=1..146bp; Blast score=145; Percent Identity=64.0; E value=1e-35; Homolog= yjeG COG3030
VRWLPFVLICLLVYIESVLFVRIASEAGVLLTLLLVIFTSCVGVSLVRNQGIKNFMSMQQKIAAGESPAKEAIKSVSLVIAGVLLILPGFFTDFLGLLLLLPPAQKLLTAKLLPHITFYRPNNHGQDGQGGHHGQTFEGEYERRQDDASYTLDGQKRHDEHGNEHDKK

SEQ ID NO: 8331 - protein, 50 aa, Xenorhabdus bovienii
  Peptide sequence Name=Xb4151_4152.C437.gene15.pep
MSINDEHANLRVVYWPCSSLLTIFKGNIFIPMVLSLINERRTTCVGSHLS

SEQ ID NO: 8332 - protein, 71 aa, Xenorhabdus bovienii
  Peptide sequence Name=Xb4151_4152.C437.gene16.pep
MLFDMRTFFNLDTFFYCSIYVFVENNVTVGNCRDINHLSLDCWRDHMWIYQKCLVPGSLYSANFINEMTYV

SEQ ID NO: 8333 - protein, 474 aa, Xenorhabdus bovienii
  Peptide sequence Name=Xb4151_4152.C437.gene17.pep
  Gene classification: Gene name=AspA; Function=Aspartate ammonia -lyase; Function class=E Amino acid transport and metabolism
  Homolog annotation: Query=1..474bp; Hit=16..489bp; Blast score=801; Percent Identity=84.0; E value=0; Homolog= aspA COG1027
MSNNIRIEEDLLGKREVPAEAYYGIHTLRAIENFYISDRTINDVPEFIRGMVLVKKAAALANKELHTIPGKIADIIVKACDEVLNTGKCLDQFPVDVFQGGAGTSLNMNTNEVLANIGLELMGHPKGEYEYLNPNDHLNRSQSTNDAYPTGFRIAVYNSIITLITSIELLQVGFDKKAVEFSDILKMGRTQLQDAVPMTLGQEFRAFSVLLKEEIKNITRTAELLLEVNLGATAIGTGLNTAPGYQTLVVEKLAEVTGLPCLPAEDLIEATSDCGAYVMVHSALKRLAVKMSKICNDLRLLSSGPRTGLNEINLPELQAGSSIMPAKVNPVVPEVVNQVCFKVIGNDICVTMASEAGQLQLNVMEPAIGQAMFESISILSNACRNLVEKCVNGITANKEVCESFVFNSIGIVTYLNPFIGHHNGDIVGKICAETGKSVREVVLERGLLTEAQLDDIFSVENLKHPTYKAKRFDD

SEQ ID NO: 8334 - protein, 94 aa, Xenorhabdus bovienii
  Peptide sequence Name=Xb4151_4152.C437.gene18.pep
  Gene classification: Function=Putative transposase; Function class=L DNA replication, recombination and repair
  Homolog annotation: Query=9..73bp; Hit=109..173bp; Blast score=84; Percent Identity=60.0; E value=3e-17; Homolog= XF2303 COG3316
MKLIPKSKEWRYLYRAVDSDGNTIDFLLTAHRDKEAALRFFKKAIRQNGQPDGVTMDPNGANKAAVDKLNKEKITLSSLVLSLLMRQNHVFYYD

SEQ ID NO: 8335 - protein, 91 aa, Xenorhabdus bovienii
  Peptide sequence Name=Xb4151_4152.C437.gene19.pep
MENSTFCPSSKVLKSLPWIAEKCTNTSLLPSSGEIKPKPLPASNHFTKPVILLDIDISFNFKPLYVVNMACLQRFTYWALRRRLTKKDIYG

SEQ ID NO: 8336 - protein, 37 aa, Xenorhabdus bovienii
  Peptide sequence Name=Xb4151_4152.C437.gene20.pep
MIYLARINFHSEASRSSKRQEMRHYFSHIAMKRRRRQ

SEQ ID NO: 8337 - protein, 48 aa, Xenorhabdus bovienii
  Peptide sequence Name=Xb4151_4152.C437.gene21.pep
MQFSPLQYPKISSRLPNLINTLKIRYIPDLNPDNLPSYSSLLRPCHMR

SEQ ID NO: 8338 - protein, 85 aa, Xenorhabdus bovienii
  Peptide sequence Name=Xb4151_4152.C437.gene22.pep
MTKPKYNQLRMERNEPHPGRKRYLITDNRCDSSVDLIDYIKARKPSSGKLRPEKLKSEKPFPSLSSAISCGKAVVGKNRTVGYQD

SEQ ID NO: 8339 - protein, 853 aa, Xenorhabdus bovienii
  Peptide sequence Name=Xb4151_4152.C437.gene23.pep
  Gene classification: Gene name=MutS; Function=MutS-like ATPases involved in mismatch repair, family 2; Function class=L DNA replication, recombination and repair
  Homolog annotation: Query=4..853bp; Hit=2..853bp; Blast score=1328; Percent Identity=79.0; E value=0; Homolog= ZmutS COG0249
MKESPAKDLDSHTPMMQQYLRLKAQHPDILLLYRMGDFYELFFDDAKKAAKLLDISLTKRGQSAGQPIPMAGVPYHAIENYLAKLVQLGESAALCEQIGDPATSKGPVERKVVRIVTPGTVTDEALLHERQDNLLAAIWHDSQGFGYATLDITSGRFRVSEMADEDTIAAELQRTRPAELLYPESFGSMALIERCSGLRRRPMWEFELDTARQQLNLQFGTRDLIGFGVEKSTLALRAAGCLLQYVKDTQRTALPHIRNITVERQQETVIMDAATRRNLELTQNLAGGTENTLASVLDQCVTPMGSRMLKRWLHTPIRDRNVLQNRQQAISALQEIGFELQPFLRQVGDLERVLGRLALRSARPRDLARMRHAFQQLPDIHQIMASSDSPYIQALQQRVGHFDELQTLLEKAVVETPPVLVRDGGVIAPGYHAELDEWRALADGASDYLDRLEIRERDKLGLDTLKVGFNAVHGYYIQVSRGQSHLVPIHYVRRQTLKNAERYIIPELKEYEDKVLTSKGKALAIEKALYEELFDLLLPHLAELQTSAEALSELDVLANLAERAETLNYTCPTLSDKTGIQITGGRHPVVEQVLSEPFISNPLTLSSQRRLLIVTGPNMGGKSTYMRQAALITLLAYIGSFVPAEKVLIGPVDRIFTRVGASDDLASGRSTFMVEMTETANILHNATEHSLVLMDEIGRGTSTYDGLSLAWACAESLANRIKAMTLFATHYFELTTLPEKLEGVVNIHLDAVEHGDTIAFMHSVQEGAASKSYGLAVASLAGVPRDVIKRARQKLKELESLSNNATAGHVDTPQLTLLTEEVSPAVEALENLNPDTLTPRQALEWIYRLKNMV

SEQ ID NO: 8340 - protein, 52 aa, Xenorhabdus bovienii
  Peptide sequence Name=Xb4151_4152.C437.gene24.pep
VDLSSEKYGIAVKFDTRRLEPSKIKDGLNKPTFWLNHNIPFIFQVATLLVAT

SEQ ID NO: 8341 - protein, 331 aa, Xenorhabdus bovienii
  Peptide sequence Name=Xb4151_4152.C437.gene25.pep
  Gene classification: Gene name=RpoD; Function=DNA-directed RNA polymerase sigma subunits (sigma70/sigma32); Function class=K Transcription
  Homolog annotation: Query=1..330bp; Hit=1..329bp; Blast score=478; Percent Identity=82.0; E value=1e-135; Homolog= rpoS COG0568
MSQSTLKVNELYDEADLDEHGMEADDFDEALLKDGDGLTNADENLDLLQEVNQRVLDATQLYLGEIGFSPLLTAEEEVLFARRALRGDIAARQRMIESNLRLVVKISRRYSNRGLALLDLIEEGNLGLIRAVEKFDPERGFRFSTYATWWIRQTIERAIMNQTRTIRLPIHIVKELNVYLRTARELAHKLDHEPSVEEIAEKLDRPIDDVSRMMRLNERITSVDTPISGDSDKALLDILSDENDSGPETTIQDDDMKQSIVKWLFELNAKQREVLARRFGLLGYEAETLEDVGREIGLTRERVRQIQVEGLRRLRDILHTQGLNIESLFRT

SEQ ID NO: 8342 - protein, 352 aa, Xenorhabdus bovienii
  Peptide sequence Name=Xb4151_4152.C437.gene26.pep
  Gene classification: Gene name=NlpD; Function=Membrane proteins related to metalloendopeptidases; Function class=M Cell envelope biogenesis, outer membrane
  Homolog annotation: Query=15..352bp; Hit=17..379bp; Blast score=303; Percent Identity=50.0; E value=2e-82; Homolog= ZnlpD COG0739
MNLGNSVKKIKWISSVMGVVLAGCSNTSDRPAPIVSIDKQEQNRGIPSRTSSISTPMPSSPSTISANRSSEHRASENRYLVNRAVENGSHQGRIIYNRNYGNIPKGSYSGSTYTVKSGDTLFYVAWITGIDFRDLSHINNISEPYNLNVGQVLRMGNVNSSNGVLLASNSTQSKIEQVDFQKSNAYPANIDRQSSEKMLPRKTISVSESSAMKLSSATDISPGSTISSGSSSWGWPAEGKVFEGFSDSKGGNKGIDIAGSRGQPVFATASGKVVYAGNALRGYGNLIIIKHNDDYLSAYAHNDTMLVRDSQDVQAGQKIATMGSTGTSLVKLHFEIRYKGKSVNPLRHLPQR

SEQ ID NO: 8343 - protein, 208 aa, Xenorhabdus bovienii
  Peptide sequence Name=Xb4151_4152.C437.gene27.pep
  Gene classification: Gene name=Pcm; Function=Protein-L-isoaspartate carboxylmethyltransferase; Function class=O Posttranslational modification, protein turnover, chaperones
  Homolog annotation: Query=1..208bp; Hit=1..208bp; Blast score=290; Percent Identity=69.0; E value=6e-79; Homolog= pcm COG2518
MLSRSMKNLLTQLRQQGIQDEHLLEIIARVPRECFVDEALAHKVYENTALPIGHGQTISQPYIVARMTKLLSLTPEANVLEIGTGSGYQTAILAHLARHVFSVERIKGLQWQAKRRLKQLDLHNISTRHGDGWNGWPSKGPFDAIIVTAAPPEIPQALLYQLADNGVMVLPVGERSQSLKVVHRYGSDFHSEVIEPVRFVPLIQGELA

SEQ ID NO: 8344 - protein, 254 aa, Xenorhabdus bovienii
  Peptide sequence Name=Xb4151_4152.C437.gene28.pep
  Gene classification: Gene name=SurE; Function=Survival protein, predicted acid phosphatase; Function class=R General function prediction only
  Homolog annotation: Query=2..249bp; Hit=1..248bp; Blast score=363; Percent Identity=73.0; E value=1e-100; Homolog= surE COG0496
MLRILLSNDDGVTAPGIQTLAARLREHYHVQVVAPDRNRSGASNALTLDRPLRINTMNNGDIAVQEGTPTDCVYLGVNRLVLPRPDIVVSGINCGPNLGDDVIYSGTVAAAMEGRHLGLPALAVSLNGDRHYETAAEVTMRLLNLLQKSPLRAGNILNINVPDVPIEQIKGFRVTRCGSRCAAKEVYALEDPKGNMLYWIGPPGEKHDAGPETDFAAIEDGFVSITPLQVDLTAYKAQELINDWLVKVGDMGEC

SEQ ID NO: 8345 - protein, 39 aa, Xenorhabdus bovienii
  Peptide sequence Name=Xb4151_4152.C437.gene29.pep
VLAGIELVCMLRKGQYRQNGEQGQGCPISLAAFFYQLAE

SEQ ID NO: 8346 - protein, 32 aa, Xenorhabdus bovienii
  Peptide sequence Name=Xb4151_4152.C437.gene30.pep
MLILLYLNNLLEQDHRNVKRRTRPMLGFKNFR

SEQ ID NO: 8347 - protein, 97 aa, Xenorhabdus bovienii
  Peptide sequence Name=Xb4151_4152.C437.gene31.pep
  Gene classification: Function=Predicted transposase; Function class=L DNA replication, recombination and repair
  Homolog annotation: Query=9..68bp; Hit=15..75bp; Blast score=58; Percent Identity=42.0; E value=2e-09; Homolog= sll1094 COG3335
MPMFFMRGWTQDLLPKLPHGAVIVMDNAPFHKRNDTTQAIADSRCQLEWLPAYSPDLNPIEHKWGGAKAIRRQKDVQLMSCLRSILNRSGYVDSAIS

SEQ ID NO: 8348 - protein, 46 aa, Xenorhabdus bovienii
  Peptide sequence Name=Xb4151_4152.C437.gene32.pep
MTLRRPFACQSCVPKQRNPCPVYVASIEQNHFHPSKQWVCQSVHHR

SEQ ID NO: 8349 - protein, 121 aa, Xenorhabdus bovienii
  Peptide sequence Name=Xb4151_4152.C437.gene33.pep
  Homolog annotation: Query=1..105bp; Hit=1..105bp; Blast score=89; Percent Identity=44.0; E value=7e-18; Homolog= gi|30249526|ref|NP _841596.1| putative transposase [Nitrosomonas europaea ATCC 19718] gi|30138889|emb|CAD85468.1| putative trans
MGYSLDFRKRVLAYKDKHSLTFEQTSAHFEISMRTLFRWCNKIEPCMTRDKPATKIPDEVLIADVQNFPDDYQWERAKRLSVSQSAIHYALKRLRITQKKNAPTPSRCSSSSSGIYRAHQR

SEQ ID NO: 8350 - protein, 30 aa, Xenorhabdus bovienii; identical to SEQ ID NO: 6724
  Peptide sequence Name=Xb4151_4152.C437.gene34.pep

SEQ ID NO: 8351 - protein, 55 aa, Xenorhabdus bovienii
  Peptide sequence Name=Xb4151_4152.C437.gene35.pep
  Gene classification: Function=Putative transposase; Function class=L DNA replication, recombination and repair
  Homolog annotation: Query=1..54bp; Hit=59..112bp; Blast score=77; Percent Identity=70.0; E value=2e-15; Homolog= XF2303 COG3316
MSERGIAVDHAALSRWVHRLVPLIVKRYRRSKPDVGRRWRMDETYIKIKGQWRYS

SEQ ID NO: 8352 - protein, 39 aa, Xenorhabdus bovienii
  Peptide sequence Name=Xb4151_4152.C437.gene36.pep
MQKLGSVALSGHQVSSPVFERVQSDVPYPKSVQTPALSC

SEQ ID NO: 8353 - protein, 166 aa, Xenorhabdus bovienii
  Peptide sequence Name=Xb4151_4152.C437.gene37.pep
MFKSKSGFSILNKLWLFAVKNKKTSDDDLINEIMEVEKFNFYYNTNATSIRQKENFEGWIRRYELDFKIISKMKINFDIDTLKIKIISISIPFLFLFFMYLCIYVFMYLCFISAMPVALKPAGLIKINDDDGWFWINKNEAMEYGFLNKRKDLWVVTPEMGHVLND

SEQ ID NO: 8354 - protein, 96 aa, Xenorhabdus bovienii; identical to SEQ ID NO: 5468
  Peptide sequence Name=Xb4151_4152.C437.gene38.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 8355 - protein, 92 aa, Xenorhabdus bovienii; identical to SEQ ID NO: 6203
  Peptide sequence Name=Xb4151_4152.C437.gene39.pep

SEQ ID NO: 8356 - protein, 41 aa, Xenorhabdus bovienii
  Peptide sequence Name=Xb4151_4152.C437.gene40.pep
MGKEMADILVIAVIAAVRSFSWRIPIRPANPALKNRLSISR

SEQ ID NO: 8357 - protein, 60 aa, Xenorhabdus bovienii
  Peptide sequence Name=Xb4151_4152.C437.gene41.pep
VAITAIDINFGHTSSLKSRKHITATNHLIHDPEMGHDSILLIVMNVQIISYNSVMHFYGF

SEQ ID NO: 8358 - protein, 167 aa, Xenorhabdus bovienii
  Peptide sequence Name=Xb4151_4152.C437.gene42.pep
  Gene classification: Gene name=InsB; Function=Insertion element IS1 protein InsB, putative transposase; Function class=L DNA replication, recombination and repair
  Homolog annotation: Query=1..167bp; Hit=1..167bp; Blast score=222; Percent Identity=64.0; E value=1e-58; Homolog= insB_g3 COG1662
MSGDSTSDGDWPEYRTSAFKKLKPKSVTEAIKPGTEVIVCCEMDEQWSYVKSKKPPRWLFYADDRIRRKVIAHVFGPRTKKTLMRLLALLAPFNIIIYMTDSWKSYEKALAGKRHVASKRYTQRIERHNLNLRQHLARLTRKTLSFSKSIEMHDRIIGYYLNIHHYQ

SEQ ID NO: 8359 - protein, 96 aa, Xenorhabdus bovienii; identical to SEQ ID NO: 7016
  Peptide sequence Name=Xb4151_4152.C437.gene43.pep

SEQ ID NO: 8360 - protein, 70 aa, Xenorhabdus bovienii
  Peptide sequence Name=Xb4151_4152.C437.gene44.pep
MHIVDQFETLSQIKYTYQYRTERDRVDQNRRFLLFLRRLSVRCLIPPYPILFQGRDRIHYNTLPIHQYKH

SEQ ID NO: 8361 - protein, 51 aa, Xenorhabdus bovienii
  Peptide sequence Name=Xb4151_4152.C437.gene45.pep
MAIFMVSPIIMTKAIVAGEIYCLCHFQFSDYSFQFIIYMNQSYLLGNRGRS

SEQ ID NO: 8362 - protein, 50 aa, Xenorhabdus bovienii
  Peptide sequence Name=Xb4151_4152.C437.gene46.pep
LLTIRIISSYDNGYFYQPINFINRENEWHNSHRDIMTCRDYLEGKIDSYK

SEQ ID NO: 8363 - protein, 120 aa, Xenorhabdus bovienii
  Peptide sequence Name=Xb4151_4152.C437.gene47.pep
  Homolog annotation: Query=12..116bp; Hit=57..161bp; Blast score=145; Percent Identity=65.0; E value=2e-34; Homolog= Pa|Phot3-178c01.p1k _g9| 10396 - 10896 217 166 aa, chain +
MVSSLALSALSVAFAGPWLFDMRQAQAWEDKFLRLESAAPAVSWLYTTQSLDKLTRHLESYLNIQLKTGETALLRFYDPRVLNQIPHLFTPEQLTHFTQDIEEWQYQLNNTAYIVKGIAS

SEQ ID NO: 8364 - protein, 64 aa, Xenorhabdus bovienii
  Peptide sequence Name=Xb4151_4152.C437.gene48.pep
  Homolog annotation: Query=1..42bp; Hit=175..216bp; Blast score=63; Percent Identity=76.0; E value=8e-10; Homolog= gi|1805764|emb|CAA60622.1| IS1327 containing a transposase [Pantoea agglomerans]
VEQDHRNIKRRTRPMLGFKSFRRTQTILAGIELVSMLRKGHHLIAYYLKRQSLRLYPSHDENHV

SEQ ID NO: 8365 - protein, 172 aa, Xenorhabdus bovienii
  Peptide sequence Name=Xb4151_4152.C437.gene49.pep
  Gene classification: Function=Conserved protein/domain typically associated with flavoprotein oxygenases, DIM6/NTAB family; Function class=R General function prediction only
  Homolog annotation: Query=1..163bp; Hit=1..163bp; Blast score=209; Percent Identity=62.0; E value=1e-54; Homolog= PA4092 COG1853
MSVENEHRLRFRNAMASLSAAVNIITTDGPAGQCGITATAVCSVTDTPPTLMVCINRNSAMNPIFQENGRLCVNILNHEQELIARHFAGMTGVSMEERFGWNIWKTGALGQPMLKETLANLEGSIEQVQEIGTHYVYLVEVKQIAVKEEGHGLIYFKRDFHHVMDKALATAV

SEQ ID NO: 8366 - protein, 520 aa, Xenorhabdus bovienii
  Peptide sequence Name=Xb4151_4152.C437.gene50.pep
  Gene classification: Function=Aromatic ring hydroxylase; Function class=Q Secondary metabolites biosynthesis, transport and catabolism
  Homolog annotation: Query=1..518bp; Hit=1..518bp; Blast score=822; Percent Identity=73.0; E value=0; Homolog= PA4091 COG2368
MRLEDLRADHKRPFTSKEYLKSLQDGREIYIYGERVKDVTTHPAFRNAAASIGQLYDVLHEPETHDILCWDTDTGNGGYTHKFFRFATSPDEMRQQRDAIAEWSRQSYGWMGRTPDYKAAFCCALGAYPEFYGQFADNARTWYKRIQESGIYFNHAIVNPPIDRHKPADQVKDVFIQIEKETDAGIIVSGAKVVATNSALTHYNFIGFGSAQVIGDNPDFALMFVAPMDADGVKLISRASYELVAGAMGSPFDYPLSSRFDENDAILVMDKVLIPWENVLIYRDFDRARNWAVQGGFARLFPMQACVRLAVKLDFITGLLQKSLECTGVVDFRGVQADLGEVVAWRNLFWSLTDAMWAEAKPWEGGAYLPDTQAIQTYRVMAPMAYSKIKNIIESNVTSGLIYLPSSVRDMNNPEINKYLEKYVRGSNGIDHVERIKILKLMWDAIGSEFGGRHELYEINYAGSQDEIRLQCLRHAYGSGNMKKMTELVDRCLSDYDLNGWTKPHLHNNRDINLLDKLLK

SEQ ID NO: 8367 - protein, 41 aa, Xenorhabdus bovienii
  Peptide sequence Name=Xb4151_4152.C437.gene51.pep
LCFSGSLKVPGHVFNMCIVSFIVLSQLLLITLKSPYDLGSR

SEQ ID NO: 8368 - protein, 35 aa, Xenorhabdus bovienii
  Peptide sequence Name=Xb4151_4152.C437.gene52.pep
MILVVDNTGVAKFNILNTQPKHEVRYSETNKPQLY

SEQ ID NO: 8369 - protein, 349 aa, Xenorhabdus bovienii
  Peptide sequence Name=Xb4151_4152.C437.gene53.pep
  Gene classification: Function=Uncharacterized ACR; Function class=S Function unknown
  Homolog annotation: Query=6..349bp; Hit=7..349bp; Blast score=401; Percent Identity=59.0; E value=1e-112; Homolog= ygbO COG0585
MTLSELHWLYGQPEATGVVKASPEDFIVREDLGFSPDGEGEHLMVHIRKTGCNTQFVADHLARFAKIPARSVSYAGLKDRNAVTEQWFCVHLPGKQDPDLTAFQLEGCEVLTASRQKRKLRIGTLKGNDFTLVLRQISDRQSVEKRLQQIAQAGVPNYFGEQRFGRDGQNLVQAQRWADNEIQVKERSRRSFYLSASRSAMFNTIASLRIAQDTHQQVLNGDALQLTGRGSWFVADELELPVLQQRIMDGELQITAPLPGDKTLGTQHQALDFEQHCLLDYASLWSLVKRERVESVRRAILVQPLNLNWEWLDERTVTLHFSLPSGSFATSVVRELINQDQNNAADIAE

SEQ ID NO: 8370 - protein, 207 aa, Xenorhabdus bovienii
  Peptide sequence Name=Xb4151_4152.C437.gene54.pep
  Gene classification: Gene name=IspF; Function=2C-methyl-D-erythritol 2,4-cyclodiphosphate synthase; Function class=I Lipid metabolism
  Homolog annotation: Query=51..206bp; Hit=1..156bp; Blast score=253; Percent Identity=85.0; E value=9e-68; Homolog= ygbB COG0245
VYHGRIFGTGILWLSPGAGTWAGRQYKSHSTRRSGIGGVLPIPKIKGTYRMRIGHGFDVHKFGGEGPLVIGGVRIPYEQGLIAHSDGDVALHAATDALLGAAALGDIGKLFPDTDPAFKGADSRELLKEAYRHIRKKGYRIGNLDITIIAQAPKMLPHIPQMRVNLAEDLECHMDDINVKATTTEKLGFVGRKEGIACEAVALLVKE

SEQ ID NO: 8371 - protein, 259 aa, Xenorhabdus bovienii
  Peptide sequence Name=Xb4151_4152.C437.gene55.pep
  Gene classification: Gene name=IspD; Function=4-diphosphocytidyl-2 -methyl-D-erithritolsynthase; Function class=I Lipid metabolism
  Homolog annotation: Query=12..252bp; Hit=3..229bp; Blast score=281; Percent Identity=60.0; E value=6e-76; Homolog= ZygbP COG1211
MNNPIFHSPADTSLADIVALIPAAGIGSRMKSDCPKQYLPLAGKTIIEHTLAALLEHPRIQRVIVALNSADNQFGRLAIASDPRITTVVGGAERADSVLAGLDYLASLSTDSSAWVLVHDAARPCLHRDDLDNLLQLINRSAPSPAVCGGLLAAPVRDTMKRMVMASEEEPSTIDHTVDRRGLWHALTPQLFPLQLLRDCLTKALAEQACITDESSALEYCGYHPVLVHGRADNIKVTQPEDLALAEFYLSRKSKEHIV

SEQ ID NO: 8372 - protein, 106 aa, Xenorhabdus bovienii
  Peptide sequence Name=Xb4151_4152.C437.gene56.pep
  Gene classification: Function=Septum formation initiator; Function class=O Posttranslational modification, protein turnover, chaperones
  Homolog annotation: Query=1..105bp; Hit=1..103bp; Blast score=115; Percent Identity=65.0; E value=9e-27; Homolog= ygbQ COG2919
MGKLTLLLLVLLGWLQYSLWFGKNGIHDYVWVKDEVVRRNSADITLRARNNQLFAEIKDLKKGQEAIEERARNELGMIKPGESFYRLVPDTSKHNAQQSLKENSKQ

SEQ ID NO: 8373 - protein, 43 aa, Xenorhabdus bovienii
  Peptide sequence Name=Xb4151_4152.C437.gene57.pep
MTPLSQNMITRCDGKVLDEMSVETHYSTRNNVFLNGSMGMVFK

SEQ ID NO: 8374 - protein, 205 aa, Xenorhabdus bovienii
  Peptide sequence Name=Xb4151_4152.C437.gene58.pep
  Gene classification: Gene name=CysC; Function=Adenylylsulfate kinase and related kinases; Function class=P Inorganic ion transport and metabolism
  Homolog annotation: Query=11..203bp; Hit=7..199bp; Blast score=278; Percent Identity=69.0; E value=3e-75; Homolog= cysC COG0529
VSQIKEHSFSNVVWHSHTLDRKQREVVNGHPALVIWFTGLSGSGKSTLAGALEQALFSRGIKTYLLDGDNLRHGLCSDLGFSETERRENIRRIGEVSKLMVDAGLVVLTAFISPHRAERQKLRELMGADRFIEVFVDTPLAICEARDPKGLYKKARAGELLNFTGIDSAYETPEQPDIYLDGSLPVESSIEKLLAALHNHNFLPI

SEQ ID NO: 8375 - protein, 480 aa, Xenorhabdus bovienii
  Peptide sequence Name=Xb4151_4152.C437.gene59.pep
  Gene classification: Gene name=CysN; Function=GTPases - Sulfate adenylate transferase subunit 1; Function class=P Inorganic ion transport and metabolism
  Homolog annotation: Query=7..480bp; Hit=2..475bp; Blast score=679; Percent Identity=70.0; E value=0; Homolog= cysN COG2895
MPALAHNETIASQIKQQGGVEAYLRIQQEKGLLRFLTCGSVDDGKSTLIGRLLHDTRQIYEDQLATLQNDSKRLGTQGEKLDLALLVDGLAAEREQGITIDVAYRYFSTEKRKFIIADTPGHEQYTRNMATGASTSDLSILLIDARKGVQEQTRRHSFISTLLGIRHLVVAVNKMDLVDYRQDIYEQIKQDYWNFAGQLPTDLHVYFVPISALEGDNIVSRSEKMAWHTGETLLDTLESVDVKKKATEQPLRFPVQYVNRPDLDFRGYSGTLSSGILRQGQQIKVMPSGVISTVERIVTFDGDLPFAVPGEAITVVLKDEIDISRGDLLIAVEDHMTVARHALVDVVWMSEQPLIQGQSLDIKVAGKKSRGKVDNVQYQVDITNLTQKVAVELPLNAIGLVEFSFDEPLLIDSYPQNADTGGIILIDRLTNVTVGAGLVREIQTEVYEEPKEYSEFELEFNRLVRRHFPHWGARDLLGGK

SEQ ID NO: 8376 - protein, 302 aa, Xenorhabdus bovienii
  Peptide sequence Name=Xb4151_4152.C437.gene60.pep
  Gene classification: Gene name=CysH; Function=3'-phosphoadenosine 5' -phosphosulfate sulfotransferase (PAPS reductase)/FAD synthetase and related enzymes; Function class=E Amino acid transport and metabolism
  Homolog annotation: Query=1..302bp; Hit=1..302bp; Blast score=533; Percent Identity=85.0; E value=1e-152; Homolog= cysD COG0175
MDEKKLTHLQQLEAESIHIIREVAAEFANPVMLYSIGKDSSVMLHLARKAFYPGKLPFSLLHVDTGWKFREMYDFRDHTAEKYGFELLVYRNPQGEALGINPFIHGSAKHTDIMKTEGLKQALDKYRFDAAFGGARRDEEKSRAKERIYSFRDRSHRWDPKNQRPELWRNYNGQINKGESIRVFPLSNWTELDIWQYIYLEQIDIVPLYFAKHRPVIQRDGALIMVDDARIDLKSGEVISQRKVRFRTLGCWPLTGAVESEAETLPEIIEEMLISTTSERQGRLIDSDQSGSMELKKRQGYF

SEQ ID NO: 8377 - protein, 486 aa, Xenorhabdus bovienii
  Peptide sequence Name=Xb4151_4152.C437.gene61.pep
  Gene classification: Gene name=CysG; Function=Uroporphyrinogen-III methylase; Function class=H Coenzyme metabolism
  Homolog annotation: Query=224..465bp; Hit=8..249bp; Blast score=301; Percent Identity=64.0; E value=8e-82; Homolog= NMB1156_2 COG0007
VDYLPLFVELKSRPVLLVGGGEVAARKASLLLRAGASLTIVAPELHSELQQRYQKAEFEWRQGGFRTEYLDGVFLVIAATDDHDLNQHIFAEANARAILVNVVDDQPLCSAIFPSIIDRSPIMVAISSAGKSPVLAKLLREKLESLLPFHLGIMAEIAGRWRERVKQRLTSIRQRRHFWEKALNGRFATLVANGQLQQAEAQLDEQLIDEQRANEQLAPAGKQGELALVGAGPGDPGLLTLKGLQVIQQADVVLYDHLVSADILELVRRDADQICVGKRAGNHSVAQEETNALIIKLARQGKKVVRLKGGDPFIFGRGGEELQVAAEAGIPFQVVPGITAAVGASAYAGIPLTHREHSQSVTFITGHCRENGDELDWPALARGNQTLAIYMGIIKAALISQKLISHGRDANTPVAVIGCGTRPEQQVLTGTLSELDRLAQKAPSPALLVVGEVAQLHHQIAWFGQQSVDQKQSVAQINRPAVVDLV

SEQ ID NO: 8378 - protein, 30 aa, Xenorhabdus bovienii
  Peptide sequence Name=Xb4151_4152.C437.gene62.pep
MTDDVRDFYWGVLLKKEVRRPALTLNIPNS

SEQ ID NO: 8379 - protein, 244 aa, Xenorhabdus bovienii
  Peptide sequence Name=Xb4151_4152.C437.gene63.pep
  Gene classification: Gene name=CysH; Function=3'-phosphoadenosine 5' -phosphosulfate sulfotransferase (PAPS reductase)/FAD synthetase and related enzymes; Function class=E Amino acid transport and metabolism
  Homolog annotation: Query=1..243bp; Hit=1..243bp; Blast score=374; Percent Identity=75.0; E value=1e-104; Homolog= ZcysH COG0175
MSQLHLAELLALNHDQRAEALADINQQLELLDARQRVSWALEHLSGEFVLSSSFGIQAAVCLHLVTQEYPDIPVILTDTGYLFPETYQFIDKLTDELKLNLTVFRAELSPAWQEARYGKLWEQGVEGIERYNQINKVEPMNQALKSLHAQSWFAGLRRQQSESRANLPVLAVQRDVFKILPIVDWDNRRVHQYLAQQGLEYHPLWEQGYLSVGDTHTTQKWQPGMSEEQTRFFGLKRECGLHES

SEQ ID NO: 8380 - protein, 576 aa, Xenorhabdus bovienii
  Peptide sequence Name=Xb4151_4152.C437.gene64.pep
  Gene classification: Gene name=CysI; Function=Sulfite reductase hemoprotein beta-component; Function class=P Inorganic ion transport and metabolism
  Homolog annotation: Query=1..571bp; Hit=1..570bp; Blast score=968; Percent Identity=78.0; E value=0; Homolog= ZcysI COG0155
MSNEKQGPLKVEGKLADSERMKLNSDYLRGTISEDLKNGLTGGFEGDNFLLIRFHGMYQQDDRDIRAERTEQKLEPRHAMMLRCRLPGGIITPSQWLGIDQFATEDTLYGSIRLTNRQTFQFHGILKSNLKPAHQLLAKMGLDSLATANDVNRNVLCTSNPVQSALHQQAYEWAKKISEHLLPRTSAYAEIWLDKEKVATTDEEPILGSTYLPRKFKTSVVIPPQNDVDLHANDLNFIAIAENDQLIGFNVLVGGGLAMTHGDKKTFPRLASEFGFIPLKHTLAIAEAVVTTQRDWGNRTERKNAKTKYTLERVGVDTFRQEVEKRAGVHFEAIRPYEFTGRGDQIGWLKGIDDQWHLTLFIENGRLLDYPGKPLKTGIAEIAKIHKGDFRLTANQNLIVAGVPESEKARIEEIARTHGLIDNSVTFLRHHSMACVSFPTCPLAMAEAERFLPTFVDYVDALMEKHGVSDEHIVLRVTGCANGCGRAMLAEIGLVGKAQDRYNLHLGGNRIGSRIPRMYRENITSAEILVILDELIGRWSAERNVHECFGDFLVRADIIKPVLNSALDFYDWQEAL

SEQ ID NO: 8381 - protein, 621 aa, Xenorhabdus bovienii
  Peptide sequence Name=Xb4151_4152.C437.gene65.pep
  Gene classification: Gene name=CysJ; Function=Sulfite reductase flavoprotein subunit; Function class=P Inorganic ion transport and metabolism
  Homolog annotation: Query=22..621bp; Hit=1..599bp; Blast score=845; Percent Identity=68.0; E value=0; Homolog= cysJ COG0369
MINPCIDFKIMDIGYSKGHGIMTTKPPSTALLPVSPEQLSRLQSAIGDFSPHQLAWLSGYFWGMVNQKPQTEVVTPAAPISETVTLISASQTGNARRLAEQLRDSLLAEKLNVNLVNAGDYKFKQIAQERVLIIIASTQGEGEPAEEAVALYKYLNSKKAPSMKETAYAVFGLGDTSYENFCQAGKDFDHRLNELGAQRLLERIDVDVEYQEQAAQWRQQITEVLKQRLPAQTQAGITVNQAGSVSEIISSPYTKDAPLTASLLTNQKITGRGSDKDVRHIEIDLGDSGLHYQPGDALGVWFENDPALVDELIELLWLTGSEQVNVHGKSLPLRQALISHVELTQNTGLIVEKYAVLAKDQKLFALIADKQALQQYAQKTPIVDMVRQAALHPEAQQFIDLLRPLTPRLYSISSSQTEVKNEVHVTVGVVRYEIEGRARTGGASGYLADRLQEDDNIRIFIEHNDNFRLPADPQTSVIMIGPGTGVAPFRAFLQQRDNQGSEGKNWLFFGNPHFVEDFLYQVEFQRYAKDGLLTRIDLAWSRDQQHKIYVQDKLREQGKEIWRWVQDGAHLYVCGDANRMAKDVEQALLDIISQQGGMDAEQADEFLSELRLERRYQRDVY

SEQ ID NO: 8382 - protein, 68 aa, Xenorhabdus bovienii
  Peptide sequence Name=Xb4151_4152.C437.gene66.pep
VPFAIANIHDFEIYTWINHKVIPDKEEILKKGLQYLITKMPNFIYRFHISIKSLSVVLYSSRKITLCL

SEQ ID NO: 8383 - protein, 121 aa, Xenorhabdus bovienii
  Peptide sequence Name=Xb4151_4152.C437.gene67.pep
  Gene classification: Function=6-pyruvoyl-tetrahydropterin synthase; Function class=H Coenzyme metabolism
  Homolog annotation: Query=1..121bp; Hit=2..121bp; Blast score=215; Percent Identity=83.0; E value=6e-57; Homolog= ygcM COG0720
MSTTIFKDFQFEAAHRLPHVPEGHKCGRLHGHSFMVRLEITGEVDPLSGWIMDFADVKVAFKPIWERLDHNYLNEIPGLENPTSEVLAKWIWEKLKPTLLPQLSAVMVKETCSAGCIYRGE

SEQ ID NO: 8384 - protein, 223 aa, Xenorhabdus bovienii
  Peptide sequence Name=Xb4151_4152.C437.gene68.pep
  Gene classification: Gene name=NrdG; Function=Organic radical activating enzymes; Function class=O Posttranslational modification, protein turnover, chaperones
  Homolog annotation: Query=1..223bp; Hit=1..223bp; Blast score=347; Percent Identity=69.0; E value=5e-96; Homolog= ZygcF COG0602
MIYPINEIFQTLQGEGVFTGVPSVFIRLQGCPVGCSWCDTKHTWEKEADKQQPMENILVKSQDSDTWGAATARQIINLFIRQGYTARHIVVTGGEPCLYNLRPLTETLESEGYQCQIETSGTHAIQCSEKTWVTVSPKVKMRGGYQVLPEAMNRANEIKHPVGRERDIEALDELLTMLDEKADPVIALQPISQKEEATRLCIETCIARNWRFSMQTHKYLNIA

SEQ ID NO: 8385 - protein, 49 aa, Xenorhabdus bovienii
  Peptide sequence Name=Xb4151_4152.C437.gene69.pep
MPESISGIQCSVWRQIPAKATPYNTIKMDVRGIDICNNTRQFSKTRVFL

SEQ ID NO: 8386 - protein, 462 aa, Xenorhabdus bovienii
  Peptide sequence Name=Xb4151_4152.C437.gene70.pep
  Gene classification: Gene name=AnsP; Function=Gamma-aminobutyrate permease and related permeases; Function class=E Amino acid transport and metabolism
  Homolog annotation: Query=4..457bp; Hit=3..458bp; Blast score=552; Percent Identity=67.0; E value=1e-157; Homolog= PA5097 COG1113
MQHNENQLKQGLSVRHIRFMALGSAIGTGLFYGSAAAIQHAGPAVLLAYLIGGAAVFMVMRALGEMAVHHPVSGSFSQYASHYLGPLAGFLTGWIYVLEMLFVCLADITAFGMYMRLWFPHVDQWIWVLGIVCFIGALNLCHVKIFGEMEFWLSIVKVTAIIAMIIGGIIIMIYGFGQSTEHATGISNLWEHGGFMPNGISGVVASFAIVMFAFGGIEVIGITASEAKNPEKTIPKAINAVPFRILIFYVLTLCILMCIYPWNQIDQNASPFVQIFSNLGINSAANILNVVVITAAISAINSDIFGAGRMMYGMAQERQAPEAFKKLTRNGVPWMTVLVMTIVLLLGVWLNFLIPNDIFILIASVATFATVWVWLMILISHVAMRRQMSAKDIKSLKFPVPMWPIAPAITIVFMVGVIMLLGYFEQTRDALYVGIGWVLVLTLAYSFCVKKKLSKNHLSTNQ

SEQ ID NO: 8387 - protein, 276 aa, Xenorhabdus bovienii
  Peptide sequence Name=Xb4151_4152.C437.gene71.pep
  Gene classification: Function=Uncharacterized BCR; Function class=S Function unknown
  Homolog annotation: Query=20..275bp; Hit=6..260bp; Blast score=308; Percent Identity=60.0; E value=4e-84; Homolog= yafD COG3021
LVRSYARRRRAKKNSAPKNYAIRYVANQPVERVLPTSKRLLEDNSLPHGQPLPAFNHELCVAIWNIYKQQRPSWQEVLGSLIESSQLILLQEAQTTPDLLKFVTVSGLVADQVPAFSIPQHPSGVMTLASSSPVYCYPLREKEPILRLSKSSLITIYPLPDNRQLMVINVHAINFSFGVDVYSRQLNNIGIHINLHHGPVIFAGDFNAWSHRRLRVLVRFAQRMQLKEVYFNDDHRTIVFGKPLDFVFYRELKVLNAAVLTTMASDHNPLIVNFSL

SEQ ID NO: 8388 - protein, 62 aa, Xenorhabdus bovienii
  Peptide sequence Name=Xb4151_4152.C437.gene72.pep
MSIIDFNLLRTKRFCRINRENLSQCGVRCILCSIETSSIPAKIVWARRNDLKPNIGRINGIM

SEQ ID NO: 8389 - protein, 45 aa, Xenorhabdus bovienii
  Peptide sequence Name=Xb4151_4152.C437.gene73.pep
VFYRLLLVFLKERSKSLTFIEKYMTFCRANRVFNSKSLQTFTLSR

SEQ ID NO: 8390 - protein, 201 aa, Xenorhabdus bovienii
  Peptide sequence Name=Xb4151_4152.C437.gene74.pep
  Homolog annotation: Query=2..196bp; Hit=3..197bp; Blast score=261; Percent Identity=62.0; E value=6e-69; Homolog= Pa|Phot3-217d01.q1k _g146| 89544 - 90152 2112 202 aa, chain +
MEKFYQLKITLTETEPVIWRRFVVPSNISLDRLHDVIQAVMGWEDSHLHEFIFSAKRFTEMPEEMENGQEEGKFKLDSLIKRKGSKFAYLYDFGDSWEHEIVLENSNYSPEKLPMPIFCVEGEQACPPEDSGGVYGYMELLNILKDPTHEDYQDMFEWVNGDADISPDDVFSPEKFDVEEINNKLALYYRWSRDRYLSMFE

SEQ ID NO: 8391 - protein, 30 aa, Xenorhabdus bovienii
  Peptide sequence Name=Xb4151_4152.C437.gene75.pep
MNILAEKRDITATAVLRFVLVTCLLMPNVW

SEQ ID NO: 8392 - protein, 95 aa, Xenorhabdus bovienii
  Peptide sequence Name=Xb4151_4152.C437.gene76.pep
MILGHYCPAILMLFYLLFPLINHWLNRKRHTFFQHNSLSRTAIMQNLRLLMHITADAMTTVFTHNTVIIRLSMLLYRMTDIPQGDTRLHKFNSFI

SEQ ID NO: 8393 - protein, 68 aa, Xenorhabdus bovienii
  Peptide sequence Name=Xb4151_4152.C437.gene77.pep
  Gene classification: Gene name=Map; Function=Methionine aminopeptidase; Function class=J Translation, ribosomal structure and biogenesis
  Homolog annotation: Query=1..58bp; Hit=196..253bp; Blast score=97; Percent Identity=75.0; E value=2e-21; Homolog= PA2748 COG0024
MTFTIEPMINQGKKEIKQHKDGWTVMTKDHRLSAQFEHTILVTRNGFKVLTLRDEEREIFKRYMSINH

SEQ ID NO: 8394 - protein, 522 aa, Xenorhabdus bovienii
  Peptide sequence Name=Xb4151_4152.C437.gene78.pep
  Gene classification: Function=Predicted membrane-associated, metal -dependent hydrolase; Function class=R General function prediction only
  Homolog annotation: Query=6..516bp; Hit=12..521bp; Blast score=284; Percent Identity=34.0; E value=2e-76; Homolog= ybiP COG2194
MFFFDKNKKASCFVSLFFLIFLIHKCFGYQLKLIYVFSAFALFLFLAALSKRVYLFLITFFSLVAILYAPVGLNYGFPDINAVGSLLYTNQNETLEYISGFPISTYLTVIGIFALMMFSFRLNVNLSGKNKKWLFFLFFIPAFWSPAKGYIKSGFENGTELLNTSLPEVRFFSDAYQSYTKVMSENSRFAKIIKLQDDWQPVVKEEKYDTYIMVIGESVRKDFLGAYGFPAKNTPWLDNANATLFTHYISAAPSTQLSLTNSLAIRQSNEVNLNNSIVTLANKAGFETYWLSNQGMKGGFDSPVAMIGQQAKHPMFLKEGSSDDRSYMPDENLLPYVRNALKNDQHDKKKKLVIIHLMGSHPQPCARTNNQYSTDFHSKNISCYVQSIHNTDSLLAEIENIANQNQLNWTMLYFADHGLSFVHKGTDNENLTHGDKNQQNYQVPFIITSYDYSARNKIDAQRSGLHLLPMLSLWLGIEEPRLVSECDWFSNQKCQNQHNVISFEGKHMDFNRLHNDAIHFGL

SEQ ID NO: 8395 - protein, 35 aa, Xenorhabdus bovienii
  Peptide sequence Name=Xb4151_4152.C437.gene79.pep
MKLSPTISGGSEPTAEYRIKRSESSNQWFGYGCNG

SEQ ID NO: 8396 - protein, 717 aa, Xenorhabdus bovienii
  Peptide sequence Name=Xb4151_4152.C437.gene80.pep
  Gene classification: Gene name=CstA; Function=Carbon starvation protein, predicted membrane protein; Function class=T Signal transduction mechanisms
  Homolog annotation: Query=1..717bp; Hit=6..721bp; Blast score=1162; Percent Identity=87.0; E value=0; Homolog= ZyjiY COG1966
MNNNKFLKHIPWMILGIIGAFCLGVVALRRGEHVSALWIIVASVAVYLVAYRYYSLYIATKVMKLDATRATPAVVNNDGLNYVPTNKNVLFGHHFAAIAGAGPLVGPVLAAQVGYLPGTLWLLAGVVLAGAVQDFMVLFISSRRNGASLGEIIKEEMGQVPGTIALFGCFLIMIIILAVLALIVVKALAESPWGVFTVCSTVPIALFMGIYMRYIRPGRVGEVSVIGVLMLIAVIWFGGVVAADPYWGPALTFKDTTITYTLIGYAFVSALLPVWLILAPRDYLATFLKIGVIIGLAIGIVILNPDLKMPAVTQFVDGTGPVWKGTLFPFLFITIACGAVSGFHALIASGTTPKLLANEKDARFIGYGAMLMESFVAIMALVAASIIEPGLYFAMNTPPAALGITMPNLHNLGTAEAPMIMASLQEVTAHAAATVSSWGFVISPEQILQTAKDIGEPSVLNRAGGAPTLAVGIAYVFHQIIPAANMGFWYHFGILFEALFILTALDAGTRSGRFMLQDLLGNFVPFLKKTDSLVAGIIGTAGCVGLWGYLLYQGVVDPLGGVKSLWPLFGISNQMLAAAALVLGTVVLIKMKRAKYIWVTVIPAIWLLICTTWALGLKLFSDDPRLEGFFFLAKEYKQRIAEGGAELTAQQISNMNHIVVNNYTNAGLSILFLVVVYSIIIYGIKTAIKASKNPERTDNETPYVPVPEGGVKVSSTH

SEQ ID NO: 8397 - protein, 67 aa, Xenorhabdus bovienii
  Peptide sequence Name=Xb4151_4152.C437.gene81.pep
  Gene classification: Function=Uncharacterized small protein; Function class=S Function unknown
  Homolog annotation: Query=1..67bp; Hit=1..67bp; Blast score=115; Percent Identity=86.0; E value=1e-26; Homolog= yjiX COG2879
MFGNLGKAGKYLGQAARMLVGVPDYDTYVQHMKENHPDKPYMTYEEFFRERQNARYGGDGKGGMRCC

SEQ ID NO: 8398 - protein, 362 aa, Xenorhabdus bovienii
  Peptide sequence Name=Xb4151_4152.C437.gene82.pep
  Gene classification: Function=Putative GTPases (G3E family); Function class=R General function prediction only
  Homolog annotation: Query=80..362bp; Hit=1..282bp; Blast score=374; Percent Identity=68.0; E value=1e-104; Homolog= yjiA COG0523
MKNFSVSVRMRAMVVMAKAACAAVSVLVSRRSKRRKSLSVKQETKMKAISVTILAGFLGSGKTTLLRHILKAEHGYKIAVIENEFGEVPIDHELIGDRATQIKTLSNGCICCSRSSELEDALLDLLDGIDKGQIDFDRLIIECTGMADPGPITQTFFSHEILCQRFLLDGIITLVDAMHADQQLNRFSIAQSQVGYADRILLTKTDVAPEHDALFERLQRINAKAPIHKVVHGEADLSLLFDIEGFMLNDKLTVSNSVFRFIPKQQNTIQSIVINLTHPVGLAEVSDLMEELLLSFADNLLRYKGILAIKEEPRRLLFQGVQRLYSADWDRAWHDNEERLSVLVFIGMDLPEQKIREKFAEL

SEQ ID NO: 8399 - protein, 52 aa, Xenorhabdus bovienii
  Peptide sequence Name=Xb4151_4152.C437.gene83.pep
LIIFYSLLSSEIVCIKIRCSYLNRKLYYICTLLVLIPCKKISNILTKIRQQE

SEQ ID NO: 8400 - protein, 183 aa, Xenorhabdus bovienii
  Peptide sequence Name=Xb4151_4152.C437.gene84.pep
  Gene classification: Gene name=XerC; Function=Integrase; Function class=L DNA replication, recombination and repair
  Homolog annotation: Query=2..183bp; Hit=8..189bp; Blast score=219; Percent Identity=57.0; E value=1e-57; Homolog= fimB COG0582
MKQRKFLTRYEIDAILEQTKQGRHAERDYCMLLMCFIHGFRVSELCNLCLSDLDLNSSIIHIRRLKGGLSTTHPLIPKEIEALKKWLDIRQKWRDADAPWVFLSQKSGSISRQQVYALLKRYGKQASVSVSPHPHMLRHACGYALADLGRDTRLIQDYLGHRNISHTVIYTASNVKRFSRIWE

SEQ ID NO: 8401 - protein, 49 aa, Xenorhabdus bovienii
  Peptide sequence Name=Xb4151_4152.C437.gene85.pep
LPHSVHQGHLTRIYTITINIFIKDKTNRSRKFFLYCFPIRLIWYFANHV

SEQ ID NO: 8402 - protein, 48 aa, Xenorhabdus bovienii
  Peptide sequence Name=Xb4151_4152.C437.gene86.pep
MIKKHPNFIFTNQFSILNFVFLLYLVFNSNLYGGNLKSTWHSDAINRE

SEQ ID NO: 8403 - protein, 55 aa, Xenorhabdus bovienii
  Peptide sequence Name=Xb4151_4152.C437.gene87.pep
VFAYSGNPCLIHHNFDDLCIGLLHRMMSEWTKLIVIHLSHVKKRLEKEKYITKSR

SEQ ID NO: 8404 - protein, 441 aa, Xenorhabdus bovienii
  Peptide sequence Name=Xb4151_4152.C437.gene88.pep
  Gene classification: Gene name=SdaC; Function=Amino acid permeases; Function class=E Amino acid transport and metabolism
  Homolog annotation: Query=7..441bp; Hit=6..443bp; Blast score=631; Percent Identity=81.0; E value=0; Homolog= ZyhaO COG0814
MKTATKNNEVTTHTSPAAKRANMTEVEWKKAIKFDSTDTGWIIMSIGMAIGAGIVFLPVQVGLMGLWVFLLSSIIGYPAMYLFQRLFINTLAESPECKDYPSVISGYLGKNWGILLGILYFIMLVIWMFVYSTAITNDSASYLHTFGITSELLSKNPFYGLILICILVAISSRGEQWLFKISSLMVLTKLFVVAALGLSMIGMWHLYNIGVLPPFAILIKKAIITLPFTLTSILFIQTLSPMVISYRNHQHNREVARYKTLRAMNVAFGVLFCTVFFYAISFTLAMGHDEAVKAYEQNISALAIAAQFFPDGWVVTVSVILNIFAVMTAFFGVYLGFREASQGIAMNILGRLMPTEKINEKWVQKGIMIFAILLAWGAIILNAPVLSFTSLCSPIFGIVGCLIPSYLVYKVPSLHHYKSASLILIIFTGILLCISPFLAFS

SEQ ID NO: 8405 - protein, 49 aa, Xenorhabdus bovienii
  Peptide sequence Name=Xb4151_4152.C437.gene89.pep
MLARLAAGEVWVVTSLFFVAVFIIALAYIFGVVIGIEQVQKETHHINTK

SEQ ID NO: 8406 - protein, 43 aa, Xenorhabdus bovienii
  Peptide sequence Name=Xb4151_4152.C437.gene90.pep
LVILTIQTIREKSCALYHVCSCSKHPVSIKSFLLLILWGSSAC

SEQ ID NO: 8407 - protein, 348 aa, Xenorhabdus bovienii
  Peptide sequence Name=Xb4151_4152.C437.gene91.pep
  Gene classification: Gene name=FabH; Function=3-oxoacyl-[acyl-carrier- protein] synthase III; Function class=I Lipid metabolism
  Homolog annotation: Query=2..344bp; Hit=5..316bp; Blast score=62; Percent Identity=21.0; E value=5e-10; Homolog= NMB1916 COG0332
MKIIGISGLLPSRCVTNGDVLNLIEQHSKKTFQGDFPKTLRTIQRLLEKTGLESRYWLGEGEKPMRLMEEAFEQALRQANIKKSEIDLLIYPNVTRGFTEPANSTFIAKALGLNCRNYDVLDACNGWVTAMDIINGKMKAGEIRYAAIINMEFGMSEGGPFRKNFSLNSASELAYKYPSFTIGEAASVTILSNEDTDNFKFDYISRPDLCDICNISLPNWELFCNDSDIELISPLGGKYQFNSYAAALHEYAGEEVPKVFKQHNIASSDIHKIFIHTGAPNMWDGFGKAVDAADKMHNIGQKTGNIITASIPFGIADALGKDQVERDKLCMGWAGSGGMVFSAMSFKL

SEQ ID NO: 8408 - protein, 30 aa, Xenorhabdus bovienii
  Peptide sequence Name=Xb4151_4152.C437.gene92.pep
MISVGLVNKNRVFLIVLAGEYFSLNDIDSQ

SEQ ID NO: 8409 - protein, 223 aa, Xenorhabdus bovienii
  Peptide sequence Name=Xb4151_4152.C437.gene93.pep
  Gene classification: Gene name=CsgG; Function=Uncharacterized protein involved in formation of curli polymers; Function class=M Cell envelope biogenesis, outer membrane
  Homolog annotation: Query=4..223bp; Hit=7..227bp; Blast score=302; Percent Identity=70.0; E value=2e-82; Homolog= PA0045 COG1462
MKSKFTLASLCLASLMLAGCATESSSTLQVQKVSSYNTIYQGIRSPIAVGKFENRSSYQNGIFSDGIDRLGNQSKTTLVTHLQQTGRFNVLERTNMAELQTEAGLQGKAQKLKGANYVITGAVTEFGRKEVGDHQLWGILGRGKSQVAYAKVMLNVVNVETSEVIFSSAGAGEYKLSSREIIGFGGASGYDSTLNGKVLDLAIREAVNDLVAGIESGAWKPVN

SEQ ID NO: 8410 - protein, 118 aa, Xenorhabdus bovienii
  Peptide sequence Name=Xb4151_4152.C437.gene94.pep
  Homolog annotation: Query=1..116bp; Hit=1..116bp; Blast score=167; Percent Identity=75.0; E value=4e-41; Homolog= gi|37527821|ref|NP _931166.1| hypothetical protein [Photorhabdus luminescens subsp. laumondii TTO1] gi|36787257|emb|CAE16338.1|
MFLMKKTGILLGILLLAGCVNAPKTIYEWGDYQPTVYQYYQQDKMGLQEQIQALQKVIELAKAKDKSVPPGLHAQMGLLYSQTGKIDEAFQQFVIEKSLFPEAAAYMDFLLSKSKGVK

SEQ ID NO: 8411 - protein, 219 aa, Xenorhabdus bovienii
  Peptide sequence Name=Xb4151_4152.C437.gene95.pep
  Homolog annotation: Query=1..218bp; Hit=1..218bp; Blast score=317; Percent Identity=74.0; E value=8e-86; Homolog= Pa|Phot3-217d01.q1k _g105| 62138 - 62809 2386 223 aa, chain -
MNRFWGAIGALLLLTLTGCVQQKPYDYTALRESKPKSILVLPAVNKSVEIQAGGSLISQVTYPLAESGYYVFPVAVVEETFRQNGVTEAQDVQNISYKKLHDIFGADAALYLDITQYGTQYLVISSDTRVSAAARLVDLRSGKQLWRGTATASSTENDNYSSGGLVGMLVSAAISQIANTITDRGHDIAGIASHRLLSAGQYGRLLYGPRSEHYGKEKL

SEQ ID NO: 8412 - protein, 446 aa, Xenorhabdus bovienii
  Peptide sequence Name=Xb4151_4152.C437.gene96.pep
  Gene classification: Gene name=NorM; Function=Na+-driven multidrug efflux pump; Function class=Q Secondary metabolites biosynthesis, transport and catabolism
  Homolog annotation: Query=10..444bp; Hit=7..437bp; Blast score=334; Percent Identity=45.0; E value=1e-91; Homolog= Cj0619 COG0534
MHQSDVVDRSLFSLSWPIFIDIFLHMATLLINTYMVSHISSAYLAAMGGGNLVFDLCITIFNFISVGCSVVIAQYLGSGKRDKASQAIHISIAFNFVLGLGCALVTVFFGYKILHIMNLPENLMEDGSAYLRVLGICLIPEAISIILAACLRVYGKSKTAMYVTLIANLLTIVGNMVVLYGFFGLPKYGLEGVAWSTVFGRTVAIILLSGLLFYGLKIKFNPRLLIHWSKNMLGKILHIGLPAAGENLVWILQYMAAQAFIGLMGETSLAAQTMYFQLSLFIMLFGISISIGNEIMVGHLVGAKRFEDAYIRGLNSLKIGVIVTSGVVLVFWILREPLLNMMTEDKKIIELLLPLFLLSVFLEPGRTFNIVMVNALRASGDARFPLYTALIFMWCISIPVGYFLGIVMNMGILGIWIGFFCDEWVRGLVNAWRWKSKRWQSKRLDI

SEQ ID NO: 8413 - protein, 39 aa, Xenorhabdus bovienii
  Peptide sequence Name=Xb4151_4152.C437.gene97.pep
VTYLESVGDSTRFIGQLVGGLRYLHRWHREGLGIKNLLR

SEQ ID NO: 8414 - protein, 48 aa, Xenorhabdus bovienii
  Peptide sequence Name=Xb4151_4152.C437.gene98.pep
VKSTIWKFIWLACLFWKRKFRVSLASDSCGFYRRRFFIPSPSLCHRCK

SEQ ID NO: 8415 - protein, 349 aa, Xenorhabdus bovienii
  Peptide sequence Name=Xb4151_4152.C437.gene99.pep
  Gene classification: Function=ABC-type iron transport systems, ATPase components; Function class=P Inorganic ion transport and metabolism
  Homolog annotation: Query=1..347bp; Hit=5..350bp; Blast score=558; Percent Identity=78.0; E value=1e-159; Homolog= afuC COG3841
MTQQHFVELKNVTKRFGSNAVIDSLNLSIPQGHMVTLLGPSGCGKTTVLRLVAGLEKPSEGNIFIDSEDVTERSIQQRDICMVFQSYALFPHLSLGENIGYGLKMQGRPKAEIREQVREALELVDLAGFEDRYVDQISGGQQQRVALARALILKPKVLLFDEPLSNLDANLRRNMREKIRELQQRFNITSLYVTHDQSEAFAVSDTVLVMNKGKIMQIGSPQTLYRHPASRFMASFMGDANIFPATLGLDYVEIFRYRLPRPAHFTTTRSSITVGIRPEAMTLNQQGSESQRCKVSYVAYMGAQYEVTVDWHGQTLLLQINATQLQPRVGEEYYLEIHLVGMFVLEEEI

SEQ ID NO: 8416 - protein, 692 aa, Xenorhabdus bovienii
  Peptide sequence Name=Xb4151_4152.C437.gene100.pep
  Gene classification: Gene name=ThiP; Function=ABC-type iron/thiamine transport systems, permease components; Function class=H Coenzyme metabolism
  Homolog annotation: Query=1..690bp; Hit=1..690bp; Blast score=988; Percent Identity=84.0; E value=0; Homolog= ZafuB COG1178
MSHTLTLPKKQGRDAVFWWIMLAWLSFALLPSWSLDYGLLESTQEEILAAYSWHSVNSSILWFLLPSLLLLRPLTPASRNQRQRHYFDAGYALLCTLFIITSATLAGRGLGYATIVLFIALGAIITLALTRLEWLGGDSFVIGSLVAITALVGVFILFPSIAIFIPMFKDEADQFAPFAFISILGQPHIIKVMANSILLSVAVGVGCTVFGLILAIYTARIAKRSAIIGRIFSILPIVTPPFVVGLGVTLMMGRSGYITEFMATWFGLTNTNWLYGFTGIWIAQVLAFTPMAFMILDGAIKTIHPSLEEASYTLRANRYQTFFHVFLPLLKPALANAFLIVVVQSLADFSNPLVLGGNFDVLATQIYFYITGSQLDYQSASTLGASLLVFSLLVFCIQYMWIGKRSYVTVSGKSYRGDVQPLPVSLVWGVCTTLFIWVTFNILLYGSIFYGSFTVNWGVDYTLTLDNFINLFGQGMSDGAWPSLLDTLLYAGIAAPITAILGLLIAYVVVRQEFRGKKAIEFTTMLCFAVPGTVAGVSYILAFNDAPFYLTGTAVIIIVSMTMRNVPVGIRAGIAGLGQIDKSLDEASLSLRAGSMRTIFHILLPLLRPAILSALIYSFVRAITTVSAIVFLVTPDTRVATAYILNRVEDGEYGLAIAYGSILIVVMLAVIFLFDYLVGEARISRSKAKNTQ

SEQ ID NO: 8417 - protein, 343 aa, Xenorhabdus bovienii
  Peptide sequence Name=Xb4151_4152.C437.gene101.pep
  Gene classification: Gene name=TbpA; Function=ABC-type iron/thiamine transport systems, periplasmic component; Function class=H Coenzyme metabolism
  Homolog annotation: Query=1..343bp; Hit=1..343bp; Blast score=563; Percent Identity=80.0; E value=1e-160; Homolog= ZafuA COG1840
MKLTSLFTLITMGLTATVITNNAQAAGRLNVYCNATNAMCEAETRAFGEKYNVKTTFVRNGSGSTLAKIEAEKRNPQADVWYGGTLDPHSQAGEIDLLQPYQSPNLAQIMPQFRDPAKRKGNYTSAVYMGILGVGVNTERLKEKNLPVPTCWKDLIKPEYKGEIQIADPQSSGTAYTALATFAQLWGEDNAFDYLKKLNGNISQYTKSGIAPARNTARGETAIGIGFLHDYSLEVENGAPMKLIAPCEGTGYEIGGVSIIKNARNLDNAKLFVDWVLSKEAQELSWKKGKSYQILTNTTAESSPTTLNPAELNLINYDMDKYGSSQVRKELINKWVIEVKMSK

SEQ ID NO: 8418 - protein, 79 aa, Xenorhabdus bovienii
  Peptide sequence Name=Xb4151_4152.C437.gene102.pep
MRVKRDVNFIRMMSLYSEFFVLNFFNAGTNKPNYFLLNKIELLIQVKDIMNSKISLCKFIDKICNRDNKLKIVLHDIIT

SEQ ID NO: 8419 - protein, 44 aa, Xenorhabdus bovienii
  Peptide sequence Name=Xb4151_4152.C437.gene103.pep
MAAKKIYDMAENRESLDPDGWFSPYLKNRGNYVFSLFFRYQLYD

SEQ ID NO: 8420 - protein, 50 aa, Xenorhabdus bovienii
  Peptide sequence Name=Xb4151_4152.C437.gene104.pep
MINFIYSNIIINPRIIRIIPGIHPRMNIQIIFYNSVTHSMDFEKDIERGQ

SEQ ID NO: 8421 - protein, 51 aa, Xenorhabdus bovienii
  Peptide sequence Name=Xb4151_4152.C437.gene105.pep
MSFLFWDQKHGRPFFVLSCRQHKRTNGAASLTLPTTIAHPFHSRQLLRCQI

SEQ ID NO: 8422 - protein, 46 aa, Xenorhabdus bovienii
  Peptide sequence Name=Xb4151_4152.C437.gene106.pep
MDSTSDGDWPEYRASSFKKLKPKSVTEAIKSGTEVIVCCERDEQWS

SEQ ID NO: 8423 - protein, 38 aa, Xenorhabdus bovienii
  Peptide sequence Name=Xb4151_4152.C437.gene107.pep
MAKIDVTCPSCCAVKEIYRNGCSRSGHQRYFCQYCRHS

SEQ ID NO: 8424 - protein, 49 aa, Xenorhabdus bovienii
  Peptide sequence Name=Xb4151_4152.C437.gene108.pep
MSRPKTKLRIYSPFEMGMLDIAVAENIYSDLKDISGVTISDFHPLPVMR

SEQ ID NO: 8425 - protein, 79 aa, Xenorhabdus bovienii
  Peptide sequence Name=Xb4151_4152.C437.gene109.pep
MFDHALNRRNHFHRIFFIGEDTCYKIIQHVDYDKCFHLYDLLLTLVCLKGNWKNTTEPPSYAIYRIFYIKKNNPLDLGC

SEQ ID NO: 8426 - protein, 179 aa, Xenorhabdus bovienii
  Peptide sequence Name=Xb4151_4152.C437.gene110.pep
  Gene classification: Gene name=PncA; Function=Amidases related to nicotinamidase; Function class=Q Secondary metabolites biosynthesis, transport and catabolism
  Homolog annotation: Query=2..174bp; Hit=3..168bp; Blast score=136; Percent Identity=46.0; E value=1e-32; Homolog= TVN0771 COG1335
MKALIVIDMLNDFVTGVLANEEDAMKMIPSIQRMIKHARNNPDWLVVYANDAHRADDREMEIWGKHAMAGTWGADVIDELAPIGMEREIVSPKRFYNAFDGTGLEDVLAQYGVTEVVLTGQHIHCCVHHTAYGAFIRGYGITVLSDAVCAFPGIDQQAALDYLKTIYGAEITTSKAFGV

SEQ ID NO: 8427 - protein, 115 aa, Xenorhabdus bovienii
  Peptide sequence Name=Xb4151_4152.C437.gene111.pep
  Homolog annotation: Query=1..115bp; Hit=1..115bp; Blast score=171; Percent Identity=75.0; E value=2e-42; Homolog= Pa|Phot3-217d01.q1k _g21| 12278 - 12625 1234 115 aa, chain +
MQKIALLTYILVLFSFAQPAKALSEEEAESLADMTAVYIYLKYDCGYSQIPDREIRRAVIYFAQRNKWDLNNYNSQLMEELNQSGYNDLKGINLPQKTKCQALARPSLSLLAYVK

SEQ ID NO: 8428 - protein, 75 aa, Xenorhabdus bovienii
  Peptide sequence Name=Xb4151_4152.C437.gene112.pep
MFLYKKLILNDYIFIFIPYFIRGSHTHSSCVIRKMYILMYINYSEWSCWFLRKLIWLSLIHGSALPIKVKKIKFG

SEQ ID NO: 8429 - protein, 639 aa, Xenorhabdus bovienii
  Peptide sequence Name=Xb4151_4152.C437.gene113.pep
  Gene classification: Gene name=SpeA; Function=Arginine decarboxylase (spermidine biosynthesis); Function class=E Amino acid transport and metabolism
  Homolog annotation: Query=1..639bp; Hit=22..658bp; Blast score=1071; Percent Identity=79.0; E value=0; Homolog= speA COG1166
MKETAMNDNIARKMRQTYNIAYWGGGYYYVNDLGNVSVCPNPDLPEAQVELTELVKKVQEEKKQLRLPSLFCFPQILQHRLRSINAAFKRARESYGYKGDYFLVYPIKVNQQRRVIESLANAGEPIGLEAGSKAELMAVLAHAGMTRTVIVCNGYKDREYIRLALIGEKLGHKVYLVIEKMSEIAMVLEEAERLSVIPRLGVRARLASQGAGKWQSSGGEKSKFGLAAAQVLQLVETLRSAGKLNSLQLLHFHLGSQLANIRDVATGVRESARFYVELHKLGVNIQCFDVGGGLGVDYEGTRSQSECSVNYGLNEYANNVIWGIGDACEEHGLPHPTVITESGRALTAHHTVLISNVIGVEHNEFTETTPPAEDASRPLASLWDTWQEMQDGGYSRSLREWLHDSQFDLQDVHTQYAHGMLNLSERAWAEELYLNICRHIQRDLDPSNRAHRPFIDELQERMADKFYVNFSLFQSMPDAWGIDQVFPVLPIEGLDKPLDRRAVLLDITCDSDGIIDHYVDGDGIAATMPMPAYDPENPPLIGFFMVGAYQEILGNMHNLFGDTAAVDVYVSEHGEVTYLQSEEGDSVANMLQYVKLEPQVLMSRFCDQVKAADLDENLQEQFLQEFESGLYGYTYLEDE

SEQ ID NO: 8430 - protein, 48 aa, Xenorhabdus bovienii
  Peptide sequence Name=Xb4151_4152.C437.gene114.pep
MRYCRSVAFYERYYHSWQSPSWSRGLPSPVKSITQDTINSANSTYLAH

SEQ ID NO: 8431 - protein, 53 aa, Xenorhabdus bovienii
  Peptide sequence Name=Xb4151_4152.C437.gene115.pep
MHHYLLIVNGQQPHYAIDVFTSSSFLFNMNSFRCYRKHSNRLVISSRHHIVTP

SEQ ID NO: 8432 - protein, 48 aa, Xenorhabdus bovienii
  Peptide sequence Name=Xb4151_4152.C437.gene116.pep
LQNEIYQNTFTLTDLFLKTPKNVTRQKIFKTKKTGILDKSALKWPSRW

SEQ ID NO: 8433 - protein, 384 aa, Xenorhabdus bovienii
  Peptide sequence Name=Xb4151_4152.C437.gene117.pep
  Gene classification: Gene name=MetK; Function=S-adenosylmethionine synthetase; Function class=H Coenzyme metabolism
  Homolog annotation: Query=1..384bp; Hit=1..384bp; Blast score=724; Percent Identity=91.0; E value=0; Homolog= metK COG0192
MTTHLFTSESVSEGHPDKIADQISDAVLDAILEQDPKARVACETYVKTGMVMVGGEITTSAWVDIEEITRRTVREIGYTSSDMGFDANSCAVISAIGKQSPDINQGVDRADPLEQGAGDQGLMFGYATNETNVLMPAPITYAHLLVERQAQVRKNGILPWLRPDAKSQVTFQYDNGKIVGIDAVVLSTQHSEDIQQKELQEAVMDEIIKPVLPAEWLTPMTKYFINPTGRFVIGGPMGDCGLTGRKIIVDTYGGMARHGGGAFSGKDPSKVDRSAAYAARYVAKNIVAAGLADRCEIQVSYAIGVAEPTSIMVETFGTEKVPTSTLIQLVREFFDLRPYGLIKMLDLLHPIYRDTAAYGHFGREHFPWEATDKAEILRSAAGLK

SEQ ID NO: 8434 - protein, 190 aa, Xenorhabdus bovienii
  Peptide sequence Name=Xb4151_4152.C437.gene118.pep
  Gene classification: Gene name=SprT; Function=Uncharacterized BCR; Function class=S Function unknown
  Homolog annotation: Query=12..173bp; Hit=1..162bp; Blast score=202; Percent Identity=59.0; E value=2e-52; Homolog= ZsprT COG3091
MSEITIPYTAVMKFVRVPLALQQTVMRTLRQKLAQASDYLETTFPEPCVTYRQRGTIAGSACLQGWEIRLNPVLLIENQQSFIDEVIPHELAHLLTYHQFGKVAPHGKEWRFVMETVLKVPANRTHQFSVDSVRSKIFIYYCRCQQHELTIRQHNKVLKGKSCYLCQQCKERLKLLEQNKSNTPQSESST

SEQ ID NO: 8435 - protein, 115 aa, Xenorhabdus bovienii
  Peptide sequence Name=Xb4151_4152.C437.gene119.pep
  Homolog annotation: Query=1..109bp; Hit=1..104bp; Blast score=112; Percent Identity=57.0; E value=1e-24; Homolog= gi|37527599|ref|NP _930943.1| hypothetical protein [Photorhabdus luminescens subsp. laumondii TTO1] gi|36787034|emb|CAE16109.1|
MKNLLAVCLLSFVLTGCDNHLSIDGTNEIAVKTSIEKIRDTLPEDKKLKFDDSLNIAMTNSIDFDDLFKESANGNIKSGDIERLEQKFFRSLHGKTADQLIAEAEKIKAANFTSQ

SEQ ID NO: 8436 - protein, 45 aa, Xenorhabdus bovienii
  Peptide sequence Name=Xb4151_4152.C437.gene120.pep
MVFISFRIVLRNFVGFEQILKLIIMVHKYISFFAVMRKLLGVWLA

SEQ ID NO: 8437 - protein, 58 aa, Xenorhabdus bovienii
  Peptide sequence Name=Xb4151_4152.C437.gene121.pep
MKEDELWKNMVCETKNIFDNHKTLFSKEHLKTEFSVLLQVTVNHKVFLKMQLTNNPKI

SEQ ID NO: 8438 - protein, 378 aa, Xenorhabdus bovienii
  Peptide sequence Name=Xb4151_4152.C437.gene122.pep
  Gene classification: Gene name=FecB; Function=ABC-type cobalamin/Fe3+- siderophores transport systems, periplasmic components; Function class=P Inorganic ion transport and metabolism
  Homolog annotation: Query=20..373bp; Hit=31..356bp; Blast score=70; Percent Identity=24.0; E value=3e-12; Homolog= MJ0085 COG0614
MSVIHYSIKYFILVLFVLLPICSQAENITVTDIAGREVTVNAPAQRVILIDSRSIIALNILHPNDPLKGIVAWDNALEKTAPDLAAAYEEKFPQLRKIPIFPTPYTRDFSVEKALTYKPDLVIFNMGLKPKLDNSNAVKLLEKSGIPVIFIDFCQYPLSNTVSSMELLGKVFKKEENAGKFIAFYESRLSLINKRIATLYQEQIPSVFIEHHAGMLGAKDCCDTIGANSFGEFVTTAGGDNIGSKWFSDMGGRINEEQLLVSNPDTYLMTVADWDQVHAGSQSVPLGYTGNLEKSEKRLQNLLSRPNLKVLSSYREKRVMAIYHQYYDSPFNIIAVEAIAKWLHPELFKDIDPHADSIYVHKTFTALDGSGVFWVTTK

SEQ ID NO: 8439 - protein, 53 aa, Xenorhabdus bovienii
  Peptide sequence Name=Xb4151_4152.C437.gene123.pep
MLANIKITPNACQKKSPGSIEKPTGKTCRFRLRRYYLVVTQNTPLPSNAVNVL

SEQ ID NO: 8440 - protein, 446 aa, Xenorhabdus bovienii
  Peptide sequence Name=Xb4151_4152.C437.gene124.pep
  Gene classification: Gene name=GltP; Function=Na+/H+-dicarboxylate symporters; Function class=C Energy production and conversion
  Homolog annotation: Query=7..423bp; Hit=34..450bp; Blast score=543; Percent Identity=71.0; E value=1e-154; Homolog= mll5840 COG1301
MDNTSKKKPLYQILYIQVIFAILLGIALGHFYPDIGESLKPLGDAFIKIVKMIIAPVIFLTVVTGIAGMNNMKAVGSVVGKSMLYFLTFSTLALIIGLIAANIIRPGDGLNISPESLDSSKVIGYVEKAHESSIVGFLMNIIPETVVSPLVNGNILQVLFIAVIFGIALASTGKKGEPILVFLQNFSEPVFKMVGILMKLAPIGAFGAMAFTIGKYGISSIGNLMMLIVTFYMTSLLFIFVVLGAVAKYNGFSIIKLIKYIKDELWLVLGTSSSEAALPSLMRKMENAGCEKSVVGLVIPTGYSFNLDGTNIYMTMAALFIAQATGIELSFTEQISLLLVAMISSKGAAGVTGAGFITLAATLSVVPSLPVAGMALILGIDRFMSECRALTNLVGNACASIVVARWENALDKDKMHQALNGNRQNSVEDISFSLSSKKNISPPENK

SEQ ID NO: 8441 - protein, 34 aa, Xenorhabdus bovienii
  Peptide sequence Name=Xb4151_4152.C437.gene125.pep
MFYGVNSYFSVRIAFKYKRFLSINKLNNKREGEI

SEQ ID NO: 8442 - protein, 493 aa, Xenorhabdus bovienii
  Peptide sequence Name=Xb4151_4152.C437.gene126.pep
  Gene classification: Gene name=PutA; Function=NAD-dependent aldehyde dehydrogenases; Function class=C Energy production and conversion
  Homolog annotation: Query=17..490bp; Hit=54..532bp; Blast score=460; Percent Identity=47.0; E value=1e-129; Homolog= VC0819 COG1012
MKKLHNIAKEMLPAKSYKMLINGEWVDSVSRETRKSYNPATGELLTEYAAGNAQDVELAVKAAQKALPAWSKESATEKQSLLLKIADLLEAESERFITLEALDAGKTLNLCRTFDIPFAVDHFRYFAGVIRAHSDEADVIDADTLSLVIREPIGVVGQIIPWNFPLLMAAWKLAPALAAGNTIVINPASLTSISLLEFGRILNQVLPAGVVNIVTGRGSSVGQAILDHEGIDKVAFTGSTEIGYNVAAAAARRIIPATLELGGKSANIIFPDANMKKAVKYAADGILLNQGQACESGARLFLHKDIHDEFLKSLKAVFESVRVGDPMMTETEMGCQISQEQMDFILGYIDLAKQEGATVLTGGNRITGAGYDDGFFVQPTIITNVTNKMRVAQEEIFGPVLCVIPFSSEEEVVEMANDSEYGLGGAVWTQDINRALRVAKAVQTGRMWVNTYHALPAHAPFGGYKKSGLGRETHKMSLDAYTQVKNIYISTKE

SEQ ID NO: 8443 - protein, 45 aa, Xenorhabdus bovienii
  Peptide sequence Name=Xb4151_4152.C437.gene127.pep
MYRHYLCGCLVLLVVIHLNKKLIIKIATRKGGDCLGTYNYSFVLI

SEQ ID NO: 8444 - protein, 461 aa, Xenorhabdus bovienii
  Peptide sequence Name=Xb4151_4152.C437.gene128.pep
  Gene classification: Gene name=CitT; Function=Di- and tricarboxylate transporters; Function class=P Inorganic ion transport and metabolism
  Homolog annotation: Query=19..461bp; Hit=14..463bp; Blast score=449; Percent Identity=58.0; E value=1e-126; Homolog= PM1167 COG0471
MDASESLTPAIGPNPSNKRGLIILALDIILLVALLKFLPYGEKTNAGLALMAFVGVLWLTEAIHVTITALCIPILAVGMGLMNTGDALQSFANPIIFLFFGGFALATALHIQGLDRLIANRLLMIARGRLSVAVLLIFGITAVLSMWISNTATAAMMLPLILGILANLDVRTERNTFVFVLLGVAYSASIGGLGTLVGSPPNAIAAAQLGMDFFTWMKYGVPMVIILLPVMVAVMYIMLRPNLKHKFDLKLEHLEWNSKRIITMAIFLLTVFSWIFSSIISDAFGGIKDLDTIIAVSAAILIGITGVSTWSQIQNNTEWGVLMLFGGGLTLSAVLKNSGASEVMANGMAATFGASHWFVIILAVTAFIIFLTEFTSNTASAALLVPIFATVAEALGMPVMALTMIIGIGASCAFMLPVATPPNAIVYGSGYIKQIEMVRVGMVLNVVCIAIISVVAWFFWL

SEQ ID NO: 8445 - protein, 38 aa, Xenorhabdus bovienii
  Peptide sequence Name=Xb4151_4152.C437.gene129.pep
VYDFGIYHVGFVQLTNDCIENILILCRYFILFISSSYL

SEQ ID NO: 8446 - protein, 34 aa, Xenorhabdus bovienii
  Peptide sequence Name=Xb4151_4152.C437.gene130.pep
MFWRKGICSFAILTKDNFIRISDYKYDDEMKSMK

SEQ ID NO: 8447 - protein, 433 aa, Xenorhabdus bovienii
  Peptide sequence Name=Xb4151_4152.C437.gene131.pep
  Gene classification: Gene name=Eno; Function=Enolase; Function class =G Carbohydrate transport and metabolism
  Homolog annotation: Query=1..433bp; Hit=1..433bp; Blast score=707; Percent Identity=88.0; E value=0; Homolog= PM1871 COG0148
MSKIVKVLGREIIDSRGNPTVEAEVHLEGGFVGLAAAPSGASTGSREALELRDGDKSRFMGKGVLKALSAVNGSIAQALVGQDAKDQANIDKIMIELDGTENKSNFGANAILAVSLANAKAAAAAKGMPLYEHIAELNGTPGRFSMPLPMMNIINGGEHADNNVDIQEFMIQPIGASTLKEAVRIGSEVFHNLAKVLKAKGMSTAVGDEGGYAPNLESNAAALAAIKEAVEQAGYVLGKDITLAMDCAASEFYNKETGNYELKGEGRTFTSQEFTHYLEGLTKEYPIVSIEDGLDESDWDGFAYQTKVMGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGNRATFNGLKEVKGQA

SEQ ID NO: 8448 - protein, 545 aa, Xenorhabdus bovienii
  Peptide sequence Name=Xb4151_4152.C437.gene132.pep
  Gene classification: Gene name=PyrG; Function=CTP synthase (UTP -ammonia lyase); Function class=F Nucleotide transport and metabolism
  Homolog annotation: Query=1..545bp; Hit=1..545bp; Blast score=945; Percent Identity=84.0; E value=0; Homolog= pyrG COG0504
MKTNYIFVTGGVVSSLGKGIAAASLAAILEARGLKVTIMKLDPYINVDPGTMSPTQHGEVFVTEDGAETDLDLGHYERFIRTKMTRRNNFTTGRVYSEVLRKERRGDYLGATIQVIPHITNEIKDRIIRGAEGYDVVLVEIGGTVGDIESLPFLEAIRQMAVEVGREHTLYMHLTLVPYLAAAGEVKTKPTQHSVKELLSIGIQPDVLICRSDRIIPANERAKIALFCNVPEKAVISLKDVDSIYKIPALLKSQGLDDYICKRFSLGYPEADLSEWEQVVYEEANPSGEVTIGMVGKYVELPDAYKSVIEALKHGGLKKRLTVNIKLIDSQDVETRGVDVLKDLDAILVPGGFGGRGIEGKIMTARYARENNVPYLGICLGMQVALIEFSRNVAGMKEANSTEFEPECKLPVVGLITEWRDENGNLEVRSEESDLGGTMRVGGQLCRLSEGSLVRKLYGQDDIIERHRHRYEVNNLLLKRIEEAGLRIAGRSIDNRLVEIIENPAHPWFVACQFHPEFTSTPRDGHPLFAGFVEAAGKYQKGQLK

SEQ ID NO: 8449 - protein, 266 aa, Xenorhabdus bovienii
  Peptide sequence Name=Xb4151_4152.C437.gene133.pep
  Gene classification: Gene name=MazG; Function=Predicted pyrophosphatase; Function class=R General function prediction only
  Homolog annotation: Query=9..265bp; Hit=4..260bp; Blast score=330; Percent Identity=66.0; E value=1e-90; Homolog= mazG COG1694
MDKIKTTSIERLKGIMTQLRHPQQGCPWDKVQTSATIAPYTLEETYEVIDAIERNDANALKEELGDLLFHIVFYAQMGQEQQLFDFDDICDAVCDKLERRHPHIFDQQAGISSEEAIGSWEQRKTAERAEKDQHSVLDDIPASLPALMKAYKIQKRCASVGFDWDTLGPVLGKVYEEIDEVMDEARQVVVDEARLEEELGDLLFSVVNLSRHLGHKPEMALQKACGKFENRFRSVEKLIFDQGLSLETATLEEMEQMWQQVKKQQP

SEQ ID NO: 8450 - protein, 745 aa, Xenorhabdus bovienii
  Peptide sequence Name=Xb4151_4152.C437.gene134.pep
  Gene classification: Gene name=SpoT; Function=Guanosine polyphosphate pyrophosphohydrolases/synthetases; Function class=T Signal transduction mechanisms
  Homolog annotation: Query=1..745bp; Hit=1..744bp; Blast score=1242; Percent Identity=80.0; E value=0; Homolog= relA COG0317
MVAVRSAHLTPAGEFAVDKWIASLHITNPQSSEKLAETWHYCHEKVQDHPDAALLLWRGVEMVEILSTLSMDNDSMRAALLFPILDAKLLDNETVTETFGTAITNLVHGVMEMDAIRQLKATHTDSTSSVQVDNVRRMLLSMVEDFRCVIIKLAERIAHLREVKDASEDERVLAAKECSNIYAPLANRLGIGQLKWELEDFCFRYLHPDEYKKIARLLHERRIDREQYIEKFVTTIRKYMLKEGIPVEIYGRPKHIYSIWRKMQKKSLGFDELFDVRAVRIVVERLQDCYAALGIVHTHYRHLPDEFDDYVANAKPNGYQSIHTVVLGPNGKTLEIQIRTRQMHDDAELGVAAHWKYKEGTAIGGGKSGSYESRIAWLRKLIAWQEEMADTGEMLDEVRSQVFDDRVYVFTPKGDVIDLPAGSTPLDFAYHIHSDVGHRCIGAKISGRIVPFSYQLQMGDQIEIITQKHPNPSRDWLNPNLGYVTTSRGRAKIHNWFRKQDRDKNIIAGRQMLDNELTHLGITLKEAEKELIARYNVHSLEEVLAGIGVGDIRIHQLMNFLQSKFNKTTAEEADRKALRNLENKTYTPRSVKQDNGRIVVEGVGNLMHHVARCCQPIPGDEIIGFITRGRGISIHSADCEQLAELEISAPERIVDAVWGENYSSGYSLVVRVLANDRSGLLRDITTILANEKVNVLGVSSRSDVKQQLATIDMNIEIYNLQVLGRVLAKLNQLSDVIEARRLHGN

SEQ ID NO: 8451 - protein, 450 aa, Xenorhabdus bovienii
  Peptide sequence Name=Xb4151_4152.C437.gene135.pep
  Gene classification: Gene name=TrmA; Function=SAM-dependent methyltransferases related to tRNA (uracil-5-)-methyltransferase; Function class=J Translation, ribosomal structure and biogenesis
  Homolog annotation: Query=1..444bp; Hit=1..431bp; Blast score=528; Percent Identity=59.0; E value=1e-150; Homolog= ygcA COG2265
MVQFYSPNRRSVNRGIISVTADNLDAQGQGIARHQGKTIFIQGLLPGEQAQIQLTEEKRQFAKAKIVKRLSDSPFRVVPRCPHFNVCGGCQQQHVAIELQAKTKASVLEHLIQRETGISISAHPIIHSPEYGYRRRVRLGLQYDVKKNPGRQQKLLMGFRQSQTNDLVAVAHCPVMRPELEQLLQPLSQCLNSLSAVKRLGHVELVLADNGPLMVLRHLAPLKHEDREKLRTFSVQHKAAVYLAGDEKILEPLTEGQTAPWYQVDGLKLKFSPWDFIQINDEVNQKMVVQALAWLDLQPTDRVLDLFCGMGNFTLPMATKAQTVVGVEGVAALVANGQYNAQLNELNNVDFFHENLESDIHQQPWAVLGFNKVLLDPARAGAAGVMSHIVKLAPERVVYVSCNPTTLARDSKILLEAGYHLVSVRMLDMFPHTGHLESMALFSREPMAIE

SEQ ID NO: 8452 - protein, 783 aa, Xenorhabdus bovienii
  Peptide sequence Name=Xb4151_4152.C437.gene136.pep
  Gene classification: Gene name=BaeS; Function=Signal transduction histidine kinase; Function class=T Signal transduction mechanisms
  Homolog annotation: Query=1..518bp; Hit=1..519bp; Blast score=507; Percent Identity=52.0; E value=1e-143; Homolog= barA_1 COG0642
MTKYSLRTRMMSLILVPVLLVGTLVSISFISYRYYELKNLIVRSGISIIEPLSIASEVGINLDNRRRVEVLVNSLHRRNSEIVKAIAIFDKNHKLFDISNDKYDANQLRLPAGEPIPKVLLSQSGHDNNIILMMPLIAENIQENEWRTTTSKANPIGYIAIDLDLRTAQIQQYKEITTSIILLILCLGGTALFAHILVRKVTQPLGGMVRVVEQIRQGQLNIRVTGAMPGELAALQNGINTVAESLSKYKDEMQLHIDQATSDLQITMEQLEIQNVELTLAKKRAQEAVKIKTEFLANMSHELRTPLNGVIGFTRQMLKTPITSQQAEYLYVIERSANNLLKIINDILDFSRLESNKLVLDQVPFLLRDTVNEVIELLTPVASEKNLPLQHRIDDKLPNLMIGDPIRLQQILTNLIGNAIKFTDKGSVILEVRLRQQQHHLVQIDFTITDTGIGIKPEYRPILFQAFNQADASITRHYGGTGLGLSITKRLVNEMKGEIDFISEPAKGTVFYFDLWLEKEAFLLGSLPERLPIPPRLPITVMAVDDNPANLKLIGTLLDEQIENTLLCSSGLEALTTAQQHALDLILMDIQMADMDGIQTSEQIHQLPQHKETPIVAVTAFPCNETQNGGRSPFVGCLSKPLDERRLKAWLNQYSQKKKSQFIDWDIALKKTDGKESLAREILEMLVQSLPEMKAMIEQILAADSDVDHKQFQYHVHQLHGSCCYNGVPKLQAICEFIEKQLKQAIPLADLEPELLEFIDEINHVIAAAPDILRAPGSLTSIP

SEQ ID NO: 8453 - protein, 516 aa, Xenorhabdus bovienii
  Peptide sequence Name=Xb4151_4152.C437.gene137.pep
  Gene classification: Gene name=Dgt; Function=dGTP triphosphohydrolase; Function class=F Nucleotide transport and metabolism
  Homolog annotation: Query=5..513bp; Hit=1..501bp; Blast score=565; Percent Identity=58.0; E value=1e-161; Homolog= dgt COG0232
MGGLMTKIDFKQKLNYQRKYSNSSIHPDDEDQVNRQFESDRGRIINSAAIRRLQQKTQVFPLERNAAVRSRLTHSLEVQQIGRYISKTIIAELTKQNLLEKYGLSDRLLAFESLIEMACLMHDIGNPPFGHFGEAAIRDWFSRRLDPDYFSDCVSESTARQDGCKVAALSYNGETKKDLFRRQLRKDLCEFEGNAQAIRLAHNLLKLNLTYAQIGCILKYTCPAYRLEGSPDEFSYLMKKKGYYWSEDSFIHELKKALQLGDFCRFPLTYIMEAADDISYCIADLDDAVEKGIFNVEQLVEYLKKEWEENGGHSKGDLFEFTVMQAHKKTASNEARRSIHEQFFMYLRVFITGKLVPYTAKRFIENLPEIYAGTFNHALLEEDGDEHRLLQILKSVTRKWVFSHPEVEELELQGYRIITGLLDVYSPLLELSRQDFMSLHRNNFHKKYFIETRLLHKLSTKHRLAYEEAVENIVATDEVEKDVLEFYYRARLIQDYISGMTDHYAYEEYRKFMVSK

SEQ ID NO: 8454 - protein, 36 aa, Xenorhabdus bovienii
  Peptide sequence Name=Xb4151_4152.C437.gene138.pep
VSYSWLINGLVSMKRHSYSMRQCNIESLFTGYSGYK

SEQ ID NO: 8455 - protein, 232 aa, Xenorhabdus bovienii
  Peptide sequence Name=Xb4151_4152.C437.gene139.pep
  Gene classification: Gene name=Pfs; Function=Nucleoside phosphorylase; Function class=F Nucleotide transport and metabolism
  Homolog annotation: Query=1..230bp; Hit=1..230bp; Blast score=297; Percent Identity=70.0; E value=5e-81; Homolog= pfs COG0775
MKVGVIGAMEQEVTLLRDQIEGLQTVSRGGCEIYTGKLNGVDIALLKSGIGKVSSALGTTLLIEHCQPDIVINTGSAGGLDPKLNVGDIVVSGEVRYHDADLTAFGYEPGQMAQCPPAFIADSQLITLAEKCIKSLNLNAVRGLICSGDAFINGAEPLARIRATFPQVAAVEMEAAAIGHVCHLYQIPFVVVRAISDVADQESHISFDEFLVIAARESTRMVNAMLSELSQH

SEQ ID NO: 8456 - protein, 282 aa, Xenorhabdus bovienii
  Peptide sequence Name=Xb4151_4152.C437.gene140.pep
  Gene classification: Gene name=FecB; Function=ABC-type cobalamin/Fe3+- siderophores transport systems, periplasmic components; Function class=P Inorganic ion transport and metabolism
  Homolog annotation: Query=21..278bp; Hit=5..263bp; Blast score=261; Percent Identity=52.0; E value=8e-70; Homolog= ZyadT COG0614
MKPWMKIISLRSIWLSFSFLLFSFLYSVSAPLHAAASRVISLAPSTTELAYAAGLGDRLVAVSAYSDYPEAAKKLEQVADWQGINVERIIALKPDLILAWRGGNPQRPLEQLAALGIPVFYSDVKKVEDVATDLERLAVHSPRPDIAKKSAADIRQTFSKLKQTYATPNPKPVFLQFGMNPIFTSSDHTIQSEILSACGGKNIFADSTVPWPQVNREQVLTRKPEVIVLGGTEDQKQRVADFWQPQLNVKIITLNDDWFSRAGPRIILATEQLCRELNLSGG

SEQ ID NO: 8457 - protein, 39 aa, Xenorhabdus bovienii
  Peptide sequence Name=Xb4151_4152.C437.gene141.pep
MQKPLVVVVLLSASDRKYDTAIKNKGSLSAAFIFFYVGL

SEQ ID NO: 8458 - protein, 114 aa, Xenorhabdus bovienii
  Peptide sequence Name=Xb4151_4152.C437.gene142.pep
  Gene classification: Gene name=IscA; Function=Uncharacterized ACR; Function class=S Function unknown
  Homolog annotation: Query=1..114bp; Hit=1..114bp; Blast score=206; Percent Identity=89.0; E value=4e-54; Homolog= yadR COG0316
MSDDAALPLQFTDAAANKVKVLVADEDNPNLRLRVYITGGGCSGFQYGFTFDDQMNEGDLTIQKQGVELVVDPMSLQYLVGGCVDYTEGLEGSRFIVTNPNAKTTCGCGSSFSV

SEQ ID NO: 8459 - protein, 64 aa, Xenorhabdus bovienii
  Peptide sequence Name=Xb4151_4152.C437.gene143.pep
LLHKGNKLLHVRMIWLPHQAALKWPPPYLYPYFSGAFINEPVRNALLSGKTGDPRRCQLAGTRL

SEQ ID NO: 8460 - protein, 427 aa, Xenorhabdus bovienii
  Peptide sequence Name=Xb4151_4152.C437.gene144.pep
  Gene classification: Gene name=HemL; Function=Glutamate-1 -semialdehyde aminotransferase; Function class=H Coenzyme metabolism
  Homolog annotation: Query=1..426bp; Hit=1..426bp; Blast score=746; Percent Identity=85.0; E value=0; Homolog= ZhemL COG0001
MNQSEMLYSQAKQVIPGGVNSPVRAFNGVGGTPVFIQRADGAYLYDVDGNAYIDYVGSWGPMVLGHNHPAIRNAVIEAAERGLSFGAPTAAEVEMAKRVTELVPSMDMVRMVNSGTEATMSAIRLARGYTGRDKIIKFEGCYHGHADCLLVKAGSGALTIGQPNSPGVPADFAKHTLTCVYNDLNSVREAFEKYPEEIACIIVEPVAGNMNCIPPRPEFLPGLRKLCDEFGALLIIDEVMTGFRVALGGAQEYYNVKPDLTSLGKIIGGGMPVGAFGGRQDIMEKLAPTGPVYQAGTLSGNPIAMAAGLACLNEVAQPGVHPRLSELTDKLASGLKNAASAAGVPLVVNHVGGMFGIFFTDAESVTCYQDVMACDVERFKQFFHLMLDEGVYLAPSAFEAGFMSIAHSDEDIQRTVDAAARCFARLN

SEQ ID NO: 8461 - protein, 59 aa, Xenorhabdus bovienii
  Peptide sequence Name=Xb4151_4152.C437.gene145.pep
VTPQSRGVTLGKHACGLFQDLIGVNKYVSSTHLIKSSPFLLNYRAAPCFCATRRKPTIE

SEQ ID NO: 8462 - protein, 39 aa, Xenorhabdus bovienii
  Peptide sequence Name=Xb4151_4152.C437.gene146.pep
MLKLQLLQARAAQAKVDMEAGKLTSGDVFFDELEVGQYD

SEQ ID NO: 8463 - protein, 66 aa, Xenorhabdus bovienii
  Peptide sequence Name=Xb4151_4152.C437.gene147.pep
MIRRVYASNLRRSRLRITKKKHRAGYRRCLISNRVSPPSIPMGGSLDFDRNAQIAIIASKSGSGQS

SEQ ID NO: 8464 - protein, 820 aa, Xenorhabdus bovienii
  Peptide sequence Name=Xb4151_4152.C437.gene148.pep
  Gene classification: Gene name=MrcA; Function=Membrane carboxypeptidase (penicillin-binding protein); Function class=M Cell envelope biogenesis, outer membrane
  Homolog annotation: Query=1..801bp; Hit=1..800bp; Blast score=1069; Percent Identity=69.0; E value=0; Homolog= ZmrcB COG0744
MSDDDRQPIGRKGKKPELRRERPAKKRHRQDDYENDENNDFDNDDEEQVMTKKGKKPRPPRSRWRGFWLLLLKIFIVLAVLIAIYGFYLDNKIRHRIDGKVWDLPAAVYGRMVNLEPGMNYSKNEMIRLLEGMQYRKVTKITRAGEFVVRGNNIEMLRRPFDFPDGKEGQIQARLVFSDNHIASIENMENQRQFGFFRLDPKLITMMQSPNGEQRLVVPRSGFPDLLVQTLLETEDRYFYEHDGVRPLSIARAVLANLTAGRTVQGGSTLTQQLVKNLFLSNERTFSRKANEAYMALLMDARYSKDRILELYLNEVFLGQSGDEQIHGFPLASLYYFGRPIDELSLDQQALLVGMVKGASMYNPWRNPKLALERRNVVLKILLNRQIIDQELYDLLSARPLGVKSKSGVITPQPAFMQLVRQELQENLGDKINNLSGVKIFTTLDPVSQDAAEKSVEEGVADLRKTRKVDDLEGAMVVVDRFSGEVRAMVGGSQPGYAGFNRALNARRLIGSLAKPATYLTALSQPDKYRMNTWLADEPISIPLSGGKSWQPRNFSRNFSGRVMLVDALARSINIPTVSLGLSIGLDRITNTLISLGIPAKEIQQVPSMLLGAINLTPMEMAQEFQTIASGGNRAKLSALRSILAEDGTVIYQSYPQAERAVPPQAAYLTLYGMQQVVARGTGSSLTKKYGKYNLAGKTGTTNDLRDSWFTGIDGKEVAIIWTGRDNNGLTNLTGATGALKIYLRYLENETPLVLNNRPPEDIVDMSVNEDGSFNCTGNGIRMLPVWTDDPQSLCQQSTPQPVEDNKEEAPGWLQEMFNQ

SEQ ID NO: 8465 - protein, 821 aa, Xenorhabdus bovienii
  Peptide sequence Name=Xb4151_4152.C437.gene149.pep
  Gene classification: Gene name=HrpA; Function=HrpA-like helicases; Function class=L DNA replication, recombination and repair
  Homolog annotation: Query=3..820bp; Hit=19..823bp; Blast score=927; Percent Identity=62.0; E value=0; Homolog= ZhrpB COG1643
LLLPIYDVLDSVITKLKTSKQVLLHAPTGAGKSTGLPLAILNKAQLTGRIIMLEPRRLAARSVAERLAEQLNEPVGVTVGYRMRAETKVSASTRLEVVTEGILTRMLQQDPELSDVSLVILDEFHERSLQADLALALLLDVQEGLREDLRILVMSATLDNQRLSSLLPDAPVIVSEGRRYPVARSYHPLPIHQHFEQSVASAVLRLLQQETGSLLLFLPGAGEIQRVLAQLEQKINDDTLLCPLYGALSLSDQRKAIAPAPAGMRKVVLATNIAETSLTIEGIRLVVDSGLERTSRFEPKSGLTRLMTQRISQASMVQRAGRAGRLEEGVCWHLFSREQAERATEYSEPEILHSDLSSLLLSLLQWGCRDSNQLNWLDSPPQPALAVAQSLLLRLGTLDDNQQLTARGWQMAEAGSEPRLAAMLCAGKEQSDEALVTAAKLVAILEEPPRSGLPDLTHWINSNQPHWQQRTNQLIRNLASKTAKIGSKKISTEKINAAFVPELLVQGFPDRIAKNRDNLGRFQIANGLGVALEPGDPLSGEQWLIAPTLQQNSKNPDARVLLACPLNIEHIIHQYPSLFTEQTAVEWDDSKGTLRAWKRLQCGRLTVKAQLLAKPSQAELQESLLNWIRQEGLAALNWSPEALQLRIRLQRATEWLSEIEWPAVDDDNLLDSLEQWFLPMLAGVGDLKGLRQVELSCALLALLDWQQRQILDNELPTNYTVPTGSRITIQYFHDKPPLLSVRMQEMYGEQQNPVLAKGRVPVVVELLSPAHRPLQITQDLAAFWQGAYREVQKEMKGRYPKHLWPDDPANTAPTRRVKKYI

SEQ ID NO: 8466 - protein, 236 aa, Xenorhabdus bovienii
  Peptide sequence Name=Xb4151_4152.C437.gene150.pep
  Gene classification: Gene name=SfsA; Function=Sugar fermentation stimulation protein (uncharacterized); Function class=G Carbohydrate transport and metabolism
  Homolog annotation: Query=1..231bp; Hit=1..231bp; Blast score=310; Percent Identity=62.0; E value=7e-85; Homolog= sfsA COG1489
MEFSPPLKSATLIRRYKRFLADILTPEGETLTIHCANTGAMTGCAIPGDTVWYSTSDNPKRKYPNSWELTQTQNGHLICVNTLRANELVYQSIEKNAISELSDYEQIRREVVYGKEKSRIDLLLQSKQRVNCYIEVKSVTLLQENKGYFPDTVTIRGQKHLRELSLIAQQGQRAVLFFAVLHSGISQVTAAKHIDHDYACLLEQACNSGVEVVCYGASMTKDRMVLNRKLPFLSIG

SEQ ID NO: 8467 - protein, 55 aa, Xenorhabdus bovienii
  Peptide sequence Name=Xb4151_4152.C437.gene151.pep
LFLPLVLQWCEGYRVYCLNMLQNLPHQYVLFTNYPIDKKGNLRFRTILSFVILAP

SEQ ID NO: 8468 - protein, 41 aa, Xenorhabdus bovienii
  Peptide sequence Name=Xb4151_4152.C437.gene152.pep
MARMLKDEVLRFCPSCIMLLLTHALSNDPPNNGGKKIGRYK

SEQ ID NO: 8469 - protein, 151 aa, Xenorhabdus bovienii
  Peptide sequence Name=Xb4151_4152.C437.gene153.pep
  Gene classification: Gene name=DksA; Function=DnaK suppressor protein; Function class=T Signal transduction mechanisms
  Homolog annotation: Query=1..151bp; Hit=1..151bp; Blast score=253; Percent Identity=94.0; E value=5e-68; Homolog= dksA COG1734
MQEGQKRKTSSLSILAIAGVEAYQEKPGEEYMNDAQLTHFKLILEAWRNQLRDEVDRTVSHMQDEAANFPDPVDRAAQEEEFSLELRNRDRERKLIKKIEKTLKKVEDDDFGYCESCGVEIGIRRLEARPTADLCIDCKTLAEIREKQMAG

SEQ ID NO: 8470 - protein, 306 aa, Xenorhabdus bovienii
  Peptide sequence Name=Xb4151_4152.C437.gene154.pep
  Gene classification: Gene name=GlnS; Function=Glutamyl- and glutaminyl-tRNA synthetases; Function class=J Translation, ribosomal structure and biogenesis
  Homolog annotation: Query=1..305bp; Hit=1..303bp; Blast score=386; Percent Identity=62.0; E value=1e-107; Homolog= ZyadB COG0008
MLPYIAPDMTQSEHSALYIGRFAPSPSGDLHFGSLVTALGSYLQAHACHGKWLVRIDDIDPPREVPGSASRILQSLEHYGLCWDGEVLYQSQRHETYRAILAQLQQQGNSYYCTCTRQRIQQLGGFYDDHCRHLHLLADNAAVRLKQRHPIYGFHDKLQGYITVPAKMAEEDFTIYRKDGLFAYNLVVVVDDNHQGVTEIVRGADLIKPTVRQLSLYQNLNFAIPDYVHLPLVLNQEGNKLSKQNHAQPIPLDDPRPLLIDALSFLNQPTIAGWQDLTTDQVLRQAIVGWNINPVPQKNITYRQFK

SEQ ID NO: 8471 - protein, 503 aa, Xenorhabdus bovienii
  Peptide sequence Name=Xb4151_4152.C437.gene155.pep
  Gene classification: Gene name=PcnB; Function=tRNA nucleotidyltransferase/poly(A) polymerase; Function class=J Translation, ribosomal structure and biogenesis
  Homolog annotation: Query=64..479bp; Hit=16..430bp; Blast score=619; Percent Identity=74.0; E value=1e-177; Homolog= pcnB COG0617
MIRENKTKRDTQAASERPVTVSDHTAQIESRTLPKHRREHHSSSSNADNAAMKKKSVKAKPSTPPITVLPRDQHPISRKDISDNALKVLYRLNKSGFQAYLVGGGVRDLLLHKKPKDFDIATNATPEQVRKLFRNCRLVGRRFRLAHIMFGPDVIEVATFRGSHEQVESNDRNQSQKAQSGMLLRDNIFGSVEEDAVRRDFTINSLYYGIEDFALRDYVGGMADLQAGIIRLIGDPETRYREDPVRMLRAVRFASKLDMTIEKTTAEPIPQLAFLLKDIPSARLFEESLKLLQSGHGYSTYKLLREYNLFQLLFPMMQRGFTPNSDSPLEKLLEQVLKNTDYRLQNDKRVNPAFLFAAMLWYPLIEHAEKLSQEGGLPYYDAFALAMNDILDEQCGSIAIPKRHTTTMRDIWLLQLRLPRRQGKRANKLMEHPKFRAAYDLLELRASVEPRHELKELVLWWSEFQQATAPQQRGMISELGTDPVRRRTRPRRSSRPRQFKDNG

SEQ ID NO: 8472 - protein, 160 aa, Xenorhabdus bovienii
  Peptide sequence Name=Xb4151_4152.C437.gene156.pep
  Gene classification: Gene name=FolK; Function=7,8-dihydro-6 -hydroxymethylpterin-pyrophosphokinase; Function class=H Coenzyme metabolism
  Homolog annotation: Query=1..144bp; Hit=1..144bp; Blast score=203; Percent Identity=71.0; E value=8e-53; Homolog= folK COG0801
MARVYIAIGSNLADPLQQVDNALAALHVIPDTSFVMRSSFYRSKPMGPQDQPDYLNLAVALETKLQPEALLDHTQAIELAQGRIRKDERWGPRTLDLDIMLFGDCIIKTERLTVPHYGLKQREFMLYPLAEIAPDLVFPDGETLAARLKHVPENGLTFWL

SEQ ID NO: 8473 - protein, 39 aa, Xenorhabdus bovienii
  Peptide sequence Name=Xb4151_4152.C437.gene157.pep
LVVARIAGFIVVTRRFMKEKLFNISYSRGRFLDNQGLSH

SEQ ID NO: 8474 - protein, 263 aa, Xenorhabdus bovienii
  Peptide sequence Name=Xb4151_4152.C437.gene158.pep
  Gene classification: Gene name=PanB; Function=Ketopantoate hydroxymethyltransferase; Function class=H Coenzyme metabolism
  Homolog annotation: Query=1..262bp; Hit=1..263bp; Blast score=393; Percent Identity=72.0; E value=1e-109; Homolog= ZpanB COG0413
MKPTTLTDLSQLKKEKRKFATITAYDASFAHLFAEQGINVMLIGDSLGMTLQGLDSTLPVTVEDIAYHTRCVRAGAPHSFLISDMPFMSYATPEQSFSSAATLMRSGANMVKIEGGSWLCEAVNMLTERAVPVCGHLGLTPQSVNIFGGYKVQGRDETSAQQLLNDAIALEKAGMQLLVLECVPTALGQRVSEALEIPVIGIGAGNLTDGQILVMHDALGITARPPKFAKDFLKETGNIRDAIRLYIEQVESGAYPGQAHSFK

SEQ ID NO: 8475 - protein, 285 aa, Xenorhabdus bovienii
  Peptide sequence Name=Xb4151_4152.C437.gene159.pep
  Gene classification: Gene name=PanC; Function=Panthothenate synthetase; Function class=H Coenzyme metabolism
  Homolog annotation: Query=1..283bp; Hit=1..282bp; Blast score=366; Percent Identity=62.0; E value=1e-101; Homolog= ZpanC COG0414
MLIIETIPILRREIRRWHQAGKRIAFVPTMGNLHDGHMSLVDTARAQADVVIVSIFVNPMQFEHEDDLVNYPRTLQEDCEKLSHRKVELVFAPNANEMYPNGSNSSQTFVEVPDLSYLLEGANRPGHFRGVTTVVSKLFNLIQPDLVYFGEKDFQQVQIIRKIIADMAYDITLVSVPIVREKSGLALSSRNNLLSAEEKKIAPVLHQIMQCIAEKLTHGERATEQLLELASTHLREEGFMPDELFIRDAENLTPLTLQSKKAVILMAAWLGQVRLIDNQQVDLVG

SEQ ID NO: 8476 - protein, 32 aa, Xenorhabdus bovienii
  Peptide sequence Name=Xb4151_4152.C437.gene160.pep
MASGICASCYGSTNTHIPSLKSANQIDLLIVN

SEQ ID NO: 8477 - protein, 33 aa, Xenorhabdus bovienii
  Peptide sequence Name=Xb4151_4152.C437.gene161.pep
MMHISLRPWLQFTDNGEGLNNTHTHTVSKKIKF

SEQ ID NO: 8478 - protein, 156 aa, Xenorhabdus bovienii
  Peptide sequence Name=Xb4151_4152.C437.gene162.pep
MLNMIVHMNTAGSGVIRPSTYEIMKDYLFSEFKMGTYEAELKSESILNHDVYNNCEPEDVVLFTSATDAWINIIRMLRVKENSEVWVSDSEYAANIIYFSFLSNKYNVKLRRVPSTLNFTPDLEWMKNNLSDNVSICGFNNSLKIRIDDSNFNNEN

SEQ ID NO: 8479 - protein, 406 aa, Xenorhabdus bovienii
  Peptide sequence Name=Xb4151_4152.C437.gene163.pep
  Gene classification: Gene name=ProP; Function=77 Permeases of the major facilitator superfamily; Function class=G Carbohydrate transport and metabolism
  Homolog annotation: Query=30..394bp; Hit=7..358bp; Blast score=62; Percent Identity=21.0; E value=9e-10; Homolog= BH3211 COG0477
MFDTIATIRGLNVKLRSLFFVTLSFRMGTMGFPFFAAYLIQEKSLNAIQAGVLVGVFGAGALLCDVIIGYFIKNFGSNKVIVFSLLFTSIILFLIPFLDYYYTIIAFSFLWGISYESFTPAAYSETVTHSDSSSRKIAFSCNRLAINIGMAIGPLVGGIIFSVHPILVFFVNSIFTFFSLIFYLLSMKSKENINNSLGSLDGNDCIKKECEVIEDKKYHYPRLIVILSSVLPVHIAYALPPTFLSAYIINYTSFPSYFVGVIFFVNAFLVILFELPINKKMNNVNSRLSLILGLLLAGGGFSLMIDINSAIILIMATILWSLGEMIIFPSITHYVSGISSSENVDRNLGFYSAGVNIGVMITPSIAFYMMENEFISPWLFVGFVLLFISAFLVCIKKSKTLWKNNA

SEQ ID NO: 8480 - protein, 156 aa, Xenorhabdus bovienii
  Peptide sequence Name=Xb4151_4152.C437.gene164.pep
  Homolog annotation: Query=3..154bp; Hit=271..422bp; Blast score=80; Percent Identity=30.0; E value=8e-15; Homolog= gi|27377194|ref|NP _768723.1| blr2083 [Bradyrhizobium japonicum] gi|12620782|gb|AAG61058.1|AF322013_177 ID871 [Bradyrhizobium
MNGPAHAEIILTNEGPVLVEVGARLNGNMEPDFHDIVLGNNQARITYISYCSPDRFIKNFSGKKYSKLKEACVLNTSTKLDGVISAINEKIVNEIKELNTVFKLSVKYGIGRKITPTIDLLSSPLRIFIFSDEITAIESDCKNIDSIKDGVYELNV

SEQ ID NO: 8481 - protein, 32 aa, Xenorhabdus bovienii
  Peptide sequence Name=Xb4151_4152.C437.gene165.pep
MHRLAEHPENIYQAFDDLYLINKNKELYSHHY

SEQ ID NO: 8482 - protein, 40 aa, Xenorhabdus bovienii
  Peptide sequence Name=Xb4151_4152.C437.gene166.pep
MCIILKMGTEETFTYSSFLVGKTDYFCHTHLNPNFRLFFL

SEQ ID NO: 8483 - protein, 54 aa, Xenorhabdus bovienii
  Peptide sequence Name=Xb4151_4152.C437.gene167.pep
MTISGCQKNTKMRLAVFLSRTHLPVIPFVRDSGSRPQVFGGILREGDGRLSFTV

SEQ ID NO: 8484 - protein, 126 aa, Xenorhabdus bovienii
  Peptide sequence Name=Xb4151_4152.C437.gene168.pep
  Gene classification: Gene name=PanD; Function=Aspartate 1 -decarboxylase; Function class=H Coenzyme metabolism
  Homolog annotation: Query=1..126bp; Hit=1..126bp; Blast score=186; Percent Identity=76.0; E value=3e-48; Homolog= panD COG0853
MLRTMLQGKLHRVKVTQADLHYEGSCAIDQNFMDAAGILEYEAIDIYNVDNGERFSTYAIAAERGSRIISVNGAAARRAAVGDKLIICSYVQIADELTKFHKPKVAYFDGDNVMSRLAKAVPVQVA

SEQ ID NO: 8485 - protein, 37 aa, Xenorhabdus bovienii
  Peptide sequence Name=Xb4151_4152.C437.gene169.pep
LHNRSHQRPTHYCATPPLFTAERYIYKFLFLGSQPSP

SEQ ID NO: 8486 - protein, 256 aa, Xenorhabdus bovienii
  Peptide sequence Name=Xb4151_4152.C437.gene170.pep
  Gene classification: Function=ABC-type multidrug transport system, permease component; Function class=R General function prediction only
  Homolog annotation: Query=1..256bp; Hit=1..256bp; Blast score=326; Percent Identity=75.0; E value=1e-89; Homolog= yadH COG0842
MIQLYWVALKTLWMKEITRFGRIWVQTLLPPVITMSLYFVIFGNLVGSRIGEMGGFSYMQFIVPGLIMMSVITNSYANVSSSFFGAKFQGSIEEVLVAPVPTHIIIAGFVGGGVARGVCVGILVTLVSQLFVPVQIHSWSMVVITLLTTSIVFSLAGLLNAIYAKTFDDISIIPTFVLTPLTYLGGVFYSLTLLPEFWQLVSKLNPIVYMISGFRYGFLGITDVSLTMTLGMLGIFIFVFYLLAWYLIESGRGLRT

SEQ ID NO: 8487 - protein, 308 aa, Xenorhabdus bovienii
  Peptide sequence Name=Xb4151_4152.C437.gene171.pep
  Gene classification: Gene name=CcmA; Function=ABC-type multidrug transport system, ATPase component; Function class=Q Secondary metabolites biosynthesis, transport and catabolism
  Homolog annotation: Query=1..305bp; Hit=1..305bp; Blast score=468; Percent Identity=78.0; E value=1e-132; Homolog= yadG COG1131
MAYALELTQLTKTYAGGVKALRGIDLRVEEGDFYALLGPNGAGKSTTIGIISSLVNKSSGKIKVFGYDIDTDLVNAKRQLGLVPQEFNFNPFETVIQIVLNQAGYYGVPRNVAYSRAETYLSQLDLWEKRNERANRLSGGMKRRLMIVRALMHQPKLLILDEPTAGVDIELRRSMWEFLKALNAQGTTIILTTHYLEEAEMLCRNIGIIQYGELVENTSMKDLLSQLERETFLLDLTPRGVMPVVEGYDYRLVDAVTLEVDVKRGQGLNDLFSQLSMQGIQISSMRNKANRLEELFVGLTNNNQGANQ

SEQ ID NO: 8488 - protein, 59 aa, Xenorhabdus bovienii
  Peptide sequence Name=Xb4151_4152.C437.gene172.pep
MFFYLIPIVAKKGRKNNGIICILHSKIAKNKGVFTYGLCIGIDSAYENLCRWCEGVAWD

SEQ ID NO: 8489 - protein, 217 aa, Xenorhabdus bovienii
  Peptide sequence Name=Xb4151_4152.C437.gene173.pep
  Gene classification: Gene name=CynT; Function=Carbonic anhydrase; Function class=P Inorganic ion transport and metabolism
  Homolog annotation: Query=2..216bp; Hit=1..215bp; Blast score=326; Percent Identity=72.0; E value=1e-89; Homolog= yadF COG0288
MMRKIEELFARNKQWSQSVNEENPHFFKELSKVQKPHFLWIGCSDSRVPAEKLIDAAPGDLFVHRNVANLVIHTDLNCLSVVQYAVDVLQVEHIIICGHYGCGGIEAAVDGTELGLINNWLLHIRDLWYKHSSMLGELPPNDRLNRLCELNVIEQVYNLGHSTIMQAAWKRGQKVMIHGWVYGLKDGELHDLDVTADSREKLELNYRQAISKLAHKK

SEQ ID NO: 8490 - protein, 181 aa, Xenorhabdus bovienii
  Peptide sequence Name=Xb4151_4152.C437.gene174.pep
  Gene classification: Gene name=Hpt; Function=Hypoxanthine-guanine phosphoribosyltransferase; Function class=F Nucleotide transport and metabolism
  Homolog annotation: Query=5..181bp; Hit=6..182bp; Blast score=283; Percent Identity=81.0; E value=9e-77; Homolog= hpt COG0634
MSKPKHIVEVMISEQEIKQRIAELGQQITEHYRNSDRELVLVGLLRGSFIFMADLCREVQVPHEVDFMTASSYGNEMNSTRDVKILKDLDEDIRGKDVLIVEDIIDSGNTLNKIREIFALREPNSLAICTLLNKPSRREVDVPVEWIGYSIEDKFVVGYGIDYAQHYRHLPYIGHVTLLEE

SEQ ID NO: 8491 - protein, 40 aa, Xenorhabdus bovienii
  Peptide sequence Name=Xb4151_4152.C437.gene175.pep
MCLFTKSDTPIDIPSPHKDAHTKNMRTKYFAKHIRIHHLQ

SEQ ID NO: 8492 - protein, 34 aa, Xenorhabdus bovienii
  Peptide sequence Name=Xb4151_4152.C437.gene176.pep
VIGGCDAFRRMVLKITVTDNQLCYLTKINNAMNN

SEQ ID NO: 8493 - protein, 96 aa, Xenorhabdus bovienii
  Peptide sequence Name=Xb4151_4152.C437.gene177.pep
VPDIDAVVASLTNVKPVRLLSFPLTVFSSQRKSGYRDSSQTLRRRSPSDRARRHPMCVPANIECHRGYFLPFIQPVASYSYIIATKFNYSWRYLFW

SEQ ID NO: 8494 - protein, 51 aa, Xenorhabdus bovienii
  Peptide sequence Name=Xb4151_4152.C437.gene178.pep
MSLSSPGRSLAYRAITAVVLIRYDKESTEVYNHLATPPWREHAPLWVLLLL

SEQ ID NO: 8495 - protein, 138 aa, Xenorhabdus bovienii
  Peptide sequence Name=Xb4151_4152.C437.gene179.pep
MKSFKAILQTARVGFGLRHSNQRTYMMKSLKLSVAALLVLFSSTALAVPAVSLEHASKTATAVEHNVKTAKDNVSSLEKKVTKGSKNQKASQKNNSNKSKAGSTKQGANSALCKDGTYSKSKTHKGACSRHGGVAKWL

SEQ ID NO: 8496 - protein, 48 aa, Xenorhabdus bovienii
  Peptide sequence Name=Xb4151_4152.C437.gene180.pep
LLYLNQWHFRQGHGCTERHRWRYLTTHPIPKIAASGASPLTNFAVAPS

SEQ ID NO: 8497 - protein, 294 aa, Xenorhabdus bovienii
  Peptide sequence Name=Xb4151_4152.C437.gene181.pep
  Gene classification: Function=ABC-type thiamine transport systems, ATPase components; Function class=H Coenzyme metabolism
  Homolog annotation: Query=64..293bp; Hit=1..230bp; Blast score=278; Percent Identity=59.0; E value=7e-75; Homolog= ZyabJ COG3840
VFYRLGILALSRYLATKISAPCLSIFISKSGHIAVKTVQSPHSCCCFSVLSCSVCLNAYRADAMIKLENVIYTYEHLAMHFHVNIEAGERIAILGPSGAGKSTLLSLMAGFQSAESGDIWLNDENHAHTSPSKRPVSMLFQENNLFSHLTIEQNIGLGLHPGLRLTGEQQKTLQQIAAQVSLQDYLNRLPAQLSGGQRQRAALARCLVRQQPILLLDEPFSALDPALRNEMLELLTQVCDTRQLTLMMVSHNLDDAAKIAPRSLLIVDGRIYYDGATAKLVNGEAPEAAILGIG

SEQ ID NO: 8498 - protein, 534 aa, Xenorhabdus bovienii
  Peptide sequence Name=Xb4151_4152.C437.gene182.pep
  Gene classification: Gene name=ThiP; Function=ABC-type iron/thiamine transport systems, permease components; Function class=H Coenzyme metabolism
  Homolog annotation: Query=1..531bp; Hit=1..531bp; Blast score=629; Percent Identity=71.0; E value=1e-180; Homolog= ZyabK COG1178
MAKRRKPLIAGWLLPGVIASGLLLVVALSAFGALWFNAPENHWQGFLSDSYLWHVIRFTFWQAFLSAVLSVTPAIFLARALYRRRFPGRMLFLRLCAMTLVLPVLVALFGILTVYGRVGWLANISQWMGIEYRFTPYGLQGILLAHIFFNMPMAVRLLLQSLENIAVEQRQLAAQLGMNEWQHFRFVEWPYLRRQILPTGALIFMLCFASFATVLALGGGPAATTIELAIYQALNYDYDLGHAALLALIQLFCCLGLVLVSQKLKGTLVVGYGHQQKWRNPQDSWLQKGCDGLFIIIALLLLIPPLLAVIVDGLNGAVLNVLRQPALWQAFTTSAVIALGAGLLCVMLTIMLLWSSRELRLRHSPRWGQAMETSGLLILAMPGIVLATGFFILLNTTVGLPHSPYGLVILTNGLMAIPYALKVLDNPMRDLAERYNPLCRSLNIQGIHRLRWIELKALKIPLAQALAFSCVLSIGDFGVVALFGNEDFRTLPFYLYQQIGAYRSQDGAVTAFLLLLLCFILFSVLERLPGRRHD

SEQ ID NO: 8499 - protein, 337 aa, Xenorhabdus bovienii
  Peptide sequence Name=Xb4151_4152.C437.gene183.pep
  Gene classification: Gene name=TbpA; Function=ABC-type iron/thiamine transport systems, periplasmic component; Function class=H Coenzyme metabolism
  Homolog annotation: Query=15..337bp; Hit=10..327bp; Blast score=466; Percent Identity=69.0; E value=1e-131; Homolog= tbpA COG1840
VFKNLFSRFITISTLLISACVFAQTAQTKPTLTVYTYDSFASEWGPGPAIKKAFEAECNCELKLVALEDGVSLLNRVRMEGKKTSADIVLGLDNNLIQAAQQTGLFTPSHIDTSKLKLPVTWNSKTFIPYDYGYFAFVYNKNTLPHPPKSMDELINSNQNWKIIYQDPRTSTPGLGLLLWMQDIYGDKAVQEWPKVAKKTLTVTKGWSEAYGLFLKGEGDMVLSYTTSPAYHILSEKKDNYAAAIFSEGHYLQIEVAAQLVSSKQPKLAQKFMQFMISPAFQQAIPTTNWMYPVIDIPLPEVFKQLSVPAKPLQFSADDVAKHRNQWIRTWQSAVSR

SEQ ID NO: 8500 - protein, 54 aa, Xenorhabdus bovienii
  Peptide sequence Name=Xb4151_4152.C437.gene184.pep
MENIFISMISVSKSYVGTSRIRFDGFFSAIRFYNSSTPLRWRYCRDFRYGCKVQ

SEQ ID NO: 8501 - protein, 176 aa, Xenorhabdus bovienii
  Peptide sequence Name=Xb4151_4152.C437.gene185.pep
  Gene classification: Gene name=MutT; Function=NTP pyrophosphohydrolases including oxidative damage repair enzymes; Function class=L DNA replication, recombination and repair
  Homolog annotation: Query=1..175bp; Hit=1..175bp; Blast score=282; Percent Identity=81.0; E value=1e-76; Homolog= ygdP COG0494
VIDDDGYRPNVGIVICNRQGQVLWARRYGQHSWQFPQGGINPGESPEQAMYRELFEEVGLNRKDVRVLTSTRSWLRYKLPKRLVRWDTKPVCIGQKQRWFLLQLLCNEADINVQRSNAPEFDGWRWVSYWYPVRQVVSFKRDVYRRVMKEFSSIVMPVQESAPQLHSPYLHRRRRS

SEQ ID NO: 8502 - protein, 748 aa, Xenorhabdus bovienii
  Peptide sequence Name=Xb4151_4152.C437.gene186.pep
  Gene classification: Gene name=PtsP; Function=Signal transduction protein containing GAF and PtsI domains; Function class=T Signal transduction mechanisms
  Homolog annotation: Query=1..748bp; Hit=1..748bp; Blast score=978; Percent Identity=65.0; E value=0; Homolog= ZptsP COG3605
MLMRLREIVEKVAMAANLSEALELLVNETCLAMSTDVCSIYLADHQRHCYYLMATRGLKKPEERAISLAFDEGVVGVVGRLSELINLADVRDHPSFKYIPQVKEEGLRAFLGVPIVYRRQLQGVLVVQQNERRLFDESEESFMVTLAMQLAVILAQAQTKGLFGQYRQTRIKALAISSGIVMAQGWQDGSQPSLEQVFEASTLEYQAERSRLTEALEQATAECRRISKRFTSSSQKESAAIFDLYSHLLNDPKLKQDLFFSVDNGFVAEWAVKSVVEKYAEQFASLQDPYMRERASDLRALGQRVLFHLDGSFTGDSEWPERFILVADELSANLLAEMPQEQLAGVIVRDGATHSHSAILVRAMGIPAIMGADIQPELLHNRMLILDGYRGEFFVEPEPLIIQEYRQIIEEEQVLSELAEGELKQKAQLKNGERVLVQLNAGLSLKYEQQIGGSIDGIGLYRTEIPFMLHRGFPSEDEQKNRYQEMLALLPDKPVVLRTLDIGADKQLPYMPISEENPCLGWRGIRITLDQPEIFLIQLRAMLKANVLIGNLKILLPMITSIEEIDEARKLIDRAKAEVEQTIGSTITMPQIGIMVEVPSTIFLLPQLKKRINFISIGTNDLTQYLLAVDRNNTHVAALYDNLHPAVIKALKLAFDESQRVGLPVSICGEMAGLPMGALILIGLGYRSLSMSGRSVPRIKYLLRHLDTNDLELLIKEILKAETSRQVKALSTEFMEANGLGGLVRGGI

SEQ ID NO: 8503 - protein, 292 aa, Xenorhabdus bovienii
  Peptide sequence Name=Xb4151_4152.C437.gene187.pep
  Gene classification: Gene name=Lgt; Function=Prolipoprotein diacylglyceryltransferase; Function class=M Cell envelope biogenesis, outer membrane
  Homolog annotation: Query=1..281bp; Hit=1..283bp; Blast score=402; Percent Identity=73.0; E value=1e-112; Homolog= lgt COG0682
MSTSYLAFPNIDPVIFSIGPVSLHWYGFMYLVGFVFAMWLANRRAAKPNSGWNKNEVESLLYTGFVGVFVGGRLGYVLFYNLPMFLDNPLYLFKVWDGGMSFHGGLVGVICAMLWFARRTKRHFLQVSDFVAPLVPFGLGMGRIGNFINGELWGRVTLDTPWAILFPSSRSEDIALATTDPSLWPILEKYGVLPRHPSQLYEMVLEGIVLFIILNLFIRKPRPMGSISGLFLIGYGAFRIIVEFFRQPDAQLGLFEGISMGQILSIPMILVGILMIIWAYKCQRNNKIQEAK

SEQ ID NO: 8504 - protein, 264 aa, Xenorhabdus bovienii
  Peptide sequence Name=Xb4151_4152.C437.gene188.pep
  Gene classification: Gene name=ThyA; Function=Thymidylate synthase; Function class=F Nucleotide transport and metabolism
  Homolog annotation: Query=1..264bp; Hit=1..264bp; Blast score=501; Percent Identity=88.0; E value=1e-142; Homolog= thyA COG0207
MKQYLDLMKKVLEDGTAKDDRTGTGTLSIFGHQMRFNLQDGFPLVTTKRCHIRSIIHELLWFLNGDTNTQYLRDNNVTIWDEWADENGDLGPVYGKQWRAWSSADGRQIDQLAKVLEQLKSDPDSRRIIVSAWNVGELDKMALAPCHAFFQFYVAEGKLSCQLYQRSCDVFLGLPFNIASYALLVHMLAQQCDLEVGDFVWTGGDTHLYSNHLEQTKLQLSREPRTLPKLIIKRKPASLFDYRFEDFEIVDYDPHPGIKAPVAI

SEQ ID NO: 8505 - protein, 48 aa, Xenorhabdus bovienii
  Peptide sequence Name=Xb4151_4152.C437.gene189.pep
LRIHFICGAVRRNSKSLFFILRTTADKCKKSRLNPLFNNLVDTLHLLS

SEQ ID NO: 8506 - protein, 345 aa, Xenorhabdus bovienii
  Peptide sequence Name=Xb4151_4152.C437.gene190.pep
  Gene classification: Function=Predicted transposase; Function class=L DNA replication, recombination and repair
  Homolog annotation: Query=179..332bp; Hit=34..184bp; Blast score=70; Percent Identity=29.0; E value=3e-12; Homolog= BH2520 COG3335
MKINLTDAQKDALELMHDTTRDGRVRDRIKAVLLASEGWTAQMIAQALRIHESTVSRHLKDYFSEEKLAPENGGSESRLSAEQTTELVEYLMANLMHTTAQIVAYVRARWQVTFTVAGMTKWLHRQGFSYKKPMGAPHKFDADKQQQFIETYNALKEECGQNAPILFIDAVHPTLSTKLSYGWMKSGRKHVKVVETTGSRTRLNIMGALNLQRIEETIVREYPTINAKNVVLFFGSIRETYPLSQKIHIILDGAGYHRSGVVQFFAEVLNIELHYLPPYSPNLNPIERLWKYVNEQVRNNVYFPDTKTFRETLRHFFHVTLPEKAKELTTRLTDNFQILKPASSS

SEQ ID NO: 8507 - protein, 74 aa, Xenorhabdus bovienii
  Peptide sequence Name=Xb4151_4152.C437.gene191.pep
MKNQASSMTTGIEKQWIVLIKQFQSKPLQITIISITAAYLMQLSTQPKLKPAVVWNQARLLLECDIFFIKIILN

SEQ ID NO: 8508 - protein, 53 aa, Xenorhabdus bovienii
  Peptide sequence Name=Xb4151_4152.C437.gene192.pep
MKTFIFAAIERANTDQQLPIKIKCVAESYHQAKAMLSGEYITAWAGQIINHGN

SEQ ID NO: 8509 - protein, 128 aa, Xenorhabdus bovienii
  Peptide sequence Name=Xb4151_4152.C437.gene193.pep
MNNKLQAAVEIAEEIEASIFPVVTAIQNEAEPDTYLMCRGVHRQTCDLAQRLRDINKEYIMEGVIDTCSNLDIELEPAKNAIEKLRSLLSTMIDVRGDDDDANLLLIAIDLAFDAGKEIARVRGVEYS

SEQ ID NO: 8510 - protein, 117 aa, Xenorhabdus bovienii
  Peptide sequence Name=Xb4151_4152.C437.gene194.pep
MNDIRKHICVNEDRLSEMKEDDLNYLISSSEDVIFAMTNGLLSIGNLASAAVHSEEYSQDDAMTDLERIAHLLTVVPLIIEAEHENNISAGIELRERQAIKKEKQLIQLIRNYHENT

SEQ ID NO: 8511 - protein, 136 aa, Xenorhabdus bovienii
  Peptide sequence Name=Xb4151_4152.C437.gene195.pep
MKILKSIETATIQDIKIELREVYVVRGASKTYLSEKGALNKLAYVRAQKQFNKEDRPSNFPAQEVIQEDGTSALRKGKMRPEFMERHAQVLEELKADVRQVREIARLKKECKKAKEKLLTVLDDLENAENKYKNSK

SEQ ID NO: 8512 - protein, 117 aa, Xenorhabdus bovienii
  Peptide sequence Name=Xb4151_4152.C437.gene196.pep
MTKLTLLERKRKAFIHAKLDTLQKKHSSHSVIVKVAEINYRLDLDEEILTIALIRFFELDALASKNKQKAEQLLISTYNSFYTKFGNLTAEGNEFMNEILKLIAKKTEPINGDNNEK

SEQ ID NO: 8513 - protein, 114 aa, Xenorhabdus bovienii
  Peptide sequence Name=Xb4151_4152.C437.gene197.pep
MEITMKNETYLDFAETAIQKEKEEKYDLAALYWGKARSVATSFNTQAWSEYRQEHNEKRYSLHNSYSEAIRDQKESRKIAAINKRTAEVLESHLENHAETNKWKQKLQQAANND

SEQ ID NO: 8514 - protein, 62 aa, Xenorhabdus bovienii
  Peptide sequence Name=Xb4151_4152.C437.gene198.pep
MIEYEQATELAQSLELKGLFRRAADKWGEALSLSRNKKQEQECIKNNLRCVREAKITIREGL

SEQ ID NO: 8515 - protein, 72 aa, Xenorhabdus bovienii
  Peptide sequence Name=Xb4151_4152.C437.gene199.pep
MTKRRNKTQQGYAGMTIPQGLSLERNEVADYTNVCKHLSNFKRIGDQILMPLNRKQRRLAKKLNIEITEVEQ

SEQ ID NO: 8516 - protein, 254 aa, Xenorhabdus bovienii
  Peptide sequence Name=Xb4151_4152.C437.gene200.pep
  Homolog annotation: Query=4..253bp; Hit=25..273bp; Blast score=319; Percent Identity=61.0; E value=3e-86; Homolog= gi|24113243|ref|NP _707753.1| orf, partial conserved hypothetical protein [Shigella flexneri 2a str. 301] gi|24052243|gb|AAN43
MINKTELITINKTQMPVVEYQGQRVVTFSMIDQVHARPEGTAKAAFNRNNHRFVQGVDYQVLSQDDIRTDLPDGLFSKFAPSGIVLFESGYLMLTKPFNDDVAWQVQRELVSSYFRKPQTVLSELEMIARIASHTAQQQRQINHIGEQVEQAHEAIEQIKRGTIPAGWIGFSLAATESGLTNPKCRTLAEQYNVPIDTVTIMTPDGQPRPMKVVFKEDFMSAFRLMMGEAEKRGTRWSHPKMGIFQVIGWEDKQ

SEQ ID NO: 8517 - protein, 176 aa, Xenorhabdus bovienii
  Peptide sequence Name=Xb4151_4152.C437.gene201.pep
  Homolog annotation: Query=1..175bp; Hit=1..176bp; Blast score=201; Percent Identity=55.0; E value=6e-51; Homolog= gi|24113244|ref|NP _707754.1| orf, hypothetical protein [Shigella flexneri 2a str. 301] gi|30063313|ref|NP_837484.1| hypothetic
MIINSCLLRAALVCVAKNDPRYYLCGVHITPKYLESSNGFVAFRLEHGINTRRKAIIQFHGKIPKKADTTELHFTKEPYAVHRDIAGVRVGFTALSMLDGRFPDLDRVIPKKVENVIPQFQAEFLTYPQKMFGDDSRFIAVSMHPSGMTEGCVMKFSDNINQRYGNPQLVVMPCRI

SEQ ID NO: 8518 - protein, 143 aa, Xenorhabdus bovienii
  Peptide sequence Name=Xb4151_4152.C437.gene202.pep
MITKNFRLNALANAYAAAIYHDVTARNGGDHFAMRVGKTEISVAIVDGIKGIRELVDSYALEALQQNYPAWEVIAINLMEKCVINDCLTGHGRKIWQSMINDMGTCWQLRGRFNENRISGQGQHSANSHCQFHYRTPKTQPLC

SEQ ID NO: 8519 - protein, 62 aa, Xenorhabdus bovienii
  Peptide sequence Name=Xb4151_4152.C437.gene203.pep
MNVKVLSEAVDNLIRMIPAVVDVERGLNKHIVNVCHLALLICHCPPPCKGFCKRASCDWLCL

SEQ ID NO: 8520 - protein, 62 aa, Xenorhabdus bovienii
  Peptide sequence Name=Xb4151_4152.C437.gene204.pep
ALCEFDLVTRCFYLHPLTGPYVMCSGCSARIHQGEFQHQQPQEVICLSLFFTSLITRFLHRC

SEQ ID NO: 8521 - protein, 56 aa, Xenorhabdus bovienii
  Peptide sequence Name=Xb4151_4152.C438.gene1.pep
  Homolog annotation: Query=Organism:..Escherichiabp; Hit=coli..O157bp; Blast score=; Percent Identity=; E value=; Homolog= Pa|Phot5 -500d07.p1k_g88| 80125 - 80361 1128 78 aa, chain +
MSQEAFADKCGLDRTYISGIERGIRNPTLEIIYVIANGLQIELNELFNLETRLPPN

SEQ ID NO: 8522 - protein, 54 aa, Xenorhabdus bovienii
  Peptide sequence Name=Xb4151_4152.C438.gene2.pep
MMLLIPELAIGVYLLVPDLLLTIEADKQLQWYSKDILNAAVNISTLFRQYFSGH

SEQ ID NO: 8523 - protein, 318 aa, Xenorhabdus bovienii
  Peptide sequence Name=Xb4151_4152.C438.gene3.pep
  Gene classification: Gene name=URH1; Function=Inosine-uridine nucleoside N-ribohydrolase; Function class=F Nucleotide transport and metabolism
  Homolog annotation: Query=6..314bp; Hit=2..310bp; Blast score=472; Percent Identity=74.0; E value=1e-133; Homolog= PM1767 COG1957
MKMLPKKIILDCDPGHDDAIALLLAHGNPDIELLAVTTVVGNQTLNKVTRNALSIARIANIHNVPFAAGCHRPLVRDIQTAPEIHGETGLDGVILPEPALRLDARHAVDLIIDIIMENPPKSVTLVPTAGLTNIALAARKSPHIVERVKEVVLMGGGYHTGNWSAVAEFNIMIDPEAAHIVFNEKWPLTMVGLDLTHQAQATPDIIDAISKIKTRPAQFVLDALQFYGERYRESQYFDYPPVHDPCAVAYVIDPTVMTTQKVPVNIELAGTLTTGMTVADFRFPPPKDCHTQVAVKLDQAKFWQLVINALKNIGETEY

SEQ ID NO: 8524 - protein, 52 aa, Xenorhabdus bovienii
  Peptide sequence Name=Xb4151_4152.C438.gene4.pep
MITPATICLFFIAYTYESYVLTMLKPFIIYMLIMSQLLNILLISLDFYLIVL

SEQ ID NO: 8525 - protein, 466 aa, Xenorhabdus bovienii
  Peptide sequence Name=Xb4151_4152.C438.gene5.pep
  Gene classification: Gene name=DadA; Function=Glycine/D-amino acid oxidases (deaminating); Function class=E Amino acid transport and metabolism
  Homolog annotation: Query=37..466bp; Hit=3..432bp; Blast score=605; Percent Identity=67.0; E value=1e-173; Homolog= PA2317 COG0665
MLNKCDKVSLKKQSNKIVGCTSSGNRQMLTGYNMNNNLDSLTYYAATKKYDLRFPTLTEDLDVDVVIIGGGFSGVNTALELAEKGITNIAILEGRTLGYGGTGRNGGQVMAGIGHDLDRIKRHVGEKGLEAIFKISNMGAGIIRDRIAKYDIKADFCKGYGYLGYNSRQEKTLRGWLKEFQAACPDEEIELYAGADVKKVIGSDLYTCALKHMGGGHVHSLNLLLGEAKAATEQGVRIFENSQVVNVEYGPRVTVRTAMGTVRASKILWACNAFLNGLEPTIYKKTINTYAFQLMTEELSDDLIEKISPIRGAYSDISPVINYYRVTKENRVLFGSATQYFEYIPSDLKAWNRKRMLDVFPYLKDVKIELAWGGPLSCSVNLFPQIGSLPEHNNVFYVQGYSGFGVTPSHIVCKILAEGMSEGSERYSLMSSIPHLNVVGKDKLRNLLLSAGKTWHQASGYWKGRR

SEQ ID NO: 8526 - protein, 122 aa, Xenorhabdus bovienii
  Peptide sequence Name=Xb4151_4152.C438.gene6.pep
  Gene classification: Function=Predicted enzyme of the cupin superfamily; Function class=R General function prediction only
  Homolog annotation: Query=11..118bp; Hit=12..119bp; Blast score=112; Percent Identity=52.0; E value=8e-26; Homolog= PA2318 COG3450
MIKPLLLDQALPELMPIGSVTHLGSIVLEGDPQASGAMTHGEPTDNLTCGIFACTKGKFKMIYPFDEMATVHEGSVKLTNVKTGATVEYHKGDSWFAAKGTEILWEITTERFVKHYMACVNA

SEQ ID NO: 8527 - protein, 498 aa, Xenorhabdus bovienii
  Peptide sequence Name=Xb4151_4152.C438.gene7.pep
  Gene classification: Gene name=PutA; Function=NAD-dependent aldehyde dehydrogenases; Function class=C Energy production and conversion
  Homolog annotation: Query=1..498bp; Hit=1..500bp; Blast score=462; Percent Identity=44.0; E value=1e-130; Homolog= feaB COG1012
MMSEITLLKPVTDFLQRPHGNYINGLSLPGQGNRTFSVVNPASDEMIAKVNQGEEAEINLAMEAASKAFHGSWAQTSPMERGKCLNRLADLLQKHGEELAQLESLCSGKPIQLARMLDVGASADYLRYFAGWSSKISGETLNVSLPSLKGEKYTAFTRREPIGVVVGIIPWNFSIMIAIWKLGAALACGCTLVLKPSEYTPLTMLRVAELAKEAGIPDGVINVVNGSGARVGSALLAHPHCAKVTFTGSVPTGTIIGKSAIEYGLSRATLELGGKNAAAFLSDMSVEKIVEGVLEAGYLNQGQICAAAERFYIPSVHMDAVLKLLSERLSAMKIGSPLDESTEMGPLANKEHYEKILSLFDKARQDGSEIVYGGHALEGAGFFVTPTIIRAKSAEDTLMQEETFGPIGTFLSYDDEEELIVMMNATPFGLSASLWTNDLSKAMRMIPRIQVGTLWINMHTFLDPALPFGGVKSSGIGREFGSAFIEHYTELKSVMVRY

SEQ ID NO: 8528 - protein, 88 aa, Xenorhabdus bovienii
  Peptide sequence Name=Xb4151_4152.C438.gene8.pep
  Homolog annotation: Query=1..82bp; Hit=1..82bp; Blast score=63; Percent Identity=51.0; E value=7e-10; Homolog= Pa|Phot5-500d07.p1k _g128| 107727 - 107993 787 88 aa, chain +
MISAKRGLKLAFWQSITGLWGSLLFSLMASILVITGAGIEQFKISILGAMLSTLVLLLHRDARHFLLIPAGIAVMCSLFAGLRYAEYF

SEQ ID NO: 8529 - protein, 100 aa, Xenorhabdus bovienii
  Peptide sequence Name=Xb4151_4152.C438.gene9.pep
MAVPARVAELVDALASGVSVRTDVGVQVPPFAPLLIFICSLYSFLYFIPLSANLFKNSRYLKNTPHSANQQISCTSQQYPQELRGNGVHRDAAAAQESKA

SEQ ID NO: 8530 - protein, 39 aa, Xenorhabdus bovienii
  Peptide sequence Name=Xb4151_4152.C438.gene10.pep
VSEFARVAELVDALASGVSVLTDVGVQVPPFAPNQTVVG

SEQ ID NO: 8531 - protein, 62 aa, Xenorhabdus bovienii
  Peptide sequence Name=Xb4151_4152.C438.gene11.pep
MEAHSRDFTANVNHYLLRKSMNGAKNGTLVLWVRQIHKNCLPVKTEQARNGLLITFWLLGRP

SEQ ID NO: 8532 - protein, 337 aa, Xenorhabdus bovienii
  Peptide sequence Name=Xb4151_4152.C438.gene12.pep
  Gene classification: Gene name=RsmC; Function=16S RNA G1207 methylase RsmC; Function class=J Translation, ribosomal structure and biogenesis
  Homolog annotation: Query=1..334bp; Hit=1..334bp; Blast score=402; Percent Identity=57.0; E value=1e-112; Homolog= rsmC COG2813
MSVLTPASEVILRHHEQFLTRHLLIAGDIQDNLATEIEAGSVRVHTNQYHHWQSLIRQLGDNASFGLVADSTFVKGCDTLIYYWPKSKHEARFQLRSLFSILPPGTGVFVVGENRSGVRSVDKLMEGIVTFQKVDTARRCSLFYGQLENQVQFDQNNWWNSYPVGDVIVNTLPGVFSQDDLDVGSRLLLSTFDGPVSGSLLDIACGAGVLAAVLGKKNPELTLTLSDVNAAATISSKATLKANKLEGNVITSNVYSAIEEKFDWIISNPPFHDGLKTNLAAADDLIRMAPNYLKSGGKLRIVANAFLPYPALLDSTFGNHKLIAQTGKFKVYQATKR

SEQ ID NO: 8533 - protein, 50 aa, Xenorhabdus bovienii
  Peptide sequence Name=Xb4151_4152.C438.gene13.pep
MYKLLINLYPSINIGGQNCDAMLIGAEISPLIVYYLLFFMADGIKHDDEA

SEQ ID NO: 8534 - protein, 136 aa, Xenorhabdus bovienii
  Peptide sequence Name=Xb4151_4152.C438.gene14.pep
  Gene classification: Gene name=HolD; Function=DNA polymerase III, psi subunit; Function class=L DNA replication, recombination and repair
  Homolog annotation: Query=2..131bp; Hit=3..132bp; Blast score=104; Percent Identity=40.0; E value=3e-23; Homolog= holD COG3050
MTKRDRLLAQLGITQWVVRSPKALQGELSVLIPDSTRLLIITHDHIDLSHSLFADIFTAMRIDVSSVYCITTKDVELLSESIHCPCWLLGVDITLSTQGISLRSPALNDLSLDGNAKRSFWQQIYHYEEYFSINSH

SEQ ID NO: 8535 - protein, 168 aa, Xenorhabdus bovienii
  Peptide sequence Name=Xb4151_4152.C438.gene15.pep
  Gene classification: Gene name=RimI; Function=Acetyltransferases; Function class=R General function prediction only
  Homolog annotation: Query=20..165bp; Hit=1..146bp; Blast score=203; Percent Identity=66.0; E value=7e-53; Homolog= rimI COG0456
MTYPLTGMQNALFGNKFTIMKNISLLIPTDLPAAFQIEQFSHAFPWSEKTFYSNQGERYLNYKITLNDQIIGFAIIQCVVDEATLFNIVIHPEHQSQGYGRALLTHLINVLPEKQINTLWLEVRSSNASAIGLYEDLGFNEVSIRKNYYPTATGKEDAIIMALPLFSG

SEQ ID NO: 8536 - protein, 79 aa, Xenorhabdus bovienii
  Peptide sequence Name=Xb4151_4152.C438.gene16.pep
LIPLGKRPERPFTCKSVMLIVIGAYFRRTWIYKQSMIVWLSTIIFFTHGVANSFNDFRSDRLLGQTGKVVYFLTTQSKQ

SEQ ID NO: 8537 - protein, 529 aa, Xenorhabdus bovienii
  Peptide sequence Name=Xb4151_4152.C438.gene17.pep
  Gene classification: Gene name=FusA; Function=Translation elongation and release factors (GTPases); Function class=J Translation, ribosomal structure and biogenesis
  Homolog annotation: Query=1..529bp; Hit=1..529bp; Blast score=963; Percent Identity=87.0; E value=0; Homolog= prfC COG0480
MSNFPFQQEVAKRRTFAIISHPDAGKTTITEKVLLFGQAIQKAGTVKGRGSNQHAKSDWMEMEKQRGISITTSVMQFPYDDCLVNLLDTPGHEDFSEDTYRTLTAVDCCLMVIDAAKGVEDRTRKLMEVTRLRDTPILTFMNKLDRDIRDPMEVMDEVENELKIACSPITWPIGCGKSFKGVYHLYLDEIYLYQSGQGHTIQEVRAIKGLNNPELDAAVGEELADQLREELELVKGASHEFDQEAFLQGELTPVFFGTALGNFGVDHMLDGLVKWAPMPMSRLTDAREVTAEEEKFTGFVFKIQANMDPKHRDRVAFLRVVSGKYEKGMKLRQVRIKKDVVISDALTFMAGDRSHIDHAYAGDIIGLHNHGTIQIGDTFTQGEELKFTGIPNFAPELFRRIRLRDPLKQKQLLKGLVQLSEEGAVQVFRPLANNDLIVGAVGVLQFDVVVARLKSEYNVEALYESVNVSTARWVECNDAKKVEEFKRKNELNLALDGGDNLTYIAPTMVNLNLTSERYPEISFRKTREH

SEQ ID NO: 8538 - protein, 128 aa, Xenorhabdus bovienii
  Peptide sequence Name=Xb4151_4152.C438.gene18.pep
  Gene classification: Gene name=OsmY; Function=Predicted periplasmic or secreted lipoprotein; Function class=R General function prediction only
  Homolog annotation: Query=7..127bp; Hit=3..122bp; Blast score=74; Percent Identity=43.0; E value=2e-14; Homolog= ZosmY COG2823
MTEGDRMKHIKFTHSLLAIVLGSVLISSSALAAVTFPTNTLESAGQKIDNSLKHADAYVNDSSITAQVKADLLKTKGLDSNDISVKTEKGVVYLSGFVKNTYQAKQVAKIVHKVHGVKSVKSTLKVKK

SEQ ID NO: 8539 - protein, 96 aa, Xenorhabdus bovienii; identical to SEQ ID NO: 5468
  Peptide sequence Name=Xb4151_4152.C438.gene19.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 8540 - protein, 92 aa, Xenorhabdus bovienii
  Peptide sequence Name=Xb4151_4152.C438.gene20.pep
MSHYSLQAGFPSIPKPALVFLIADKRPLLVDFTDNLDATFRKGKCRYVSGSEVFNVFMTVAVATFRIRAVSRIPPLFIAISIICSLTPGLQA

SEQ ID NO: 8541 - protein, 56 aa, Xenorhabdus bovienii; identical to SEQ ID NO: 7384
  Peptide sequence Name=Xb4151_4152.C438.gene21.pep

SEQ ID NO: 8542 - protein, 39 aa, Xenorhabdus bovienii
  Peptide sequence Name=Xb4151_4152.C438.gene22.pep
MVRSVFHYLTKILQTYCLNSNILIDSHYSDYAMTLTLIF

SEQ ID NO: 8543 - protein, 371 aa, Xenorhabdus bovienii
  Peptide sequence Name=Xb4151_4152.C438.gene23.pep
  Gene classification: Gene name=RssA; Function=Predicted esterase of the alpha-beta hydrolase superfamily; Function class=R General function prediction only
  Homolog annotation: Query=1..303bp; Hit=1..302bp; Blast score=430; Percent Identity=65.0; E value=1e-120; Homolog= ZyjjU COG1752
VGKHIPITLGNIEPLAYKSQIKPGKIALVCEGGGQRGIFTAGVLDEFLRLGFNPFELFLGTSAGAQNISPYICGQRGYARRVINRYTTAPTFFNPLRFVRGGHLIDLDWYIDTISEQLPLNTTAAMHQFDAGREFYMCACRADNFEPDYFHPDEHNWMEILKASSAIPGFYRNGVTLGDTVYQDGGICDAIPVQEAYRRGADTIVVIRTVPSQLYYTPQWFKRMERWLEASSLQKMVKMINLHAKSYSRTQQFIKNPPDDVQVFEIYPPAPLATMALGSRISALNQDYHLGRRCGRYFLATIGHTFVGGKFGLEKRKGYGVCRSGLNNDGINHNGFRRYSLLDSINRPVTEVQEEGITPLTGSIILDDVDK

SEQ ID NO: 8544 - protein, 256 aa, Xenorhabdus bovienii
  Peptide sequence Name=Xb4151_4152.C438.gene24.pep
  Gene classification: Gene name=TatD; Function=Mg-dependent DNase; Function class=L DNA replication, recombination and repair
  Homolog annotation: Query=2..253bp; Hit=5..256bp; Blast score=317; Percent Identity=60.0; E value=7e-87; Homolog= yjjVm COG0084
MFIDTHCHFDFPPFTGNEQTSLKQARQAGVETIIVPTVSQMNFQRVAALAYDFPSIYAAFGLHPLYINEHQGSHLAELAQKLKANNPKCVAVGEIGLDLYMPEPQFEKQKRVLEAQLALAKRHDLPVILHSRKSHDQLSAILRKHDLPRTGVIHGFAGSLSQAQAFIRLGFYIGVGGTMTYERAQKTRSTISQLPLSSLVLETDAPDMPLSGYQGQPNRPERVAQVFSALCELRRESPDEVSDQIYHNSKALFALS

SEQ ID NO: 8545 - protein, 31 aa, Xenorhabdus bovienii
  Peptide sequence Name=Xb4151_4152.C438.gene25.pep
MSKEDQLRIINIYLIRILTSCYPKNISFLWL

SEQ ID NO: 8546 - protein, 35 aa, Xenorhabdus bovienii
  Peptide sequence Name=Xb4151_4152.C438.gene26.pep
VRGRLYLVVKKNKQLTSQINTAKSNIKTQNEIQIT

SEQ ID NO: 8547 - protein, 425 aa, Xenorhabdus bovienii
  Peptide sequence Name=Xb4151_4152.C438.gene27.pep
  Gene classification: Gene name=NupC; Function=Nucleoside permease; Function class=F Nucleotide transport and metabolism
  Homolog annotation: Query=1..424bp; Hit=1..417bp; Blast score=478; Percent Identity=71.0; E value=1e-135; Homolog= VC2352 COG1972
MQLIMSLIGMVVLIFIAVLFSSNYRAIKIRTVLGAFLIQVAIGAFVLYVPAGKDILIGMSKGVSNVIGYGQKGTDFIFGGLVSDKMFELFGGGGFIFALRVLPIIVFFSSLIAVLYYIGVMQIVIKILGGGMQKLLGTSRTESLSATANIFVGQTEAPLVVRPYISTMTQSELFAVMCGGLASVAGSVLAGYASMGVPLEYLIAASFMAAPGGLLFAKLLVPETEKTRDTDDAMSLIAAEDRPANIIDAAASGAASGMQLALNVGAMLLAFTALIALLNGMLGGIGGWFNYPQLSMELILGWAFSPVAYLIGVPWNEATVAGSFIGQKIVVNEFVAFMNFGEYLKPNEVVQAAGLQVLSDHTKAIISFALCGFANLSSVAILLGGLGGMAPNRRGDIARFGLKAVLAGSLSNLMSATIAGFFLAL

SEQ ID NO: 8548 - protein, 60 aa, Xenorhabdus bovienii
  Peptide sequence Name=Xb4151_4152.C438.gene28.pep
MPSGAVKAEESIVRREGALLLLLCIIMATSSRNQVRSPTNELTNRSKQSFKRMCERVQSR

SEQ ID NO: 8549 - protein, 259 aa, Xenorhabdus bovienii
  Peptide sequence Name=Xb4151_4152.C438.gene29.pep
  Gene classification: Gene name=DeoC; Function=Deoxyribose-phosphate aldolase; Function class=F Nucleotide transport and metabolism
  Homolog annotation: Query=1..259bp; Hit=1..259bp; Blast score=367; Percent Identity=79.0; E value=1e-102; Homolog= deoC COG0274
MTDLTATAQRALSLMDLTTLNDDDTDEKVAILCHQAKSPAGHTAAICIYPRFIPAARKVLREQGTPDIRIATVTNFPHGNDDIDLALAETRAAIAYGADEVDVVFPYRALMAGNEQIGFDLVKACKDACAASGVWLKVIIETGELKEENLIRKASEISIDAGADFIKTSTGKVPVNATLESAEIMLSVIRDMGVGETVGFKPAGGVRTAEEAAQYLALSARIMGDQWADSRHFRFGASSLLSNLLTALGHQSQKQSSGY

SEQ ID NO: 8550 - protein, 444 aa, Xenorhabdus bovienii
  Peptide sequence Name=Xb4151_4152.C438.gene30.pep
  Gene classification: Gene name=DeoA; Function=Thymidine phosphorylase; Function class=F Nucleotide transport and metabolism
  Homolog annotation: Query=1..412bp; Hit=1..412bp; Blast score=668; Percent Identity=82.0; E value=0; Homolog= deoA COG0213
LFLAQEIIRKKRDGHRLNEEEIRFFINGVRDNTVSEGQIAALAMTIYFHDMTMEERVALTLAMRDSGTVLDWKKLNLHGPIVDKHSTGGVGDVTSLMLGPMVAACGGYVPMISGRGLGHTGGTLDKLESIPGFDIFPDEQRFRDIIRDVGVAIIGQTNLLAPADKRFYATRDITATVDSIPLITASILGKKLAEGLDALVMDVKVGSGAFMPTYEQSEQLAESIVGVANSAGCKTTALLTDMNQVLASSAGNALEVREAVQFLTGEYRNPRLFEVTMALSAEMLVSGNLAADRAEARRKLQAVLDNGKAAETFERMVAAQKGPIDFVENYARYLPTAPFSKPVFAGQNGIITEMDTRALGMSVVALGGGRRKATDPINYSVGLSDIVALGAEVNADTPLAMIYANSENDWQEAAEVVRKSIVLGIDVNTETKAATRMVYRHIDG

SEQ ID NO: 8551 - protein, 32 aa, Xenorhabdus bovienii
  Peptide sequence Name=Xb4151_4152.C438.gene31.pep
MMNVRFIIFSCVSQFTLSMRKLSAVKIYFHYS

SEQ ID NO: 8552 - protein, 407 aa, Xenorhabdus bovienii
  Peptide sequence Name=Xb4151_4152.C438.gene32.pep
  Gene classification: Gene name=DeoB; Function=Phosphopentomutase; Function class=G Carbohydrate transport and metabolism
  Homolog annotation: Query=1..407bp; Hit=1..407bp; Blast score=716; Percent Identity=83.0; E value=0; Homolog= deoB COG1015
MKRTFIMVLDSFGIGASADAEKFGDKGSNTLGHIAEQCARGEADIGRKGSLQLPNLSRLGLGKATEESSGTFPIGLDQDAEIIGAYGYASELSSGKDTPSGHWEIAGVPVLFDWGYFQDLDNSFPQELLDKLVERANLPGYLGNCHSSGTVILDNLGEEHMKTGKPIFYTSADSVFQIACHEETFGLDRLYELCEIAREELNMGDYNIGRVIARPFVGDKAGDFQRTGNRHDLAVEPPAPTVLKKLVDEKQGEVVSIGKIADIYANVGITRKVKATGIDALFDASLVEMEQAGNNTIVFTNFVDFDSSYGHRRDVAGYAAALELFDRRLPEMLKLVKEDDILILTADHGCDPTWPGTDHTREHIPVLVYGPKVKPGSLGHRETFADIGQTVAKYFDLTPMDYGKVMF

SEQ ID NO: 8553 - protein, 238 aa, Xenorhabdus bovienii
  Peptide sequence Name=Xb4151_4152.C438.gene33.pep
  Gene classification: Gene name=DeoD; Function=Purine-nucleoside phosphorylase; Function class=F Nucleotide transport and metabolism
  Homolog annotation: Query=1..237bp; Hit=1..237bp; Blast score=417; Percent Identity=89.0; E value=1e-117; Homolog= deoD COG0813
MATPHINAEMGDFADVVLMPGDPLRAKYIAETFLEDVRQVNDVRGMLGFTGTYKGRKISVMGHGMGIPSCSIYAKELITEFGVKKIIRIGSCGAVSHDVKIRDIVIGMGACTDSKVNRLRFKDHDFAAIADFDLVRNAVDAAKAKNINARVGNIFSADLFYTPDPQMFDVMEKYGILGVEMEAAGIYGVAAEFGAKALAICTVSDHIRTGEQTSAEERQTTFNDMIEIALESILLGDN

SEQ ID NO: 8554 - protein, 173 aa, Xenorhabdus bovienii
  Peptide sequence Name=Xb4151_4152.C438.gene34.pep
  Gene classification: Gene name=FimA; Function=Pilin; Function class=N Cell motility and secretion
  Homolog annotation: Query=7..154bp; Hit=15..170bp; Blast score=72; Percent Identity=33.0; E value=1e-13; Homolog= Z4971 COG3539
MVLGFGVALTAGAASAANQGSGTVKFSGSIIDAPCSIKNTNIDVDLGAVSNSILEKGGRSASKAFKIELQNCTTETKNGVKTTFTGAEADEKGLLGIEGTASGAAIAITNAGGKIIPLGTESDKFSLHEGSNDLNFAAHLKRLTTVQGADGKNQNEIKPGEFTAIANFTLNYL

SEQ ID NO: 8555 - protein, 59 aa, Xenorhabdus bovienii
  Peptide sequence Name=Xb4151_4152.C438.gene35.pep
MSCLSVISHAFSSLCFTDFTVQREVEEKCHYRYAIKITSKWLIAWFSEYSQLERMPLVK

SEQ ID NO: 8556 - protein, 31 aa, Xenorhabdus bovienii
  Peptide sequence Name=Xb4151_4152.C438.gene36.pep
MEFNNAMYQVRSPIFSLVWQHQAAAKFKLDY

SEQ ID NO: 8557 - protein, 886 aa, Xenorhabdus bovienii
  Peptide sequence Name=Xb4151_4152.C438.gene37.pep
  Gene classification: Gene name=FimD; Function=PapC-like porin protein involved in fimbrial biogenesis; Function class=N Cell motility and secretion
  Homolog annotation: Query=44..879bp; Hit=2..843bp; Blast score=838; Percent Identity=48.0; E value=0; Homolog= Z3600 COG3188
MALFSNSMNHHFSAINIKNNINKENVANKKTVDNKAKVVNRIKPVHLKNRIKPLSALVLFALAGMQTAYSNPSIEFNIDALDVGERANIDLDKFSRAGYIMPGNYIMGVRMNKNEFPDMYSIDFTSQPDDPKNSEACISPELVKQIALKQEWAGKLGWQNDGKCLDLSSLPGMSARGELATYTLYLIVPQIYLEYDLPDWDPPSRWDNGVPGVLFDYNVNAQTSKPTHGSSNQQVSANGTAGMNAGAWRFRADWQANYNHSKTKDNKQGASGERERDWNWSRYYMYRAIPHLQAQLTFGEDYLNSNIFDSFRYTGLSLVTDDNMLPPNLRGYAPEVSGVARTNAKVTVRQQGRVLYETQVAPGPFRIQDLSDAVTGNLDVRVEEQDGGIQEFQVNTATVPYLTRPGRVQYKLVGGQSTNDKHRREGPAFGLGEFSWGINNGWSLYGGLLGAGDYNALSLGIGRDLMMFGALSFDITESRARIPKENKTFTGGSYRLSYSKRFEQYNSQVTFAGYRFSERNFMSMAQYIDRRYRDVNSDNGKELYTLIFSKQFKDLGLNAHINYSHQTYWNRPTNDRYNISLSKYLDIGRYKNINVNLSAYRNNFDNKKDDGVYLNLSIPWGDSGTLSYNGLANRQGNSHMASYFNRIDERNNYRISAGSSIGGKAAADGYYTHYGDKTLLSASASYQDGGHTSAALGLRGGVTVTANGAALHRINLPGATRLMVDTEGVSDVPVRGFGSVVHTNYFGKAVLVDVNHYYRNSANIDLDHLPDNVEALRSVQQATLTEGAIGYRKFQVMSGMKAMTVIRLPDGSFPPFGASVMNTAQREIGIVSDDGYAYLSGMNAGEKLQVHWNGGAQCEITVPQEISEASLTSFLLPCQFLKGEHQ

SEQ ID NO: 8558 - protein, 50 aa, Xenorhabdus bovienii
  Peptide sequence Name=Xb4151_4152.C438.gene38.pep
LPDKRASGLSTLERLPLEFFSFSLLLAHSQRDSFLDCSANNSTFHVKSAT

SEQ ID NO: 8559 - protein, 245 aa, Xenorhabdus bovienii
  Peptide sequence Name=Xb4151_4152.C438.gene39.pep
  Gene classification: Gene name=FimC; Function=PapD-like chaperone involved in fimbrial biogenesis; Function class=N Cell motility and secretion
  Homolog annotation: Query=3..237bp; Hit=13..242bp; Blast score=239; Percent Identity=51.0; E value=1e-63; Homolog= ZyfcS COG3121
MVTALTLTSLMPAYQAMAAMALDRTRVIFNGDVKSVSLNIENQHVDLPYLAQAWIEDDKGNKINGPLVVVPPVQRVEAGAKSQVKIQTLPTIAELPQDRESLFYFNLREIPPRSNKPNVLQIALQTRVKLFYRPEAVVARRIDLDNPWQEKLTLTRQGNQYLVNNPTSYYVTISEASNKVNGKNIDGFQPLMLAPRSSEKLGADLSALGNKPVLTYVNDYGGRPQLTFSCNGDTCTVAKTTVEEN

SEQ ID NO: 8560 - protein, 187 aa, Xenorhabdus bovienii
  Peptide sequence Name=Xb4151_4152.C438.gene40.pep
  Gene classification: Gene name=FimA; Function=Pilin; Function class=N Cell motility and secretion
  Homolog annotation: Query=58..186bp; Hit=48..172bp; Blast score=60; Percent Identity=29.0; E value=1e-09; Homolog= Z3596 COG3539
MSPLNMKLSKYVLSALFIFGIGGQKSAYAQDSLRQDVKITLTVLAAPCVIKTEDKAMEVYLGRILNRDLYQNYRTPGQNFELHLEECDPRVAQSLKIKFMGPESRTLPGLLAFGAGSGASGAAIGMESIDGKPLPFNKVSKFPLSRTSSSNVIPFRAYVQAEPGALQHNRIGAGAFNAIATFEVSYE

SEQ ID NO: 8561 - protein, 278 aa, Xenorhabdus bovienii
  Peptide sequence Name=Xb4151_4152.C438.gene41.pep
  Homolog annotation: Query=1..278bp; Hit=1..277bp; Blast score=289; Percent Identity=56.0; E value=4e-77; Homolog= gi|22094604|gb|AAM91935.1|AF525420_6 putative fimbrial adhesin [Xenorhabdus nematophila]
MRHIKKSLMKFVALLFFLSTSYAYGGAYVMAVDTQPFGNQAITTMEIIAWTEEEGAPNPCYGSNKCYVGPDVLYMNGNKPGMYGSCMDAGACLDDANRYRTAAEVMRAYKRKLGIPFRATFTITNRNADCVGLFYSYGTHPFHGTAEKFPNSTCGKLPPQNQSCSISVPSEIAYGALKASDVNNATRSITGQVKCALKGDFRLEGFSIGREAKIYLDSNRQMYSTLQINGREAMDGVSFKAKGRDQPENFTLTSILRTLTPPKAGKYEGIAVVLLSYN

SEQ ID NO: 8562 - protein, 92 aa, Xenorhabdus bovienii
  Peptide sequence Name=Xb4151_4152.C438.gene42.pep
  Gene classification: Gene name=HipB; Function=Predicted transcriptional regulators; Function class=K Transcription
  Homolog annotation: Query=3..67bp; Hit=13..77bp; Blast score=60; Percent Identity=38.0; E value=4e-10; Homolog= CC2330 COG1396
MRVSMLVGKRIQIKRKEIGMTVAELADRISVSQQQLSRYERGTNKISLEHLVDVSIALKTPADWFLEDCFNKTQVSVKNQYAFVAETILDLY

SEQ ID NO: 8563 - protein, 31 aa, Xenorhabdus bovienii
  Peptide sequence Name=Xb4151_4152.C438.gene43.pep
MCHIPLTPSSEFSCFSTSVNTHLNCLISKVI

SEQ ID NO: 8564 - protein, 203 aa, Xenorhabdus bovienii
  Peptide sequence Name=Xb4151_4152.C438.gene44.pep
  Gene classification: Gene name=XerC; Function=Integrase; Function class=L DNA replication, recombination and repair
  Homolog annotation: Query=2..190bp; Hit=8..196bp; Blast score=223; Percent Identity=58.0; E value=8e-59; Homolog= fimB COG0582
MQKRNYLTHSEIEILLKELGKHPHAERNICMIFMGFIHGFRVSELLGLKLSDADLEGKKLRVQRLKNGFSTIHPMVMREVQLIRQWLAQRQKYKNSEQNDWLFLSRTGVPMSRQQFYKIIRQTSLQANLAVCANPHMLRHSCGYALADNGVDTRLIQDYLGHRNIRHTVRYTASNAGRFGAIWQERGKRKLSTISTKLLTEDD

SEQ ID NO: 8565 - protein, 69 aa, Xenorhabdus bovienii
  Peptide sequence Name=Xb4151_4152.C438.gene45.pep
MRIGTIKATFLNADLLPPFIISSEFGINTEFRWSYFLFFLHNPLFLQINDCVFLSSHHLLLNPDVAVCE

SEQ ID NO: 8566 - protein, 244 aa, Xenorhabdus bovienii
  Peptide sequence Name=Xb4151_4152.C438.gene46.pep
  Gene classification: Function=Uncharacterized membrane protein affecting hemolysin expression; Function class=T Signal transduction mechanisms
  Homolog annotation: Query=25..231bp; Hit=1..205bp; Blast score=224; Percent Identity=59.0; E value=8e-59; Homolog= Z5988_1 COG3726
MLFKLSYQYSIWQHDVFQSMDGITMIKAKLKFRLHKTAIILICIALLVLLLQGVSYFSRSQQQAQVNQFEDLAKTLAKQVAYSLSDYMENDSKDLNNKKIVASLDYLTSKSRILDASVYLENGTQIARSGEPISVRDRLSLDGKKSGSYFNQQLVVPIPGKNEPKGFLRLTLDSHRLETEAKQVDNTTNVLRIMILLALAIGFVLAHNLLRLTPSRWQQSPYLLTANTKSPDEDRDNKSDVSQR

SEQ ID NO: 8567 - protein, 327 aa, Xenorhabdus bovienii
  Peptide sequence Name=Xb4151_4152.C438.gene47.pep
  Gene classification: Gene name=SerB; Function=Phosphoserine phosphatase; Function class=E Amino acid transport and metabolism
  Homolog annotation: Query=6..325bp; Hit=3..322bp; Blast score=448; Percent Identity=69.0; E value=1e-126; Homolog= serB COG0560
MFMSNNLAYRYLPDEIHKWPGLPLSLSGDEVMPLDYRAGDSGWLLYGRGLDKQRISDFQHRLGVAIVVVSSWRIDDYQVVRIAGSPSPRIKRLADECSLDVVPLGQIPRLRSPGLLVMDMDSTAIQIECIDEIARLAGVGDKVAAITERAMQGELDFSESLRERVAQLAGADASILQQVMETLPLMPGLTSLVRKLQSLDWHVAIASGGFTFFADNLRQQLRLFAAVANQLEVKNGKLTGKVKGPVVDAKYKATTLVRLAKELGIPLSQTVAIGDGANDLKMIRKAGLGIAYHAKPKVYTQAKVGIRHADLMGVLCVLSGGLKHEER

SEQ ID NO: 8568 - protein, 460 aa, Xenorhabdus bovienii
  Peptide sequence Name=Xb4151_4152.C438.gene48.pep
  Gene classification: Gene name=Sms; Function=Predicted ATP-dependent serine protease; Function class=O Posttranslational modification, protein turnover, chaperones
  Homolog annotation: Query=1..459bp; Hit=1..460bp; Blast score=823; Percent Identity=89.0; E value=0; Homolog= sms COG1066
VAKAVKRAFVCNECGADYPRWQGQCTACHAWNTITEVRLAAASSSRSERFSGYAGEVSISKVQKLAEISLEELPRFSTGFKEFDRVLGGGVVPGSAILIGGNPGAGKSTLLLQIMCQLSEQMKTLYVTGEESLQQVAMRAHRLGLPTDKLNMLSETSIEQICLIAEQEQPKLMVIDSIQVMHMADIQSSPGSVAQVRETAAYLTRFAKTRGVAIIMVGHVTKDGSLAGPKVLEHCIDCSVMLDGEADSRFRTLRSHKNRFGAVNELGVFAMTEQGLREVSNPSAIFLSRGDEVTSGSSVMIVWEGTRPLLVEVQALVDHSMMPNPRRVAVGLEQNRLAILLAVLHRHGGLQMADQDVFVNVVGGVKVTETSADLALLLSLVSSFRDRPLPRDLVVFGEVGLAGEIRPVPSGQERISEAAKHGFKRAIVPHANMPKKTLPEMKVFGVKKLADALSVLDELD

SEQ ID NO: 8569 - protein, 408 aa, Xenorhabdus bovienii
  Peptide sequence Name=Xb4151_4152.C438.gene49.pep
  Gene classification: Gene name=NadR; Function=Predicted ATPase/kinase involved in NAD metabolism; Function class=H Coenzyme metabolism
  Homolog annotation: Query=224..406bp; Hit=1..183bp; Blast score=326; Percent Identity=84.0; E value=2e-89; Homolog= nadR_3 COG3172
MGQFDYLKEAIKQANYTLQQVADACGMTKGYLSQLINGKIKSPSAQKLASIHQYLELAYPMEKKTVGVVFGKFYPLHTGHIYLIQRASSQVDELHVVLCYDELRDRELFINSSMSQQPTVSDRLRWLLQTFKYQKNIHIHAFDEHGMEPYPNGWGVWSQGVKGFMAEKSINPEYIYSSEAQDVARYKEYFGIETILIDPQRSFMNISGSQIRQAPFRYWEYIPTEVKPFFVRTVAILGGESSGKSTLVNKLANMFNTTSVWEYGREYVFSHLGGDEMALQYSDYDKIALGHAQYIDFSVKYANKVAFIDTDFVTTQAFCKRYEGKEHPFVQAMIDEYRFDLVILLENNTPWVADGLRSLGSERERKEFQQLLESLLKKNNIDYVCIDSADYDQRFLRCVELVQQMLMA

SEQ ID NO: 8570 - protein, 43 aa, Xenorhabdus bovienii
  Peptide sequence Name=Xb4151_4152.C438.gene50.pep
MIALVVQYFLCITSIFGKTPNTFVGLLITNKFYINKSIGLFIK

SEQ ID NO: 8571 - protein, 241 aa, Xenorhabdus bovienii
  Peptide sequence Name=Xb4151_4152.C438.gene51.pep
  Gene classification: Gene name=PhnL; Function=ABC-type transport systems, involved in lipoprotein release, ATPase components; Function class=R General function prediction only
  Homolog annotation: Query=26..228bp; Hit=31..233bp; Blast score=122; Percent Identity=34.0; E value=3e-28; Homolog= CC2091 COG1136
MNLNQFKSIDVINISYGLTSNSVNHEMISDITFSIIPGEITLITGPKASTNSTLLSIASGMLQPDQGDVLINNNKLKLMNDIELGKFHSENSGFIFHDFNLSNKLTLLDNLLLSTSYGLTLSSEQATKIAQKSLDIVKLGHKSRYYPGELSENEKQLAAMARAIVRRPEYLFADDPTRNLGHQELQMFVDIFKFIAHEQKGTVVIASQDNRLVQYADSMITLERGKVVKTYESFQEKRVMV

SEQ ID NO: 8572 - protein, 73 aa, Xenorhabdus bovienii
  Peptide sequence Name=Xb4151_4152.C438.gene52.pep
LLSLKGTSANTKIIKSGQWGLKHWSHTALNIRKSVNKPDRGNGLISGRFSELTYSLSLSNCCLVGCNLKFIGI

SEQ ID NO: 8573 - protein, 548 aa, Xenorhabdus bovienii
  Peptide sequence Name=Xb4151_4152.C438.gene53.pep
  Gene classification: Gene name=Uup; Function=ATPase components of ABC transporters with duplicated ATPase domains; Function class=R General function prediction only
  Homolog annotation: Query=1..548bp; Hit=9..556bp; Blast score=1002; Percent Identity=88.0; E value=0; Homolog= PM0425 COG0488
MHRVGKIVPPKRHILKNISLSFFPGAKIGVLGLNGAGKSTLLRIMAGIDNDIEGEARPQPGIKIGYLPQEPKLNLEHTVREAVEEAVGEVKNALTRLDEVYAAYADPDADFDKLAKEQGQLEAIIQSHDGHNLDNQLERAANALRLPAWDAKIEHLSGGERRRVAICRLLLEKPDMLLLDEPTNHLDAESVAWLERFLHDYEGTVVAITHDRYFLDNVAGWILELDRGEGIPWEGNYSSWLEQKDARLAQEASSEAARRKSIEKELEWIRQNPKGRQAKGKARLARFEELNNVDYQKRNETSELFIPPGPRLGDKVLEVTNLTKSYGDRVLIDNLSFALPKGAIVGIIGPNGAGKSTLFRMLSGQEQPDSGSITLGETVTLASVEQFRDSMDDKKTVWEEVSGGQDIMRIGNFEIPSRAYVGRFNFKGVDQGKRVGELSGGERGRLHLAKLLQVGGNMLLLDEPTNDLDIETLRALENALLEFPGCTMVISHDRWFLDRIATHIIDYQDEGKVAFFEGNFSEYEDYKKRTMGAEALEPHRIKYKKISK

SEQ ID NO: 8574 - protein, 46 aa, Xenorhabdus bovienii
  Peptide sequence Name=Xb4151_4152.C438.gene54.pep
MDGAFYPKFYISCCYLISTSSSIQLPQTVKTICAERVFISGIPVPV

SEQ ID NO: 8575 - protein, 31 aa, Xenorhabdus bovienii
  Peptide sequence Name=Xb4151_4152.C438.gene55.pep
MKESFRRTHLISFVFRPTVNTIVRQERGSHL

SEQ ID NO: 8576 - protein, 61 aa, Xenorhabdus bovienii
  Peptide sequence Name=Xb4151_4152.C438.gene56.pep
MCCPCNKNQTHSYRKMPPFIHYYMLLQRTKRITTNTKMLFNYNHIIDMIDYNSEFIRIRFL

SEQ ID NO: 8577 - protein, 639 aa, Xenorhabdus bovienii
  Peptide sequence Name=Xb4151_4152.C438.gene57.pep
  Gene classification: Gene name=MltE; Function=Soluble lytic murein transglycosylase and related regulatory proteins (some contain LysM/invasin domains); Function class=M Cell envelope biogenesis, outer membrane
  Homolog annotation: Query=4..639bp; Hit=18..654bp; Blast score=668; Percent Identity=53.0; E value=0; Homolog= slt COG0741
MNKWRHFTIAVGLVFVAGAAHADSLDAQRERYQAVKLAWETKNMAEVERLMPTLKDYPLYPYLEYRQLTQDLDIATPQQIRHFIDTYPTLPPARSLTSKYIDSLASNGDWSGILAFTPNAPRAVMTRCNYYFAKWATGNQQVAWKGAQELWLSGNTLPGSCDKLFDVWEQAGYLSANLILQRVELAIKSNNTQLVNYLIKRLPLSYRSLGENLLKLQSDPAFIEHFAQTSTSTDFTRSVIMTTFSRFARKDAEVARHSIPAIVRTQKMNDSEHQLLKDAVAWNLMSNVTPEQAKWRDEVIRDSQSTNLLERRVRLTLQDGDEKGLVQWLSLLPKSTLQKKEEWQYWSAIVLLNEGKQAEGEAILHNLREKRGFYSMVAAQKLNLTYPLMIDKAEKPDDSIAKMREIKRIHELIYWNMDNLANSEWNNFVSSQSPFKQQQLARYALEQHWPALSVQATITGKMWDHLEERFPLAWQKEFANFTVDKNISQSYAMAIARRESAWNPQARSGKGASGLMQIMPKTAEHTVKEQKIQGYSSSSQLMDPAMNIKVGTAYLDLVYQRFGNNRVLASAAYNAGPKNVERWLANSADRIDAIAFIESIPFGETRDYVKNVLAYDMYYHNFMGIHSNALTNAEWQRRY

SEQ ID NO: 8578 - protein, 107 aa, Xenorhabdus bovienii
  Peptide sequence Name=Xb4151_4152.C438.gene58.pep
  Gene classification: Gene name=TrpR; Function=Trp operon repressor; Function class=K Transcription
  Homolog annotation: Query=10..107bp; Hit=10..107bp; Blast score=108; Percent Identity=64.0; E value=1e-24; Homolog= trpR COG2973
MIPNHLIDPALTPENSDDWLTFVGLLQSAFEQNLQHPILQLLLTPDERTALSTRIRIVQELMRGQMSQRELKNELSVGIATITRGSNSLKAAPAPVRAWLEAQLLKS

SEQ ID NO: 8579 - protein, 177 aa, Xenorhabdus bovienii
  Peptide sequence Name=Xb4151_4152.C438.gene59.pep
  Gene classification: Function=Uncharacterized ACR; Function class=S Function unknown
  Homolog annotation: Query=1..170bp; Hit=4..173bp; Blast score=198; Percent Identity=58.0; E value=2e-51; Homolog= yjjX COG1986
MYHVIAATTNPAKIKAINLAFDDVFGPGTYRIEDVNVDSSVPQQPIGNTETRTGARHRVMAARQVRPEADFWVGVEAGIEDDMTFAWMVIEYKQIRGESRSASLMLPEKVLEGIREGRELGHEMAYLTGVDNIKQKGGAIGFFTNGILTRTSVYHQALILALVPIHHEIYKELNNQP

SEQ ID NO: 8580 - protein, 215 aa, Xenorhabdus bovienii
  Peptide sequence Name=Xb4151_4152.C438.gene60.pep
  Gene classification: Gene name=GpmB; Function=Fructose-2,6 -bisphosphatase; Function class=G Carbohydrate transport and metabolism
  Homolog annotation: Query=1..214bp; Hit=1..214bp; Blast score=313; Percent Identity=74.0; E value=7e-86; Homolog= ZgpmB COG0406
MLQVYLVRHGETEWNVARRIQGQTDSPLTEIGLRQARLVAQRVKSQNITHVITSDLGRTRQTAEIIAKACGCKVLLEPRLRELNMGVLENRELNSLTPEEESWRKSLVDGTPNGKIPEGESMNELSARMRAALESCLGLPAGSRPLLVSHGIALVCLVSSILGLPANSERRLRLRNCSISRVDYQDSPWLASGWIVETAGDITHLDMPALDELQG

SEQ ID NO: 8581 - protein, 293 aa, Xenorhabdus bovienii
  Peptide sequence Name=Xb4151_4152.C438.gene61.pep
  Gene classification: Gene name=AraC; Function=AraC-type DNA-binding domain-containing proteins; Function class=K Transcription
  Homolog annotation: Query=1..265bp; Hit=1..265bp; Blast score=337; Percent Identity=63.0; E value=1e-92; Homolog= rob COG2207
MDQTNIIRDLLHWMDNNLDRPLSLDNVAAKAGYSKWHLQRMFKDVTGQAIGSYIRARRLSKAAVALRLTSRPILDIALQYRFDSQQTFTRAFKKQFNRTPASYRRNEEWCATGICPPIMLDNKPLPAHKYVTLEDQLLIGTEHTCSYTLEQWSSACTEMRHGFWVNYLQHAETLPPRLYGLHHSDLSAEHEDEQTVFYTTAIEPEYATFNTQDNRPVVLPGGDYISFSYFGGKEQLKEFLFTVYGICLPKLNITRRKGYDVERYYLTNLEWKNFEDESQTHVVEFEYLIPIER

SEQ ID NO: 8582 - protein, 60 aa, Xenorhabdus bovienii
  Peptide sequence Name=Xb4151_4152.C438.gene62.pep
MRRFFRKSGYYMLRFTQNKINHSWHLELTTFTSENRNNFCSPTIKRHHKLCFLPFGNGRC

SEQ ID NO: 8583 - protein, 33 aa, Xenorhabdus bovienii
  Peptide sequence Name=Xb4151_4152.C438.gene63.pep
MTLKNTPILRKFLSACFMFNIHQPMYVGGWKWL

SEQ ID NO: 8584 - protein, 158 aa, Xenorhabdus bovienii
  Peptide sequence Name=Xb4151_4152.C438.gene64.pep
  Gene classification: Gene name=CreA; Function=Uncharacterized BCR; Function class=S Function unknown
  Homolog annotation: Query=5..158bp; Hit=4..157bp; Blast score=233; Percent Identity=75.0; E value=8e-62; Homolog= creA COG3045
MVTIKKIVIAAALIFSPVILHAEEIGSVDTVFKLFGPDNKIVIEAFDDPDVKNVTCYLSRAKTGGIKGGLGLAEDTSDAAISCQQVGPIELSDKIKTSPKKGQVVFQKRTSLVFKKLQVVRFYDPKRSSLIYLTYSDKVIDGSPKNAISAVPMMPWKE

SEQ ID NO: 8585 - protein, 238 aa, Xenorhabdus bovienii
  Peptide sequence Name=Xb4151_4152.C438.gene65.pep
  Gene classification: Gene name=OmpR; Function=Response regulators consisting of a CheY-like receiver domain and a winged-helix DNA -binding domain; Function class=T Signal transduction mechanisms
  Homolog annotation: Query=1..238bp; Hit=1..238bp; Blast score=429; Percent Identity=91.0; E value=1e-120; Homolog= arcA COG0745
MQTPHILIVEDEIVTRNTLKSIFEAEGYVVYEATDGSEMHNILSDNDINLVIMDINLPGKNGLLLARELREQANVALMFLTGRDNEVDKILGLEIGADDYITKPFNPRELTIRARNLLSRTMNLSHSGEERRQVESYKFNEWELDINSRSLVSPMGDQYKLPRSEFRAMLHFCENPGKIQTRAELLKKMTGRELKAHDRTVDVTIRRIRKHFETTPDTPEIIATIHGEGYRFCGDLED

SEQ ID NO: 8586 - protein, 49 aa, Xenorhabdus bovienii
  Peptide sequence Name=Xb4151_4152.C438.gene66.pep
MVPVVIVVMVSVVTLFFGLIWRMISCLSFNSVDPLLVKANCGRSQIFLS

SEQ ID NO: 8587 - protein, 819 aa, Xenorhabdus bovienii
  Peptide sequence Name=Xb4151_4152.C438.gene67.pep
  Gene classification: Gene name=LysC; Function=Aspartokinases; Function class=E Amino acid transport and metabolism
  Homolog annotation: Query=1..460bp; Hit=1..460bp; Blast score=707; Percent Identity=76.0; E value=0; Homolog= thrA_1 COG0527
MRVLKFGGTSVANYQRILSVADIAESELSLGQVALVLSAPAKITNHLVAMIDKTVAGQDIVSNMSDVSQIFADLLSGLKEHQPNFGYEYLKGVVEREFAYLKQTLHGISLLKQCPDSINAALICCGEKLSIAIMGAVLQARGHKVTVIDPVKNLLAHGHYLESTVDIHESSKRIAALNIPAGHIILMAGFTAGNDNGELVVLGRNGSDYSAAVLAACLRADCCEIWTDVDGVYTCDPRAVPDARLLKSLSYQEAMELSYFGAKVLHPRTIAPIAQFQIPCLIKNTANPDVPGTFIGEGQKDENLPVKGITNLNNMAMINVSGPGMKGMVGMAARVFSVMSRKGISVVLITQSSSEYSISFCVPQKELTKAQKALTEEFYLELKDGVLDPIDVIDNLAIISVVGDGMRTQRGISARFFSALTRANINIIAIAQGSSERSISAVIDNDTATTAVRFCHQMLFNTAQVVEVFVVGVGGVGSALIEQIRRQQSWLKQKHIDLRVCGIANSRAMLTDMQGIGLDNWQQSLSEAIEPFSLSRLIRLEKEYHLLNPVIVDCTSNQSIAEQYASFLGDGFNIVTPNKKANTLSMAYYRQIRQAAEKSKRKFLYDTNVGAGLPVIENLQNLLNAGDELVQFNGILSGSLSYIFGMLDEGMTLSQATLLAKEKGFTEPDPRDDLSGMDVARKLLILARESGYELELEDIHVEPVLPAAFDASGDVGRFLQRLPQLDQEFTHRVADAAKQGKVLRYVGIIEQGRCRVKIAAVDGNDPLYKVKNGENALAFYTRYYQPIPLVLRGYGAGNDVTAAGVFADILRTLSWKLGV

SEQ ID NO: 8588 - protein, 316 aa, Xenorhabdus bovienii
  Peptide sequence Name=Xb4151_4152.C438.gene68.pep
  Gene classification: Gene name=ThrB; Function=Homoserine kinase; Function class=E Amino acid transport and metabolism
  Homolog annotation: Query=8..316bp; Hit=1..309bp; Blast score=447; Percent Identity=67.0; E value=1e-126; Homolog= thrB COG0083
MEIGGLMVVRIYAPASIGNVGVGFDVLGAAVSPVDGSLLGDCVSVCEAEHFSLSNEGRFADKLPADPKHNIVYQCWQLFCQHLGKELPVAMTLEKNMPIGSGLGSSACSVVAALVALNKYADCPFDSNQLLDMMGELEGRISGGVHYDNVAPCYLGGLQLLLAQKNAVCQFVPTFDDWLWVMAYPGIKVSTSEARGILPANYPREDMIEHGRYFAGFIHACHTQQSELAAKLMKDVVAEPYRTQLLPGFANARDGVKKRGALACSISGSGPTLFAICNDMAVAKEVAQWLQQHYVQNDEGFVHICRLDLAGARQVE

SEQ ID NO: 8589 - protein, 430 aa, Xenorhabdus bovienii
  Peptide sequence Name=Xb4151_4152.C438.gene69.pep
  Gene classification: Gene name=ThrC; Function=Threonine synthase; Function class=E Amino acid transport and metabolism
  Homolog annotation: Query=1..425bp; Hit=1..425bp; Blast score=667; Percent Identity=80.0; E value=0; Homolog= thrC COG0498
MKLYNLKDSSEQVSFSQAVKQGLGRQQGLFFPQDLPEFSRDEIDELLKLDFVSRSQRILSAFIGDEIPAEQLAARVKNAFAFPAPVTGVEDDIVSLELYHGPTLAFKDFGGRFMAQILTQIAGEQPVTILTATSGDTGAAVAHAFYGLDNVQVVILYPEGKISPLQEKLFCTLGGNIHTVAIKGDFDACQALVKQAFDDEELKRALYLNSANSINISRLLAQICYYFEAVAQIPAEKREQLVISVPSGNFGNLTAGLLAKSLGLPVKRFIAATNVNDTVPRYLSEGAWQPHQTVATLSNAMDVSQPNNWPRIEELFQRKGWSLSELANGVVDDSTTQATMQELAAKGYISEPHAAVAYRVLRDQLQAGEYGLFLGTAHPAKFKESVEAILSQPLPLPQELAERADLALLSHFLPADFASLREFLMERAPT

SEQ ID NO: 8590 - protein, 258 aa, Xenorhabdus bovienii
  Peptide sequence Name=Xb4151_4152.C438.gene70.pep
  Gene classification: Function=Uncharacterized BCR; Function class=S Function unknown
  Homolog annotation: Query=1..257bp; Hit=1..257bp; Blast score=387; Percent Identity=75.0; E value=1e-108; Homolog= ZyaaA COG3022
MLITISPAKTLDYESPPATKKYSQPALLGESKQLIDVCRTLTPAQIGSLMGISDKLAGLNAARFGEWQPNFTPENARQAILAFKGDVYTGMQAETFSDADFDFAQTHLRMLSGLYGVLRPLDLMQPYRLEMGIRLDNPRGKDLYKFWGDLITENLNAALEQQGDDVLVNLASDEYFKSVNTKKLAAQIIKPIFLDEKNGKYKVISFYAKKARGLMSRFIIQNQLTDPARLVEFNLEGYAFDESLSKGSERVFKRPEQH

SEQ ID NO: 8591 - protein, 43 aa, Xenorhabdus bovienii
  Peptide sequence Name=Xb4151_4152.C438.gene71.pep
MILFRYDFVSNRFPHNAGFLNFSKNKLKRANNSDKIFLPYSSA

SEQ ID NO: 8592 - protein, 334 aa, Xenorhabdus bovienii
  Peptide sequence Name=Xb4151_4152.C438.gene72.pep
  Gene classification: Gene name=MipB; Function=Transaldolase; Function class=G Carbohydrate transport and metabolism
  Homolog annotation: Query=18..334bp; Hit=1..317bp; Blast score=540; Percent Identity=85.0; E value=1e-154; Homolog= talB COG0176
MARQQCQYFTYNDEILNMTDKLTSLRKLTTVVADTGDIAAMKLYQPQDATTNPSLILNAAQIPEYRQLINEAIEWARGQSDSREQQIIDAGDKLAVNIGLEILKLIPGRISTEVDARLSYDTEASVAKAKRLIKLYNEAGISNDRILIKLASTWQGIRAAEQLEKEGINCNLTLLFSFAQARACAEAGVYLISPFVGRILDWYKANGDKKEFAPHEDPGVISVAEIYQYYKEHGYNTVVMGASFRNSGEILELAGCDRLTISPALLKELSETAGEVECKLGYEGEIKARPARLTEAEFYWEHHQDAMATEKLAEGIRKFAVDQGKLESMIADLL

SEQ ID NO: 8593 - protein, 191 aa, Xenorhabdus bovienii
  Peptide sequence Name=Xb4151_4152.C438.gene73.pep
  Gene classification: Gene name=MoaB; Function=Molybdopterin biosynthesis enzymes; Function class=H Coenzyme metabolism
  Homolog annotation: Query=1..186bp; Hit=1..186bp; Blast score=306; Percent Identity=83.0; E value=8e-84; Homolog= mog COG0521
MNLLRIGLVSVSDRASNGVYQDKGLPALETWLEKAITTPFSVETRLIPDEQILIEQTLCELVDERGCHLVLTTGGTGPASRDVTPDATLAIADREMPGFGEQMRQISLQFVPTAILSRQVGVIRHQALILNLPGQPKAIAETLGGLKDGSGKVLVSGIFASVPYCIQLLDGPYVETDETVVAAFRPPLKNG

SEQ ID NO: 8594 - protein, 100 aa, Xenorhabdus bovienii
  Peptide sequence Name=Xb4151_4152.C438.gene74.pep
  Homolog annotation: Query=8..81bp; Hit=1..91bp; Blast score=60; Percent Identity=43.0; E value=4e-09; Homolog= gi|12484146|gb|AAG53989.1|AF327446_1 putative transposase A [Pantoea agglomerans]
MRERGIVMALVEVKCRFYDQSTTKEKLGINDIIASPVVEPSSSNTLTGLAMNNAGIRDTARALHVSINAVVRTLKNSCHDVYSAATENGNAGCGTRGSLA

SEQ ID NO: 8595 - protein, 246 aa, Xenorhabdus bovienii
  Peptide sequence Name=Xb4151_4152.C438.gene75.pep
  Gene classification: Gene name=EntD; Function=Phosphopantetheinyl transferase component of siderophore synthetase; Function class=Q Secondary metabolites biosynthesis, transport and catabolism
  Homolog annotation: Query=31..235bp; Hit=26..230bp; Blast score=105; Percent Identity=33.0; E value=4e-23; Homolog= PA1165 COG2977
MKEITFTPVKTTAIDDPFFTVIQRGNLPKYPDIQVMQTYYNQACYQDILFDKYGITYPARLQNAVNKRKAEYLAARYCTQQILNSMDYPEFQVINAPDRSPVWPDKICGSLSHSANCAIVFAASREKYQIIGVDIEQEIKQDTIDSVSRTVINETEAELLKECTLSFAQAFTLTFSIKESLFKALHPHVKRFFDFHAAEITAIDCRNHTVSIKLLKTLSDEYQAGSQFHGSFVLMPQQQVLTYLIG

SEQ ID NO: 8596 - protein, 38 aa, Xenorhabdus bovienii
  Peptide sequence Name=Xb4151_4152.C438.gene76.pep
MAVVLTGVKVISFMINRILWVSYYLLILPHFSACSLTY

SEQ ID NO: 8597 - protein, 37 aa, Xenorhabdus bovienii
  Peptide sequence Name=Xb4151_4152.C438.gene77.pep
MQRFDKHDITFFRVPVFVSVTVSHNKNDNKKEYKKSQ

SEQ ID NO: 8598 - protein, 330 aa, Xenorhabdus bovienii
  Peptide sequence Name=Xb4151_4152.C438.gene78.pep
  Gene classification: Gene name=GalE; Function=UDP-glucose 4 -epimerase; Function class=M Cell envelope biogenesis, outer membrane
  Homolog annotation: Query=1..330bp; Hit=9..337bp; Blast score=472; Percent Identity=66.0; E value=1e-133; Homolog= VCA0774 COG1087
MGYIGSHTCVQMMEAGMTPIIIDNLCNANREVLARIAALTGVMPLFYEGDIRDESFLDTIFSRHQIQSVIHFAGLKAVGESVAKPIEYYDNNVNGTLVLMRSMHKAGVKSIIFSSSATVYGDPEIVPITEQSAVGNTTNPYGTSKYMVERCLSDLHHAESDWSVVLLRYFNPVGAHPSGTMGEDPQGIPNNLLPYIAQVAVGRREKLSVYGSDYSTHDGTGVRDYIHVMDLADGHIAALNAVGKKSGLHIYNLGTGKGTSVLEMVTAFSHACGKPVPYEICPRRPGDIAECWSSPEKAERELGWKASRTLVEMTADAWRWQSQNPNGYTQ

SEQ ID NO: 8599 - protein, 50 aa, Xenorhabdus bovienii
  Peptide sequence Name=Xb4151_4152.C438.gene79.pep
MHYYPFLYQLLSFITISMLNCLEITVTALQTVGEKGWDGFALLRINTENH

SEQ ID NO: 8600 - protein, 152 aa, Xenorhabdus bovienii
  Peptide sequence Name=Xb4151_4152.C438.gene80.pep
MKWRSYTYGAMLLAGSLFSSALWAKGEAHLLFHMGLGANGKFFVGGTLENKGNKPVAGGYLAVLPLNTKCEPQAPAVQSFESLAPGEKKEFRIPVNTQLSGYRLIGFGAYDDMGFTLPTVDETAKVIKDRESNERKACQLARKSEKTAVKKQ

SEQ ID NO: 8601 - protein, 303 aa, Xenorhabdus bovienii
  Peptide sequence Name=Xb4151_4152.C438.gene81.pep
MYTHTEAAKLASLIMYAYDMNEKYYNNPTPPADPRIKEDGWNLIAYISGDDTSFSVEKKMLFTLPQSICYGYIAEKKNAPGEYVIIFRGTDDTNLLEDLHNIIAIFTSPWSSAPERKVSRGFYSVYDSLKLIAFNSECDYSQLKLANAITQIIGINGQFTILAHSLGAAIASYLMCDIAFLAPNHSACLFACPRPGNNEFVEYVDNNFSHYEVFNYAKDIVPNLPPDLPVLNISQQWDYEYKSLPNITLLNPPEALNIADSIGCNHYLTSYIAILDPDEFTRVTTDNDAVQGEVNSHCVHTNK

SEQ ID NO: 8602 - protein, 54 aa, Xenorhabdus bovienii
  Peptide sequence Name=Xb4151_4152.C438.gene82.pep
LKKLWRIWACSVEFQSAIDDLLMLKRYPFYRVGRVFSKNNDLSINIELITFCYI

SEQ ID NO: 8603 - protein, 456 aa, Xenorhabdus bovienii
  Peptide sequence Name=Xb4151_4152.C438.gene83.pep
  Gene classification: Gene name=CysK; Function=Cysteine synthase; Function class=E Amino acid transport and metabolism
  Homolog annotation: Query=6..321bp; Hit=8..323bp; Blast score=439; Percent Identity=63.0; E value=1e-123; Homolog= PA0399_1 COG0031
MAVPRSVLELIGNTPLLELTHLDTGPCQLFIKLENQNPGGSIKDRVALSMIEKAEKQGLLQPGGTIIEATAGNTGIGLALVAAMKGYKLILVVPDKMSREKIYHLRALGTDVRLTRSDVGKGHPEYYQDYALRLSKEISGAYYIDQFNNSSNSLAHATTTGPEIWQQMEHNVDAVVVGVGSGGTLGGLSQYFREVSPDTEFVLADPKGSILADYVEYGRYDEAGSWFVEGIGEDFIPPLGDFSQVQNAYRITDAEAFSSARDLLLQEGILAGSSSGTLLAAALRYCRAQKTPKRVVTLACDSGNKYLSKMFNDYWLLEQGLRSQPQENDLSDYITYRYREGATVSVSPQDTLQIAHGRMRLYDISQLPVLENEQVVGIIDEWDLMHAIHSDSNNFSLPVSKAMTGQVNTLNKKAPLEQLTATFDAGHVALIVDDNNRFLGLVTRTDVLNAWRQQLN

SEQ ID NO: 8604 - protein, 386 aa, Xenorhabdus bovienii
  Peptide sequence Name=Xb4151_4152.C438.gene84.pep
  Gene classification: Gene name=MetC; Function=Cystathionine beta -lyases/cystathionine gamma-synthases; Function class=E Amino acid transport and metabolism
  Homolog annotation: Query=6..383bp; Hit=15..393bp; Blast score=488; Percent Identity=63.0; E value=1e-138; Homolog= PA0400 COG0626
MTTTKFDTKSVHAGYVPDHTGAVMPAIYATSTYAQPAPGQHTGYEYSRSGNPTRDALESAIAELENGTRGYAFGSGLAASSTILELLDKDSHIIAVDDLYGGTYRLLEKVRRRTAGLRVTYVEAGNTAALEAAIEPDTKMIWVETPTNPLLKLADLAAIAQIAQRHKIISVADNTFASPYIQRPLDLGFDIVVHSATKYLNGHSDVVAGLAVVGSNAELAEQVAFLQNSIGGILDPFSSFLVLRGIRTLALRMERHIDNAEKIAHWLEQQPQIEKVFYPGLASHPQHELAKRQMQGFGGMISVVLKGDDDYIRRVIKELKLFTLAESLGGVESLIGQPFTMTHASIPLEKRLASGITPQLIRISVGIENSEDLIADFAQALEKASL

SEQ ID NO: 8605 - protein, 96 aa, Xenorhabdus bovienii
  Peptide sequence Name=Xb4151_4152.C438.gene85.pep
  Gene classification: Gene name=Def; Function=N-formylmethionyl-tRNA deformylase; Function class=J Translation, ribosomal structure and biogenesis
  Homolog annotation: Query=1..94bp; Hit=1..94bp; Blast score=118; Percent Identity=63.0; E value=9e-28; Homolog= VCA0150 COG0242
MAILNILTIPDERLRQKCIDVTHVDEIQTLIDDMLDTMYDTDNGIGLAAPQVGRKEAVLIIDISPNRDQPMVLVNPKIVEKERRVVNQEGCLSIRN

SEQ ID NO: 8606 - protein, 349 aa, Xenorhabdus bovienii; identical to SEQ ID NO: 5796
  Peptide sequence Name=Xb4151_4152.C438.gene86.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 8607 - protein, 171 aa, Xenorhabdus bovienii
  Peptide sequence Name=Xb4151_4152.C438.gene87.pep
  Gene classification: Gene name=HofG; Function=General secretory pathway proteins G and H and related periplasmic/secreted proteins; Function class=N Cell motility and secretion
  Homolog annotation: Query=12..155bp; Hit=4..147bp; Blast score=69; Percent Identity=31.0; E value=1e-12; Homolog= ZppdA COG2165
MTTKNGGSINGQSGFTLLELLIAMALISISLSWGLYHWGQYQNRLRLQSAVQNVLSFMERQQGLANYMNQERTLWLVIGQTWCLISSVSRISDCREGEGERVNSPYDDVFLASATSDRVDFYGVRNTAMPASFVLANSAGEISVVISGRGRIRTCSNNISQLPNCEGIKGS

SEQ ID NO: 8608 - protein, 203 aa, Xenorhabdus bovienii
  Peptide sequence Name=Xb4151_4152.C438.gene88.pep
  Homolog annotation: Query=10..202bp; Hit=4..194bp; Blast score=252; Percent Identity=58.0; E value=2e-66; Homolog= gi|37524628|ref|NP _927972.1| Prepilin peptidase dependent protein B precursor [Photorhabdus luminescens subsp. laumondii TTO1
MTLVIPLLKRKQTGFSLLEVMVAMLISSVIFIAMTKTYPVLSGQILELYRKYRLHYLVNRTIYMMEKDLRRAGYCRDRKQCEGEPLLINNKNTEAADSCFIVAFDLNLNNQWEKPDHIESEFFGYRLNNHALEWKRGVENCQGNGWERLFDPTEVMVDIFHLEKLQAKNGLTFITLSINTRWLKSPSIIYRHQMTVRLRNIRK

SEQ ID NO: 8609 - protein, 146 aa, Xenorhabdus bovienii
  Peptide sequence Name=Xb4151_4152.C438.gene89.pep
  Homolog annotation: Query=4..145bp; Hit=13..154bp; Blast score=173; Percent Identity=60.0; E value=4e-43; Homolog= Pa|Phot2-13g06.p1k _g119| 103961 - 104428 635 155 aa, chain -
VDGQRGNILLVSILMLMALSLMMLKALHYQQESAMLMMMDEKKYLNAFQRAESSLEWGKVQSWQFNMQEKENWFCQQQPEFHLQSCLKHYADNLFLLKGVAQFASGETLELYQWMKQMKKANRDTLIPIESGWLDFCPVPQAEFCL

SEQ ID NO: 8610 - protein, 125 aa, Xenorhabdus bovienii
  Peptide sequence Name=Xb4151_4152.C438.gene90.pep
  Homolog annotation: Query=9..125bp; Hit=7..123bp; Blast score=122; Percent Identity=55.0; E value=1e-27; Homolog= Pa|Phot2-13g06.p1k _g118| 103578 - 103964 629 128 aa, chain -
MKRFHLHRHKRQNGMSLPEVMLASVVFAISLLGLMRYHQALSSNFQQYWLQLKAVRLAHDQLEQYERLEGQMVLEETESQQGWKIELQREFRSLGCYQVTVHVTKSYNQSNKLDRWFCASGSIDV

SEQ ID NO: 8611 - protein, 1129 aa, Xenorhabdus bovienii
  Peptide sequence Name=Xb4151_4152.C438.gene91.pep
  Gene classification: Gene name=RecC; Function=Exonuclease V gamma subunit; Function class=L DNA replication, recombination and repair
  Homolog annotation: Query=1..1119bp; Hit=1..1116bp; Blast score=1261; Percent Identity=57.0; E value=0; Homolog= recC COG1330
MFRVYHSNQLDILKELMAIFIGENPLTNPFGKEVVLVQSPGMSQWLQIQLAEKLGVAANMEFPLPATFIWQMFTQVLPDVPKDGSFSKDAMKWKLMTLLPGLLTEPDFSSLRHYLDQDIDKRKIHQLAGRVADLFDQYLVYRPQWLESWESDQSIDGLSDTQAWQKRLWLELTEYTRQLEQPLWHRANLYHRFISTLQEGRFPLEKLPARVFICGISTLPPAYLQIFKALGQHIDIHLMFTNPCLYYWGDIQSYAFLAKLNSRKPKHYQSQQSLERFRDPENASSLFNDEGEQSLNNPLLASWGKLGRDNLYLLSQLEPDSDVHAFVELEPSCILHQIQRDMLNLEDHAQIGSTEHSFKNSLKKRQIDGKDRSLSFHSCHSPQREVEVLQDQILRLLDDDPSLTPRDIIVMMADIDSYTPYIQAVFGNAPEERYIPFAISDRKARQAHPVLQAFITLLELPQSRFTAEQVLALLEVPALASKFAIQEDGLRLLRRWVKESGICWGLDDDNIEALSLPATGQNTWRFGLTRMLLGYAMDSHAGPWNDVLPYDESSGLAAELAGQLAEFLMELNRWRKILSEDQRLSGWLAVCPQLLETFFDADEETELVLALITQQWQKVIDNGLNAHYSESVPLVLLRDELVLRFDDEKISQRFLAGSLNFCTLMPMRSIPFKVVCLLGMNDGVYPRTIPPLGFDLMAEKSQRGDRKRRDDDRYLFLEALISAETCLYISYIGKSIRDDTECNPSVLVSELLDYVCQSCCLPGDEMLNVDDSARKVRNHLLLQHTRVPFAMENFVPDHYQQSYAAEWLPAASQQGASPIDFCQPVEFETSEIKEVALDELIRFYRYPVRAFFQRRLKVHFIIEETELPEEEPFVLDHLQRYQFNQLLLSILLEEGSPESLFYHLRASGGLPHGAFGEVYWLNQLEAMQPLANKIREERTESSFIELHHELDTVVLTGKIHQVQPDGILRWRPANLMANDGIQLWIEHLAYCFSGNNGESRMYGRENSEWRFSPLTSDEAKKYLNQMVAGYFQGMSEPLPLFCRSGWAWLDDCFDRESQKINFSEEAQQKAENKLMQQWLGTQGKSGESSDAYVQRAFRQVDQLFWVRMKREVQSYLLPMACHLSRSSSK

SEQ ID NO: 8612 - protein, 961 aa, Xenorhabdus bovienii
  Peptide sequence Name=Xb4151_4152.C438.gene92.pep
  Gene classification: Gene name=Ptr; Function=Secreted/periplasmic Zn -dependent peptidases, insulinase-like; Function class=O Posttranslational modification, protein turnover, chaperones
  Homolog annotation: Query=11..956bp; Hit=11..956bp; Blast score=995; Percent Identity=50.0; E value=0; Homolog= ptr COG1025
MPKYIIRIMTMLFLLFWGTTAYAKLPWQPLPETINKSERDLRQYKAIQLPNGMTVLLVSDEKAIKSLAAISVPVGHMENPDNQLGLAHYLEHMVLMGSKRYPQSGGFTEFLQKHGGSHNASTSSNRTAFYLEVENGSLTEATERLSDALAEPLLDPVNADRERHAIDNEMTIARAGEGHRIWQVRSETLNPAHPNARFGGGNLETLKDKPDSKLQAALIDFYQRYYSANLMKGVLYGQQPIDKLAHIAVETFGRIPNRQASVPAITVPAITDKEKGIIIHYVPSKPYKSLQLEFSIADNSADFRSKTDAYLGYLIGNRSANTLSDWLQKQGLAEGISASASPTTDGNSGTFGIYVSLTDKGLEQRDRVIAAIFSYINLLKQKGIEKSYFDEMAKVLNLSFEYASIVRNMGYIQWLSDVMQDIPVSHVLDAGYLADEYNPQAIFSRLAELTPENARIWFTGPKEPHNKEAYFVHAPYQVNKITPQQRTEWRKLEKEVSLSLPELNPYIPDDLSLIKASGSQKHPKMILEQPNVRLLYMQSQYFMDEPKSIITLNMRNADGMSHAKDQVTYSLLAYLSDMGLDQLGYQASVGGMGLTLGYSEGLQIGVSGYTQHLSELLTSAISQYIAFTPTQEELNQAKSRYRDQVEAVNNGKAYEMATHPVSRLSRVPYFEQTDRLKALDTITIDDIVKYRQRMIQHSALQAGIFGNLTEKQSIDIVKSAHKQLANQGTTWWSGDHIVVDRDYAVNFKGTASSTDNALSEVYIPTGYDRINGYIYSNLLGRILSPWFFEQLRTSEQLGYVASAFNTSVGEQSGLGFLLQSNSKQPDYLHQRYQSFYQQAAKKLQAMPDADFEQYKKALLTEMRQPPETFYAEASHYNYDFGSNNFKFDTHEKTIAATEKVTKAQLIAFYDKAVIKRQGLALISQITGKKGAAHQYAELKGWKTYSNVSDFQKQLPVKVNAQ

SEQ ID NO: 8613 - protein, 1205 aa, Xenorhabdus bovienii
  Peptide sequence Name=Xb4151_4152.C438.gene93.pep
  Gene classification: Gene name=RecB; Function=ATP-dependent exoDNAse (exonuclease V) beta subunit (contains helicase and exonuclease domains); Function class=L DNA replication, recombination and repair
  Homolog annotation: Query=10..1203bp; Hit=8..1179bp; Blast score =1348; Percent Identity=58.0; E value=0; Homolog= recB COG1074
VSTEILNHKLNPLTLPLHGQRLIEASAGTGKTYTIGLLYLRLLLGLGGDAAFFRPLNVEEILVVTFTEAATDELRGRIRENIHQLRLACIREGTEESDPVYQQLLDQIPDRASAASWLLAAERQMDEAAIYTIHGFCQRMLVHNAFESGVLFDQTLIQDEYPLRKQGCADFWRRHCYPLSLSMATVINQEWSGPEALLKDVSSHLQGDMPYIVNPPDSDETLIGRHEKIISLIDTVKHRWRDVAPDLHDLIANSDVDKRSYSKKHLPNWLNSVSEWAESQTRDYQLPKELDKFSQSRLAEKTKKGETPQHPVFTAIDDLYQQPLTLRDIIISKAIVEIRQSVNQEKLMRGHMGFDDLLTRLDSALQREGGKQLATTIRQRYPVAMIDEFQDTDPQQYRIFQAIYCDQPENEQRENGLMFIGDPKQAIYAFRGADIFTYIRARSQVSAHYTLETNWRSSVPMVQAVNKLFSHTERPFLFSQIPFINVKAAEKNHNLRFLFHHQEQAALQFWLQPGEGVAKGGYEQSMARHCAAQIRDWLLAGQQGQALLQQAEKSQPVTAADITVLVRNRREAAMIRDELNALKIPSVFLSNRDSVFDTPEAKDLLWLLQAVLSPEKERELRSALASSLFGLSAQQIDQLNHDETAWDHLVDEFSGYARLWRSRGVLPMLRAVMVKYQVAENLLAGYDGERRLTDVMHIGELLQETSLQLDSEHAVVRWLAQQISRPDPQSETQQMRLESDKHLVQICTIHKSKGLEYPLVCLPFICSFRKQEQAIYHDRQSFETHFSIFQDDEKKALADEERLAEDLRLLYVALTRSIYHCSVGVAPLIQGNKKKAGNTDLHLSALGYLLQKGQQGDAQLLADSLNELSNDDIQVTLMEETDDVQWCSQNNNDSLLAARKFRRSIQDDWRVTSYSGLQYSSSHSISHAYTSAFGESVDVIVQSIAPKLDIDARGEKQEEPSSQMTPHTFPRGASAGTFLHSILEDLDFSELPEQVWLAEKLTAAGFDENWAPVLQQWIADFVTAELDEQGIQLANVPRHQQQSEMQFYLPVDKLLHSHALSALTRRYDPLSAQCAPLSFHQVKGMLKGFIDLVFCWQGKFYVVDYKSNWLGESSQSYTQEAMAKAMIEHRYDLQYQLYTLALHRYLRHRLVNYDYQQHFGGVIYLFLRGIDKANPGHGVYRYLPSIEFVDELDRLFSAAGEEQGV

SEQ ID NO: 8614 - protein, 635 aa, Xenorhabdus bovienii
  Peptide sequence Name=Xb4151_4152.C438.gene94.pep
  Gene classification: Gene name=RecD; Function=ATP-dependent exoDNAse (exonuclease V), alpha subunit - helicase superfamily I member; Function class=L DNA replication, recombination and repair
  Homolog annotation: Query=8..622bp; Hit=7..601bp; Blast score=595; Percent Identity=55.0; E value=1e-170; Homolog= recD COG0507
MSDMKLLLQQAVAQKLLRPLDVQFAYAMIENGDPLLLLITALVSAESGAGHVCLPLERISPEYLFEGRQPELAASLWFSAGKPNQQQVISALQACSAVSTGESPAPIILSRHALADYRLYMQRMWQSERRVAEFFASVELSDDIDEVQLHRILDELFGVTAEGEIDWQKVAAAVAVTSRISVISGGPGTGKTTTVAKLLAALIKLNEGRTLSIQLAAPTGKAAARLTESLSEAVNKLALTSQQSNSIPEQAQTIHRLLGAQPDSQKLRYHRDNPLSLDILIIDEASMVDLPMMARLIEALPPRAKVIFLGDKDQLASVEAGAVLGDICRFAEQGYSAKRAEQLSQLTGCQLTSYSMPDSGEHTLAVRDCLCLLRKSYRFNSASGIGQLASAVNQGNSAGVSAVLGQSLPDVHFNPLAGDEDYQRLLMQTAEGYYRYLAMVNEQASDKDILAEFNRFRLLCALREGPFGVSGLNQRVEQLLHRKGVISLPRSAESGGYAGRPIMILRNDSTLGLFNGDIGIMLRNKDNELKAHFQLSDGTIKPFQPSRLPQHETAYVMTVHKSQGSEFEHTALVLPTQFSPVVSRELVYTALTRAREKLTLYAHKPVLDKAVSTSTQRRSGLAEWLKPKGECQSGQ

SEQ ID NO: 8615 - protein, 444 aa, Xenorhabdus bovienii
  Peptide sequence Name=Xb4151_4152.C438.gene95.pep
  Gene classification: Gene name=ArgB; Function=Acetylglutamate kinase; Function class=E Amino acid transport and metabolism
  Homolog annotation: Query=1..289bp; Hit=2..290bp; Blast score=463; Percent Identity=78.0; E value=1e-130; Homolog= argA_1 COG0548
MKERCTELVEVFRHSVPYINAHQGKTFVIMLDGEAIAHENFPNIVNDIGLLHNLGIRLIVVYGARPQIDQKLAEYHSQPIYHKHIRVTDAKTLELVKQSAGLLQLDITARLSMSLSNTPLQGANINVISGNFIIAQPLGVDDGIDYCHSGRIRRIDEEAINQQLDNHAIVLIGPVAVSVTGESFNLTSEDIASQLAIKLKAEKLIGFCSSQGVLDAEGNILSEIVPNEGEARLNELGSEGDYSSGTARFLRGAIKACRRGVRRSHLISYQENGSLVQELFSREGSGTQIVMERSEQIRRANINDIGGILELIRPLEQTGILVRRSREQLEMEIDKFTLIEHDNVTIACAALYSYPDEKIGEMACVAVHPNYRNSSRGEVLLNSIAGQARQAGLEKLFVLTTRSIHWFQEKGFEPAEINMLPVEKQALYNYQRCSKILMLNLEVY

SEQ ID NO: 8616 - protein, 35 aa, Xenorhabdus bovienii
  Peptide sequence Name=Xb4151_4152.C438.gene96.pep
MARGNMDKNNNIIYIYIDINKLRERKMFFLMTATR

SEQ ID NO: 8617 - protein, 415 aa, Xenorhabdus bovienii
  Peptide sequence Name=Xb4151_4152.C438.gene97.pep
  Gene classification: Gene name=AmiC; Function=N-acetylmuramoyl-L -alanine amidase; Function class=M Cell envelope biogenesis, outer membrane
  Homolog annotation: Query=1..415bp; Hit=31..446bp; Blast score=584; Percent Identity=70.0; E value=1e-167; Homolog= amiC COG0860
MSHSDHNPSRRNLLKGAAAMWLLSISSIGHAATSKIIAVRIWPASSYTRVTLEANILLKYRQFSLSNPNRIVIDLQGVQLNSALSGMGSQIHQRDPYLKLVRVGQFNPKTVRLVFEIKQPVAPHIFTLPPIAKFKHRLVLDLYPSKAANVEDDPLQALLEEYNSGDLEKNLPAEKRKPGRPGKNRPIVIMLDPGHGGEDSGAIGKYKTREKDVVLQIARRLQALIKREPGMKVYMTRNEDVFIPLQVRVAKARKMQADLFVSIHADAFTNRAARGSSVFALSTKGATSNTARFLAQTQNESDLIGGVSKSGDEYLDHTMLDLVQTATINDSLKFGSEVLKRIGKVNKLHKNSIDQAGFAVLKAPDIPSILVETAFISNLEEERKLKTAKFQQQVAESIFAGIKAYFKSGVELARR

SEQ ID NO: 8618 - protein, 74 aa, Xenorhabdus bovienii
  Peptide sequence Name=Xb4151_4152.C438.gene98.pep
MNKNTTNSAIFNHTRNKFGKYQQKTCNSAEPAYSVPTSDAGWSSLVARRAHNPKVVGSNPAPATNPIRCHIGRV

SEQ ID NO: 8619 - protein, 48 aa, Xenorhabdus bovienii
  Peptide sequence Name=Xb4151_4152.C438.gene99.pep
MIKNSTICRVFVHSWGYGTVIYFFLTTFYYLPGFDIVRRRIIMTGDKV

SEQ ID NO: 8620 - protein, 365 aa, Xenorhabdus bovienii
  Peptide sequence Name=Xb4151_4152.C438.gene100.pep
  Gene classification: Gene name=MltA; Function=Membrane-bound lytic murein transglycosylase; Function class=M Cell envelope biogenesis, outer membrane
  Homolog annotation: Query=4..354bp; Hit=5..354bp; Blast score=505; Percent Identity=67.0; E value=1e-143; Homolog= mltA COG2821
MKLWGKYLLWGFVISLLSGCQMRPTDQGQQYKDGRISEDLQLVNIPNAQGSPTNAGDFQAQVKFISKSSPRLYGNNRATLDAIQNWMLSGGDPRELNQYGLLAYQMDGDDNYGNVKFTGYYTPVLQARHVKQGEFKYPLYRMPGKSRLRLPNRAAIYNGALSEKLIIGYTNSLIDNFLMEVQGSGYIDFGDGSPLTFFGYSGKNGHAYQSIGKILVNRGEVPLEEMSLKAIRQWVSQHNESEVRELLEQNPSFVFFKPEPFTPVRGASAVPLVAEASVASDKALIPPGTALLAEVPVLDKTGKFTGQYRMRLMVALDVGGAIKGNHFDIYHGVGHDAGETAGFYNHYGRVWVLKKSSSGFLTANQ

SEQ ID NO: 8621 - protein, 270 aa, Xenorhabdus bovienii
  Peptide sequence Name=Xb4151_4152.C438.gene101.pep
  Gene classification: Function=Dinucleotide-utilizing enzymes involved in molybdopterin and thiamine biosynthesis family 1; Function class=H Coenzyme metabolism
  Homolog annotation: Query=1..267bp; Hit=1..267bp; Blast score=432; Percent Identity=81.0; E value=1e-121; Homolog= ygdL COG1179
MQVSLSDAYLQRFAGTARLYGQKALSLFARSHVCVVGIGGVGSWAAEALARTGIGAITLIDMDDVCITNTNRQLHALVQNVGLSKTEVIAERIRAINPECQVTCIDDFVTPDNVAELVSAEFSYVIDAIDSVRPKAALLAYCRRYKIPIVTTGGAGGQLDPAQIQVVDLAKTVQDPLAAKLKERLKSDYRVVKNGKGKLGIDCVFSTEQLVYPQSDGTVCAAKNTADGSKRMDCASGFGAATMVTATFGFIAVSHALKKMVAKAERENRL

SEQ ID NO: 8622 - protein, 152 aa, Xenorhabdus bovienii
  Peptide sequence Name=Xb4151_4152.C438.gene102.pep
  Gene classification: Function=SufE protein probably involved in Fe-S center assembly; Function class=R General function prediction only
  Homolog annotation: Query=10..139bp; Hit=7..136bp; Blast score=147; Percent Identity=58.0; E value=4e-36; Homolog= ygdK COG2166
MTSISDSILAPHPFGTEISEQQLIENFQQCQLWEDRYRQLIGLAKKLPPLADELKQQNIEMSGCENRVWLGHQLRSDGCLHFYGDSEGRIVKGLLAVLLTAVEGKTAEQVLQAPLSELFQHIGLEQQLSGSRLNGIKSLINTVQVIARSHLS

SEQ ID NO: 8623 - protein, 401 aa, Xenorhabdus bovienii
  Peptide sequence Name=Xb4151_4152.C438.gene103.pep
  Gene classification: Gene name=CsdB; Function=Selenocysteine lyase; Function class=E Amino acid transport and metabolism
  Homolog annotation: Query=1..399bp; Hit=1..399bp; Blast score=484; Percent Identity=59.0; E value=1e-137; Homolog= csdA COG0520
MKSFDSEKFRQQFPALQQQTVFLDSAATALKPICMIEATQHYYQNHSATVHRSQHASAQAMTARYEQARSLVAELINAPRPENIIWTKGTSESINLTAQGYFRPRLNVGDEIIISEQEHHSNLLPWLILAEQTGARIVKWPIGNQNRPDINTLATLLNEKSRLVAISQMSNVTGTTVDLAQVSTLAHQYDCLVLVDGAQGIVHTPVDVQRLGIDFYTFSAHKLYGPNGLGVLYGKGELLDVMSPWQGGGKMLTQVSFNGFTPEAVPYRFEAGTPNVAGVVGFAATLEWLKTVDIPLAESHAVTLTDYAEQQLSTLTGFISYRDGDASLLAFNIQGIHHNDLATLIAEQNISLRSGQHCAQPLLDALGVSGCLRASFMPYNNQQDVDKLVSAVKFALSLLEE

SEQ ID NO: 8624 - protein, 96 aa, Xenorhabdus bovienii
  Peptide sequence Name=Xb4151_4152.C438.gene104.pep
  Gene classification: Gene name=Hcp; Function=Hemolysin-coregulated protein (uncharacterized); Function class=R General function prediction only
  Homolog annotation: Query=1..66bp; Hit=48..113bp; Blast score=80; Percent Identity=54.0; E value=4e-16; Homolog= Z0248 COG3157
MTRDQNINYQPVDIRKPIDKSSPLLAQNLTNNERLTCSFHFYRTSMQGGLELYYKIKLTGATLGSVMSNNGDFVWLTCFGQSLVESAKNGVKSNCR

SEQ ID NO: 8625 - protein, 259 aa, Xenorhabdus bovienii
  Peptide sequence Name=Xb4151_4152.C438.gene105.pep
  Gene classification: Gene name=Bax; Function=Uncharacterized FlgJ -related protein; Function class=R General function prediction only
  Homolog annotation: Query=5..249bp; Hit=6..271bp; Blast score=202; Percent Identity=45.0; E value=3e-52; Homolog= Zbax COG2992
MPSLIMRTTAVFAFFLSLIFTGLSYASTSTSKMKEYSHNGIQESLPDLRQYPSGTPRKKAFLNIVVPVIDEHNQKIMQDRKWLLSHQETRHWSVQDTSRLQKICASYKMACTSPKQVNWNKLLSRVDIIPTHFVATQAAAESGWGTSELAKKNNNLFGMRCNSCGKTKGKIKGYSVYRNVDDSVIAYMKNMNTHRAYESLRTSRAKQRTAQTPLNTSKLIDNLNGYSELGAHYNRYLHQVFNGNKKLISQAQEQELTDL

SEQ ID NO: 8626 - protein, 96 aa, Xenorhabdus bovienii; identical to SEQ ID NO: 5468
  Peptide sequence Name=Xb4151_4152.C438.gene106.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 8627 - protein, 92 aa, Xenorhabdus bovienii; identical to SEQ ID NO: 6203
  Peptide sequence Name=Xb4151_4152.C438.gene107.pep

SEQ ID NO: 8628 - protein, 56 aa, Xenorhabdus bovienii; identical to SEQ ID NO: 7384
  Peptide sequence Name=Xb4151_4152.C438.gene108.pep

SEQ ID NO: 8629 - protein, 61 aa, Xenorhabdus bovienii
  Peptide sequence Name=Xb4151_4152.C438.gene109.pep
VAITAIDINFGHTSSLKSRKHITATNHLIHDLSPRCNLKSIGYRLTCQKYHLRIRNAFRTV

SEQ ID NO: 8630 - protein, 473 aa, Xenorhabdus bovienii
  Peptide sequence Name=Xb4151_4152.C438.gene110.pep
  Gene classification: Gene name=DltB (BS); Function=Predicted membrane protein involved in D-alanine export; Function class=M Cell envelope biogenesis, outer membrane
  Homolog annotation: Query=1..473bp; Hit=1..478bp; Blast score=268; Percent Identity=38.0; E value=1e-71; Homolog= NMA1478 COG1696
MNFFSFEFLGSFVILLLAYWLLQKAPKLQNGLLILVSYLFIFSFAAKFAYILFAYTLFIYFLANILSRYLSNKAIFTLLIFGIVGCFTAFKYYSFFQEAIQQSLANLGISVELPILELLMPLGLSFYAFHSVSYVMSVCKKELPPAPLIDVILYLCFFPSIVAGPINRAKDFLPQIQTSSRVMLEPFKALLLIALAIAKLFLFSSTLSENFVNPVFDDPTGYHAGQVLVAIYAYAWNIYFNFSGYTDLVTGIALLLGFKVPQNFNAPYLAENLQEFWRRWHISLSTFIRDYVYIPLGGNKKGTIRKNMNLFSAMVISGLWHGAGLSFIIWGAIHGLGLIFHNIKNSLFPSTGNRNKAQRKNPISLFLSRVMTFHFVCFAWVFFRSPTFNEALTVLNQLFSGDVLTALLSSSTLLIAFWGFFIIYPWLVDIRNTIEKNYRLMSWVYYPIPLALLLTLVFMLSPSGMPGFIYANF

SEQ ID NO: 8631 - protein, 378 aa, Xenorhabdus bovienii
  Peptide sequence Name=Xb4151_4152.C438.gene111.pep
  Gene classification: Function=Uncharacterized BCR; Function class=S Function unknown
  Homolog annotation: Query=20..367bp; Hit=11..316bp; Blast score=227; Percent Identity=36.0; E value=2e-59; Homolog= NMB1274 COG2845
MPISEFTFNLKKVGQVVFIVTLTSLLLIWLNQRSLESFWQQKYHRNSPWTTLKGEPMWDLGSNMQQGAIAASETFMAYARGIHQDNNLQAINIDATPSMILPDFQVGLNFLGGYTYSIESRYLTFPDLLQKDVRHTQSSLLRNHSPSNAVTEITPKTNVSLGKKDQVLFAGDSMMQGVAPHLKRRLYQEHGIASINLSKQSTGLAYPGFFDWPKTIGDTLRKNPDIKLVVVFLGPNDPWDMPTKRGGAYLKFASEDWENLYRQRIETILNDAHQHKVDVIWVGPPNMRQKKLSGGMAYLNKLYQAEVAKMGEIYVSVNDMFKYRSENYSDYIGDGSSTIKLRSGDGIHFSLNGQQTIANAIFSLMTFIQEPVKEDATI

SEQ ID NO: 8632 - protein, 404 aa, Xenorhabdus bovienii
  Peptide sequence Name=Xb4151_4152.C438.gene112.pep
  Gene classification: Gene name=TesA; Function=Lysophospholipase L1 and related esterases; Function class=E Amino acid transport and metabolism
  Homolog annotation: Query=51..402bp; Hit=46..390bp; Blast score=199; Percent Identity=34.0; E value=5e-51; Homolog= NMA1480 COG2755
MQPFRQFRWFYRIMGAGLVIALSVSLLSCHGKKSKPSSELQMTQIHRQKQLTNFGDPNLPLLADKLRHSNSRQLHFVQLGDSHTAADFFTGKLRSLLQNRYGDAGPGFISPISIPGQRTATVKFTDDKKNWWLSSSRKDNRADYPLGGFIATPENVSSTIRMNLSPSTFEKYGISALYQSHEATQIRMQFSQWNLPATQSEWQFSQQHSVSFPLRVDAQDTHLKIGGWLIKRQSSGIMLSALGINGATISMLDKWQPQWINTLVQLKPDMVILAYGTNEAFNDSLDLVAYQKELTSKVQEIRKVMPEVVILLVGPSDSLKNKTAASCAEQQPALLNGIIQAQQAVAKQQHTLFWNWQEFMGGSCSVRSWQQQNLARPDYVHLSAAGYERSAEALYSQIIGLIEQ

SEQ ID NO: 8633 - protein, 45 aa, Xenorhabdus bovienii
  Peptide sequence Name=Xb4151_4152.C438.gene113.pep
MADHMGWRFIPVPTGNTEGKSVSSCHSSVYPRTYGEHFVSIVKTQ

SEQ ID NO: 8634 - protein, 44 aa, Xenorhabdus bovienii
  Peptide sequence Name=Xb4151_4152.C438.gene114.pep
MAGTTEVNTGAVYPRTYGEHYILPFNFFFPVGLSPYLRGTQTHV

SEQ ID NO: 8635 - protein, 127 aa, Xenorhabdus bovienii
  Peptide sequence Name=Xb4151_4152.C438.gene115.pep
MRYPLTTFLGLSPYLRGTLEPNHQTVIRLWFIPVPTGNTRWARSKCRVRTVYPRTYGEHRNGETGCLGTDGLSPYLRGTPKSNALAIIFSRFIPVPTGNTLRTEIFSLDDPVYPRTYGEHSKYNRLF

SEQ ID NO: 8636 - protein, 36 aa, Xenorhabdus bovienii
  Peptide sequence Name=Xb4151_4152.C438.gene116.pep
MIFTQITSPSPQQTPIRFFIEKPENKYKKNGILINQ

SEQ ID NO: 8637 - protein, 446 aa, Xenorhabdus bovienii
  Peptide sequence Name=Xb4151_4152.C438.gene117.pep
  Gene classification: Gene name=GntT; Function=H+/gluconate symporter and related permeases; Function class=G Carbohydrate transport and metabolism
  Homolog annotation: Query=1..446bp; Hit=1..446bp; Blast score=548; Percent Identity=78.0; E value=1e-156; Homolog= gntU COG2610
MTTLTLVLTAVGSVLLLLFLVMKARMHAFIALILVSMGAGIFSGMPLEKITQTMQNGMSGTLGFLAVVVALGAMFGKILHETGALDQIAVKLLGSFGEKRANYALGIAGLICALPLFFDVAVVLLIGVVFAVARRTGGNVVKLAIPLFAGVAAAAAFLVPGPTPMLLASQMGADFGWMLLIGLSAAIPGMLLAGPMYGNFISKHVTLELPEDLNTPSIGKNQMPSFGFSLALVLFPLVLVGLKTIAARFVDQRSTLYQWLEFIGHPFTAILIACLVAIYGLAIRRGMSKDRVMEVCSAAIQPAGIILLVTGAGGVFKQVLVDSGVGPALGNALVGAGLPIALACFILSGAVRVIQGSATVACLTTVGLVLPVIGELGYSGAQMAALSVCIAGGSLILSHVNDSGFWLFGKFTGATEIQTLKTWTIMETILGTTGAIIGMIYFAMLS

SEQ ID NO: 8638 - protein, 179 aa, Xenorhabdus bovienii
  Peptide sequence Name=Xb4151_4152.C438.gene118.pep
  Gene classification: Gene name=GntK; Function=Gluconate kinase; Function class=P Inorganic ion transport and metabolism
  Homolog annotation: Query=14..171bp; Hit=1..158bp; Blast score=224; Percent Identity=70.0; E value=3e-59; Homolog= gntK COG3265
MSNTQQPNHVFVLMGVSGSGKSAVASGVARKLGAAFLDGDFLHPRANIIKMAQGHALNDDDRQPWLKALNDAIFAMQRTNNISLLVCSALKKNYRDMLRNGNKNLSFLYMQGDFYLIESRLKARKEHFFKPQMLISQFEVLEEPTDDEKDVHHIDIRPDLDEVIKNTMTTIDCITEGNS

SEQ ID NO: 8639 - protein, 331 aa, Xenorhabdus bovienii
  Peptide sequence Name=Xb4151_4152.C438.gene119.pep
  Gene classification: Gene name=PurR; Function=Transcriptional regulators; Function class=K Transcription
  Homolog annotation: Query=1..303bp; Hit=1..303bp; Blast score=444; Percent Identity=71.0; E value=1e-125; Homolog= gntR COG1609
MKKKRPVLQDVADLVGVTKMTVSRFLRNPDQVSEALGKRIAETLDQLGYIPNRVPDILSNSTSRTIGVLLPSLTNQVFAEVIRGIEQVTDCNGYQTMLTHYGYSAQKEEERLLSLLSYNIDGLILAERTHTPKTLKVLETAGIPVVELMDSVSPCLDIAVGIDNFEAARQMTVAMIEHGCQNVIYLGARQDERTLIRLDGYEMAMRSAGLQPRNVMTPASSSYSLGAQLLRETWQKYPDVDGLFCTNDDIAIGAIFECQRQGINVPEQIAVAGFHGHDVGQVMMPKLASVLTPRDLIGRRAAEALFARLQGQKLEQTLIDVGFTLSLGESV

SEQ ID NO: 8640 - protein, 323 aa, Xenorhabdus bovienii
  Peptide sequence Name=Xb4151_4152.C438.gene120.pep
  Gene classification: Gene name=PurR; Function=Transcriptional regulators; Function class=K Transcription
  Homolog annotation: Query=1..319bp; Hit=1..327bp; Blast score=289; Percent Identity=46.0; E value=3e-78; Homolog= VC1286 COG1609
MITLEDVASYSGVSRATVSRVVNGDNKVKAATRAKVENAIVELGYSPNLAARELASNQSNTLGLVTTSYRGGFFGALMDSIQTEAESHGKQLLVMQGRNRAENEWQAITHLHSLRCGGMILHVRAISDDKLRQLAQSGRSFVLLDRLVAGLEPRCVVFDHHKASYLATQTLVENGHIRIACVSGPLSRNPSRQRRQGFLDAMQNAGLNPVACLEGEYDLQSGYRQTRTILAKSRPDALFFCSEEMALGALLAIKELGLSVPEDISIICYDSGERAAFVYPALTSVHFPITDMACFAARLLIEPDTPPPEFTPQIIYRNSLRQG

SEQ ID NO: 8641 - protein, 436 aa, Xenorhabdus bovienii
  Peptide sequence Name=Xb4151_4152.C438.gene121.pep
  Gene classification: Gene name=CelF; Function=Alpha-galactosidases/6 -phospho-beta-glucosidases, family 4 of glycosyl hydrolases; Function class=G Carbohydrate transport and metabolism
  Homolog annotation: Query=4..435bp; Hit=6..436bp; Blast score=510; Percent Identity=58.0; E value=1e-145; Homolog= VC1284 COG1486
MKPIKIAVIGGGSSYTPELVEGIIQRSQIIPLSELALVDVEAGRHKLETIAALTRRMLDRHDLEHVTVTAHYSPDEAIKGASFVLTQLRVGQLPARAADERLGLKYGLLGQETTGVGGFAKALRTIPVLLDIAHKVERLAPEAWIINFSNPAGVVTEAVSRYSKAKIIGLCNVPISMHHMIANMLQRPYQDVQLRFAGLNHMVWVHQVLVNGRDETEQVLELLCNGAELTMNNIKEEPWPPEFLQALGAIPCPYHRYFYQTGKMLQEEKEIAASKGTRAEQVMQVERELFELYADPKLDHKPAQLSFRGGSFYSEVALELISAIHNNLGTQLVVNTENRGAIIDLPDDAVIEANCIVDAQGAHPLAFGHLPDSMSALTQQVKAFERLTIEAAVHGDRKVALLALVTHPLIGDVALDSTLLNEILEINRMYLPQFKR

SEQ ID NO: 8642 - protein, 144 aa, Xenorhabdus bovienii
  Peptide sequence Name=Xb4151_4152.C438.gene122.pep
  Gene classification: Gene name=CelC; Function=Phosphotransferase system cellobiose-specific component IIA; Function class=G Carbohydrate transport and metabolism
  Homolog annotation: Query=34..136bp; Hit=12..114bp; Blast score=87; Percent Identity=42.0; E value=5e-18; Homolog= celC COG1447
MKNSFWQKSSSRPKNSPTLRRSNNLGGCSVNMGSEQQDFEQQIVELLVHAGSARSSALMALQQAKVGDFQQAGILMEEARQETRAAHAIQTKLIGLDEGCGKLPINLITVHAQDHLMNAMVIQDLASNMIDLYQRLPPQDRQPE

SEQ ID NO: 8643 - protein, 440 aa, Xenorhabdus bovienii
  Peptide sequence Name=Xb4151_4152.C438.gene123.pep
  Gene classification: Gene name=CelB; Function=Phosphotransferase system cellobiose-specific component IIC; Function class=G Carbohydrate transport and metabolism
  Homolog annotation: Query=5..439bp; Hit=4..438bp; Blast score=418; Percent Identity=54.0; E value=1e-117; Homolog= VC1282 COG1455
MEWIMSFYTSLTRIVENHIAPIAGRIGSQRHIIAIRDGFISAMPFLIIGSIMLIVANPPFDAQTTSFLGQAWLEFAKAHWQTITMPFFMTMGLMSVFVSIGTAYSLAKSYGLDGLTSALLSLMAFLLAAAPQVDNKMPLDFLGGTGVFTALICAIWSVELIRLLKKYNISIKMPSQVPPAIARSFELLYPVVGILLTVYPVSLLLQNEFNLLLPAAVMQIFEPLIAIGDTLPAVMLVVLIANLLWFAGIHGDNIVTGLLNPIFMANIAANAALMTQGMATTQILTAPYWSFYVCIGGSGSTLVLAFLYLRSRSIHLKTIGKLSVVPAMFNINEPLLFGSPVVMNPTLLIPLLVVPLINAVLAYGALHLDLVQKMIAIAPWTAPAPVGALISAAWDYRAVVLVGLLMVIDLLIWYPFFKVYEKQLLAEEQQQAKKLADAQA

SEQ ID NO: 8644 - protein, 101 aa, Xenorhabdus bovienii
  Peptide sequence Name=Xb4151_4152.C438.gene124.pep
  Gene classification: Gene name=CelA; Function=Phosphotransferase system cellobiose-specific component IIB; Function class=G Carbohydrate transport and metabolism
  Homolog annotation: Query=1..100bp; Hit=1..100bp; Blast score=85; Percent Identity=48.0; E value=7e-18; Homolog= VC1281 COG1440
MKTILLCCAAGMSTSMLVQRMQAEAERRELEVAIKAVPALELEMYINEADVILLGPQIKYELPRFTALAEPLGKPISLIEMMDYGALRGDKVLDHALSLLE

SEQ ID NO: 8645 - protein, 72 aa, Xenorhabdus bovienii
  Peptide sequence Name=Xb4151_4152.C438.gene125.pep
MATSSSLLSASACIRCTNMLVDIPAAQHNRMVFMILFSLLLSIMISSNSKMRALSFWLRLTGYFSVAAIRFA

SEQ ID NO: 8646 - protein, 98 aa, Xenorhabdus bovienii
  Peptide sequence Name=Xb4151_4152.C438.gene126.pep
MGCLSLKAVYPRTYGEHGMALHFFDSSAGLSPYLRGTHQGLLDQRKLGRFIPVPTGNTVHALNRYSFVSVYPRTYGEHSNFIYLFYKMFFDLQNSTIF

SEQ ID NO: 8647 - protein, 37 aa, Xenorhabdus bovienii
  Peptide sequence Name=Xb4151_4152.C438.gene127.pep
MSCINWCFTAIISFIRDFGDLFGDDYQIINEVFLYLK

SEQ ID NO: 8648 - protein, 79 aa, Xenorhabdus bovienii
  Peptide sequence Name=Xb4151_4152.C438.gene128.pep
MKLMIAVKHQLIQLIDEDSLQKIKLKKQLITYYKYLMEFKHHLELLYFLTFNSFFFINIFLIKFITINKFNNILIIYFN

SEQ ID NO: 8649 - protein, 43 aa, Xenorhabdus bovienii
  Peptide sequence Name=Xb4151_4152.C438.gene129.pep
MQFFIIFYISFFFVPFVFEVLKCILYLYIKHFVYYIILTRNYF

SEQ ID NO: 8650 - protein, 202 aa, Xenorhabdus bovienii
  Peptide sequence Name=Xb4151_4152.C438.gene130.pep
  Gene classification: Gene name=AcrR; Function=Transcriptional regulator; Function class=K Transcription
  Homolog annotation: Query=5..194bp; Hit=4..194bp; Blast score=142; Percent Identity=38.0; E value=2e-34; Homolog= mlr0535 COG1309
MTRKRGRPLNFDKELALKKAMDIFWTKGFEGTQLVDLTAVMGINPPSFYAAFGSKFNLFCEAVQLYIETVGNKTVNALNDAKTTKEGLKAMLENSIINASSNEAGGCLMIMGVVNNRAENYPAWEYLREERAKTLTLIQLRIERGIMEGDLPKNTDSKTLAEYFLGITQAISFQARDGVSKNTLQRLIEPALAALPSPKTLE

SEQ ID NO: 8651 - protein, 399 aa, Xenorhabdus bovienii
  Peptide sequence Name=Xb4151_4152.C438.gene131.pep
  Gene classification: Gene name=AraJ; Function=Arabinose efflux permease; Function class=G Carbohydrate transport and metabolism
  Homolog annotation: Query=14..370bp; Hit=1..358bp; Blast score=236; Percent Identity=48.0; E value=5e-62; Homolog= PA3336 COG2814
MQNTSATDNKSETLPLAVYILAFGIFALVTSEFQVAGMIPVMASDLGVSISQIGYLVSLYALAMAVGGPLLTIGLLKIPPKFALIILYVIFTIGEVLGAIASSYHFLVVARLITGAASGAFYGVAIAICVEIVSEHKRGWAISIVLAGIMAGTILGLPMANLIGTHFGWRESFWVVSVLVVLGLIVSILWIPSLPKQQEISLKSELIALKSPRLWAVFSTSLLIIGATFSAFTYFIPILKNITGYSDGAVAVLLTVYGIATMLGNIVVGKLADRHTITILAVGLALLTIFLALFAIFAENKLISVLSLIGIGLVGVTMNPAMVTRVIRTANGRPLVNTIHSSVITLGIVIGAFLGGLGISFDLGLTSPMWVGFFMAIVGFTTLIPDLQLYHRERVKLNS

SEQ ID NO: 8652 - protein, 59 aa, Xenorhabdus bovienii
  Peptide sequence Name=Xb4151_4152.C438.gene132.pep
MVIIRGSYLFAQEVASYISDNGRIMNIGSCLGERMPAAGLTLYAMSKSAIVGLTQRISV

SEQ ID NO: 8653 - protein, 129 aa, Xenorhabdus bovienii
  Peptide sequence Name=Xb4151_4152.C438.gene133.pep
  Gene classification: Function=Predicted transposase; Function class=L DNA replication, recombination and repair
  Homolog annotation: Query=2..125bp; Hit=139..248bp; Blast score=77; Percent Identity=41.0; E value=3e-15; Homolog= mll8100 COG3293
MLTAGQAHESQSATPLLDGIGIQRKNGFMKRRGKAVLADKGYSGGKLRSYLRKLRIKRVIPYKINEKGSGDGRTQFDKLTYRNRNVVERCFGFLKGNRRIATRYEKTARNYLSMVKLGCIRLFCRRLYN

SEQ ID NO: 8654 - protein, 151 aa, Xenorhabdus bovienii
  Peptide sequence Name=Xb4151_4152.C438.gene134.pep
  Gene classification: Function=Predicted transposase; Function class=L DNA replication, recombination and repair
  Homolog annotation: Query=3..127bp; Hit=2..117bp; Blast score=102; Percent Identity=44.0; E value=2e-22; Homolog= mll8100 COG3293
MRARYDIPDEAWILIEPCLPPIHSKRAGRPHAEHRRVMNGMFWVLCSGAPWRDLPERYGPWKTVYNRLNRWSKSGIINKIFNRLLSILDEKGLIDWAEICLDGSNIRASKDAAGAKKNIPISLTLMRWVAHAVVMAPKSTWPPMERGFPST

SEQ ID NO: 8655 - protein, 73 aa, Xenorhabdus bovienii
  Peptide sequence Name=Xb4151_4152.C438.gene135.pep
MNRGQARFYQYPCLIRNVVTCPHLFPVLKTVQMIILSICIKGHALVPVCCIYRGRMWYIPRWYCCLRHFCWVW

SEQ ID NO: 8656 - protein, 65 aa, Xenorhabdus bovienii
  Peptide sequence Name=Xb4151_4152.C438.gene136.pep
MQQLTAISLQFRQKSSFLQSSLRWLKEVFDCQADSPPCSLSADDVIQNKNRFACHRTASCAINIF

SEQ ID NO: 8657 - protein, 229 aa, Xenorhabdus bovienii
  Peptide sequence Name=Xb4151_4152.C438.gene137.pep
  Gene classification: Gene name=AcrR; Function=Transcriptional regulator; Function class=K Transcription
  Homolog annotation: Query=40..228bp; Hit=12..200bp; Blast score=204; Percent Identity=59.0; E value=6e-53; Homolog= PA1226 COG1309
MIKDKRNLYTKSRLPLVSYLWYINMSSNKAHSKLANSQTRIRLTREERYQQLTAIAWQIIRNEGTEALTLGRLAEKASVTKPVVYDHFGTRSGLLAALYIEFDNRQTIIMDTAIQQSEHTLEKKAAVIASSYINCVLFQGSEIPSIIAALAGSPELEKIKREYAKIFVEKCRVILVPYTQSGKMTAASLWAMLGAAETLSYAAANGDITAIQAEIELSAIIIAMVERSL

SEQ ID NO: 8658 - protein, 203 aa, Xenorhabdus bovienii
  Peptide sequence Name=Xb4151_4152.C438.gene138.pep
  Gene classification: Gene name=MdaB; Function=Putative NADPH-quinone reductase (modulator of drug activity B); Function class=R General function prediction only
  Homolog annotation: Query=2..195bp; Hit=1..192bp; Blast score=195; Percent Identity=53.0; E value=2e-50; Homolog= PA1225 COG2249
LVHALIVISHPISDSLSGHVAQYIADGITQSNPENSVELADLAKEGFDPRFTESDIVAFYKESLPPVDVIAEQSRIALADALVLVYPVYWWTMPALLKGWIDRVFCHGWAYNEHPDGRLEKKLQHLPVHLVAIGAAGRETYLKHGFWDAMKTQIDHGIFDYCGAPVITSELLLHPELKDTNAYEEAAYDIGRHIFSMAEVSEA

SEQ ID NO: 8659 - protein, 40 aa, Xenorhabdus bovienii
  Peptide sequence Name=Xb4151_4152.C438.gene139.pep
MIKDTCCQLTSRSGGLSASTGIILLLISLIYDRKLTLILL

SEQ ID NO: 8660 - protein, 208 aa, Xenorhabdus bovienii
  Peptide sequence Name=Xb4151_4152.C438.gene140.pep
MRPTKPGISTAVLIRSHLCNGCRSTMCMRNTGISRKPGQSVRTVMKPPPSPRLCFLSDTSYWKRITAMSPARKLTTQSRTARRFCFISPIFPLSCVACCPVFTTLCAKPSVSQRLHRQHWINHCEHCGAQQDDTELFAEVGGAFFPASREQAATIQLHRIDQPFVGYCEDISHHHDRFDPKQDYHLCNACDWFASMTLIINNQSTSRH

SEQ ID NO: 8661 - protein, 91 aa, Xenorhabdus bovienii
  Peptide sequence Name=Xb4151_4152.C438.gene141.pep
MTVRTDCPGLREIPVFRMHIVERQPLHKWLRIKTAVDIPGLVGRIPVCSQLAYSRIIVSSMCCKLRGTMMFRRVRLAVVPIIFVCPARIQL

SEQ ID NO: 8662 - protein, 67 aa, Xenorhabdus bovienii
  Peptide sequence Name=Xb4151_4152.C438.gene142.pep
  Homolog annotation: Query=1..57bp; Hit=16..73bp; Blast score=78; Percent Identity=63.0; E value=2e-14; Homolog= gi|37528190|ref|NP _931535.1| Transposase, IS630 family [Photorhabdus luminescens subsp. laumondii TTO1] gi|36787627|emb|CAE16734
MHDTTRDKRVRNRIKSVLLASESWTEIIAQALRIHETTVNRHMKDYLNQENLTPENGRITIPLRSQN

SEQ ID NO: 8663 - protein, 151 aa, Xenorhabdus bovienii; identical to SEQ ID NO: 8654
  Peptide sequence Name=Xb4151_4152.C438.gene143.pep
  Gene classification: Function=Predicted transposase; Function class=L DNA replication, recombination and repair
  Homolog annotation: Query=3..127bp; Hit=2..117bp; Blast score=102; Percent Identity=44.0; E value=2e-22; Homolog= mll8100 COG3293

SEQ ID NO: 8664 - protein, 129 aa, Xenorhabdus bovienii; identical to SEQ ID NO: 8653
  Peptide sequence Name=Xb4151_4152.C438.gene144.pep
  Gene classification: Function=Predicted transposase; Function class=L DNA replication, recombination and repair
  Homolog annotation: Query=2..125bp; Hit=139..248bp; Blast score=77; Percent Identity=41.0; E value=3e-15; Homolog= mll8100 COG3293

SEQ ID NO: 8665 - protein, 35 aa, Xenorhabdus bovienii
  Peptide sequence Name=Xb4151_4152.C438.gene145.pep
MCRGNAKFCPNMSSKQYVITDKNASLLNITIRKIS

SEQ ID NO: 8666 - protein, 128 aa, Xenorhabdus bovienii
  Peptide sequence Name=Xb4151_4152.C438.gene146.pep
  Gene classification: Gene name=GloA; Function=Lactoylglutathione lyase and related lyases; Function class=E Amino acid transport and metabolism
  Homolog annotation: Query=1..128bp; Hit=6..134bp; Blast score=107; Percent Identity=44.0; E value=3e-24; Homolog= DR1341 COG0346
MVPELTVTNFPVSLDFYVQILGFNIMIRRKDPDFAYLHLGKAQLMLEAFHETGWNTAELNKPLGRGINLQIEVDDINSILNRLQINKIKLYHPLKDNNYATGDTHICQREFLVQDPDGYLLRFSQYIG

SEQ ID NO: 8667 - protein, 915 aa, Xenorhabdus bovienii
  Peptide sequence Name=Xb4151_4152.C438.gene147.pep
  Gene classification: Function=Predicted helicases; Function class=R General function prediction only
  Homolog annotation: Query=14..799bp; Hit=20..791bp; Blast score=496; Percent Identity=39.0; E value=1e-140; Homolog= ZygcB COG1203
MPMLINNFDYLIRYWGKAQKNIYSDTDYHLLAYHCLDVAAVGKYLLAPHKKITADIADFLELSKEELQNLFVFFLLLHDIGKFASAFQQLYSPKQHTELLKPQHCKPYDSKHFRHDRLGLFFWKQIQNDVLFALVGDNNLQRRDKDRAQDTLMVLMQCMLGHHGKPIDDGDDWRAIGDFTEAPNITDAKAFTNDLITLFQPRLSLEKLLSKEWKDNLKQVSWQLAGIVVMADWIGSDNAHFRYQTNPVPLAEYWQTAEQQAQIALNAIDMQYTPAISPYKSIQHYYGFSPTPLQQWAEEVPIDDSPQLFILEDVTGAGKTEAAFTLTHRLMQAGVAEGFYFGLPTMATSNAMFSRVAKHYREMFNTSGKPPSIVLAHGASKMNNAFNDIILTSQNNDSDYTKDEITATAQCHQWLADSRKKALLAPVGVGTIDQALLAVLPRKYQSLRLIGLNRKILIFDEVHAADEYMFALLENLLNLHLHQGGSVILLTATLSLKQRQKLADIWLSSAGQTPQKLRQTAFPLATKITLTPENPIIEQPLHSRSDVSREVIVKTLDSLDACVQTALNAAKKGRCVVWVRNSVDDALHAFRLIQSQMNNPEDCLLFHSRFILHDRKKIEDLVLEIFGKNSTQLHRQGKILITTQVFQESLDADADEMITDICPIDDLIQRTGRLHRHTRDAEGIYQQSISDCRPAPVLYLHAPKWDDQPQADWLSKDFRNTQYVYRSPGRLWLGLRELRRSGAIRMPAEARTLIEAVYSDDAYEHIPDTLRHKENEFIGEGHSKEAKAESQTLRWKHGYCNHSASGWYDDDSDISTRFSDIETVEILLVKLADKDALIPWANEGEFAVQLSTIRLPKNKFADKLLAVPESFSHAVEQLKSQFKSAKYLQIWLPELDPNFSYDPTIGFYEIHQQEA

SEQ ID NO: 8668 - protein, 534 aa, Xenorhabdus bovienii
  Peptide sequence Name=Xb4151_4152.C438.gene148.pep
  Homolog annotation: Query=2..531bp; Hit=1..534bp; Blast score=657; Percent Identity=59.0; E value=0; Homolog= gi|37524747|ref|NP _928091.1| hypothetical protein [Photorhabdus luminescens subsp. laumondii TTO1] gi|36784172|emb|CAE13041.1| unn
MMNLVKNAWLTFKMRDGSQKKLPLAAICDPNVMDFALPRADFQGAAYQLAIGLLQTVFAPVDKFQWHDFYEASPTQADLQTAFDRVEHAFNLSGNGPLFMQDFDSLDSVKSTTISGLLIEAPGANTLKLNTDHFIKRGQYEIISPEMAAIALFTLQINAPAGGVGHRVGLRGGGPLTTLVQPQTLDTPLWHKLWLNIVNQEYCGYPEADLHSPSVFPWLGKTKLSQPTGTEIYASDVHELYMYWAMPRRIRLQIDDKPAICQLTGQPTEQSVTRYRTQNYGNNYAGNWQHPLTPYKWNPKKANDDHLSIKGQPGGITYKLWNSLAFSRNNEGQKAALVVDHFHQICDYFAEEHSATPRLWVFGYDMDNMKARGWYSTTLPLFSIAVEKQDVIFRRARNLQTLSANALIQCRSQIKSGWFNRPNDVKGNMSFIDAAFYQRTQTAFFKAIQQIISSQQASSYLSPEEAKSWLYQLRNTCFDLFDEYVLSESVDPKTLPKKVKARHFLTQWLFGAKEIKSFMTEYQIERQQKEVINE

SEQ ID NO: 8669 - protein, 183 aa, Xenorhabdus bovienii
  Peptide sequence Name=Xb4151_4152.C438.gene149.pep
  Homolog annotation: Query=1..182bp; Hit=1..182bp; Blast score=192; Percent Identity=53.0; E value=2e-48; Homolog= gi|37524748|ref|NP _928092.1| hypothetical protein [Photorhabdus luminescens subsp. laumondii TTO1] gi|36784173|emb|CAE13042.1|
MNSLSESTLLCWWESMFLSPSELKAKGRYPAPTVYKAQLKRCQNIDTAMLTGGFRALWQNLSESDAETVDEKTIIKWAMIAMTVVHVKYNVTTTLATAAGTKTENDKPVVSELRFAQLQGAKTPDELVTRLRRTLQLINGTVSMLDLAKDIEQWVRECHQQRPRRANQRLSVQWALEYYKAAK

SEQ ID NO: 8670 - protein, 345 aa, Xenorhabdus bovienii
  Peptide sequence Name=Xb4151_4152.C438.gene150.pep
  Homolog annotation: Query=1..343bp; Hit=1..342bp; Blast score=505; Percent Identity=74.0; E value=1e-142; Homolog= Pa|Phot3-217d01.q1k _g166| 99354 - 100388 1890 344 aa, chain -
MSQFIQLHLLTSYPPANLNRDDIGRPKTARMGGVDRLRISSQSLKRHWRVSDLFQAALAGHLGFRTKRFGLEIYQQLIEADVKEKQAIEWASAIAGVFGKKKKDTPLEIEQLAHISPTEKAAVISLIKQLADENRAPTKEELSLLSKERMAVDIALFGRMLASSPAYNIEAACQVAHAISVHDVVIEDDYFTAVDDLNDGKSDTGSAHIGENGFAAALFYSYICINKTLLMENLAGNETLVNQAIAALTEAAVKISPSGKQNSFGSRAYASYVLAEKGEYQPRSLSVAFLKPINDEDQAASAIAALEKQVENFDKVYGDCADTRHSINTLTGEGSFAELIKFITN

SEQ ID NO: 8671 - protein, 250 aa, Xenorhabdus bovienii
  Peptide sequence Name=Xb4151_4152.C438.gene151.pep
  Gene classification: Function=Uncharacterized ACR; Function class=S Function unknown
  Homolog annotation: Query=1..239bp; Hit=1..234bp; Blast score=135; Percent Identity=36.0; E value=6e-32; Homolog= Z4066 COG1688
MQTYLVFRLYGVLASWGVEAVGESRPTSLHPTRSAILGLLGAALGIRRDDEMRLAELQQSVNIAIKQIVAGSLMRDYHTSQVPSQNNKQQHFTRKSELGESELNTILSSRDYRSDGLWIIAISLTDQAHLTLTTLRDALLKPVFTLSLGRKSCPLCVPTMPQITQSPCLKAALDTEFPPLTQSEKADHYWLGDSGIVSYFWEGDKNEIEIPDVAVLTSQLWDEPLSRTRWQFTQRTMHQLSLMEKAHVPV

SEQ ID NO: 8672 - protein, 224 aa, Xenorhabdus bovienii
  Peptide sequence Name=Xb4151_4152.C438.gene152.pep
  Homolog annotation: Query=1..224bp; Hit=26..249bp; Blast score=253; Percent Identity=57.0; E value=1e-66; Homolog= Pa|Phot3-217d01.q1k _g164| 97935 - 98684 2703 249 aa, chain -
MYLSKVTLRPSAYREQFLSKMAKNSVYSSHQLLWQLFTEQVERNFLFREDIGINGTPEFFVLSHTAPIPNSAMFQIQSKAFTPQLRSGQKLAFKLRLNPTICITDKDSGKQRRHDVLMNAKRQAQLAGASTDEIQPLMMQAVQAWIQDEKRLTSWGIQFDFDPDVERYTQHRCRKSSGQKVAFSSVDFQGVLTLSDHKLFLAQYAKGFGRAKSFGCGMMLIRTL

SEQ ID NO: 8673 - protein, 306 aa, Xenorhabdus bovienii
  Peptide sequence Name=Xb4151_4152.C438.gene153.pep
  Gene classification: Function=Uncharacterized ACR; Function class=S Function unknown
  Homolog annotation: Query=1..305bp; Hit=1..304bp; Blast score=459; Percent Identity=75.0; E value=1e-129; Homolog= ygbT COG1518
MAFIPLKPIPIKNRNSMIFIGMGRIDVKDNAFVVIDEVNGERMHIPVGSIVCIMLEPGTRVSHEAVKLASATGTLLIWVGEAGVRLYSVGQPGGARSDKLLYQAKLALDEELRLKVVRKMFELRFGEPAPQKRSVEQLRGIEGARVRKTYQILAKQYGVQWHGRNYDHTDWDKGDLINRCISAATSCLYGVTEAAILAAGYAPAIGFLHTGKPLSFVYDIADILKFGTVVPIAFKVAATNRIAPDRQVRIACREKFRTDRILKRLIPLIEEVLAAGEISPPPPPDDAQPPAIPEPLSIGDIGHRSR

SEQ ID NO: 8674 - protein, 120 aa, Xenorhabdus bovienii
  Peptide sequence Name=Xb4151_4152.C438.gene154.pep
  Homolog annotation: Query=20..117bp; Hit=19..116bp; Blast score=152; Percent Identity=75.0; E value=1e-36; Homolog= gi|16130661|ref|NP _417234.1| hypothetical protein [Escherichia coli K12] gi|7466545|pir||F65056 hypothetical protein (iap 3'
MMPNLPPSPNRSPSAILVTGADNMSITIVVTEAVPPRLRGRLAIWLLEIRAGVYVGDVSQKIREMIWEQITELTEAGNAVMAWGTNTESGFDFQTFGENRREPIDFDGLRLVKFKPLPEG

SEQ ID NO: 8675 - protein, 43 aa, Xenorhabdus bovienii
  Peptide sequence Name=Xb4151_4152.C438.gene155.pep
MTWRESPVYPRTYGEHTIRVKMYTFEPVYPRTYGEHSKYNHLF

SEQ ID NO: 8676 - protein, 98 aa, Xenorhabdus bovienii
  Peptide sequence Name=Xb4151_4152.C438.gene156.pep
MTSLSHSESCYYGKICSAVGLSPYLRGTLRPREVCSHCRRFIPVPTGNTISIPVFNPALPVYPRTYGEHDNKLSAGRSIDGLSPYLRGTHWLILMSPI

SEQ ID NO: 8677 - protein, 339 aa, Xenorhabdus bovienii
  Peptide sequence Name=Xb4151_4152.C438.gene157.pep
  Homolog annotation: Query=1..339bp; Hit=1..327bp; Blast score=426; Percent Identity=62.0; E value=1e-118; Homolog= Pa|Phot4-330f06.p1k _g23| 34279 - 35262 579 327 aa, chain +
MTLTNFSKLLAATLCLATSYSYADGERPLFSLTMAESGVSQTNNDGSLSHSTKSESRILPIWGDEARAKGYDLPEPFGASYGYMNLRQDIIIDSIKFQFTNPLVDKSFRNLIAVNAGDTREKNESHMLKLDTWVLPFINVYGVYGKTKGTSKTNLDSIYFMDMEDPWLKNIPFELNFEGKTYGGGATFAGSYNQFFATLDANYTRTTLDILDGDISALVITPRVGYEFVFEPLFTGQGNTKVQVWVGAMYQDITQRFKGDVSKLNLPSDLADLFGSLTNNTADNGKYKSDIKFDVEQHLAHKWNNTVGARFEITRNFNILSEVGFGNRNSLFVSGEFRF

SEQ ID NO: 8678 - protein, 383 aa, Xenorhabdus bovienii
  Peptide sequence Name=Xb4151_4152.C438.gene158.pep
  Homolog annotation: Query=6..383bp; Hit=6..381bp; Blast score=517; Percent Identity=67.0; E value=1e-145; Homolog= gi|37524518|ref|NP _927862.1| hypothetical protein [Photorhabdus luminescens subsp. laumondii TTO1] gi|36783942|emb|CAE12804.1
MFGYKTIKRLVISSLLIFSVSSAQADILPNRQKIDGWLSELGGSNQLDASKKVDWGVLPGPFYTPEMGMGVGVAVVGLYRPDNSDHTSQTSSLGLSGFASSTGAFGLNFTNYNFLARDQWRLFVSGTLNNTPTYYWGKGYDAGKNNGNKEKYRAQEFDIRPRLLYRVTDATYMGLGWHFSSLNASDPDIGAAKYFAQSVGGRSVTSSGVSAYFSYDTRDFLPNAKHGQAFEIVYTYFSPELGGDNRFNTTQLQFSTYHQLSEKSVLAFDNYARFSSGDVPWNQLSLLGSSQRMRGYYEGRYRDTNILTSQLELRHKLDWRHGIVGWIGTGTLSDSPSKLGAKHWLPSIGVGYRFEFKPRMNVRLDFGVGKDSTGFYFQVGEAF

SEQ ID NO: 8679 - protein, 356 aa, Xenorhabdus bovienii
  Peptide sequence Name=Xb4151_4152.C438.gene159.pep
  Homolog annotation: Query=2..346bp; Hit=25..369bp; Blast score=427; Percent Identity=59.0; E value=1e-118; Homolog= gi|37524517|ref|NP _927861.1| hypothetical protein [Photorhabdus luminescens subsp. laumondii TTO1] gi|36783941|emb|CAE12803.
MPVEPVLISDTQEQPEIDWPVLTPIEPPEGLRACCAFGYDLKTEVVGIPVPFYDIDNIVEAEKLGEHHYNDSALGASAALLGISNEKIGLLYTQKGGFIDISHVRDTADYTLYLFSQIYAHLGQERKLSLSNELAARKIHFFAFTPPVDPVERYTLSAYLAAKLAFQLAAWHEIAQWYGYQSVPGFPEGISAFSPEDLYSNLLGARLALTLILQGHASSVTQFTTSMAAILPSALHKLEPYSKSDTKKMFNQVDGLWWNSHERIPQKFLVLRRNYEIQDNRYPLMPSGKEKFARRLSLPDEYKPFSLDKLAELQLWPTEQMKNLPVPNSYWTVKDFNALAEHAQHEDARQLLLSSK

SEQ ID NO: 8680 - protein, 176 aa, Xenorhabdus bovienii
  Peptide sequence Name=Xb4151_4152.C438.gene160.pep
  Homolog annotation: Query=20..165bp; Hit=1..145bp; Blast score=167; Percent Identity=61.0; E value=8e-41; Homolog= gi|17546540|ref|NP _519942.1| TRANSCRIPTION REGULATOR PROTEIN [Ralstonia solanacearum] gi|17428838|emb|CAD15523.1| TRANSCRIPTI
MNLLESEDKTSRNRKVVETMPDSKVFVDNYLPALLGQAWMLVSSEFHDIVEARGLSVLEWRVLSALAGSGPIGISLLAQKTVSKQPTITRVLQRLELQGHVTRFSNGRGDRRITLVHLTDSGQQVVVGLLAEAESHEKNILEPLGSGKSQLLKEVLQELIKRHTPMRRALGRFGKE

SEQ ID NO: 8681 - protein, 37 aa, Xenorhabdus bovienii
  Peptide sequence Name=Xb4151_4152.C438.gene161.pep
MQPKLFQYHAGYRNRWGDNRRETLQRGIQSPLWSDAE

SEQ ID NO: 8682 - protein, 31 aa, Xenorhabdus bovienii
  Peptide sequence Name=Xb4151_4152.C438.gene162.pep
MASQPRCNEINVMSNVAHAITMGCVKFCHIN

SEQ ID NO: 8683 - protein, 395 aa, Xenorhabdus bovienii
  Peptide sequence Name=Xb4151_4152.C438.gene163.pep
  Gene classification: Gene name=AraJ; Function=Arabinose efflux permease; Function class=G Carbohydrate transport and metabolism
  Homolog annotation: Query=8..392bp; Hit=59..443bp; Blast score=274; Percent Identity=47.0; E value=1e-73; Homolog= XF1728 COG2814
VRSTTSHTGETNALPLASLLALAMTGFLALMTETVPAGMLAQISMGLNISESMAGQFVTLYAIGSVIAAIPLTTATQSWRRRPLLLVVLGALFVFNTLTILTSNYTFALIARLFAGMAGGLIWGMLAGYARRMASEPLKGRALAIAGVGAPLALSLGVPLGAFLGSLIGWRMTFGLLSLLTLAVMVWIRLRVPDYPGQSSEKRLSISSVFATPGVRPVLTVLIFWVLAHSILYTYIMPFLAPAGLSHRVDIILLIFGASSVLGIWLIGVLIDKYLRSLVLISIGLFALVALALGLAGILPAVIYISMAIWGLTFGGAAALLQTASADAAGSGADVAQSILVTVWNLSIAAGGMLGGILLDTQGVHIFPWTLLGLLVVGLIIAWGAKKHGFPATLQ

SEQ ID NO: 8684 - protein, 323 aa, Xenorhabdus bovienii
  Peptide sequence Name=Xb4151_4152.C438.gene164.pep
  Gene classification: Gene name=LysR; Function=Transcriptional regulator; Function class=K Transcription
  Homolog annotation: Query=28..315bp; Hit=1..288bp; Blast score=301; Percent Identity=50.0; E value=6e-82; Homolog= PA2316 COG0583
MKAHISIKNRLQFKIYMTNMSSIGKRIMDNFSVLEVFVRVSEVRSFTAAGNQLGVSSSAISKAISRLEEKLRVRLFHRSTRTVTLTPEGTLFLKRCRRILNEIEAAENELSQSQSVPSGKLKVSMPSIGVLFMPKFAEFSQQYPEIELEIDSTDGLVDLIEEGFDAVIRTGEPADSRLMARVLGSYKRVIVGSPTYFQKFEIPKKPEELINHFCMMYRYKSTGKLDIWPINQDNPTLQLEWPTRMVTNTLDPLVSFAENSLGITCIPDLAIREQLKTGKLITILNDFNNDITTCRILWPSSKYLSPKLRVFINFMVENLFKNE

SEQ ID NO: 8685 - protein, 569 aa, Xenorhabdus bovienii
  Peptide sequence Name=Xb4151_4152.C438.gene165.pep
  Gene classification: Gene name=Fmt; Function=Methionyl-tRNA formyltransferase; Function class=J Translation, ribosomal structure and biogenesis
  Homolog annotation: Query=73..224bp; Hit=79..227bp; Blast score=78; Percent Identity=36.0; E value=2e-14; Homolog= PA3554_1 COG0223
MKTMESSENYTFVIIGQGTLAVRCCQFLLSIGIHLEVVMPLDSVFLLWAKKEGLKCINTIQDLESLVSNNSVEWLFSISNPIILTSALLDNIKLGAFNYHDAPLPKYAGTHATSWALFAMEDKYAVTWHRIATVVDAGDIAVQQNVEINRSDTALSLNMKCYNAAFEGFKKLISLIKGGKSIEYVKQNVSERSFFSSRKRPYAGACLQWAHSAEELSALVRGLSFGERYRNPLCVPKVYLINIIGIVKTLEVLSVSTHKQAGILVDIAQNFWIVTTGTTDIRIEFIQLTGEDLRADFLADMLCISVGDSLPIINNSDLEDLTQEHEELAPYESFWVNRLESFRPLNFKFDTLYHDLDCIFEIYYNWNLYIDIENVTSEERLVNILGAFAVYLALVNDVQYFHLDCATELPKHEVIDYSIFFSASVPFEFNIDFNCSALDLYSSISVERSILNKFKTFHKDIICRYPQLRSTESLYSKYICNVRISIIDFINSEVKPAVYQLYEKNNASLTMQIDPVKGAFRWISNSSHIENADLKRMADHIISLDRLLLSNPNLPLKSLLSQCGTLGII

SEQ ID NO: 8686 - protein, 334 aa, Xenorhabdus bovienii
  Peptide sequence Name=Xb4151_4152.C438.gene166.pep
  Gene classification: Function=Thioesterase domains of type I polyketide synthases or non-ribosomal peptide synthetases; Function class=Q Secondary metabolites biosynthesis, transport and catabolism
  Homolog annotation: Query=84..175bp; Hit=17..105bp; Blast score=67; Percent Identity=40.0; E value=3e-11; Homolog= BS_pksR_3 COG3319
MPEKNSISVYDDFFSLGGDSLSAVDIIQSINNRLGSNLPLHALFEASTIEKLACLVDVNSNKYAERLVSLQPHGALSSIFCWPGLGGYPMSLRLLAEKLGKARPFYGIQAFGLNEDERPYGSIQKLVHADITAIRNKQPRGPYVLWGYSFGTILAFEAAYQLEQLGEKVEELVLIAPGMTKGHSLQLQSSDKSSGYENKSLVSLLFSVFSRSSDDQDLLEYLDYVNDEDDFASLISKRHSGLSLDLIKRISRVVITTSESLSSESESIFHNRLITAPVKIFSAKGDQLSYFETNSNCFINIPDVAQINVPHFELLKEPGINELLSRMRMLINWM

SEQ ID NO: 8687 - protein, 619 aa, Xenorhabdus bovienii
  Peptide sequence Name=Xb4151_4152.C438.gene167.pep
  Gene classification: Gene name=EntF; Function=Non-ribosomal peptide synthetase modules and related proteins; Function class=Q Secondary metabolites biosynthesis, transport and catabolism
  Homolog annotation: Query=52..601bp; Hit=506..1029bp; Blast score =274; Percent Identity=30.0; E value=2e-73; Homolog= PA2402_1 COG1020
MHSVTQNKSWERLLNINGFELDIRELVELKNSLSYDKISISWSTSGQEERFEYAIDQCLPGLFLSSVRHIPDNVAIVDGDDKLCFWQLAHLSLHVANYLRYLNCSIDECIGLFVEPSLEQLIGVWGIIFSGAAYLALAPDYPPERLKYMIENSSMKYIFVQEKVKFKILDIISSDITLITISDVIDYVKMSAKTKSVSKPRELKPENLAYIVYTSGSTGKPKGVMIEHRSIVNQMLWLNKKGFLSRDKKIIHKTSISFDAAQWEMLSVCCGTQLVISDFSINKNISKLIDDIIKNNVSLLQCVPTLLQSLVNRHKFAKCSSLSHILCGGESLTKKLALQCLDTLPNCELINVYGPTEFTCNASFYNVSIGIKKEHHEGVSIGRPVDNTEFHILDENGRSVSSGNSGELYISGIQIARGYFNQENLTNKHFFSFIPTGSNTPIMSYKTGDLAYQSMDGSFYFIGRKDNQIKIRGMRVELEEIKIELESLPLINVAAVMNKYHDVSQSILIACVELSTEGVILKENHDHQELVSILKKELARRIPDYMIPTLFVFVDVMPLTITGKIDFNKIEKIFGKESLKEKSEPKSINERVIQSIWMECLKKIVFLFMMTSFLLVVIH

SEQ ID NO: 8688 - protein, 266 aa, Xenorhabdus bovienii
  Peptide sequence Name=Xb4151_4152.C438.gene168.pep
  Gene classification: Gene name=AsnB; Function=Asparagine synthase (glutamine-hydrolyzing); Function class=E Amino acid transport and metabolism
  Homolog annotation: Query=9..196bp; Hit=285..487bp; Blast score=98; Percent Identity=31.0; E value=8e-21; Homolog= YPR145w COG0367
LALANKYHSNVTAISFGLPGSDDIKISKKFCEENKIRQIIYTFTEQDLIDDIDSAVYYGEFFEKIDSVDSIIANFGYFIANKLGFKVALCGEGSDEIFCGYDLFKTYPSIDELSLYRLNNLHRTDLQRVDRASMRNSVEARVPFMNNQVVRYALSLHESLKINNGVEKYILREAFRDFLPDYIIDRPKIRMPDGSGVKNILIDYVNSVDLQIPKDVLRMLESIGLNDKSSFHFANKYLNNGYHLPDERFKKLGKDYTASGYFDFIS

SEQ ID NO: 8689 - protein, 96 aa, Xenorhabdus bovienii; identical to SEQ ID NO: 5468
  Peptide sequence Name=Xb4151_4152.C438.gene169.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 8690 - protein, 92 aa, Xenorhabdus bovienii; identical to SEQ ID NO: 6203
  Peptide sequence Name=Xb4151_4152.C438.gene170.pep

SEQ ID NO: 8691 - protein, 56 aa, Xenorhabdus bovienii; identical to SEQ ID NO: 7384
  Peptide sequence Name=Xb4151_4152.C438.gene171.pep

SEQ ID NO: 8692 - protein, 137 aa, Xenorhabdus bovienii
  Peptide sequence Name=Xb4151_4152.C438.gene172.pep
MYVSQKWDVAEEYAMALVTLDPYWSVNYQELAEVYLKQNKYTKALEQYQNAKQAGLPRVTFTEYMIGVCHEHLGDHQEAINSFKNVLTMDETNISAGLSGYNISSKYDLESKEYFREFINRWDEQGFLTPMHKEMIV

SEQ ID NO: 8693 - protein, 137 aa, Xenorhabdus bovienii
  Peptide sequence Name=Xb4151_4152.C438.gene173.pep
MNKITSINVTRFDHIQMEVANLDESIRFYEEVFGFKKKEAGLRRMVRWVILGNESKLYLCLHEYAERTGIENSGLEITHVGFIVDNFDSVLQKLKSHNVKLPDGDIIQYHSSRSIYFLDPNGYKIEISEFNGGGIDP

SEQ ID NO: 8694 - protein, 351 aa, Xenorhabdus bovienii
  Peptide sequence Name=Xb4151_4152.C438.gene174.pep
  Homolog annotation: Query=68..320bp; Hit=62..310bp; Blast score=125; Percent Identity=30.0; E value=1e-27; Homolog= gi|37526107|ref|NP _929451.1| hypothetical protein [Photorhabdus luminescens subsp. laumondii TTO1] gi|36785537|emb|CAE14486.
MFLLEVMIMLSEENEIFKSISERSNKEIYSQCVIQLDEYRARKVMSELSNGFTQSFDGKMGHKPVESELRKLITEIYERVKSGNGIVLLKGISITEINEIELGERFLRLCSLMGKPVSQSVMGDTLGRVEDMTHIDPDARGYRNREELFMHTDQPDMVCMLCVRQAKHGGDSKFASAVALHEAIKQTRLDLLSALYTGYPYHRLNEHPPGASEITEHNVPVFSEYNGELSIRYLRFNMFAAAFARNEKVPPLLQKAVNYLDELATSHYFCWITSLEKGDILFFNNYLFLHSRTAFEDNEDPVKKRLMYRVWLACDNFRSIRSELAVHPEGAGGRGGITPQHGKRPRFDYDL

SEQ ID NO: 8695 - protein, 322 aa, Xenorhabdus bovienii
  Peptide sequence Name=Xb4151_4152.C438.gene175.pep
  Gene classification: Gene name=Tas; Function=Predicted oxidoreductases (related to aryl-alcohol dehydrogenases); Function class=C Energy production and conversion
  Homolog annotation: Query=5..320bp; Hit=1..313bp; Blast score=226; Percent Identity=41.0; E value=3e-59; Homolog= mll8386 COG0667
MITYMKYKTLGNSGAYVSTICLGTQQFGRWVDERSAREILNIFTEYGGNFIDTADCYPIYLSDGSDGGELSESFIGRWLKSYSRRDDLIIATKFSAPMGDNPNNKGVSRKYIIRAVEQSLKRLKTDYIDLYQVHDDYFDVPMEETLSALDDLVRRGLVRYIGCSNFAAWRIMKSLSLCEKRGYVPYVTVQEKYNLLEKDEYESELMGLCQEEGIGMLPYVPLAKGFLTGKYHRGSINNGFFREKDVRTLYDNERNWEVLYLIQEIAEKNEITCTQVALAWLLQRPSVVAPVVGVNSIKQLKIVLASVDVSLCSTDIEELDRL

SEQ ID NO: 8696 - protein, 311 aa, Xenorhabdus bovienii
  Peptide sequence Name=Xb4151_4152.C438.gene176.pep
LTDSRNIQEKGGCVAIALIDHCYSILPTGNRQQAISLLNRSGFLVSSERIQHDGGKESIFIHFTGSYLELIEIIDLNQFESSCTVTELRASKFGYPYALVAATGKIKNCANKLKKFYQDVADIRYVIPNMQGWEKAAWAILNIPEHYTPGCYFQFIQYLLRKPSWAEINYGQNNIYGVCGFYFCTNTPIEDREHWYNFFSLIGDCYKFEGKTLSIGIQQIYWLHPDEFYAYFGVEPNLDESQGARLSAVKLLSSDIEVSFNYLKKGGFLIEGYTEQGFYTKIDPSLGYALHIVKGNGAFDYAEDINRRLLE

SEQ ID NO: 8697 - protein, 291 aa, Xenorhabdus bovienii
  Peptide sequence Name=Xb4151_4152.C438.gene177.pep
  Homolog annotation: Query=93..262bp; Hit=129..286bp; Blast score=83; Percent Identity=27.0; E value=5e-15; Homolog= gi|23053761|ref|ZP _00079954.1| COG2159: Predicted metal-dependent hydrolase of the TIM -barrel fold [Geobacter metallireducen
MKDFDINVFDAHVHTEFEGAPDHFSGIISSLDSFKESINGINFVGALSDSAVPSQNHGDLSEYGIYHCAVIRDLNYKIDIIEKNILSGKIYAIKINVGFIHRYASDEFFQPLYILAEKLKVPIMFHSGDPGWSHAKVKYADPISFDEIAVDYPGVNFVLVHAGNPWFQSAAVVAAKNANVFLEGSSLIDGDTKACSDERAKRLISKPLSWIIDYLGSSEKLIFGSGWPMVYLKSYLDLFRQGVPEEAWKDVFCDNALKLYGFVIEKRSDGQLICVPKYKRKDSNNVHYSSK

SEQ ID NO: 8698 - protein, 331 aa, Xenorhabdus bovienii
  Peptide sequence Name=Xb4151_4152.C438.gene178.pep
  Gene classification: Gene name=CcmA; Function=ABC-type multidrug transport system, ATPase component; Function class=Q Secondary metabolites biosynthesis, transport and catabolism
  Homolog annotation: Query=4..326bp; Hit=10..333bp; Blast score=314; Percent Identity=47.0; E value=7e-86; Homolog= DR1581 COG1131
MSIIQVNNLCKSYEVYTKNPGLLGSLKSFIKREYAIVEAVKSINFSIDKGEIVGFLGANGAGKTTTMKMLTGIIKPSSGHIQVLGYTPYERKNEYLKSITFVAGQKQQLAWDLTPNDSFILHKVIYSINEKEFLNYRDELVEMLSLNSVIDRPVRHLSLGERMKCELALSLLHKPSVLFLDEPTIGLDVNMQRSVREFIAHYNQINNATILLTSHYMADVEALAKRVIIINSGGIVYDGKLSHLIKKRSPKKILKATISGLIKPELRSLINSSSDDGQSIELIVERDLLPSVVAKLMEEKIILDISIHDEPIEKVLGRYLSSYGETDVEAS

SEQ ID NO: 8699 - protein, 287 aa, Xenorhabdus bovienii
  Peptide sequence Name=Xb4151_4152.C438.gene179.pep
  Gene classification: Function=ABC-type multidrug transport system, permease component; Function class=R General function prediction only
  Homolog annotation: Query=25..287bp; Hit=6..267bp; Blast score=125; Percent Identity=35.0; E value=6e-29; Homolog= DR1582 COG0842
MMSLLKRFWEDIYLHMVKLMLKQVRRSLLLWWVLIGQSFSRVIAYRAQSIIWLLGGIMPIAVMFVWLGLAKEGEIGSYTASDFAVYFLSIYLVRQLTAIWVMRRLDRDIRRGELSMLLLRPVSPLYNYVSDHVGEMMVRGPIISLVFILGILLTGNLHRLDIRNLLIFIPALALAWIIIFHLYYCLGLLAFWISNSMAFDPLLWALYTILGGVLIPLDLYPENVASWLKLLPFASALDFPVQIILGKLDGLLLLIGFGVQLFWVILLTCIRVLLWNAGLKRYSASGA

SEQ ID NO: 8700 - protein, 260 aa, Xenorhabdus bovienii
  Peptide sequence Name=Xb4151_4152.C438.gene180.pep
  Gene classification: Function=Predicted membrane protein; Function class=S Function unknown
  Homolog annotation: Query=2..260bp; Hit=3..262bp; Blast score=112; Percent Identity=29.0; E value=4e-25; Homolog= DR1583 COG3694
MRYISLFLVLLRHSFLLEFEFRFNALVNLINSSLSCLLALLVLTGFFGQVSQVGGWTYYQMVALLGVTLIIESLIDSWLFPSVHSLSEYIRRGDLDQIIIRPVDTQFFVSFHRFNIWDGANFIVGYVVVLLAMSQQDALTIWNFLQFNFALLLGACVFYSLFMCSNLLAFWFTKVSDVWIICYSLMDVGRFPVSAYPGALRFLLSFLLPVFFVSNVPAQAALGIMSMETLLLAFVYAIGALILTRFFWLKAISKYSSSSS

SEQ ID NO: 8701 - protein, 36 aa, Xenorhabdus bovienii
  Peptide sequence Name=Xb4151_4152.C438.gene181.pep
VIRSGSERTLFDFISGSGKSVYCIIDYNKNADNFID

SEQ ID NO: 8702 - protein, 105 aa, Xenorhabdus bovienii
  Peptide sequence Name=Xb4151_4152.C438.gene182.pep
MKSKRVLSEPERITLQQLALNHPHRDVRTRGTGLLMLTRGLKPRQIAVETGCSVRVIYNWVHTWHDFGIAGLLGGHAGGRYPAMTSEMIATAVEIACSESLTLSR

SEQ ID NO: 8703 - protein, 89 aa, Xenorhabdus bovienii
  Peptide sequence Name=Xb4151_4152.C438.gene183.pep
MSGNGLPALPPVPKNLSRSPGLCDLIPSDKTDCCPCHSTHQARNVCNSFEARFHGIFPVDSTHIAPEETRQDRIHQNKPNGSGLIVHRP

SEQ ID NO: 8704 - protein, 163 aa, Xenorhabdus bovienii
  Peptide sequence Name=Xb4151_4152.C438.gene184.pep
  Gene classification: Function=Predicted transposase; Function class=L DNA replication, recombination and repair
  Homolog annotation: Query=1..129bp; Hit=21..146bp; Blast score=65; Percent Identity=35.0; E value=2e-11; Homolog= DRB0120_2 COG3335
LVYFDESGLAASPPVQYGWSPRGKSHETEPQNYCRRSVLGALNDTDNSLFYQTVSGHITRANVIDFLAQVAKQGDHCLTFLVLDNARIHLGIETKIKVEWLREHNMFLLYLPAYSPELNLIEIVWKQAKYHWRRFITWTKETMEEEPNTLLGGYGNKFAINFS

SEQ ID NO: 8705 - protein, 42 aa, Xenorhabdus bovienii
  Peptide sequence Name=Xb4151_4152.C438.gene185.pep
VVALTHSSHIVAYASGDPFTCCRATSCKLLDIYMNNIKKIYK

SEQ ID NO: 8706 - protein, 490 aa, Xenorhabdus bovienii
  Peptide sequence Name=Xb4151_4152.C438.gene186.pep
  Gene classification: Function=Zn-dependent carboxypeptidases; Function class=E Amino acid transport and metabolism
  Homolog annotation: Query=8..488bp; Hit=3..491bp; Blast score=282; Percent Identity=32.0; E value=5e-76; Homolog= mlr3932 COG2317
MRCKMKYYKKLEKLMEKWNSLYGASMVLHWDKRTMMPIRSHLLRSEQISLLSTMQHEILASQEITELLNCIDITQLNDWQKANMREIYRLHTMATQIPENLVNRLTQATMKCEKVWHLQANQTDQQALEKSFEELITLTREMAYSFGDSLNISAYDALLEQHQPGLRDHFILPIFNQIESFTANFTSIRNRLPKEKNNWPIIPKYQQQKFAKKLMLEMKFDFRTGRLDESVHPFTGGISGDIRVCSYFKPDNIILSISAIMHEMGHASYESRLPRQFRGQPVGDSRGMCIHEGIALLFEKKIGHSSEYLEYLSKKLNKQFGYLNYFSKEKLLHHFNTVRRSGIRVSADDFTYPAHILIRYKIEKELISGELSVKNLNNRWRDLYNLYLGIAPSLHEGPWQDIHWAAGYFGYFPCYLIGNVISSQLFNKAEKEFSIKNEISQGKFDKIQKWLSEKIYKKSSYYEFEDLILSSCGKSLSADDFINNLKERLH

SEQ ID NO: 8707 - protein, 381 aa, Xenorhabdus bovienii
  Peptide sequence Name=Xb4151_4152.C438.gene187.pep
  Gene classification: Function=Uncharacterized proteins of WD40-like repeat family; Function class=S Function unknown
  Homolog annotation: Query=62..300bp; Hit=108..339bp; Blast score=84; Percent Identity=29.0; E value=2e-16; Homolog= MTH1485 COG1520
MTYNLNIFNLHLKNTWYKNKQSLRSIKKKWSTIRYNYTEPPKICGEINLNERIWSIPGYIGNNKFIISCYDGYIYCYHLKTFQKIWQLKTNGPIYSSPAVTRNGDFIIGGEDATLRMISAHGHCLWQFNAYDAFHSTPTIDEKNGIVYAGSYDHSMYAININNGELIWKRDFEKNIIDDIYSSPALTSEGNIIFGTNKILICIDKFGTTIWEVANEGRFEGSAALDYSINTGIIGTEENGQIIIFDIITGRIRTIHQTGGFIVSCPSIGYQHIATIGSDDKNIYGIDLITTDILWKYYVGTRFVYTPFSSLPNGDPIFVGTTDDPNHFAESVHCHNHKNGEFRWKITAPTGIHSAPLITEEGYLIIGSHWNKVYIYQWDEV

SEQ ID NO: 8708 - protein, 223 aa, Xenorhabdus bovienii
  Peptide sequence Name=Xb4151_4152.C438.gene188.pep
  Gene classification: Function=Predicted flavoprotein; Function class =R General function prediction only
  Homolog annotation: Query=1..221bp; Hit=1..214bp; Blast score=269; Percent Identity=62.0; E value=2e-72; Homolog= PA2280 COG0431
MTNILPNLAHALPDIISLDLLDKQQDFSHKARILLLYGSNRTPSFSRLLVQEAALLLNSLGAETRIFDPFYLPLPDTTADSHNKVVELQQLMQWSEGQVWCSPEHHGSISAVFKSQLDWVTLETNLSCPTQGKTLAVLQVNGGGQSFNVVNQLRTIGRYMRMFTIPNHLSVSQAFLEFEETGRMRTSSYYDRLIDVMEELLKFTLTLRDKRQYFLDRYSERHK

SEQ ID NO: 8709 - protein, 39 aa, Xenorhabdus bovienii
  Peptide sequence Name=Xb4151_4152.C438.gene189.pep
MAVVTIVELKGSLAAFAIVAREASLTCSVFAYIKRVYLI

SEQ ID NO: 8710 - protein, 93 aa, Xenorhabdus bovienii
  Peptide sequence Name=Xb4151_4152.C438.gene190.pep
MGDDLFPFRIKSIPKPMTLFFIAYKKPLLIQFTDKCDIVISDLSRCYLFWREFFNVRITVLIPRPNTRPVSLPPEPFIAISTIFSFIPGLWPL

SEQ ID NO: 8711 - protein, 56 aa, Xenorhabdus bovienii
  Peptide sequence Name=Xb4151_4152.C438.gene191.pep
MLLIRKGNKSSPMSLAPERMQPAENCSTYWCLLIFVSSRPITGEAMPEKWCRKNIW

SEQ ID NO: 8712 - protein, 31 aa, Xenorhabdus bovienii
  Peptide sequence Name=Xb4151_4152.C438.gene192.pep
MEIHEKLIGTYILKNIITTLWVMTKYSNSCR

SEQ ID NO: 8713 - protein, 82 aa, Xenorhabdus bovienii
  Peptide sequence Name=Xb4151_4152.C438.gene193.pep
  Homolog annotation: Query=1..70bp; Hit=171..240bp; Blast score=87; Percent Identity=54.0; E value=5e-17; Homolog= gi|7328117|emb|CAB82577.1| hypothetical protein [Klebsiella pneumoniae]
MDVAGTQTKITEMILAKLADYLLAVKENQPSLSAEVTTQFQTFWHNTPEDIVGLGFYEEFDTQYGSKDHRSLIRASCERKGI

SEQ ID NO: 8714 - protein, 75 aa, Xenorhabdus bovienii
  Peptide sequence Name=Xb4151_4152.C438.gene194.pep
  Homolog annotation: Query=2..75bp; Hit=300..373bp; Blast score=114; Percent Identity=72.0; E value=5e-25; Homolog= gi|7328117|emb|CAB82577.1| hypothetical protein [Klebsiella pneumoniae]
MHWFVENQLHWILDIAFREDQLQARMGYAGKNLALIRKWILNMLKQNTSRKLSLENKRRLCCLSDDYLLESFGCF

SEQ ID NO: 8715 - protein, 113 aa, Xenorhabdus bovienii
  Peptide sequence Name=Xb4151_4152.C438.gene195.pep
MKDPIRNASLSAVKVASEIAYNYVSEVRNQRVFPDSDALSGLQNLDGALPQNGTDCQQVLVQLHKYGSPATVATTGGRYFGLVVGGSTPADIQRSLKAIADAIDEVKRLNRML

SEQ ID NO: 8716 - protein, 363 aa, Xenorhabdus bovienii
  Peptide sequence Name=Xb4151_4152.C438.gene196.pep
  Gene classification: Function=Predicted GTPase; Function class=R General function prediction only
  Homolog annotation: Query=1..363bp; Hit=1..363bp; Blast score=678; Percent Identity=92.0; E value=0; Homolog= ychF COG0012
MGFKCGIVGLPNVGKSTLFNALTKAGIEAANFPFCTIEPNTGVVPMPDPRLDQLAEIVKPQRILPTTMEFVDIAGLVKGASKGEGLGNQFLTNIRETEAIGHVVRCFENDNIIHVSGQVDPASDIEIINTELALADLDTCERAIHRVQKKAKGGDKDAKTELDALEKCLPHLEQAGMLRALDLSAEEKAAIRYLSFLTLKPTMYIANVNEDGFENNPHLDTVRAIAETEGSVVVPVCAAIESDIAELEDGDREEFMAELGLEEPGLNRVIRAGYQLLNLQTYFTAGVKEVRAWTIPIGATAPQAAGKIHTDFEKGFIRAQTIAFEDFINYKGEQGAKEAGKMRAEGKDYIVKDGDVMNFLFNV

SEQ ID NO: 8717 - protein, 37 aa, Xenorhabdus bovienii
  Peptide sequence Name=Xb4151_4152.C438.gene197.pep
MPLEQELNRQCVAQLIIACIIAPILYNSPTGILSVGL

SEQ ID NO: 8718 - protein, 220 aa, Xenorhabdus bovienii
  Peptide sequence Name=Xb4151_4152.C438.gene198.pep
  Gene classification: Gene name=Pth; Function=Peptidyl-tRNA hydrolase; Function class=J Translation, ribosomal structure and biogenesis
  Homolog annotation: Query=28..218bp; Hit=3..193bp; Blast score=306; Percent Identity=80.0; E value=1e-83; Homolog= pth COG0193
LYSSLEAGKLNPFFYFIANKRTKTVSNIKLIVGLANPGAEYAQTRHNAGAWFVDLLAQRHRQPLKEESKFFGYTARINLNGQDVRLLVPTTFMNLSGKSVLALAGFYRIQPDEILVAHDELDLPPGVAKMKLGGSNGGHNGLKDIQNKFSNNPNFHRLRIGIGHPGDKNKVVGFVLGKPPASEQKLIDEAIDEALSCTDILMKEGMNKAINRLHAFRAGA

SEQ ID NO: 8719 - protein, 56 aa, Xenorhabdus bovienii
  Peptide sequence Name=Xb4151_4152.C438.gene199.pep
MLPRMKAFLRFITNLQYFSELNLQTKRTQKHESRHILGYIIALLSKRLLRRRSQVV

SEQ ID NO: 8720 - protein, 91 aa, Xenorhabdus bovienii
  Peptide sequence Name=Xb4151_4152.C438.gene200.pep
  Homolog annotation: Query=1..89bp; Hit=1..89bp; Blast score=111; Percent Identity=58.0; E value=3e-24; Homolog= Pa|Phot2-7h01.p1k_g4| 2779 - 3054 213 91 aa, chain -
MKRKNAFILGNIFMGLGMAAMLISLSFVLLSHVFSLDQSGFATGISLMGLFVGALVWLAGASIGGREQVSDKYWWLKNYDERYRRKKHRTS

SEQ ID NO: 8721 - protein, 650 aa, Xenorhabdus bovienii
  Peptide sequence Name=Xb4151_4152.C438.gene201.pep
  Gene classification: Function=Phospholipase/lecithinase/hemolysin; Function class=I Lipid metabolism
  Homolog annotation: Query=18..364bp; Hit=13..396bp; Blast score=130; Percent Identity=30.0; E value=4e-30; Homolog= PM0076_1 COG3240
MKKAFLFTPALLALSISTISNAHAYDSTYDFGDSLSDSGNNGRYTTDGETSQLYAEYVAEHITGSKPTASKDGGTNYAQGGATAIGSLNPKYNTTEQVKKYLAAHNNRADANGVYIHWIGGNDLAAALIAGQKNPFDAYDIVNRSATAAGEQINLLVNAGAGLIIAPTVPDVGITPRLLETVLSGALQTKGKSQDDINAILQQVRAGINEYPTPNNEVRDLVLDGALKKIAAKTTDPAETEALLLAAYGVARKGATNLADAYNKLVDEKISQSNGNIMRVDANGLLKEVIANPLVYGISNTLGYACSESLSDAECSSKDPKFDSNQSFLFADSLHPTPLGHLILGQYIESIYNAPSQVMTLNQVNRIPVKGVRSSLDGHLQQLRNGGNAQGKIGIFGGYTGSHNNTFTLGGDYQLTDNLLLGAVYSNYKDERTSASNFTHEGRAHVVTSYALWNFYDKGWLSGDLHYSNNKYDSLTRIIQLGQATRRETGSTTGKQWGGRLTAGWDIAVTNQITTSPIIQYAWDKGDIKGYRESGNNSTSMHFADQNYTSKVGTLGWRVDTQLGRFNPYASVQFNHQFGDTRYKLSSAINSTEVSFVQESGKQNTDWRQYTVGVNANLFNNWRGFASVTRNEGNSQEHNYNFSLGINASF

SEQ ID NO: 8722 - protein, 59 aa, Xenorhabdus bovienii
  Peptide sequence Name=Xb4151_4152.C438.gene202.pep
MTIKSHNSRYRLSGRLAATVITHQNCSGVRVLDVPDDLLFVYDVVFFLNACSECKLCWG

SEQ ID NO: 8723 - protein, 312 aa, Xenorhabdus bovienii
  Peptide sequence Name=Xb4151_4152.C438.gene203.pep
  Gene classification: Gene name=PrsA; Function =Phosphoribosylpyrophosphate synthetase; Function class=F Nucleotide transport and metabolism
  Homolog annotation: Query=1..312bp; Hit=4..315bp; Blast score=558; Percent Identity=95.0; E value=1e-159; Homolog= prsA COG0462
MKLFAGNATPELAQRVANRLYTSLGDAAVGRFSDGEVSVQINENVRGGDVFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQKGLENPIVVSPDIGGVVRARAIAKLLNDTDMAIIDKRRPRANVSQVMHIIGDVAGRDCVLVDDMIDTGGTLCKAAEALKERGAKRVFAYATHPIFSGNAVENIKNSVIDEFIVCDTIPLSAEIKALNKVRTLTLSGMLAEAIRRISNEESISAMFEH

SEQ ID NO: 8724 - protein, 292 aa, Xenorhabdus bovienii
  Peptide sequence Name=Xb4151_4152.C438.gene204.pep
  Gene classification: Gene name=IspE; Function=4-diphosphocytidyl-2C -methyl-D-erythritol 2-phosphate synthase; Function class=I Lipid metabolism
  Homolog annotation: Query=1..280bp; Hit=1..279bp; Blast score=392; Percent Identity=69.0; E value=1e-109; Homolog= ychB COG1947
MTLTWPSPAKLNLFLYITGQRSDGYHELQTLFQFLDYGDEITITPRQDNQIHLLTPVEGVAHDNNLIVRAARLLQDHLLQNNNKGTQHLGADIHIDKCLPMGGGLGGGSSNAATVLIALNYHWQANLSDDELAQLGISLGADVPVFIKGHAAFAEGIGEKLRPASPEEKWFLVAHPGIEISTPTIFTDPELKRNSPIRSLPALLQAPFTNDCESIARKRFRKVEQLLSWLLEYAPSRLTGTGACVFGEFESEASARKVLNQSPEWMQGFVARGVNISPLHTFRSGIYMLLNQ

SEQ ID NO: 8725 - protein, 205 aa, Xenorhabdus bovienii
  Peptide sequence Name=Xb4151_4152.C438.gene205.pep
  Gene classification: Gene name=LolB; Function=Outer membrane lipoprotein involved in outer membrane biogenesis; Function class=M Cell envelope biogenesis, outer membrane
  Homolog annotation: Query=6..202bp; Hit=8..204bp; Blast score=227; Percent Identity=55.0; E value=5e-60; Homolog= hemM COG3017
MKISSLFRLLPLSAVLLTACTVTQPPTGTGSANSPQWHIREQQLQKLKNYQTRGSFAYLANEKKVYARFFWQQYSPDNYKLLLLNPLGTTELELFVQPNMIQLTDNNGKKYLSDTPESLIYQLTNMNIPLDNLKNWIIGLPGDAKDFQLDENYLLKSVSSKKNGEIWKVNYQGYDASTMPVLPNRLELTQGKNRIKLKMDNWTTQ

SEQ ID NO: 8726 - protein, 34 aa, Xenorhabdus bovienii
  Peptide sequence Name=Xb4151_4152.C438.gene206.pep
MHQFNKSQSDGYAVIYSRNFDKISLNYHLDYRLG

SEQ ID NO: 8727 - protein, 420 aa, Xenorhabdus bovienii
  Peptide sequence Name=Xb4151_4152.C438.gene207.pep
  Gene classification: Gene name=HemA; Function=Glutamyl-tRNA reductase; Function class=H Coenzyme metabolism
  Homolog annotation: Query=1..418bp; Hit=1..418bp; Blast score=577; Percent Identity=77.0; E value=1e-164; Homolog= hemA COG0373
MTLLALGINHKTAPVSLRERVAFSPDTIGLALDNLLQQRLVRGGVVLSTCNRTELYLSVEPQDNLKDQLISWLCEYHQLNPDDLKASLYWHLDNDAVSHLMRVASGLDSLVLGEPQILGQVKKAFAESQNYQSLSGELERLFQKSFSVAKRVRTETEIGANAVSVAFAACTLARQIFESLSKLNILLVGAGETIELVARHLKEHRVRHMMIANRTKERAQTLASQVNAEVISLSEIDTRLAEADIVISSTASPLPIIGKGMVERALKVRRNQPMLLIDIAVPRDIEPDVEKLSNAYLYSVDDLQAIIQQNLAQRKAAAVVAEGIVQQESRYFMDWLRSQGAVNTIREYREQAEKVRAEMTAKALMSIRQGADAEQIINQLTHQLTNRLLHTPTKSLQQAASDGDLERLNLLRDSLGLDHN

SEQ ID NO: 8728 - protein, 360 aa, Xenorhabdus bovienii
  Peptide sequence Name=Xb4151_4152.C438.gene208.pep
  Gene classification: Gene name=PrfA; Function=Protein chain release factor A; Function class=J Translation, ribosomal structure and biogenesis
  Homolog annotation: Query=1..360bp; Hit=1..360bp; Blast score=564; Percent Identity=85.0; E value=1e-161; Homolog= ZprfA COG0216
MKPSIVAKLEALQERHEEILVHLGDASVIADQDRFRALSKEYAQLTDVTHCFKSWKTVQEDLQTAEMMLDDLEMREMAQEELKDAKIRNEELEQQLQLLLLPKDPDDERNCFLEVRAGTGGDEAAIFAGDLFRMYSRYAEARRWRVEIISANEGEHGGYKEVIAKVSGDQVYGHLKFESGGHRVQRVPETESQGRIHTSACTVAVMPEIPEAELPDISPGDLKIDTFRSSGAGGQHVNTTDSAIRITHLPTGIVVECQDERSQHKNKAKAMSVLAARIRAAEMHKRQEAEASERRNLLGSGDRSDRNRTYNFPQGRVTDHRINLTLYRLDEVIEGKLDMLIQPIIIEYQADQLSALSEQD

SEQ ID NO: 8729 - protein, 286 aa, Xenorhabdus bovienii
  Peptide sequence Name=Xb4151_4152.C438.gene209.pep
  Gene classification: Gene name=HemK; Function=Predicted rRNA or tRNA methylase; Function class=J Translation, ribosomal structure and biogenesis
  Homolog annotation: Query=1..279bp; Hit=1..275bp; Blast score=356; Percent Identity=62.0; E value=1e-98; Homolog= ZhemK COG2890
MNYQCWLQHAATQLFESDSPKRDAEILLGYVTGRSRTYLIAFDETLISSEELHQLDSLLGRRIQGEPVAYIIGEREFWSLPFAVSPATLIPRPDTECLVEKALELLPDSPARILDLGTGTGAIALALASERNDCYVTGVDINSDAVMLAQYNAEKNAGKLAIHNVNFLQSEWFAAVGNQQFDMIVSNPPYIDECDPHLQEGDIRFEPATALIAAQNGMADLQAIVGQARHFLSPNGWLLLEHGWKQGIVVRNLFLEKGYQQIATFQDYGGNERITIGRWNKNETHS

SEQ ID NO: 8730 - protein, 269 aa, Xenorhabdus bovienii
  Peptide sequence Name=Xb4151_4152.C438.gene210.pep
  Gene classification: Function=Uncharacterized ACR; Function class=S Function unknown
  Homolog annotation: Query=1..269bp; Hit=1..269bp; Blast score=312; Percent Identity=56.0; E value=2e-85; Homolog= ychA COG2912
MKPIVNYEFNNTPLIDGIILVSKIIRPDFPQTLVSEQLTALVEEARQRLSSITDSKVKLDSLLTLFYREWKFGGANGVYCLSDTLWLDRLLHSRQGSPVSLGTVFTHIAQALGLSVQPVIFPIQLILRIDLLDQPTWFINPLNGDTLNEHTLDVWLKGNIGPTVRLKKQDLQEADNVSLVRKITDTIKVSLMEEKKMELALKASEVVLTFDPDDPYEIRDRGLIYAQLDCNHIAVSDLSYFVEHCPEDPISEMIKMQINTIEQRLIVLH

SEQ ID NO: 8731 - protein, 284 aa, Xenorhabdus bovienii
  Peptide sequence Name=Xb4151_4152.C438.gene211.pep
  Gene classification: Gene name=KdsA; Function=3-Deoxy-D-manno -octulosonic acid (KDO) 8-phosphate synthase; Function class=M Cell envelope biogenesis, outer membrane
  Homolog annotation: Query=1..284bp; Hit=1..284bp; Blast score=514; Percent Identity=89.0; E value=1e-146; Homolog= ZkdsA COG2877
MQQKVVNIGDIKVANDLPFVLFGGMNVLESRDLAMRICEHYVTVTQKLGIPYVFKASFDKANRSSIRSYRGPGLEEGMKIFQELKQTFGVKIITDVHEPAQAQPVADVVDVIQLPAFLARQTDLVEAMAKTGAVINIKKPQFVSPGQMGNIVEKFKEGGNDQVILCDRGSNFGYDNLVVDMLGFGVMQQATHGAPVIFDVTHALQCRDPLGAASGGRRAQVAELARAGMAVGIAGLFLEAHPDPENAKCDGPSALPLAKLESFLMQIKAIDDVVKSFPELDTSK

SEQ ID NO: 8732 - protein, 560 aa, Xenorhabdus bovienii
  Peptide sequence Name=Xb4151_4152.C438.gene212.pep
  Gene classification: Gene name=SUL1; Function=Sulfate permease and related transporters (MFS superfamily); Function class=P Inorganic ion transport and metabolism
  Homolog annotation: Query=2..542bp; Hit=12..550bp; Blast score=642; Percent Identity=68.0; E value=0; Homolog= ychM COG0659
MKESYSFPRFIRDIIAGITVGVIAIPLAMALAIGSGVAPQYGLYTAAIAGIVIAMTGGSRYSVSGPTAAFVVILYPVSQQFGLSGLLIATLMSGVILIVMGLARFGRFIEYIPMSVTLGFTSGIAITIATMQVQNFFGLKLVHIPENYIDKVIALSQALPSLQLSDTLIGLTTLLVLIFWPKLGVKLPGHLPALITGTAVMGAMHLLGYDVATIGSSFSYTLSDGTQGQGIPPILPQFVLPWNLPDTHSLNISWNTVSALLPAAFSMAMLGAIESLLCAVILDGMTGKKHHSNGELLGQGLGNIAAPFFGGITATAAIARSAANVRAGATSPIAAVVHSLLVLLTLLVLAPMLSYLPLAAMSAILLIVAWNMSEAHKVVDLIRHAPKDDIIVMLLCLSLTVLFDMVVAITIGIVLASLLFMRKIANMTRISTSSLTSADKGLLVVRINGPLFFAAAERIFAELREKSADYQTIIMQWDAVPVLDAGGLHAFQGFVRELGKEKHIVVCDIPFQPLKTLARAKVTPIEGELSFYATLPKALKEMAVNYTSEVCASSEKIQGQ

SEQ ID NO: 8733 - protein, 170 aa, Xenorhabdus bovienii
  Peptide sequence Name=Xb4151_4152.C438.gene213.pep
MSRSDKHIWMPCLNGQKSTYNGEHNMQQENLISKVIIATLKSWRFISALSVFSILSATAILIAVFNTATLNNIALYAVLLFTTLYCQYYCWRTWLDCHYFQILNSSPEKSAEFDQTLLLIFNKLPQSRTQNDRFNGAIKLLKKATIGLILQWVMFFLFLLMLKYSALIQL

SEQ ID NO: 8734 - protein, 439 aa, Xenorhabdus bovienii
  Peptide sequence Name=Xb4151_4152.C438.gene214.pep
  Gene classification: Gene name=PgpB; Function=Membrane-associated phospholipid phosphatase; Function class=I Lipid metabolism
  Homolog annotation: Query=17..349bp; Hit=2..341bp; Blast score=256; Percent Identity=45.0; E value=2e-68; Homolog= ynbD_1 COG0671
MEHYMHSSLDSRRRLWLTGVIWLLFLTPFFFLTYGQVNQFTAQRGDVGTVMFGWEHNIPFWSWSIIPYWSIDLFYGISLFICTHRREQWLHGWRLMTASLIACIGFLLFPLKFSLSRPTTEGLFGWLFNQLALFDLPYNQAPSLHIILLWLLWLRYSAYVCGYWRGLLHIWSVLVALSVLTTWQHHFVDMLTGFAVGVIISYLLPVSYRWRWQSNQDRYARKLFSYYLTGSALFALMAYLLGGSFWLLLWPAVSLLMVALGYAGLGSSVFQKQPDGRMSLSARWLLAPYQLGAWLSYLWFRRKSTPFSHITEGIILGSLPCQPVTTASVLDMTAEWHRRSDSHTVDYVCQPQIDLLPLTPESLQSAICALDKLRQQGDVFVHCTLGLSRSAMVIAAWLLKQHPEYDINTVVAILRKARPHVTFRQTHLDALSQWAKIYL

SEQ ID NO: 8735 - protein, 589 aa, Xenorhabdus bovienii
  Peptide sequence Name=Xb4151_4152.C438.gene215.pep
  Gene classification: Gene name=PldB; Function=Lysophospholipase; Function class=I Lipid metabolism
  Homolog annotation: Query=6..277bp; Hit=3..274bp; Blast score=381; Percent Identity=63.0; E value=1e-106; Homolog= ynbC_1 COG2267
MTPQLDQRIAEEHYFTTSDNASLFYRYWPQQQANPDKAIIIFHRGHEHSGRIQHVIDGLDLPDVPMFAWDARGHGKTEGPRGYSPSMGTSIRDVDEFVRFIANQYNIAMGNIVVIGQSVGAVLVSAWVHDYAPKIRAMILAAPAFDIKLYIPFATQGLQLMQKARGIFFVNSYVKARYLTHDETRIASYNSDPLITREIAVNILLDLYQTAERVVKDAAAITLPTLLFISGSDYVVNKKPQHQFYQQLNTPIKEKHVMDGFYHDTLGEKDRHLVFDKIRVFIERVFALPRYQHDYSREDTWSHSADEFRTLSTSLPSLCPKKLSYQLMRKVMNTRWGRASEGICIGLKTGFDSGSTLDYVYRNQPQGKGILGRMLDKNYLNSIGWRGIRQRKIHIEMLIRHAIRSLREQNMPVHMVDIAAGHGRYILDAINDFSKVDSILLRDYSEINVNQGQAYIEERDLTDKIRFVIGDAFNAESIASITPAPTLGIVSGLYELFPDNNLLRNSLRGFADAMTENGYLVYTGQPWHPQIEVIARVLSSHRDNQPWIMRRRTQGEMDALVEAAGFEKLYQLTDNWGIFTVSIAKRVHR

SEQ ID NO: 8736 - protein, 207 aa, Xenorhabdus bovienii
  Peptide sequence Name=Xb4151_4152.C438.gene216.pep
  Gene classification: Gene name=PgsA; Function =Phosphatidylglycerophosphate synthase; Function class=I Lipid metabolism
  Homolog annotation: Query=1..190bp; Hit=3..192bp; Blast score=191; Percent Identity=58.0; E value=4e-49; Homolog= Z2319 COG0558
MTIYDLKPRFQNLLRPIVIYLYKQGINANQVTLTALFLSIFAGSLLSLFPSPHLYWLLPIFLFIRMALNAIDGMLAREHNQKSHLGAIYNELGDVISDVALYLPFCLLPDVNSFSLLIILFLTILTEFIGVLAQTIGSSRRYDGPIGKSDRAFIFGAYGLIIAIFPSALGWSSSLFAFMIILLLVTCYQRVVKALREIRLAEQSHSK

SEQ ID NO: 8737 - protein, 264 aa, Xenorhabdus bovienii
  Peptide sequence Name=Xb4151_4152.C438.gene217.pep
  Gene classification: Function=Predicted transcriptional regulator; Function class=K Transcription
  Homolog annotation: Query=37..258bp; Hit=1..221bp; Blast score=242; Percent Identity=55.0; E value=3e-64; Homolog= mll3208 COG2378
MILFKGSKNYLFNQLNYDSCVLLEIDESVNLNGWDELSRAQRLLSLMEILRRYHFPVQGKVLAQKLNISLRTLYRDIASLQAQGAIIEGEPGIGYVLRPGFVLPPLMFTQNEIEALALGANWVAKRADSQLKESANNAISKIAAVIPAELKQMLEASSLLIGPAATAVQPVVEIQQIRQAINTRHKITFAYLDIKDIPSERTIWPFALGYFENISIVIGWCELREEFRHFRSDRIMRLKIEKQCYPRSRQVLLKEWRAMEKISR

SEQ ID NO: 8738 - protein, 83 aa, Xenorhabdus bovienii
  Peptide sequence Name=Xb4151_4152.C438.gene218.pep
MLTLKFSTSVNAKPSHIWAHYVDFNLRKKWEIDLEYLQFEGEIKTGQYGKMRLSGMPEIRFYLSNIEVNKEFTNQVTFRKWEY

SEQ ID NO: 8739 - protein, 183 aa, Xenorhabdus bovienii
  Peptide sequence Name=Xb4151_4152.C438.gene219.pep
  Homolog annotation: Query=62..183bp; Hit=2..123bp; Blast score=209; Percent Identity=80.0; E value=1e-53; Homolog= gi|37526190|ref|NP _929534.1| hypothetical protein [Photorhabdus luminescens subsp. laumondii TTO1] gi|36785620|emb|CAE14570.1
MGILTFRHQIITDENNMACRIQVTVSFEPDANIPAVQAEGFFKQGTQDLVETVLRLKNIVETVSPKPNLQLVYVSDIEHSTAFYKTIFNAEPIFASSRYVAFSAGGEVLFAIWSGGVKPDRAIPRFTEIGIMLPSGKDVDRCFDEWRKNPEIKIVQEPHTEVFGRTFLAEDPDGHIIRVCPLD

SEQ ID NO: 8740 - protein, 62 aa, Xenorhabdus bovienii
  Peptide sequence Name=Xb4151_4152.C438.gene220.pep
MRKILNISSGFFLRYGGERGVRTLDTFSRIHTFQACSFSLSDTSPCFVSAVILLGISARVTK

SEQ ID NO: 8741 - protein, 77 aa, Xenorhabdus bovienii
  Peptide sequence Name=Xb4151_4152.C438.gene221.pep
LCSGSFLEYGGERGVRTLDTFSRIHTFQACSFSLSDTSPHFVVVAISLEFVAATGRNYREKQGRRQQAYDDFFRLFD

SEQ ID NO: 8742 - protein, 53 aa, Xenorhabdus bovienii
  Peptide sequence Name=Xb4151_4152.C438.gene222.pep
MVASLCQKARNENIDNVTQLTYLPLHITKSASALVNDYQTFKLFFICVISQKA

SEQ ID NO: 8743 - protein, 313 aa, Xenorhabdus bovienii
  Peptide sequence Name=Xb4151_4152.C438.gene223.pep
  Gene classification: Gene name=SerA; Function=Phosphoglycerate dehydrogenase and related dehydrogenases; Function class=E Amino acid transport and metabolism
  Homolog annotation: Query=1..313bp; Hit=14..325bp; Blast score=344; Percent Identity=53.0; E value=8e-95; Homolog= ycdW COG0111
MNIIFFHSSSNTDEWIQGIQARLPDAKVRQWFSGDQEPADYALVWQPPYEMLANRQGLKGIFALGAGVDAIFKQESKNPGMLPADVPLIRLEDTGMGRQMQEYTITSVLHYFRRMDEYKRYQEQRLWAPMSPHNRKEFVIGVLGAGVLGLSVIGKLMEFDFNVRCWSRTPKQLNSVESFYGKEQLGDFLSGCKVLINLLPDTPETRGILNLSLFSQLKSGSYVINLARGAQLVEQDLLVAIDKGYIAGATLDVFAEEPLSNMHPFWTHPRIHVTPHIAANTVPEAAMDVICENIRRMARGEMPTGLVDRERGY

SEQ ID NO: 8744 - protein, 45 aa, Xenorhabdus bovienii
  Peptide sequence Name=Xb4151_4152.C438.gene224.pep
  Gene classification: Gene name=TorD; Function=Uncharacterized component of anaerobic dehydrogenases; Function class=R General function prediction only
  Homolog annotation: Query=1..36bp; Hit=1..36bp; Blast score=59; Percent Identity=69.0; E value=6e-10; Homolog= ycdY COG3381
MNEFSIVCRILGTLFNRAPQDPVLQPLITMIAEGKLKQGMAFGTG

SEQ ID NO: 8745 - protein, 42 aa, Xenorhabdus bovienii
  Peptide sequence Name=Xb4151_4152.C438.gene225.pep
FRNNRFPFLRELTGVSRSVTSVEDPRCKRSSHSSCSKGHALF

SEQ ID NO: 8746 - protein, 123 aa, Xenorhabdus bovienii
  Peptide sequence Name=Xb4151_4152.C439.gene1.pep
  Homolog annotation: Query=1..106bp; Hit=78..182bp; Blast score=92; Percent Identity=43.0; E value=1e-18; Homolog= gi|34499577|ref|NP _903792.1| hypothetical protein CV4122 [Chromobacterium violaceum ATCC 12472] gi|34105428|gb|AAQ61783.1| hyp
VGIFTHSSHNSIRLYNKEYHNIPFQELQGRIKGSVEIDDNTFIGANAIIMPNTKIGKGCIVTAFSYVQGNFSDFSIIAGNPAKKVGDVRKIDYRLLKKHPELIESYLKYFNYKSIGALIDHEE

SEQ ID NO: 8747 - protein, 319 aa, Xenorhabdus bovienii
  Peptide sequence Name=Xb4151_4152.C439.gene2.pep
  Homolog annotation: Query=8..319bp; Hit=41..350bp; Blast score=369; Percent Identity=54.0; E value=1e-101; Homolog= gi|32527114|gb|AAP85864.1| conserved hypothetical protein [Ralstonia eutropha]
MKNNKELYKNLCETEKTIPIFSQAWWLDATAGIENWDVAIVQKENGEIIASLPYMIKKVQFLKKITQPKLTQFLGPWFKENNSNYTKSLGQQKDLMFSLIEQLPEFHSFSQNWNHSQQNWLPFYWKNFSQSTRYTYRITDISNEEKLWNGFQSNIRGYIRKAKERYELEIRTDLDIHEFLKLNNKVFERQNKTPPYEDNFVIDLDRVCSEKKSRKIFIAQDKLGRKHAGAYLIWDNNNAYYIMAGADPSLPNSGATSLCLWEAIKFASTVTKNFDFEGSMLEPVERFFRAFGAEQTPYFHISKTNSKILKTYYFLKNLK

SEQ ID NO: 8748 - protein, 449 aa, Xenorhabdus bovienii
  Peptide sequence Name=Xb4151_4152.C439.gene3.pep
  Homolog annotation: Query=102..434bp; Hit=91..414bp; Blast score=136; Percent Identity=30.0; E value=7e-31; Homolog= gi|34540651|ref|NP _905130.1| hypothetical protein PG0883 [Porphyromonas gingivalis W83] gi|34396965|gb|AAQ66029.1| hypothet
MKSINSNILLWFQLIIRERFGIPINASYTEKGIKLYLQKEEKYIILDELQSSFYSIDTKLSFTTWNGCEEGWETILASPLPAPTIKNLPKPLIEKKSYGHNIHYDIIGLTYWILSRIEEINKEQVLDNHYRFPAIESHAYKNNYLNRPIVDEWLHILRQIIEKTWPNAVLKKHQFRFNATHDVDRPYRFKYCKLTKLIKNIAGDVIRKKVFSSIIYAPFIKISNNKHVLNKDLYFTFDWIMNLSEKNNIKSEFYFICGRTDRTKDADYEIEDPLIRGLLRKIHSRGHVIGLHPSYSSFQDPQQIKEEFSRLQNVCAEENIKQKQYGGRMHYLRWSHPETLVAWNNAGLNYDSTLGYADRPGFRCGTCFEYPAINPLTNEILNIRIRPLIVMESSILKYMNIKNTNDAKTLFLYYKNICKKFNGEFTLLWHNSELYNNKMREIYLALLTE

SEQ ID NO: 8749 - protein, 357 aa, Xenorhabdus bovienii
  Peptide sequence Name=Xb4151_4152.C439.gene4.pep
MNKISDYFHSQALFALLAPIIVLYGMDSNLPLTPVIYSLASILFIRWLTNTSIKTPKISIVPIIKNGDKIFYLISLIMVIYLVCWYFFSGAVNNINFNITKVYEFREKNSAITNIGILAYVNDWVYSVFSLSLLGYSLWRKKYITFLFVIICQIFFYSISAHKSVLFAPFFVIGIYFYFSRTNALSSVPLVFSTTVLCGLLLYNIVNETIFPSMFIRRVFFVPANLTYVYFEFFQHNPYSMWSNSILKFIQPNIYEAGISKTIGIYIGTDIYANNGYISSGFAQAGLLGIFLYSIILGIYLKWLNILSNKGPTLWLGLILVVTPLRSLLISSDLLTVMLTHGLFVATLMLILLRKNK

SEQ ID NO: 8750 - protein, 373 aa, Xenorhabdus bovienii
  Peptide sequence Name=Xb4151_4152.C439.gene5.pep
  Gene classification: Gene name=RfaG; Function=Predicted glycosyltransferases; Function class=M Cell envelope biogenesis, outer membrane
  Homolog annotation: Query=2..366bp; Hit=3..366bp; Blast score=393; Percent Identity=47.0; E value=1e-109; Homolog= PA3149 COG0438
MKIAHLTSVHHRYDTRILLKECTSLSTFGYDVYLIVADGKEDELIQNINILDVGKPSGRLNRILTSTNKIYKKALEVDANIYHLHDPELIPIGLKLKKKGKIVIFDSHENVSQQILGKPYLQKSLKKIISRLYSYYEKYSLSKFDGIISATTSIKEKLIKINKNTIAVNNFPIINDITNTNIIWDKKENRICYVGAISNIRGIKEMVESVSDIKTNTKITIGGNFPNNKFENEVKNNKNSNEIEFLGFLNRKQINELFSISKAGLVVLHPTINYLDSLPVKMFEYMAAGIPIIASNFPLWKEIISSNNCGLLVNPLEPTEIANAIDFIINNSDISKEMGKNARVAIEKKYNWSIECEKLLDFYTKIDELSLSN

SEQ ID NO: 8751 - protein, 91 aa, Xenorhabdus bovienii
  Peptide sequence Name=Xb4151_4152.C439.gene6.pep
  Gene classification: Gene name=WcaA; Function=Glycosyltransferases involved in cell wall biogenesis; Function class=M Cell envelope biogenesis, outer membrane
  Homolog annotation: Query=4..89bp; Hit=7..92bp; Blast score=89; Percent Identity=45.0; E value=5e-19; Homolog= BS_tuaG COG0463
MNSLVSIIMPTYNSSKYIEDSINSILKQTYKHWELIITDDHSNDNTFDIISKYSLIYPQIKIFKHEKNLGAGAVRNNSIEHSSGRFTSFSR

SEQ ID NO: 8752 - protein, 142 aa, Xenorhabdus bovienii
  Peptide sequence Name=Xb4151_4152.C439.gene7.pep
  Gene classification: Gene name=WcaA; Function=Glycosyltransferases involved in cell wall biogenesis; Function class=M Cell envelope biogenesis, outer membrane
  Homolog annotation: Query=1..139bp; Hit=114..253bp; Blast score=109; Percent Identity=42.0; E value=7e-25; Homolog= BH3661 COG0463
MLKKECALSYSYYQKINEDGQLKGIIKAPKFTNSKKLLFTNVIGCLTAIYDTQKVGKLYMPLIRRRQDMALWLKIMNISGNAYGIPEILAYYRVSKNSLSGNKYNAAKSQWHLYRNILTLGFVKSSIYFISYAFFGLIKKFK

SEQ ID NO: 8753 - protein, 388 aa, Xenorhabdus bovienii
  Peptide sequence Name=Xb4151_4152.C439.gene8.pep
  Gene classification: Gene name=Ugd; Function=Predicted UDP-glucose 6 -dehydrogenase; Function class=M Cell envelope biogenesis, outer membrane
  Homolog annotation: Query=1..388bp; Hit=1..388bp; Blast score=573; Percent Identity=73.0; E value=1e-163; Homolog= ugd COG1004
MDITIAGIGYVGLSNGILLSQKHKVIALDISEEKVNLINKKKSPVVDKEIEFYIKEKKLDLIATLDKKLAYENADFVIIATPTDYDPKTNYFNIKSVESVIEDVLYYNPTAIMIIKSTIPVGFTKQMREKYNTDNIIFSPEFLREGRALYDNLYPSRIVIGEKSERAQLFSDLLLEGAIKKDIPILFTESTEAEAIKLFSNTYLAMRVAYFNELDSYAEINELNTRQIIEGVSLDPRIGNHYNNPSFGYGGYCLPKDTKQLLANYQKVPNNIINAIVEANRTRKDFIADSILSKNPKIVGVYRLIMKSNSDNFRASSIQGIMKRIKAKGIEVVIFEPEMTDEYFFNSKLIRDLEYFKSISDIIISNRMSEELKDVKEKVYTRDLFGND

SEQ ID NO: 8754 - protein, 32 aa, Xenorhabdus bovienii
  Peptide sequence Name=Xb4151_4152.C439.gene9.pep
MPHLLLTITLSTSFCYHMSHAKHRPIRTRNPA

SEQ ID NO: 8755 - protein, 167 aa, Xenorhabdus bovienii
  Peptide sequence Name=Xb4151_4152.C439.gene10.pep
  Gene classification: Gene name=CspR (BS); Function=Predicted rRNA methylase (SpoU class); Function class=J Translation, ribosomal structure and biogenesis
  Homolog annotation: Query=1..167bp; Hit=1..157bp; Blast score=264; Percent Identity=76.0; E value=4e-71; Homolog= ZyibK COG0219
MLNIVLFEPEIPPNTGNIIRLCANTGCQLHLIQPLGFTWDDKRLRRAGLDYHEFANIKQHHDFHAFLVSEGLSPVNSQSPSGARLFALTTKGTPAHSNVSYQDGDYLMFGPETRGLPAYVLDNMPTEQKIRIPMLSDSRSMNLSNSVAVVVFEAWRQLGYSGALLRD

SEQ ID NO: 8756 - protein, 278 aa, Xenorhabdus bovienii
  Peptide sequence Name=Xb4151_4152.C439.gene11.pep
  Gene classification: Gene name=CysE; Function=Serine acetyltransferase; Function class=E Amino acid transport and metabolism
  Homolog annotation: Query=6..278bp; Hit=1..273bp; Blast score=479; Percent Identity=85.0; E value=1e-135; Homolog= cysE COG1045
MRMIAMSREELNEVWKNIKNEARELADCEPMLASFFHATLLKHENLGSALSYMLANKLATPIMPAIAVREVVEDAYRSDPEMIGSAARDIKAVRLRDPAVDKYSTPLLYLKGFHALQAYRIAHWLWNQERKALAIYMQNQISVSFSVDIHPAAKIGCGIMLDHATGIVIGETAVVENDVSILQSVTLGGTGKAGGDRHPKVREGVMIGAGSKILGNIEIGRGAKIGAGSVVLRAVPPHTTVAGVPARIVGKPESDKPSLDMNQHFNGINNGFEYGDGI

SEQ ID NO: 8757 - protein, 339 aa, Xenorhabdus bovienii
  Peptide sequence Name=Xb4151_4152.C439.gene12.pep
  Gene classification: Gene name=GpsA; Function=Glycerol 3-phosphate dehydrogenase; Function class=C Energy production and conversion
  Homolog annotation: Query=4..333bp; Hit=6..335bp; Blast score=533; Percent Identity=79.0; E value=1e-152; Homolog= gpsA COG0240
MNTASMTVIGAGSYGTALAITLARNGHEVVLWGHNPQHIHALQQARCNQAFLPDISFPDNLLLEADLKNAVSTSSNILIVVPSHVFGDVLQQIKPYLQPDSRIVWATKGLEAETGRLLQDVAREILGNEIPLAVVSGPTFAKELAAGLPTAIAVSATTPEFGEELQQLFHCGKSFRVYKNPDFTGVQLGGAIKNVIAIGAGISDGMGFGANARTALITRGLAEMSRLGIALGADPSTFIGMAGLGDLVLTCTDNQSRNRRFGMMLGQGISVDDAQREIGQVVEGYRNTKEARALAERAGVEMPITEQIYQILYCNKNVIEAAQTLLGRATRDEGENLNS

SEQ ID NO: 8758 - protein, 157 aa, Xenorhabdus bovienii
  Peptide sequence Name=Xb4151_4152.C439.gene13.pep
  Gene classification: Gene name=SecB; Function=Preprotein translocase subunit SecB; Function class=N Cell motility and secretion
  Homolog annotation: Query=1..157bp; Hit=1..155bp; Blast score=256; Percent Identity=83.0; E value=6e-69; Homolog= secB COG1952
MSEQNNTEMAFQIQRIYTKDVSFEAPKAPQIFQLEWQPEVKLDLDTASNELAQGVYEVVLRVTVTAALGEETAFLCEVQQAGIFSIDGIDGTQLAHCLGAYCPNILFPYARECITSLVGRGTFPQLNLAPVNFDALFMNYLQQQAEQSEPSETTQEA

SEQ ID NO: 8759 - protein, 145 aa, Xenorhabdus bovienii
  Peptide sequence Name=Xb4151_4152.C439.gene14.pep
  Gene classification: Gene name=PspE; Function=Rhodanese-related sulfurtransferases; Function class=P Inorganic ion transport and metabolism
  Homolog annotation: Query=2..144bp; Hit=1..143bp; Blast score=189; Percent Identity=65.0; E value=6e-49; Homolog= yibN COG0607
MLQEIMQFISRNTILSLAWIALLVAVIVMTAKSVFSKSKEITRAQAIHFINKEDAVVVDLRSRDDFRRGHIIGSVNLTPSEIKENNLGEFEKHKKQLVIVVSANGLESRTPAEHLIRAGFERVYSLKEGITGWSGENLPLARGKK

SEQ ID NO: 8760 - protein, 38 aa, Xenorhabdus bovienii
  Peptide sequence Name=Xb4151_4152.C439.gene15.pep
LTQHTGILCYLRYLLLTNGSCFPPCCKKSCNLLAGILS

SEQ ID NO: 8761 - protein, 56 aa, Xenorhabdus bovienii
  Peptide sequence Name=Xb4151_4152.C439.gene16.pep
VCCVNYSQLAPAQCRFCGEFREKAKILRDSFDCHVSPKYFISHGAGAGFSPINELN

SEQ ID NO: 8762 - protein, 443 aa, Xenorhabdus bovienii
  Peptide sequence Name=Xb4151_4152.C439.gene17.pep
  Gene classification: Gene name=NlpD; Function=Membrane proteins related to metalloendopeptidases; Function class=M Cell envelope biogenesis, outer membrane
  Homolog annotation: Query=54..443bp; Hit=42..427bp; Blast score=355; Percent Identity=60.0; E value=7e-98; Homolog= yibP COG0739
MIGKVLNKMADSKDLKSRNQRQKQDQWQPQNRSLLLCILLFAFFSTDTFANQISESKNQLKDIQQDIAEKEESVKQQQKKRTNLLSQLKDQESTISEVGLSLHGTQTRLNKLGNEITSLNANIKRLQIQQKEQRRLLAKQLDSAFRQGNHQGLELLFNGQETQRKERILAYYSYLNQARQETINKLQKTTEQLNQQKKLQLEKQNEQKTILSSQKQQKQKMEVVHIARQKTLTELESSLQKDQQSLTELRQNEAQLRNKIAKAEREAKARAEREAREAARVRAQVAAKQKQAQQKGSRYKPTEEERSLMARTDGLGRPAGQAIWPVRGRVIHSFGEAIQGELRWKGIVIAAADNTEVKAISDGRVLLADWLQGYGLVVVVQHGKGDMSIYGYNKTTLVSVGQQVRAGQSIALVGSSGGQQQPSLYFEIRRQGRAVNPLPWLGK

SEQ ID NO: 8763 - protein, 345 aa, Xenorhabdus bovienii
  Peptide sequence Name=Xb4151_4152.C439.gene18.pep
  Gene classification: Function=Uncharacterized BCR; Function class=S Function unknown
  Homolog annotation: Query=64..315bp; Hit=1..249bp; Blast score=255; Percent Identity=56.0; E value=5e-68; Homolog= ZyibQ COG2861
MVREIGEEKIMVKSRLIRRVIPFTLLSWILLFCLSLLFTLNAHAARLAIVIDDFGYRVHHENKILQMPTAVSIAILPDSPHGREMAQKAHKQGREILIHLPMAPLSKQPLEKNTLHPSMSREEIGRIIHDAIQKVPHAMGMNNHMGSAMTSSLNGMENVMQVLSSYHHLYFLDSVTIGKTQVTKAAMGTPVQVLRRHVFLDNVQTEAETRHQLNRAIALARKQGSAIAIGHPYPTTVRALQQALTALPDDIELVTPSRLLNPTSASKNDHQTARKCAKPHEPAAVPATKLDYLKRIGNALTHNAIVETLSQHIDKLLGKTESAQKDKTVQGNTGARTTTDTCADF

SEQ ID NO: 8764 - protein, 341 aa, Xenorhabdus bovienii
  Peptide sequence Name=Xb4151_4152.C439.gene19.pep
  Gene classification: Gene name=Tdh; Function=Threonine dehydrogenase and related Zn-dependent dehydrogenases; Function class=E Amino acid transport and metabolism
  Homolog annotation: Query=1..341bp; Hit=1..341bp; Blast score=645; Percent Identity=90.0; E value=0; Homolog= tdh COG1063
MKSLSKLKPEEGIWMADVPTPELGHNDVMIKIRKTAICGTDVHIYNWDDWSQKTIPVPMVVGHEYVGEVVAIGQEVKGFNIGDRVSGEGHITCGHCRNCRGGRTHLCRNTTGVGVNRAGAFAEYLVIPAFNAFKIPDNIPDELAAIFDPFGNAVHTALSFDLVGEDVLVSGAGPIGIMAAAVCKHVGARHVVITDVNEYRLDLARKMGVTRAVNVSKENLTDVMKELGMTEGFDIGLEMSGAPQAFRTLLSTMNHGGRIALLGIPPSDMAIDWNQVIFKGLFIKGIYGREMFETWYKMAALIQSGLDLTPIITHQFSIDDFQKGFDIMRSGQSGKVILNWD

SEQ ID NO: 8765 - protein, 398 aa, Xenorhabdus bovienii
  Peptide sequence Name=Xb4151_4152.C439.gene20.pep
  Gene classification: Gene name=BioF; Function=7-keto-8 -aminopelargonate synthetase and related enzymes; Function class=H Coenzyme metabolism
  Homolog annotation: Query=1..398bp; Hit=1..398bp; Blast score=658; Percent Identity=83.0; E value=0; Homolog= kbl COG0156
MSASFYQKMNEQLEQTRAEGLFKNERIITSAQNADITVADGSQVINFCANNYLGLANHPDLIAAAKAGLDSHGFGMASVRFICGTQDSHKELENKIAEFLGMEDAILYSSCFDANGGLFETLFGPEDAIISDSLNHASIIDGIRLCKAKRYRYANNDMQELRAQLEKAKADGAENILVATDGVFSMDGVIADLKSVCDLADEFDALVMVDDSHAVGFVGKGGRGTHEYCDVMGRVDIITGTLGKALGGASGGYTAARKEVVEWLRQRSRPYLFSNSLAPSIVAASIKVLDMLKHGDELRDRLWRNANLFRAKMTAAGFTLAGADHAIIPVMLGDAKLAQEFAAELLKEGIYVIGFFYPVVPKDQARIRTQISAAHTEEQIEHAVAAFIRIGKQLNVIA

SEQ ID NO: 8766 - protein, 34 aa, Xenorhabdus bovienii
  Peptide sequence Name=Xb4151_4152.C439.gene21.pep
VSSLAGSISKIHHAFHLFRYSGEKNVSVFLSENE

SEQ ID NO: 8767 - protein, 312 aa, Xenorhabdus bovienii
  Peptide sequence Name=Xb4151_4152.C439.gene22.pep
  Gene classification: Gene name=WcaG; Function=Nucleoside-diphosphate -sugar epimerases; Function class=M Cell envelope biogenesis, outer membrane
  Homolog annotation: Query=1..311bp; Hit=1..309bp; Blast score=512; Percent Identity=79.0; E value=1e-145; Homolog= rfaD COG0451
MIIVTGGAGFIGSNIVKALNDEGYKDILVVDNLKDGTKFVNLVDLDITDYIDKEDFIASIVAGDDFGDIDAIFHEGACSSTTEWDGKYMMDNNYQYSKDILHYCLERQIPFLYASSAATYGGRSDNFIEERQYEKPLNVYGYSKFLFDQYVRDILPQADSQICGFRYFNVYGPREGHKGSMASVAYHLNNQIHQGQNPKLFAGSEHFRRDFISVSDVAAVNLWFWKNSISGIFNCGTGRAESFQAVADAVTGFHQEKSPVVEYIEFPEKLKGRYQSFTQADLTKFRAAGYDKPFKTVAEGVTEYMQWLNQDN

SEQ ID NO: 8768 - protein, 350 aa, Xenorhabdus bovienii
  Peptide sequence Name=Xb4151_4152.C439.gene23.pep
  Gene classification: Gene name=RfaF; Function=ADP-heptose; Function class=M Cell envelope biogenesis, outer membrane
  Homolog annotation: Query=1..348bp; Hit=1..347bp; Blast score=529; Percent Identity=74.0; E value=1e-150; Homolog= ZrfaF COG0859
MKILVIGPSWVGDMMMSQSLYRTLKALYPNAEIDVMAPAWCRPLLAKMPEVNQALAMPLGHGTLGLGERRRLGIALRDSTYDRAYVLPNSFKSALVPFFANIPLRTGWRGEMRYGLLNDIRVLNKSAFPLMVQRYVALAYNGKMMSGAEDLPQPLLWPQLDVSDEDIAESTAAFNIADHRPIIGFCPGAEFGPAKRWPHYHYAALAEQLITQKGYQILLFGSAKDHEAGEDIRARLSESAREDCLNLAGQTSLEQAVNIIAACDAIVTNDSGLMHVAAALNRPLVALYGPSSPDFTPPLSNKAEVIRLITGYHKVRKGDNAGGYHQSLIDIQPEQVLALLEKLLQSEKQN

SEQ ID NO: 8769 - protein, 321 aa, Xenorhabdus bovienii
  Peptide sequence Name=Xb4151_4152.C439.gene24.pep
  Gene classification: Gene name=RfaF; Function=ADP-heptose; Function class=M Cell envelope biogenesis, outer membrane
  Homolog annotation: Query=1..319bp; Hit=1..319bp; Blast score=438; Percent Identity=67.0; E value=1e-123; Homolog= rfaC COG0859
MRVLLVKTSSMGDVLHTLPALTDAKQHFPGIQFDWIVEEGFAQIPTWHNAVENVIPVAIRRWRKNWFRKDIREERARFRETLRQNQYDTIIDAQGLLKSAFLVTRLAHGSKHGYDRKSIREPLASFFYDHRHTVSKQQHAVERIRTLFADSLGYQKPTEQGDYAIARHFLNSQIKGQSDYLVFLHATTRDEKHWPENHWRQLIAEIQSTGMRIKLPWGAEHEHQRALRLAEGFAHVDILPKLTLAEVAQVLAGAKAVVSVDTGLSHLTAALDRPNITLFGPTDPGLIGGYGKEQLPLKSVDNTMQSIAPPKVMQLLQNVLK

SEQ ID NO: 8770 - protein, 300 aa, Xenorhabdus bovienii
  Peptide sequence Name=Xb4151_4152.C439.gene25.pep
  Homolog annotation: Query=6..300bp; Hit=9..306bp; Blast score=343; Percent Identity=55.0; E value=2e-93; Homolog= gi|37524508|ref|NP _927852.1| hypothetical protein [Photorhabdus luminescens subsp. laumondii TTO1] gi|36783932|emb|CAE12794.1|
MGIFFMAEIKALFSGWKKCDFERYKEAYALFGGCVSTDPNIISFLDRHLDGKFSFYIKETGNLIKGACFSFNNNKLVEEMKDRYLISYDEITFPIAMDAKLFLPVKSKRLSPIHENNFINTCYKPFFNKRKICLIKDSFSYKTRRNRSNEINKFKRAGGEIRPSSEFSAEELVNIYVDLYQKRWDYNHSAEQRKHLLEMYTELREHIFGYVLLINGNPCAYDFVLRADSPKWISFDAINGGYDPEYADLSVGSILMWVNTQEAKAQCQEADKTMRYSLGNPTFEYKNRWCVTLPLGKVLF

SEQ ID NO: 8771 - protein, 54 aa, Xenorhabdus bovienii
  Peptide sequence Name=Xb4151_4152.C439.gene26.pep
MGRMALNKDQFYLTGEIITLHIIIYNSRYYWLDQYLFSLLNALQTYGKKMEIFL

SEQ ID NO: 8772 - protein, 76 aa, Xenorhabdus bovienii
  Peptide sequence Name=Xb4151_4152.C439.gene27.pep
MILSTIFSNRSFIKGCRLGGHGNICISDEAKNRIQITNNIYYWIYYLILSWHFHGYKKISIFFPYVCNAFSNENKY

SEQ ID NO: 8773 - protein, 319 aa, Xenorhabdus bovienii
  Peptide sequence Name=Xb4151_4152.C439.gene28.pep
  Gene classification: Gene name=WcaA; Function=Glycosyltransferases involved in cell wall biogenesis; Function class=M Cell envelope biogenesis, outer membrane
  Homolog annotation: Query=5..231bp; Hit=3..224bp; Blast score=160; Percent Identity=41.0; E value=2e-39; Homolog= BH3714 COG0463
MSVYPKISVLMSVYNGEKYLEEAIDSILSQTFEDYELIIIDDGSTDSSPSILSSYAEKDMRVKVITNENNIGLILSLNKGLYMASSNLVARMDADDIAIPERLKIQVDFMQNHPDIVVCGGFTTYLENPTKGDIHATSHEGIVAECFFHCPVAHPTVIMRKDKILELTDGYDPNDLYAEDYGLWSRLIMSKRAKFANINKSLLNYRTHPNNPRFEYKKKQKKTAVTIQQKMFSSLGIYIPLKDVSLMNHSEGKISIDDVKQCEFWLYKIEQCTNNMNKTERICFLREIKDKKMYLWRKIRKNSMSAILRYIRARLYYKK

SEQ ID NO: 8774 - protein, 317 aa, Xenorhabdus bovienii
  Peptide sequence Name=Xb4151_4152.C439.gene29.pep
  Gene classification: Gene name=WcaA; Function=Glycosyltransferases involved in cell wall biogenesis; Function class=M Cell envelope biogenesis, outer membrane
  Homolog annotation: Query=17..308bp; Hit=4..295bp; Blast score=68; Percent Identity=24.0; E value=7e-12; Homolog= L16653 COG0463
MTIKACDIDLASSKILSIVVAAHNLEKLILKCINSIKDALSDCDPSLYEVLLIDDSSSDSTPSILRKFSEENDSFIYIRKEFKSLGKVKKYSVEVSNGEYITFVDGDDFLSEFSMKEIVGFLMDKRPDMLISPLQEVRNDADIIHKSSLISPVLFDKKTAIKEYLIHKKYQAHSCGKFFRKKLLRGNNFPEVSCYEDALSFPAVLIKCNKVYYTKMKYYNYIKSEGSLSGNINEEKINLMADVVLTADRVFGKEFRMLTVCHAIDIIYKYRNNLSRKSHSLLMGLIDSISVLNFMLNTNVRFSFKKKYYKIRNHFKS

SEQ ID NO: 8775 - protein, 323 aa, Xenorhabdus bovienii
  Peptide sequence Name=Xb4151_4152.C439.gene30.pep
  Homolog annotation: Query=1..321bp; Hit=4..324bp; Blast score=565; Percent Identity=83.0; E value=1e-160; Homolog= Pa|Phot2-60c06.p1ka _g168| 124349 - 125326 2792 325 aa, chain -
MTLPTFIITIDTEGDDLWQNSDKISTKNTQYLPRFQNLCERFGFKPVWLTNYEMAMDDSYIEFAKDVIARDTGEIGMHLHAWNNPPIVSLTADDMRYKPYLIEYAKDQIKAKIDLMTNLLEEKLQTKMLSHRAGRWAFNEYYAQLLVEYGYQVDCSVTPKINWHFTKGDPNGNGGTDYSHFPTQAYFMDLQDIAKEGDSSLLQVPMSIQYKHSPIMNFIKQKYDHLRGKQRSPSVNWLRPKGGNLEQMKKVVQQTLAGGSDYVEFMLHSSEFMPGGSPTFKDEEQIEQLYRDLEGLFDFLRPLVRGMTLAEYYQFKSPKNNAD

SEQ ID NO: 8776 - protein, 32 aa, Xenorhabdus bovienii
  Peptide sequence Name=Xb4151_4152.C439.gene31.pep
MIDTTYRVIEKLKMYTLWLLAALKSSYRIDII

SEQ ID NO: 8777 - protein, 355 aa, Xenorhabdus bovienii
  Peptide sequence Name=Xb4151_4152.C439.gene32.pep
  Gene classification: Gene name=RfaF; Function=ADP-heptose; Function class=M Cell envelope biogenesis, outer membrane
  Homolog annotation: Query=9..354bp; Hit=6..343bp; Blast score=282; Percent Identity=43.0; E value=3e-76; Homolog= ZwaaQ COG0859
MIKNHNGIKKILVIRLQHHGDMLLITPVISTLKYHYPDAKIDVLLYQETLPMLENSPEISSIFSIDRKWKNFGAKKHLLLEWDLLKTLSQQRYDLTINLADQWRSAFITRFIGAPIRLALDYPKRQNWKWRLCHTEVVSTIGHDSLHTVEQNLSILKPLQLTPLINKVTMSYGKDDLQWVKDTLSGYKFAENYLVIQPTSRWFFKCWDEIKMAKVITALQKEQQNIIITSGPDRRELEMVDTILSYCPDKNNILSLAGQLTLPKLAALIDHSKLFIGVDSVPMHMAAALKTPCIALFGSSKLTFWKPWQSIGEVIWAGDYGNIPHPDDIKTHTDTRYLDLIPTDAVISAARKYIS

SEQ ID NO: 8778 - protein, 376 aa, Xenorhabdus bovienii
  Peptide sequence Name=Xb4151_4152.C439.gene33.pep
  Gene classification: Gene name=RfaG; Function=Predicted glycosyltransferases; Function class=M Cell envelope biogenesis, outer membrane
  Homolog annotation: Query=149..319bp; Hit=151..328bp; Blast score=91; Percent Identity=30.0; E value=1e-18; Homolog= MJ1607 COG0438
MKSLRLAIVRQKYRPDGGAERFVTRALEALNHQQLELNIITRSWQGESNPNWNIHLCNPIKFGRISRERGFAKAARNLWQKEQFDLVQSHERIAGCDIYRAGDGVHQRWLHQRARILPKWKAHWLLNNPYHRYVMNAEEEMYSSPSLKQVICNAEMIKKEIIEEFSLAEDKISVIYNAIDSTKFFPAHEQTRLQLRQQYNIPTTAKCLIYVGSGFERKGLSAAIKTIAKTGDYLLVVGKDKEQVKYEELANTLGCQHRIRFMGLQKNTLLLYQMSDALLLPTLYDPFPNVILEAMACGLPVITSTTCGGAEFITEGKNGFICDALDIGKLEEAVYCLPNNILGTDMSISARNQVINSTPENLSQQLIQLYQRVSEQ

SEQ ID NO: 8779 - protein, 367 aa, Xenorhabdus bovienii
  Peptide sequence Name=Xb4151_4152.C439.gene34.pep
  Gene classification: Gene name=RfaG; Function=Predicted glycosyltransferases; Function class=M Cell envelope biogenesis, outer membrane
  Homolog annotation: Query=9..313bp; Hit=8..304bp; Blast score=105; Percent Identity=29.0; E value=7e-23; Homolog= Cj1127c COG0438
VKEHILFIIDGLPGGGAENVTLRLAIGLHQLGYQISLLSLNTQLVYNIPEGIHYIVSADSYQGPFRKLNELKRRAKAMDKVLSELFQQKGKPTLVISNLHKTDRIVVKSTILSYCNVWHCIHGIFSHSYLSNKKPLSYWIKKEKIKKVYKNKQVICVSDAVRDDLVKNIGIHPKQITTIYNPFNFNEIKHRALQPNPYHGKNYLLHIGRFHEVKRHDRLIAAFAQAKLPCKLIIVGNGAKDIENHIKAKIHELNLGDKVILAGFHSNPLPIIHGAKAVVISSDSEGLPTVLIEALICHTPIVSTDCPGGVREIMTGKLKEYLSEITVDALAEKMQLVYNEPPVITDTMYEKFAINNILRQYTALIEQ

SEQ ID NO: 8780 - protein, 425 aa, Xenorhabdus bovienii
  Peptide sequence Name=Xb4151_4152.C439.gene35.pep
  Gene classification: Gene name=KdtA; Function=3-Deoxy-D-manno -octulosonic-acid transferase; Function class=M Cell envelope biogenesis, outer membrane
  Homolog annotation: Query=1..425bp; Hit=1..425bp; Blast score=638; Percent Identity=74.0; E value=0; Homolog= kdtA COG1519
MLLRLYQVLLYLIQPLIWLRLLLRSRKSPAYRKRWGERYGFCAKKVAKGGILLHSVSVGETLAAIPLVRILRHHYPFLPITVTTMTPTGSERVLSALGTDVNHVYLPYDLPGSMSRFLDNVNPKLVIIMETELWPNLITQLNQREIPLVIANARLSTRSAAGYQKISNFIKTILNKITLIAAQNQEDGERFIELGLKRSQLAVTGSLKFDISVTPELAAKAVTLRRQWAPHRPVWIATSTHDGEETIILDAHCKLIQQFPDLLLILVPRHPERFTKAAELTQKAGLNSILRSSDTIPDPNVQVVIGDTMGELMLLYGIADLAFVGGSLVERGGHNPLEAAAHAIPVIMGPHTFNFKDICAKLDKANGLIAVTDSHSLSAAINSLLTDEDYRLYYGRHAAEVLHENQGALQRLLKLLEPYLPPRGH

SEQ ID NO: 8781 - protein, 258 aa, Xenorhabdus bovienii
  Peptide sequence Name=Xb4151_4152.C439.gene36.pep
  Gene classification: Gene name=WcaA; Function=Glycosyltransferases involved in cell wall biogenesis; Function class=M Cell envelope biogenesis, outer membrane
  Homolog annotation: Query=7..254bp; Hit=4..253bp; Blast score=236; Percent Identity=47.0; E value=1e-62; Homolog= PM1306 COG0463
MSKRKRLSVVMIAKNSADLIADCLLSVDWADEIIVLDAGSTDTTCQIASEMGAKVYINTQWPGFGRQRQLAQSYASGDYIFMIDTDERVTPELRTSIEQILADPDDDKVYDCARLNLFMDRFMKHSGWYPDKVIRLYCREHYQYNDNQVHESLNTQGVRIVTLKGDLRHLTCRNLMEFQQKQLNYARDWAKYRHEQGNTARYFSIFSHTLGAFFKTWLLRAGFLDGKQGLVLAMVNAQYTFNKYAALWELTQTESKKR

SEQ ID NO: 8782 - protein, 163 aa, Xenorhabdus bovienii
  Peptide sequence Name=Xb4151_4152.C439.gene37.pep
MIAPFFTLSYLPNFFSIACATGSGRNVETSPSWRATSFIKDDDTKDRFCEGNKKTLSSSGIKCRFMLASCHSYSKSETERTPRIKMVACCFLAKLAISSLNPTTSTFFRWAVTSFASAVRSSRLNMGFFLSLLAMASKTWSNMFAARVTISRWPWVIGSKVPG

SEQ ID NO: 8783 - protein, 269 aa, Xenorhabdus bovienii
  Peptide sequence Name=Xb4151_4152.C439.gene38.pep
  Gene classification: Gene name=Nei; Function=Formamidopyrimidine-DNA glycosylase; Function class=L DNA replication, recombination and repair
  Homolog annotation: Query=1..268bp; Hit=1..268bp; Blast score=407; Percent Identity=73.0; E value=1e-114; Homolog= ZmutM COG0266
MPELPEVETSRRGIEPHLTGNVIQYSEVRNSRLRWPVSEQIMKLADQPVLSVRRRAKYLLLELPEGWIIIHLGMSGSLRILLNESPPEKHDHVDLIMADGKILRYTDPRRFGAWLWSDNLDECSVLAHLGPEPLSDAFDGEYLYTLSRHKKTVIKPWLMDNKVVVGVGNIYANEALYVAHILPERPVNSLTQEEAYLLADTIKQILHRSIEQGGTTLKDFLQSDGKPGYFAQELFVYGKKGELCPTCGEKIESIKLGQRSTFFCRQCQH

SEQ ID NO: 8784 - protein, 411 aa, Xenorhabdus bovienii
  Peptide sequence Name=Xb4151_4152.C439.gene39.pep
  Gene classification: Gene name=RfaL; Function=Lipid A core - O -antigen ligase and related enzymes; Function class=M Cell envelope biogenesis, outer membrane
  Homolog annotation: Query=18..405bp; Hit=18..399bp; Blast score=241; Percent Identity=38.0; E value=1e-63; Homolog= ZwaaL COG3307
MLDIKNRFNIGNNKKSLWNLSIIGLYIILVYLPDITRYKNLVMILICATALCYLVKDFRQVVNSLRSSLFLSILLFVLAIFYSIGISIDSALSFKEMNKPILNGLLLFSVTFPIVLYQEKKQHIAKMILIAFIIGMGLISLTDIAKYLINYYATGEMPFMNYNHREFSYGFLFYFPVLLCTWALWKKHSLLSWLLLIIASAISLFLLLGTLSRGAWVAIVVATVFIIVINREWKLILAATICLGLLAGSIHWSAVSNPATKLLLHKLTQTDSSYRYSNGTQGSAWSLIMENPVKGYGFGNKVYHQVYNSRVADYPDWTFRTSIGPHNVFLSLWFAGGLFGLITTLLMTLSTLFTGSQIIRQHSGIIRQAGLILLTAFIGLFIVRGAFENAYINEIGILFGLMIALYKQKDD

SEQ ID NO: 8785 - protein, 34 aa, Xenorhabdus bovienii
  Peptide sequence Name=Xb4151_4152.C439.gene40.pep
LLNASPQWAGLQTISVIAYLDRFSAITCMISFAR

SEQ ID NO: 8786 - protein, 392 aa, Xenorhabdus bovienii
  Peptide sequence Name=Xb4151_4152.C439.gene41.pep
  Gene classification: Gene name=RfaG; Function=Predicted glycosyltransferases; Function class=M Cell envelope biogenesis, outer membrane
  Homolog annotation: Query=183..385bp; Hit=165..351bp; Blast score=68; Percent Identity=26.0; E value=1e-11; Homolog= AF1728 COG0438
MKIAYIDPYPVPDYRVASLQILQNVDAFARQGHSVCLITPEGQNRVEEIIGRALPPSAELIALRNMRRKWYFPLNTQKLFYFQVSRWLKDHQVDAIFTRNIKMANYLLRKHPDIPHFFESHEVFAQSFKESHKLDKRKNRRKYHKLRNTEQQVYRHSKAVFVLTSLLSEDIYKEYSVKTPMIVAPDGVDMLAVESTKKASSGRRHKPGETTQVLYLGSLHRWKGVPTVMKAMYYLDNAVLNIAGGDSVQIERLKCTAQQIGVSDKVNFLGFIQPKKRFQVIAENDICVLPLTKTSIGSRYTSPLKLFEYMAMGKPVVISDFPSIRDAVDEKAVNFADSENAESFAEQIQSLIDNPAEMMAKVGYSQRLVAERFNWDQRAKLIMQVIAENLSK

SEQ ID NO: 8787 - protein, 367 aa, Xenorhabdus bovienii
  Peptide sequence Name=Xb4151_4152.C439.gene42.pep
  Gene classification: Gene name=RfaG; Function=Predicted glycosyltransferases; Function class=M Cell envelope biogenesis, outer membrane
  Homolog annotation: Query=157..354bp; Hit=168..363bp; Blast score =122; Percent Identity=37.0; E value=6e-28; Homolog= PH1844 COG0438
MKIGFIDVTVTMSYGGIQTAVWELAKALTDAGHEIHIFGGTGDVRPVLGERNIHVHTFPFTPRERVINIGRRFQRIVERYSFARHARERVIAENFDWVILTKPFDFFWPRMMPKTSCTKFCYMSGGTSFFKGDRALGNKISAWVACSHFNAWQIQHHFKQFPNVIYNGVDIDKFKPVNSDLRHRLDINENTFLLTFAGRLVGWKGMKVAIDAMALLRDKDVRLLIIGAGDDLNLLKKKVSELNLEKTVIFHPPVGHDQLPEFYAAGDAGIFPSIGDEAFGITIAEAMACGRPVIASYIGGIPEVVGNENHAGILVAPGNAAAIAEAVNHLLSLPDRGKAMGKLARQRIETMYTWEHSANRLLGAIKK

SEQ ID NO: 8788 - protein, 136 aa, Xenorhabdus bovienii
  Peptide sequence Name=Xb4151_4152.C439.gene43.pep
  Homolog annotation: Query=1..87bp; Hit=1..87bp; Blast score=134; Percent Identity=73.0; E value=2e-31; Homolog= gi|37528670|ref|NP _932015.1| WalO protein [Photorhabdus luminescens subsp. laumondii TTO1] gi|36788109|emb|CAE17233.1| WalO prot
MQPKNILVIIIARFGDTLLITPVIRALKLRWPEANIDVLAHKKTKEILENISEIHSITAFSKGQAKWRGWFSRRRYDFALVYHSFHPGRFLAPQQHPKLAVIEHPIDYQQATRQDEMSAISVEQVWVSVQNLLENT

SEQ ID NO: 8789 - protein, 371 aa, Xenorhabdus bovienii
  Peptide sequence Name=Xb4151_4152.C439.gene44.pep
  Gene classification: Gene name=RfaG; Function=Predicted glycosyltransferases; Function class=M Cell envelope biogenesis, outer membrane
  Homolog annotation: Query=6..352bp; Hit=1..355bp; Blast score=122; Percent Identity=28.0; E value=4e-28; Homolog= XF1470 COG0438
MTKKTLNILHTESSCGWGGQEIRILTESQGMIQRGHQVVIVCCPASTIYHEAHSYGVPVVALPIEKKRLPCLRAMRRWLKAEGRQFDVINTHSSTDSWLVAAACATLQGMPPIVRTRHVSTNVSTSVATRWLYLKSCQHIVTTGEKLRQYLHTNNGYPLPHMTSVPTGIDLTRFHPENKQLCRQRIGIADKPTLGIVATMRTWKGHRYLLDSWKILHSCYPDWQLLFVGDGPQRKNLEPQAKQEGLSESVIFLGNRQDVPDCLNAMDVFALPSFGNEGVPQGIMQAMACGLPVVSTSVGAITEAVIDGDTGYIIEPRCVEQLTERLDVLMKSAELRLQMGNASLERAADLFSMDNMLEKMEFIFYGSMERK

SEQ ID NO: 8790 - protein, 50 aa, Xenorhabdus bovienii
  Peptide sequence Name=Xb4151_4152.C439.gene45.pep
LIQLFASMWCIKKLKLNNFSGLRKNPAYAGFFYTCQNVWIAWLKTGYAWT

SEQ ID NO: 8791 - protein, 55 aa, Xenorhabdus bovienii
  Peptide sequence Name=Xb4151_4152.C439.gene46.pep
  Gene classification: Gene name=RpmG; Function=Ribosomal protein L33; Function class=J Translation, ribosomal structure and biogenesis
  Homolog annotation: Query=1..55bp; Hit=1..55bp; Blast score=79; Percent Identity=89.0; E value=6e-16; Homolog= rpmG COG0267
MAKGIRDKIKLVSSAGTGHFYTTTKNKRTMPEKLELRKFDPVIRQYVVYKEAKIK

SEQ ID NO: 8792 - protein, 78 aa, Xenorhabdus bovienii
  Peptide sequence Name=Xb4151_4152.C439.gene47.pep
  Gene classification: Gene name=RpmB; Function=Ribosomal protein L28; Function class=J Translation, ribosomal structure and biogenesis
  Homolog annotation: Query=1..78bp; Hit=1..78bp; Blast score=135; Percent Identity=96.0; E value=9e-33; Homolog= rpmB COG0227
MSRVCQVTGKRPVSGNNRSHALNATKRRFLPNLHSHRFWVESEKRFVTLRVTAKGMRVIDKKGIDVVLAELRARGEKY

SEQ ID NO: 8793 - protein, 75 aa, Xenorhabdus bovienii
  Peptide sequence Name=Xb4151_4152.C439.gene48.pep
MSILQKSNQLELYIGYDRLVRLRSPSQHIFITEKTHIISIKKLTEIGSSRQTQDPQRWRSIRPHSLMLKSRTTKI

SEQ ID NO: 8794 - protein, 230 aa, Xenorhabdus bovienii
  Peptide sequence Name=Xb4151_4152.C439.gene49.pep
  Gene classification: Gene name=RadC; Function=DNA repair proteins; Function class=L DNA replication, recombination and repair
  Homolog annotation: Query=16..230bp; Hit=10..224bp; Blast score=248; Percent Identity=52.0; E value=4e-66; Homolog= radC COG2003
MDVTVMEISDELHSNLAPREKLLAYGAVSLTDAELLAIFLRTGTRGIPVVQMAEHLLKSFGSLYHLLSADYADFCSHKGMGLCKYVQLQAVSELAKRFFSSQFIHEDVMSSPVATQNYLQDLLSWQDREVFVVLFLTNQNKVICHDEMFKGTINKVEVHPREIVKQAVKVNAASIILAHNHPSGNPEPSLADKLVTEKIIDACELVGVKVLDHIVIGKQHCVSFVERGWI

SEQ ID NO: 8795 - protein, 53 aa, Xenorhabdus bovienii
  Peptide sequence Name=Xb4151_4152.C439.gene50.pep
LRTCLIQVPKNDKFAKRYASHENGAGDAFFIMGYWRREATGRKGMRGNIWMLR

SEQ ID NO: 8796 - protein, 33 aa, Xenorhabdus bovienii
  Peptide sequence Name=Xb4151_4152.C439.gene51.pep
MFTRKLFAGKSCHSDCPHVSYNYLRFYHKKILS

SEQ ID NO: 8797 - protein, 409 aa, Xenorhabdus bovienii
  Peptide sequence Name=Xb4151_4152.C439.gene52.pep
  Gene classification: Gene name=Dfp; Function =Phosphopantothenoylcysteinesynthetase/decarboxylase; Function class =H Coenzyme metabolism
  Homolog annotation: Query=9..409bp; Hit=27..430bp; Blast score=561; Percent Identity=72.0; E value=1e-160; Homolog= dfp COG0452
MAGFSSKQLSGKHIVLGISGGIAAYKTAELVRRLRDRGAEVRVAMTPAAEAFITPLTLQAVSGHPVSDDLLDPAAEAAMGHIELAKWADLIILAPATADLLARLTAGMANDLVTTICLASAAPIAVAPAMNQQMYRAQATQHNLNVLKERGVLIWGPDEGSQACGDVGPGRMLEPMAMVELATQHFNTDQDFSGLCITITAGPTHEALDPVRFITNHSSGKMGFSIAQAAAERGADVTLIAGPVNLPTPPGVKRIDVTSALEMHEYVQVTAASQHIFIGCAAVADYRFKQIATEKIKKQGDEVTFTLVKNPDIVASVATMEINRPFVVGFAAETQNVEEYARRKLKQKSLDLICANNVSLAEHGFNSDTNALHLFWHDGSVNLPHSSKLQLGHCLLDEILKRYDEKNRR

SEQ ID NO: 8798 - protein, 152 aa, Xenorhabdus bovienii
  Peptide sequence Name=Xb4151_4152.C439.gene53.pep
  Gene classification: Gene name=Dut; Function=dUTPase; Function class =F Nucleotide transport and metabolism
  Homolog annotation: Query=3..152bp; Hit=2..151bp; Blast score=258; Percent Identity=83.0; E value=2e-69; Homolog= Zdut COG0756
MTKKIDVKILDPRIGQEFPLPTYATPGSAGLDLRACLDNAVELAPGQTELLPTGIAIHIADEQLAAVILPRSGLGHKHGVVLGNLVGLIDSDYQGQLMVSVWNRGDKMFIIEPGERIAQMVFVPVVQAEFNLVEDFETSKRGSGGFGHSGRQ

SEQ ID NO: 8799 - protein, 60 aa, Xenorhabdus bovienii
  Peptide sequence Name=Xb4151_4152.C439.gene54.pep
VPVSVRFPHVYFSFLYVLFLPCLIRPLLKQQNKSSYFLPTTIMGKKYENRLTVSGFMESY

SEQ ID NO: 8800 - protein, 199 aa, Xenorhabdus bovienii
  Peptide sequence Name=Xb4151_4152.C439.gene55.pep
  Gene classification: Gene name=AcrR; Function=Transcriptional regulator; Function class=K Transcription
  Homolog annotation: Query=1..199bp; Hit=15..212bp; Blast score=284; Percent Identity=80.0; E value=4e-77; Homolog= ttk COG1309
MAEKERTKKKNRREEILQTLAHMLESSDGSQRITTAKLAANVGVSEAALYRHFPSKTRMFDSLIEFIEDTLISRINLILQDEKDTITRIRLILILLLGFAEKNPGLTRIMTGHALMFEQDRLQNRINQLFERIEAQLRQILKEKKIRDGQGFNYDEAVLASQLLAFCEGMLSRFVRSEFRYRPTQEFEIRWPLILTQLQ

SEQ ID NO: 8801 - protein, 46 aa, Xenorhabdus bovienii
  Peptide sequence Name=Xb4151_4152.C439.gene56.pep
MPLLSYFIVNSTRRCILTQFNEKTARYHSQHERGNFTVQAQLLQLS

SEQ ID NO: 8802 - protein, 62 aa, Xenorhabdus bovienii
  Peptide sequence Name=Xb4151_4152.C439.gene57.pep
MASLPYYMRGVISTTHPARPLGEGFFYLSAVFTQRAIRYRILCDRLPPPPNKAAYLDFHVDI

SEQ ID NO: 8803 - protein, 213 aa, Xenorhabdus bovienii
  Peptide sequence Name=Xb4151_4152.C439.gene58.pep
  Gene classification: Gene name=PyrE; Function=Orotate phosphoribosyltransferase; Function class=F Nucleotide transport and metabolism
  Homolog annotation: Query=1..213bp; Hit=1..213bp; Blast score=346; Percent Identity=79.0; E value=1e-95; Homolog= pyrE COG0461
MKAYQREFIELALKKQVLKFGEFTLKSGRKSPYFFNAGLFNTGRDVALIGRFYAAALLDSGISCDLLFGPAYKGIPIATTTAVALAERHDIDMPYCFNRKEAKDHGEGGSLVGSPLQGNVVVVDDVITAGTAIRESMEIIKQHGATLSGVILCLDRQERGQETLSAIQEVERDYHCKVFSIITLNDLIRYLRENPDMQPYLAAVEAYRREYGI

SEQ ID NO: 8804 - protein, 242 aa, Xenorhabdus bovienii
  Peptide sequence Name=Xb4151_4152.C439.gene59.pep
  Gene classification: Gene name=Rph; Function=RNase PH; Function class= J Translation, ribosomal structure and biogenesis
  Homolog annotation: Query=7..241bp; Hit=2..236bp; Blast score=355; Percent Identity=80.0; E value=3e-98; Homolog= Zrph COG0689
MSPVGKRPAGRTAGQVRPIKMTRHYTKHAEGSVLVEFGDTKVLCNASVEEGIPRFLKGQGQGWITAEYGMLPRATNSRNAREAARGKQTGRTMEIQRLIARSLRAAVDLKKLGEYTITLDCDVIQADGGTRTAAISGACVALVDALNKLVADGKLKKSPMKSMVAAVSVGIVEGEGLCDLEYVEDSAAETDMNIVMMDDGRMIEVQGTAEGEPFSHDELLSLLSLAKEGLETIFAAQRDALK

SEQ ID NO: 8805 - protein, 44 aa, Xenorhabdus bovienii
  Peptide sequence Name=Xb4151_4152.C439.gene60.pep
VFSPLLKHYWGRIIRPNTANAYPASTRRVIIRSSFYKLETNYDP

SEQ ID NO: 8806 - protein, 287 aa, Xenorhabdus bovienii
  Peptide sequence Name=Xb4151_4152.C439.gene61.pep
  Gene classification: Function=Uncharacterized stress-induced protein; Function class=S Function unknown
  Homolog annotation: Query=1..287bp; Hit=1..287bp; Blast score=379; Percent Identity=81.0; E value=1e-105; Homolog= yicC COG1561
MIRSMTAFARRDIKADWGNAAWELRSVNQRYLETYIRLPEQFRSLEPVIRERIRSRLTRGKVECNLRFDLDTRTQGTLMLNENLAKQLVEAANWVKQQSNQGEINPVDILRWPGVMSAEEQDLDTISIQLLAELDLALDAFIQSRETEGQALKTLIEQRLDAVTEEASKIRQQMPEILQWQRERLQTKLEEAQIQLENNRLEQELILMAQRIDVAEELDRLDAHVKETRNILKKKEAVGRRLDFMMQEFNRESNTLASKSINADVTNSAIELKVLIEQMREQIQNIE

SEQ ID NO: 8807 - protein, 37 aa, Xenorhabdus bovienii
  Peptide sequence Name=Xb4151_4152.C439.gene62.pep
MCFGYTFGYTLIMRYCDSLCNALITKKPDTTRCMLAL

SEQ ID NO: 8808 - protein, 49 aa, Xenorhabdus bovienii
  Peptide sequence Name=Xb4151_4152.C439.gene63.pep
LPDFIHALISLLVSLGIVQSPMKNRGCTQNGFLNVLWVHLWVHPNHALL

SEQ ID NO: 8809 - protein, 423 aa, Xenorhabdus bovienii
  Peptide sequence Name=Xb4151_4152.C439.gene64.pep
  Gene classification: Gene name=XerC; Function=Integrase; Function class=L DNA replication, recombination and repair
  Homolog annotation: Query=1..415bp; Hit=1..407bp; Blast score=135; Percent Identity=28.0; E value=1e-31; Homolog= mlr6952 COG0582
MPKLTNKEIRAWIKSGKRFEGKADGNGLYLRFREADRIPSWRFRYKLAGKSRTMNLGTYADLSLAKARELTRELSARVSLGYDVAGEKQERKAEALAKIEAEKNAIKVSDLAAEYFERQILPRWKHPDILRRRIDKDINPRIGHMKLEDVRPRHIDEMLKSIVDRGAPTMATDVLRWLRRMFDYAIKRQMIEINPCSAFEVADAGGKEVSRDRWLTREELIILLRTFRTSSISRQNEISFKILLALCLRKMELCGARWEEFNFKKAVWHFPAERSKNGDAVDIPLCPQVIEWFMELKAMACGSQYVLPARKMQHRMIPHIQESTLPVALAKVRRELPVDMPNFTIHDFRRTARTHLAALGVDPFVAERCLNHRIKGVEGIYNRHDYFDERKAALAQWCDLLVALEKGEDYNVTPIKQIKRKFL

SEQ ID NO: 8810 - protein, 245 aa, Xenorhabdus bovienii
  Peptide sequence Name=Xb4151_4152.C439.gene65.pep
MKKPPEIDRFKLFSFQGRATPNAVALSLLGINPYAAVKDIPEEYSENVNMLRSAIVNNVNAVNPLQDTKTNSAVDSDIVFGAAYPYVCLLEEFIPEIIKSRIEQALNNIYTKYKNDEWKTYIHALGGQELVQKIAMQNKKGQGQYRKNDEQKGTYKLIGLLVLLLQEKTINGCQPSNNYGSIGKPNKKRIYEDIKELVDGMNKDLLADGINKDFLGGVGSSTFYDKLRDADYYLNESDEQLVHNQ

SEQ ID NO: 8811 - protein, 30 aa, Xenorhabdus bovienii
  Peptide sequence Name=Xb4151_4152.C439.gene66.pep
MGLYFSCVGFSASPCCFWPPYVMPISVVTC

SEQ ID NO: 8812 - protein, 80 aa, Xenorhabdus bovienii
  Peptide sequence Name=Xb4151_4152.C439.gene67.pep
MVKQKNPRMKNTSPYPEIGNARKRHTADFLGISDSTLHRWIKDKKIPQPFELEDGFFVFDAAEIRKWVENKKSRRESIVI

SEQ ID NO: 8813 - protein, 279 aa, Xenorhabdus bovienii
  Peptide sequence Name=Xb4151_4152.C439.gene68.pep
MNEVSFYKDENLSYIFNYKFIPFEENGKDTGFMIRTIELYKLAKMKDSIKKFTELTGFNFDNLIPSVEEIKLLIKRGRSVVSNYSKLPEKEDAELKSMVDILSNAQSGKIKNPNSYSISNRAWITDMHHAVERKEDSIKRERGKLEKVNGLYGLLYPVIEWLFSEKIMGFKKELLESIPRETVNLNALLSGMDWEHSRACKLIISATDELERCINKIISQCVTPKDKYTLNHTPVYQSDYYKLYYRKESHHLKHVLTADEYVNTMVNAKNRTKDKLSYM

SEQ ID NO: 8814 - protein, 339 aa, Xenorhabdus bovienii
  Peptide sequence Name=Xb4151_4152.C439.gene69.pep
  Homolog annotation: Query=6..302bp; Hit=5..302bp; Blast score=192; Percent Identity=38.0; E value=6e-48; Homolog= gi|17975128|ref|NP _536650.1| putative major capsid protein [Bacteriophage K139] gi|17865410|gb|AAL47517.1|AF125163_23 orf18 [B
MYITAIPDAARTFHANFTRGAEYTSSNSNTFAISPPSENLLRVAISDSSWFLNKLTLADVSQENGDTVNLGDNTLHTGRVIDGRFHKRVNMEGAPYALEETDTCAAISYEQMSLIANSGSGDDEHFTKIMSDLFSKTVSLDMIRIGFNGEFCAYPTQPDIYKRGQDVNRGWHAIAKEFNQGSQVITDKISLGKNGDFPNLDAIANYLIIKKIPEEFREDPRLVVLVGSELAALYREKLFSASDKAADIQASQLALSTIAGRFALIPPFMPGRRLVVTTLDNLHIYTQKNTRRFRAEFVDERQVYEHSYLRNEGYGLGDGNLYAAVDENAIHIEEGVFSL

SEQ ID NO: 8815 - protein, 173 aa, Xenorhabdus bovienii
  Peptide sequence Name=Xb4151_4152.C439.gene70.pep
  Homolog annotation: Query=3..132bp; Hit=2..131bp; Blast score=139; Percent Identity=50.0; E value=2e-32; Homolog= gi|32030386|ref|ZP _00133247.1| hypothetical protein [Haemophilus somnus 2336]
MSESQLMTTWICVATEGQTIDRRVIEAQWLNEIAETYDPNYYTALIWEEHNRNLDNLGEVLAARTDVIDGKARLYLRLRPNLKLMEYNRQGQKLFCSIEVQEDFQGEGIFYLGGLAVTDSPASVGTDRLKFSINRSHFSRKKSKFSISSPVVFNLSDGLKNTKNRWFTAISAG

SEQ ID NO: 8816 - protein, 31 aa, Xenorhabdus bovienii
  Peptide sequence Name=Xb4151_4152.C439.gene71.pep
MIKIGLNYEVDRDEKTAQPKLGKRVNLRRLL

SEQ ID NO: 8817 - protein, 170 aa, Xenorhabdus bovienii
  Peptide sequence Name=Xb4151_4152.C439.gene72.pep
  Homolog annotation: Query=14..163bp; Hit=22..179bp; Blast score=70; Percent Identity=33.0; E value=1e-11; Homolog= gi|15799976|ref|NP _285988.1| putative regulator encoded in prophage CP-933I [Escherichia coli O157:H7 EDL933] gi|15829554|ref
MKIKRLHPSERLGYIGNTLAKSNVRRGNLRIVKATVDATCVFFCVVNNAYLMAAYAYLNSMVALSEHPKGWLVSFTTSISTSDNVTAPIERGNSGGDHFYKVKEIIFMMTVPTQTQFKFIFLCVKRSDTTAKPFRIEATALDEHNARILLVHDFVLLFAGRLPVQPKREN

SEQ ID NO: 8818 - protein, 72 aa, Xenorhabdus bovienii
  Peptide sequence Name=Xb4151_4152.C439.gene73.pep
MTNTIHKNAVISATGEKQLLRVAQMTAFLAELLNNSEGKPISSEGMAVVMECLSEQVELIIEESSLMNRDIK

SEQ ID NO: 8819 - protein, 904 aa, Xenorhabdus bovienii
  Peptide sequence Name=Xb4151_4152.C439.gene74.pep
  Homolog annotation: Query=338..900bp; Hit=126..687bp; Blast score =685; Percent Identity=58.0; E value=0; Homolog= gi|16766057|ref|NP _461672.1| putative inner membrane protein [Salmonella typhimurium LT2] gi|16421291|gb|AAL21631.1| putative
MNNQNYPDASTIPTSIPSVTDIVKAANGRWYYILSNLGVSVPENNKHGACPKCGGKDRFRFDDKNGKGTWFCNHCGSGDGLDLIKLVTGQDIKTTCFEINKILLLPEFKKITPTRIKKASAQKGIELFEKLKALCLSGESQYLSNKGLTNHQYLITQQQYTQGGIIFPTGSLLLPLVDNQVSIKGGQLISPKGEKSLLSGSVLSGSFIVVADKTDKNIEQVVITEGFATGLSLSKVIDAFIVAAVAATNLVKVAQQLRERWPQAKIIIAGDNDFIDGKENTGKLWAEKAAKAVDGWVTLPPTHYKADWDDYRQENSDNKVKEAFFEEMIYCGKDKAYLPQGFRLTQEYLWYDKLVNKSDGDTEVRNIKISSPIKVTAITCDADSSNYGRLLEWEDTYGNCRKWAMPMEMLSGSGEELRRVLLVNGLSYINTSGQARAHLMEYISLCRPEKKVTCVNKTGWHGNVYVLQDEVVGSGADSVILQTSSVQGKDFRVSGTSEEWREHIGKYCTGNARLAFSVSLAFASSLLKLVGVGGGGYHLKGESTDGKTTTMKVAASVCGGTDYWYTWRATGNALEGTACRRNDATLMLDEIREVDGREAGNIAYMLANGQGKARAKTDGSVRETNRWNLLFLSTGELSLVEHAANAGERTYAGVEVRMIQIPSDSGKHGVFEDLHQFASGKSLAEYLEQAVTKYHGSPFRDWLKYLTHDLTSISGTAKALLKEYTANMMPENAGNQVGRAITRFALVAMAGEIATRAGITGWQQGEAYAAAEKCLAAWMKERGHTANQEDITALEQVTDFISRNQFSRFADWYDENSRPLNMMGFRRVEKGTANQDPTVQFYVLSSAWKEICKGFDSRKVARLCVEKGWLEAGKDGRIQTSIRLPEIGLKRVYLFNSDVLGSAE

SEQ ID NO: 8820 - protein, 46 aa, Xenorhabdus bovienii
  Peptide sequence Name=Xb4151_4152.C439.gene75.pep
MCNSGNTGNNQLYQGLPLLPVNFGEWQQLVTKIGCYHLLPVRFLEW

SEQ ID NO: 8821 - protein, 70 aa, Xenorhabdus bovienii
  Peptide sequence Name=Xb4151_4152.C439.gene76.pep
MKVLKVYCPECDGQATIKKIKTQELNNIPEIYCCCNDVECGHTYALTLSFSHSIRPSKLVQDSRNHVLKL

SEQ ID NO: 8822 - protein, 48 aa, Xenorhabdus bovienii
  Peptide sequence Name=Xb4151_4152.C439.gene77.pep
MQGRRKCKLKLCEISRSASDNSSHKIIDAISQIATISIHDYVNLVPTY

SEQ ID NO: 8823 - protein, 38 aa, Xenorhabdus bovienii
  Peptide sequence Name=Xb4151_4152.C439.gene78.pep
LVCRILKLKKLFDPKRAGGCGVVRFTSGLRLFRGDYVA

SEQ ID NO: 8824 - protein, 63 aa, Xenorhabdus bovienii
  Peptide sequence Name=Xb4151_4152.C439.gene79.pep
LYISWVIIQQLRSRHGSPLTVTFTSSYNATNRTLSYADKILRSRWIHLVHVTTSRLRHVIPTK

SEQ ID NO: 8825 - protein, 74 aa, Xenorhabdus bovienii
  Peptide sequence Name=Xb4151_4152.C439.gene80.pep
MYRFGGILCVHTPQLKPVPTSRKCWTQRLTVNLLKSLVETVVQRSLSVELNSMLGKTLSWMQSSIRLCNVMGIR

SEQ ID NO: 8826 - protein, 132 aa, Xenorhabdus bovienii
  Peptide sequence Name=Xb4151_4152.C439.gene81.pep
  Gene classification: Gene name=Doc; Function=Prophage maintenance system killer protein; Function class=N Cell motility and secretion
  Homolog annotation: Query=4..122bp; Hit=2..119bp; Blast score=82; Percent Identity=39.0; E value=1e-16; Homolog= NMB0917 COG3654
MIWVSAQEVIAFHDRILQRLPGVAGMPDSGRAEALIYRVQNRTHYEGITDIFELAATYWAAIARGHIFNDGNKRTAFFVTMTFLYRNGIKIRDNDNTLENLTVDAATGEKTVDQLAQHLRELVDYTNPSCNP

SEQ ID NO: 8827 - protein, 41 aa, Xenorhabdus bovienii
  Peptide sequence Name=Xb4151_4152.C439.gene82.pep
MNKFNRIAFHNIPEHITKPEYTLLYLAFLLSEHCRTNHSSA

SEQ ID NO: 8828 - protein, 46 aa, Xenorhabdus bovienii
  Peptide sequence Name=Xb4151_4152.C439.gene83.pep
MAFRAFSSSSRNSHDGSCYSIYLPVNFDSASGSFCNFAFRRILSMP

SEQ ID NO: 8829 - protein, 54 aa, Xenorhabdus bovienii
  Peptide sequence Name=Xb4151_4152.C439.gene84.pep
MTFAVNNNDANGYREAKDHAIKALKKMVEPMTEAEIQALIERTRQTMNESNLHD

SEQ ID NO: 8830 - protein, 40 aa, Xenorhabdus bovienii
  Peptide sequence Name=Xb4151_4152.C439.gene85.pep
VKGSFLAYSYQYHINIELGKRIRSLRKGLFLDGITVFELH

SEQ ID NO: 8831 - protein, 274 aa, Xenorhabdus bovienii
  Peptide sequence Name=Xb4151_4152.C439.gene86.pep
  Homolog annotation: Query=1..274bp; Hit=5..278bp; Blast score=417; Percent Identity=80.0; E value=1e-116; Homolog= gi|16131516|ref|NP _418102.1| DNA-damage-inducible protein [Escherichia coli K12] gi|7465838|pir||G65165 DNA-damage-inducible
MEQHHQPFEKIKRIDESGIEFWSARELSKLLEYSEYRHFTPVLERAKEACSHSGHNIENHFEDVLDMVNIGSGAQRKLKDIILSRYACYLVVQNGDPSKPVIAAGQTYFAIQTRRQELADDATFKRLREDEKRLFLRNELKEHNKQLVETAQRAGVETNIDFAIFQNHGYQGLYGGLDQKAIHQRKGLKKSQRILDHMGSTELAANLFRATQAEEKLRRDNVKSKTQANQTHFDVGRKVRDTIQELGGTMPEDLPSPEKSIKQLETIAKKKLKK

SEQ ID NO: 8832 - protein, 46 aa, Xenorhabdus bovienii
  Peptide sequence Name=Xb4151_4152.C439.gene87.pep
LSRWYEALLLLSLFYSIFPRGHPWVHAKSRCTNGMIEMYSIMKVTY

SEQ ID NO: 8833 - protein, 44 aa, Xenorhabdus bovienii
  Peptide sequence Name=Xb4151_4152.C439.gene88.pep
LPDFIHALISLSVSLGIVQSPMKNRGCTQNGFLNVLWVHPSGTR

SEQ ID NO: 8834 - protein, 140 aa, Xenorhabdus bovienii
  Peptide sequence Name=Xb4151_4152.C439.gene89.pep
  Homolog annotation: Query=1..133bp; Hit=1..137bp; Blast score=170; Percent Identity=65.0; E value=4e-42; Homolog= gi|34499306|ref|NP _903521.1| probable prophage integrase [Chromobacterium violaceum ATCC 12472] gi|34105157|gb|AAQ61513.1| pro
MPKLTDKEIRAWIKSGKRFEGKADGNGLYLRFREADRIPSWRFRYKLAGKSRTMNLGTYADLSLAKARELTRELSARVALGYDVAGEKQERKAEALAKIDAIKVSDLAAEYFERQILPRWKPPDILRRRIACDWLRYMKM

SEQ ID NO: 8835 - protein, 74 aa, Xenorhabdus bovienii
  Peptide sequence Name=Xb4151_4152.C439.gene90.pep
MYRFGGILCVHTPQLKPVPTSRKCWTQRLTVNLLKSLVETVVQRSLSVELNSIIGKTLSWMQSSIRLCNVMGIR

SEQ ID NO: 8836 - protein, 470 aa, Xenorhabdus bovienii
  Peptide sequence Name=Xb4151_4152.C439.gene91.pep
  Gene classification: Gene name=ProP; Function=77 Permeases of the major facilitator superfamily; Function class=G Carbohydrate transport and metabolism
  Homolog annotation: Query=4..460bp; Hit=6..462bp; Blast score=190; Percent Identity=36.0; E value=2e-48; Homolog= Rv1634 COG0477
MIVTEENSWSDLFSSKNAANAMALSLGVALVAINSLIAITILPSVVNDIGGLNLYAWNTTLFVVTSIIGAILSARLLRASGARKSYLIAALVFFVGSLFCTLAPTMEVMLIGRTIQGFGGGLLFALSYSMVNLVFPQSLWPRAMALISGMWGVATLAGPAIGGIFAEMDTWRYAFGIMLPITLLYALFTYLILPKKNVQNETKAALPIVQLFLLSAAVMAVSAGSLSQDLKTNISGIIAAVVLIALLIIHERRTLVKLLPQNALSLRSPHLVLFTTMLLLVIGLSSDVFVPYFLQVLHGQSPLASGYMIAAAAVGWTIAEILSAGWQGAKMRFSIVSGPIFMLLGMVLLIVMLPRSSSGQWQTILPLILGLGLFGFGVGFGWPHIVTRILQVSADSDKDIGGASITIVQLSASAFGSALAGMTVNVFGFYQPGGVSGASSSSYWLFLLFAITPLLALFTAWKSAKIPAGK

SEQ ID NO: 8837 - protein, 218 aa, Xenorhabdus bovienii
  Peptide sequence Name=Xb4151_4152.C439.gene92.pep
  Gene classification: Function=Predicted transcriptional regulator; Function class=K Transcription
  Homolog annotation: Query=18..214bp; Hit=5..202bp; Blast score=144; Percent Identity=41.0; E value=8e-35; Homolog= VC2666 COG2345
MSSIDLENNIITAQTVSERLLMLLKTRGAMQASDAGKILGTSGEAARQQFVKLAKEGLVEAESETRGVGRPIQLWHLTDKGHARFPNTHAELTVQLLTIIRSQLGETAIDLLINTREQKTSASYKIAMEGAAELQEKIERLVAIRNQEGYMAQYSVQEDGAILFIENHCPICAAATICQGFCRAELKLFREILQAEVERTEYILNGARRCAYRITPLK

SEQ ID NO: 8838 - protein, 307 aa, Xenorhabdus bovienii
  Peptide sequence Name=Xb4151_4152.C439.gene93.pep
  Gene classification: Gene name=RbsK; Function=Sugar kinases, ribokinase family; Function class=G Carbohydrate transport and metabolism
  Homolog annotation: Query=7..302bp; Hit=18..315bp; Blast score=191; Percent Identity=38.0; E value=1e-48; Homolog= Z3263 COG0524
MKVPLLPVVVMGSATGDIVLRLSELPHSGEYWEAEEVDRQVGGCAFNVVRALCRLQIPVINGIFVGNGVWGERVTEEMEMLGLTVTLRHPKRDNSWCIAMMTPDDKRIYVSVPGCDDSWNADILATIPLPEQGHIYSSGYELANPKADVLREWLLASPSGLTLVLDFGPRLPDIDREFIQALPAERTILSLNLDETAMLCGAGDPVVQAGRYVNERGFTAIVRLGAEGAWICQPGCEPEYIPAYQVNVADTIGAGDAHCGGMLAGLSQGMSLRDAVELGNRVAAVTVSRSGSDGAPTKDELMDFVFG

SEQ ID NO: 8839 - protein, 471 aa, Xenorhabdus bovienii
  Peptide sequence Name=Xb4151_4152.C439.gene94.pep
  Gene classification: Gene name=CodB; Function=Purine-cytosine permease and related proteins; Function class=F Nucleotide transport and metabolism
  Homolog annotation: Query=17..466bp; Hit=2..442bp; Blast score=104; Percent Identity=27.0; E value=2e-22; Homolog= BS_yxlA COG1457
MMENVMGTQQNNQGFWKVEHTGIDIVPPSERTGTPMDLFWIWSAANIGILGIIYGAIIVSFKLSFLQSALAVLIGLSSFALVGYLSFSGKLGRTSTLTLSRNIFGIRGNIAPTMIFWGISLGWESINIVTGTLTLSALFQACGLTESTLLTVISMILFAGLSIGVTLLGKEMLIAMQRWIIHVFGAMTLVVVFYILFTTEWKAVLAMPSGSWLTGFLPAVSVVAAGTGIAWAATGADYSRYQSEGSSKLGIFTAVTAGGMIPLVLLLFAGILLSVQLPNLPTSENPIAQIGSILPDWMVIPYLMTATAGIVTMAVLSLYSASLNFLTLGIKVKQIHAVTIDSIIVLTLAIYLLFVTGDFMGPFVSFLLFCGVFLAPWEAIFLLDYIVVRRKQGYCPDSLYNGDGSNSGIKWIPVLCWLLGAFVGFLVTKNDFISGPWAVGIFANSSLGLLLSFFVSFICYGLYLMPGRYTR

SEQ ID NO: 8840 - protein, 36 aa, Xenorhabdus bovienii
  Peptide sequence Name=Xb4151_4152.C439.gene95.pep
MTRAVFRTLFNIIVFPAKEMLQISQINSGRALFLVS

SEQ ID NO: 8841 - protein, 46 aa, Xenorhabdus bovienii
  Peptide sequence Name=Xb4151_4152.C439.gene96.pep
MRHLKNQRLCWLRQELIESVRSALVMVRFFDGTPIMRAIVCANLGE

SEQ ID NO: 8842 - protein, 38 aa, Xenorhabdus bovienii
  Peptide sequence Name=Xb4151_4152.C439.gene97.pep
LASQNNNIGLSLALIINVKYKSCLYKKSGVCQYHFETT

SEQ ID NO: 8843 - protein, 260 aa, Xenorhabdus bovienii
  Peptide sequence Name=Xb4151_4152.C439.gene98.pep
  Gene classification: Gene name=PhnF; Function=Transcriptional regulators; Function class=K Transcription
  Homolog annotation: Query=9..239bp; Hit=12..242bp; Blast score=140; Percent Identity=31.0; E value=2e-33; Homolog= yegW COG2188
MPNHFVDWVREELKKKSSSPRYIQLQQAIEIAIKKQLINEDDFLPPERRLAELLNISRVTVSKAMQLLEEKGVIIRQQGVGTQVAKPGGSSLNQAVGFTSQIVKEGGTVSNYWLSRRIIPAPEDIARKLSIHIGEKIAELRRIRLANGTPVSLENTYIPREYLPNPELLEDSLYTHWEEQGIHLTNVNHKIKAIACSMELAILLNIAEKSPLLQIHQISQNNQNEIIEFSEILCRGDIYGLDFNAPQNIDIKYNKKSRHQ

SEQ ID NO: 8844 - protein, 59 aa, Xenorhabdus bovienii
  Peptide sequence Name=Xb4151_4152.C439.gene99.pep
MHHRISTLNIIKKAAINRQSIQKNILSFSFTYDDLSLSARHLAERDRDSYSFPAEFNCW

SEQ ID NO: 8845 - protein, 585 aa, Xenorhabdus bovienii
  Peptide sequence Name=Xb4151_4152.C439.gene100.pep
  Gene classification: Gene name=MdoB; Function=Phosphoglycerol transferase and related proteins, alkaline phosphatase superfamily; Function class=M Cell envelope biogenesis, outer membrane
  Homolog annotation: Query=41..582bp; Hit=1..549bp; Blast score=325; Percent Identity=35.0; E value=7e-89; Homolog= NMA0408 COG1368
MVLTKMVPYFMHGISGNHVIFIGRCKTELNYGTEWRMKKKIISGIYLGVLLIASWIIVFEKSSDIYPALVSVGVFGVIFGLAFLVSARWLFSAAFTGTVFIIIKFINQIKVHYYKEHLMFSDLNVMLDPSNQETLRHYWLAGVAMAAMLIWLIFNMVLSWRKAGPACGIKWRVASVALVAAGVCVVNLTTNAYYATWQRELPKGRGTMTNMMMSAKDTEYQPPQFGESADYFLQQAKSVTLPEPQSDVKPDVVLLLQESTVNPHIYQLPANVQLPDLYMFQRDADVSAQSPLRVQTFGGGTWLSEFSVLTGLNTDDFGSRKNAVFYFVVDHLQNSLFRAMKDNGYYTVVLTPFNKSAYHAGHAYKTMGVDRIIQPQELGYPASLEENLWTIPTQDMLSYVKTILAKETDKPIFIFSLTMYEHGPYDEGHSDDYGLTGKLEGSSAVGKFSHYMEKIKASDPAIKDFSEFVATRDKPTLFLYFGDHQPSIHFGQYDSPLADPAHITQFTMRDNLAQGTAITTGKLTDISFLGGMILERARLTAPPFYQANMTMRHLCDGALNDCQDKALVDSYKHYIYQQLNSAGKE

SEQ ID NO: 8846 - protein, 102 aa, Xenorhabdus bovienii
  Peptide sequence Name=Xb4151_4152.C439.gene101.pep
MPIRFSRSGTIAAIRECWILCQCRVRERVLQSSGTLFILFAIRYRPIPSSMDCHTALFAASARFTQQNGDNLKMGDFLSLMFWDARRGVDTSFSGWQTITEE

SEQ ID NO: 8847 - protein, 36 aa, Xenorhabdus bovienii
  Peptide sequence Name=Xb4151_4152.C439.gene102.pep
MRILITFLPFIFLVQWPIVIPSFVRSTPLLRTNLYY

SEQ ID NO: 8848 - protein, 57 aa, Xenorhabdus bovienii
  Peptide sequence Name=Xb4151_4152.C439.gene103.pep
VIIGRIFYSVSYIPYLFVDFYYVQSSLLLILSLIEHVFYYFVIKLFYLTLFPIVQME

SEQ ID NO: 8849 - protein, 263 aa, Xenorhabdus bovienii
  Peptide sequence Name=Xb4151_4152.C439.gene104.pep
  Gene classification: Gene name=MhpC; Function=Predicted hydrolases or acyltransferases (alpha/beta hydrolase superfamily); Function class=R General function prediction only
  Homolog annotation: Query=15..219bp; Hit=19..220bp; Blast score=67; Percent Identity=27.0; E value=1e-11; Homolog= AF1706 COG0596
MIQNKKSVQLSHSVVHYYCVGEGDGIVFLHGTNSDGESSFGHIVNEFSKNNTVIIPDYAGCGNSTLPQGEITAEQLAEQIAAIIKDSAKYPVTLVGTSLGAVVAAVVAANYPELISKLVLTAPWASSQDARHQLMFQTWLELEQNAPDSATAFGLSHVLSPVFLTSLGNEKIKQICSKASAKDTDKRIQLGLNIDINESLGMIKQPTLVIGLEFDTLIPIYQVVKVHQKITQSQYSRIASGHAVQMENPQDWISCIKNFLQRT

SEQ ID NO: 8850 - protein, 36 aa, Xenorhabdus bovienii
  Peptide sequence Name=Xb4151_4152.C439.gene105.pep
MLRLITDMRLSPPQNRCSGFEADPDSGNVMFSVKNF

SEQ ID NO: 8851 - protein, 200 aa, Xenorhabdus bovienii
  Peptide sequence Name=Xb4151_4152.C439.gene106.pep
  Gene classification: Gene name=PncA; Function=Amidases related to nicotinamidase; Function class=Q Secondary metabolites biosynthesis, transport and catabolism
  Homolog annotation: Query=1..193bp; Hit=1..191bp; Blast score=120; Percent Identity=35.0; E value=1e-27; Homolog= PA1677 COG1335
MNSPKTLLEISGSSEKKLDWNKAALILIDFQREYSDGALQLGEQGREAIANAAKLLAYARKNNVPVFHVVHHAKPGSAIFDPTTDKASLIKDVEANTEEEIVTKSLPSSFYNTELSDLLSLTSRKQLVLAGFMSHMCVTATAIKALELGYENFVCADACASRDLKYIDGSLVKADSVHKAAMAALNDRYATLVNCSDVVR

SEQ ID NO: 8852 - protein, 78 aa, Xenorhabdus bovienii
  Peptide sequence Name=Xb4151_4152.C439.gene107.pep
MASMDSITLFGVWVEPLFSYRLRSRWISSNNAYRRPRVQFFRRAVSCYNSRHLSRQLMAVQCIRTFLHILYAIFHNYF

SEQ ID NO: 8853 - protein, 101 aa, Xenorhabdus bovienii
  Peptide sequence Name=Xb4151_4152.C439.gene108.pep
MKNKLAELEALIAEHINQHPNLKKDFELLTSIKGIGTQMGLNVRIPLLVQRKSLHILVLFLLQSSQVHRCMVECAYLKRGLLKSGLSSLCLHSLQFVLIPT

SEQ ID NO: 8854 - protein, 80 aa, Xenorhabdus bovienii
  Peptide sequence Name=Xb4151_4152.C439.gene109.pep
  Homolog annotation: Query=1..76bp; Hit=249..324bp; Blast score=102; Percent Identity=65.0; E value=1e-21; Homolog= gi|18254491|gb|AAL66868.1| invertase [Pectobacterium chrysanthemi]
VYGRVRLSKTGPAKIRAKFFMSALTAVRFNPHINDLYNRLVNKGKAKMLALGAAMRKLVHLCYGVLNTQQSYDENYAIRT

SEQ ID NO: 8855 - protein, 39 aa, Xenorhabdus bovienii
  Peptide sequence Name=Xb4151_4152.C439.gene110.pep
MMKTMLLELDHQDGSLLVESAIYKCYDLYLIDYTEYIYG

SEQ ID NO: 8856 - protein, 284 aa, Xenorhabdus bovienii
  Peptide sequence Name=Xb4151_4152.C439.gene111.pep
  Gene classification: Gene name=LysR; Function=Transcriptional regulator; Function class=K Transcription
  Homolog annotation: Query=3..245bp; Hit=2..257bp; Blast score=98; Percent Identity=26.0; E value=6e-21; Homolog= mll2551 COG0583
MDSVNWDDLRFFTALVECRTVSAASKRLNVNYATVSRRIERLEHTLRQRLFDRTQDGYIPTVEGLILYKKTSLVRENVESLEEYFSLGGKFKKSVVISMVSSMAEYFLIPKLSDFVKKHPEIRLEIDVSNRNVSIPRKEADIAFRLELPEKGEYLSKKVGDITYKLCATPEIIEKIKNEVNVSIITFNSDFSHLPESQYLIRRFGNKSIRFQSNSVTTQRIAAENGYGVALLPSLAIKNSPLVSLELDEPIIRSIWMLTSKHTMQMTASRLVADELQRIFDGMK

SEQ ID NO: 8857 - protein, 101 aa, Xenorhabdus bovienii
  Peptide sequence Name=Xb4151_4152.C439.gene112.pep
MEICAHQMLKNDDMPYEFRLDLAKQVWDESRHEEANSFVYINNDEAFHVQIGNKWISYLAEINELSEEQLLNVMVVASEKIGIPLFGKGGWNSEIRKLIGL

SEQ ID NO: 8858 - protein, 52 aa, Xenorhabdus bovienii
  Peptide sequence Name=Xb4151_4152.C439.gene113.pep
LEKEGGIQKYGNSLVYRNQGKTIILIEIKTEGVRRFWMEHIDSDSRIVDTLP

SEQ ID NO: 8859 - protein, 430 aa, Xenorhabdus bovienii
  Peptide sequence Name=Xb4151_4152.C439.gene114.pep
  Homolog annotation: Query=9..255bp; Hit=19..258bp; Blast score=188; Percent Identity=43.0; E value=2e-46; Homolog= gi|37524328|ref|NP _927672.1| hypothetical protein [Photorhabdus luminescens subsp. laumondii TTO1] gi|36783751|emb|CAE12606.1
MDFPIYDFDGNRLYDEIGNPVITITGGFEMLKDLGTLIDIQPDWGVDLINGIDDSFDIPFTKFDDFEVNVDSINFSSIINGISGLNQEQKDKLERIINEQKKLADEDLQAANRNLMDMNHEEFSLYQSYISELQKAKSKKIIELINKAIDIINNTPEGRTLSDVSKYPYEKKHEIDFGRVSYVIYMVIDNVKKLNELLNKKHTESVNINELSLDDLADYKLRESLSNLFLYYQGLKNKLNKALDRELERIEYLEKLFTKDNGMNGWDMLSHFRGDSGRTLNLHDIGVHNQVRELMHKQGGFEKPEGSIQSRFISQIQRGERIDFKNQYDFAKEARITIIDPLWAIGGATVSGVLTDIKAENTGDKYNVSGVISYKLDDKFSSPWDIYNWSPVELNFGGTPYDITGEWSEIVNFDVDKDVYENKIKPMIGQ

SEQ ID NO: 8860 - protein, 60 aa, Xenorhabdus bovienii
  Peptide sequence Name=Xb4151_4152.C439.gene115.pep
MLFIAILFMIFVCFFTLTMFVNYFFIFKRNFKKTILVSILMTIISIISHFLPMIFYQTIF

SEQ ID NO: 8861 - protein, 51 aa, Xenorhabdus bovienii
  Peptide sequence Name=Xb4151_4152.C439.gene116.pep
VRVDAPFSLPGFHARATDFAVTYLRHRNLNNTSTIFIEIIVNCVTKRHFYY

SEQ ID NO: 8862 - protein, 46 aa, Xenorhabdus bovienii
  Peptide sequence Name=Xb4151_4152.C439.gene117.pep
MAVQAGQPLGWPIPVQVGLFVNLDASLIDTRAIKTSDPSVFSQNIL

SEQ ID NO: 8863 - protein, 331 aa, Xenorhabdus bovienii
  Peptide sequence Name=Xb4151_4152.C439.gene118.pep
  Homolog annotation: Query=30..331bp; Hit=19..316bp; Blast score=386; Percent Identity=67.0; E value=1e-106; Homolog= gi|132373|sp|P22308|REPY_ECOLI REPLICATION INITIATION PROTEIN gi|280091|pir||A43703 replication initiation protein - Escher
MNNVSEEIPMQVSRRQFFKICAGGMAGTTVTEHETKLILCCVALLNPSLENPTEEQRTVTFTYQEYAKMMGLTLDNAYHRLTNATRELMSRTVQILYPTGDIDREIFQWVNYAKFNRKTQSVTLTFSPHIQPFLFQLKRFIKYNLEHVKAFENKYSMRVYEWLLKEITQRKVYKANIEISIDKFKFMLMLDKQYTDLRNFTTRILNTVTKDLNTYSNMKLEIKKRGRPADTLIFQVELDRQIDLITELDKGSVATSKKATKPTNSTPEAHLHGGLRKTLHDALTAKIQLTGFEAKFLGDMQSKYDLNGSFSWLTQKQRTTLENILAKYGRI

SEQ ID NO: 8864 - protein, 52 aa, Xenorhabdus bovienii
  Peptide sequence Name=Xb4151_4152.C439.gene119.pep
MILFVWINRERREFTRFKRMMLMTGRIHNEKKNIHKSRPKITYLRVFRRGMC

SEQ ID NO: 8865 - protein, 276 aa, Xenorhabdus bovienii
  Peptide sequence Name=Xb4151_4152.C439.gene120.pep
  Gene classification: Gene name=FdhD; Function=Uncharacterized protein required for formate dehydrogenase activity; Function class=C Energy production and conversion
  Homolog annotation: Query=12..274bp; Hit=12..275bp; Blast score=374; Percent Identity=69.0; E value=1e-104; Homolog= fdhD COG1526
MDNANSGNRLMIDEICGATRINVQQKNHLNNPKPDWVAEEIPIALVYNGISHVVMMASPKDLDHFAMGFSLSESIITSPHEIHGIDTVISCHGGIELHIELSSRRFTELKERRRNMAGRTGCGICGTEQIAEIFRPIPPLPFTQTFSWDYLDQALAQLPRLQEIGAATGCTHAAGWIDAKGVLLGGSEDVGRHVALDKLLGIRAKTGWRQGAVLVSSRASYEMVQKSAMCGVEILFAVSAATSLAIEVAEKCNLTLVGFCKPGRATVYTHPQRLVD

SEQ ID NO: 8866 - protein, 254 aa, Xenorhabdus bovienii
  Peptide sequence Name=Xb4151_4152.C439.gene121.pep
  Homolog annotation: Query=1..253bp; Hit=1..253bp; Blast score=345; Percent Identity=65.0; E value=6e-94; Homolog= gi|37528692|ref|NP _932037.1| hypothetical protein [Photorhabdus luminescens subsp. laumondii TTO1] gi|36788131|emb|CAE17256.1|
MDAKIIIQSAEERTDLDEQIYDLVRHLWPFFMNQDPVAQQHWEKLYEPDFSRFQKFAILQQGQEERLIGLLNAIPFPWEQHSLDQLPDEGWDAVYCAGMAAKGKQQPTLLSALSVTVAPEFRGHNVPALLINSVKQTAREAGLQGFVVPVRPSLKRSYPLQDFVQYCEWKNEKGEPFDPWIRTHWRLGAKIIKPALRSMDIYGTVAEWQEWTGMKFPQSGEYIIPGGLVPLLVDIEKQMGYYIEPNLWMFHSLD

SEQ ID NO: 8867 - protein, 245 aa, Xenorhabdus bovienii
  Peptide sequence Name=Xb4151_4152.C439.gene122.pep
  Homolog annotation: Query=1..244bp; Hit=1..246bp; Blast score=239; Percent Identity=59.0; E value=3e-62; Homolog= Pa|Phot5-421b03.p1k _g41| 27059 - 27805 1630 248 aa, chain -
MKKINVLVAALGALGFMAQAQASVGFGQSQEDTTPHIKVGATKASSSPHGGSGNEPGIGVSSVRDGMLIGFSGLTRMAPADSNGIHNISMAGAPGSHGGMGVFHFSKVANADVYFGEWSQTGNATDTTHTVYYAGKDITTNMPTDGTATYVVNGINQYSGDNALSGTLTADFGEKTLIGSIENTAMTVSIDADIQSDAQFSGLATTGDLEGETQGHFFGDGASSLAGYAKFDDQSKDTAFGGSKQ

SEQ ID NO: 8868 - protein, 38 aa, Xenorhabdus bovienii
  Peptide sequence Name=Xb4151_4152.C439.gene123.pep
MPKMALFSVLFIAVLFIAIDFWLFISNNVSLVSWFFDV

SEQ ID NO: 8869 - protein, 490 aa, Xenorhabdus bovienii
  Peptide sequence Name=Xb4151_4152.C439.gene124.pep
  Gene classification: Gene name=OmpU; Function=Predicted outer membrane protein; Function class=M Cell envelope biogenesis, outer membrane
  Homolog annotation: Query=51..490bp; Hit=61..509bp; Blast score=104; Percent Identity=26.0; E value=2e-22; Homolog= PM1515 COG3699
MSDNITTPILLTALMALCLSLPVYADEDTNRKIWQEAQHNQQENEADLITPEPIFIEDGASSIVINGQTFQVENNLDNIGQALYLATNHRQWPDVRRFLTAYQKLSGHDVMLASFAQGGLARFEGDLDLAAYHYQKLLNQQPDFTRIKLELARVYFENHKNREAEQLFVGLSEQNLLPETVLKNINSYLKAIALRSDWRGSFSVGYAYNDNVNMSPDQESTCLEYNPDGSCQEERRIPKAIKKWGMSYDATLSRRYQLSGHHGIFGRGLIYGENYRDYHAENENTVLLVSGYNYKSRNHDFSFGPLFEYKHRAGDTYYRATGVKTEWRQTFSPKTALNIELEHKQLRHQQRYHWKNGDLSSSYLTLSHAISKEFVIFGGGDWVYRNNPQPADRYQQWGIRAGVSGQIYPGINGSLSATLRERRFGAYSPILLARRQDDEQIYTAVIKVPAAEILGMTPSITFRHRRNHSSVNWLYNYNKNEVLLRLEKYF

SEQ ID NO: 8870 - protein, 988 aa, Xenorhabdus bovienii
  Peptide sequence Name=Xb4151_4152.C439.gene125.pep
  Gene classification: Gene name=CirA; Function=Outer membrane receptor proteins, mostly Fe transport; Function class=P Inorganic ion transport and metabolism
  Homolog annotation: Query=27..572bp; Hit=133..625bp; Blast score=236; Percent Identity=31.0; E value=8e-62; Homolog= PA4897 COG1629
MMIDKLRQGISMVYRVKIQLTPITIALSLAFSLTAPPLFAEPKSTVTSPSKQTDLGKISVTDNSDKDEAGHNAVYDKDISNIYIGKEQIERYKGASPADLIKGAVGVYSGDARNSGALDINIRGIQGQGRIPVTIDGTEQAITVGRGYNGANNRNYIDPNLISSIEIEKGPSLSRNIKGSIGGAVVIKTLTIDDVVPKGETFGINTKVETSSNSVKERKPSLVLGQDYRDVPNFIQNGVEADPELKITPHSSKDNKFPGFKDNAFRVALGTRQEYFDLMLAYSHRRQGNYFAGKGGAHRYDEPITAADTELMNGYKTTLDPYLPFAARIYRPGNEVPNTSSEMRSVLIKNTWRLTNDQALQLGFRNTHMEFGDIMPSRLGWVKAEDNAVPQWPLANVHQQAVNLTYKWQAADNPYIDFDMNLWATRTTSNTNTAGGYPRTPVERDYSWDNGSGVKASHIDGTLIDTAKTNAQNNRWGVDISNKFTLASSLDLTLMGNFQREHLDSNDGYNPLNMYFFQSPARKGQRQEINLAFNFDWRPTSWLALSAGAKRVSYWSKDDFLSERRAARDDRYRNNSETTGHQISYYRTMTEREAYIKQKKLSKMSRKERTEYFKVKTGDITSRDGQQRKMVRQEVDWLYNSSNGQLNKSDNPYFNGQLDMQEKIIDPITGKEGYKYEYGSGVDANGIRREIPDADPWEPASKRKDHAWAPTFSATAYVTDDFRIYTRYAEAVRMPSIFEDTVGFSGNKSNRVGQKFKPERAKTTEVGFVYDFSQLVDAERHADIKVSYYNTVIENVFDRDNTYEFSQMDKQKLAGLELQARYDNGSFFTDMGLTYNLKNKVCDNNSSLRMNSLNRYDIPECIDGGFAGGYLRTSIQPQYSANLTVGGRLFDEKLELGSRMLYHSKAENKDEKWLMEALPDVYKGQSNNPMRWNPVFTVDAYVSYQITPTLSMELTGTNLTNRYYLDPLTRSMIPAPGRTFKLSITSQF

SEQ ID NO: 8871 - protein, 272 aa, Xenorhabdus bovienii
  Peptide sequence Name=Xb4151_4152.C439.gene126.pep
  Gene classification: Gene name=TonB; Function=Periplasmic protein TonB, links inner and outer membranes; Function class=M Cell envelope biogenesis, outer membrane
  Homolog annotation: Query=20..271bp; Hit=5..269bp; Blast score=67; Percent Identity=30.0; E value=1e-11; Homolog= HI0251 COG0810
MTNTAILESPTNHFPLLPGKQLLVGILIAILLHISLIWLFNRHSSYDDSAHHVNQSSPLTGLSITMVAASSWQNEPEPVSPPPPLITAPESPTKPEIALDKAVQPENRLEKPLESVKPQKRQKQQKEKPQEKVEKKSAPSPQVQKDNNEEFETSGTDQINAQSSMSRAATTQPLVGQGNSALDNYQSRLKQEVESHKRYPRKAKRMKQQGTVTIGFTLLNDGSFTAARVINSSGNSVLDDAALDAIARASSVGPKPVDMAPDVTLKIDFELN

SEQ ID NO: 8872 - protein, 49 aa, Xenorhabdus bovienii
  Peptide sequence Name=Xb4151_4152.C439.gene127.pep
VKLPVNLLRMICWDGFFRAFVLGNEWVKKIPNVLILTSASFKNSDITIP

SEQ ID NO: 8873 - protein, 454 aa, Xenorhabdus bovienii
  Peptide sequence Name=Xb4151_4152.C439.gene128.pep
  Gene classification: Gene name=ThdF; Function=Predicted GTPase; Function class=R General function prediction only
  Homolog annotation: Query=1..454bp; Hit=1..454bp; Blast score=749; Percent Identity=84.0; E value=0; Homolog= ZthdF COG0486
MNTTDTIVAQATPPGRGGVGILRISGPKAAEVAEVVLGKLPKPRYADYLPFRDVDGTVLDQGIALYFPGPNSFTGEDVLELQGHGGPVILDLLLKRILTISAVRIANPGEFSERAFLNDKLDLAQAEAIADLIDASSEQAARSAMNSLQGTFSHQVHQMVEALTNLRIYVEAAIDFPDEEIDFLSDGKIEARLDEVIEELDHVRSQARQGSLLREGMKVVIAGRPNAGKSSLLNALAGREAAIVTDIAGTTRDVLREHIHIDGMPLHIIDTAGLREASDEVERIGIERAWQEIEQADRVLFMVDSTTTDAVEPAKIWPEFMAKLPASLPVTVIRNKTDMTGEETGVLEVSGYSLIRLSAREGKGIDLLRDHLKEAMGFNSNTEGGFLARRRHLQALNTAAEHLQEGHQQLVFARSGELLAEELRLAQQVLCEITGEFTSDDLLGRIFSSFCIGK

SEQ ID NO: 8874 - protein, 537 aa, Xenorhabdus bovienii
  Peptide sequence Name=Xb4151_4152.C439.gene129.pep
  Gene classification: Gene name=YidC (BS); Function=Preprotein translocase subunit YidC; Function class=N Cell motility and secretion
  Homolog annotation: Query=1..537bp; Hit=1..546bp; Blast score=778; Percent Identity=72.0; E value=0; Homolog= yidC COG0706
MDSQRNLLFIALLFVSFLVWQAWEKDQNPQPTAQITQQANTPSSEASSGQGKLITVKTDVLSLHINTRGGDIEEADLLAYPDTLGSNKPFKLLESTPEFIYQAQSGLTGTNGPDNQADRPFYHTTQDSYVLADGQNELRIPMTYTAPDGVVYVKTFILKRGNYAVSVDYNIDNVTDKPLQMAFFGQLKQSVELPKSRDTGSSNFALHTYRGAAYSSAEAKYEKYKFGDIEDKALAVTTNGGWVAMLQQYFATAWVPGANSTNTFYTIDLKNQKMAIIGYKGETVNIAPNSKQNISSTLWVGPEIQDKMAEVAPHLDLTVDYGWLWFISQPLFKLLKFLHEFIGNWGFSIIAITFIVRGIMYPLTKAQYTSMAKMRLLQPKITAMRERHGDDRQRMSQEMMALYKTEKVNPLGGCLPLVIQMPIFLALYYMLMGSVELRHAPFIGWIEDLSAQDPYYILPLLMGATMFVIQKLSPTTVTDPMQQKIMTYMPVMFTVFFLWFPSGLVLYYIVSNLVTIIQQQVIFRSLEKRGLHTREKK

SEQ ID NO: 8875 - protein, 86 aa, Xenorhabdus bovienii
  Peptide sequence Name=Xb4151_4152.C439.gene130.pep
  Gene classification: Function=Uncharacterized ACR; Function class=S Function unknown
  Homolog annotation: Query=1..86bp; Hit=1..85bp; Blast score=124; Percent Identity=77.0; E value=2e-29; Homolog= yidD COG0759
MASSLSLGSRLLIAIIRGYQLVISPLLGPRCRFHPTCSQYGIEALRRFGMIKGSWLTVKRILKCHPLHVGGDDPVPPKKNEDNREH

SEQ ID NO: 8876 - protein, 119 aa, Xenorhabdus bovienii
  Peptide sequence Name=Xb4151_4152.C439.gene131.pep
  Gene classification: Gene name=RnpA; Function=RNase P protein component; Function class=J Translation, ribosomal structure and biogenesis
  Homolog annotation: Query=1..119bp; Hit=1..119bp; Blast score=175; Percent Identity=81.0; E value=8e-45; Homolog= rnpA COG0594
VVKLAFPRELRLLTPEHFTYVFQQPQRASSAEITILGRLNELGHPRIGLTVAKKNVKRAHERNRIKRLARESFRLNQHNLPSMDFVVLVRKGVAELDNRELTEALGKLWRRHCRLVRGS

SEQ ID NO: 8877 - protein, 46 aa, Xenorhabdus bovienii
  Peptide sequence Name=Xb4151_4152.C439.gene132.pep
MKRTFQPSVLKRNRTHGFRSRMATKNGRQVLARRRAKGRTRLTVSK

SEQ ID NO: 8878 - protein, 39 aa, Xenorhabdus bovienii
  Peptide sequence Name=Xb4151_4152.C439.gene133.pep
LTRGSTFYYNPASFYILMLRLRHRCLLISHWSPTNLLNQ

SEQ ID NO: 8879 - protein, 47 aa, Xenorhabdus bovienii
  Peptide sequence Name=Xb4151_4152.C439.gene134.pep
MAGKNRWRNTQGGGLYGLCNKAQGSYTDPYTLIVIITLFSHHILNNS

SEQ ID NO: 8880 - protein, 37 aa, Xenorhabdus bovienii
  Peptide sequence Name=Xb4151_4152.C439.gene135.pep
MEFAIYHDYTTVSSTSLIFSECQSVAISLWIKSVKAV

SEQ ID NO: 8881 - protein, 508 aa, Xenorhabdus bovienii
  Peptide sequence Name=Xb4151_4152.C439.gene136.pep
  Gene classification: Gene name=DnaA; Function=ATPase involved in DNA replication initiation; Function class=L DNA replication, recombination and repair
  Homolog annotation: Query=47..508bp; Hit=1..467bp; Blast score=822; Percent Identity=89.0; E value=0; Homolog= dnaA COG0593
LGSDDSQNRHKVHATFLIIGGVTPCTQYNVSIIPISFISLVLGEFAVSLSLWQQCLARLQDELPATEFSMWIRPLQAELSDNTLALYAPNRFVLDWVREKYINNINLLLNDFCGPEVPLLRFEVGNKPVSPNQSTSQKIIANMPIATAPSSLSVRPSWDNAKAQPELSYRSNVNPKHTFDNFVEGKSNQLARAAARQVADNPGGAYNPLFLYGGTGLGKTHLLHAVGNSIMARKANAKVVYMHSERFVQDMVKALQNNAIEEFKRYYRSVDALLIDDIQFFANKERSQEEFFHTFNALLEGNQQIILTSDRYPKEINGVEDRLKSRFGWGLTVAIEPPELETRVAILMKKADENQIQLPGEVAFFIAKRLRSNVRELEGALNRVIANANFTGRAITIDFVREALRDLLALQEKLVTIDNIQKTVAEYYKIKVADLLSKRRSRSVARPRQMAMALAKELTNHSLPEIGDAFGGRDHTTVLHACRKIEQLREESHDIKEDFSNLIRTLSS

SEQ ID NO: 8882 - protein, 366 aa, Xenorhabdus bovienii
  Peptide sequence Name=Xb4151_4152.C439.gene137.pep
  Gene classification: Gene name=DnaN; Function=DNA polymerase sliding clamp subunit (PCNA homolog); Function class=L DNA replication, recombination and repair
  Homolog annotation: Query=1..366bp; Hit=1..366bp; Blast score=636; Percent Identity=85.0; E value=0; Homolog= dnaN COG0592
MKFIIEREQLLKPLQQVSSPLGGRPTLPILGNLLLQVTESSLLLTGTDLEMEMKARVALTQPHEQGATTIPARKFFDIWRGLPDGAEISVELDGDRILVRSGRSRFSLSTLPASDFPNLDDWQSEVEFSLPQATLKRLIESTQFSMAHQDVRYYLNGMLFETEEEELRTVATDGHRLAVCSMNIGQNLPSHSVIVPRKGVIELMRLLDGGDSLLQLQIGSNNIRAHVGDFIFTSKLVDGRFPDYRRVLPKNPDKTLEANCDVLKQAFSRAAILSNEKFRGVRIYLSENQLRITANNPEQEEAEEIVDVSYQGTEMEIGFNVSYVLDVLNALKCEQVSLLLTDATSSVKIENSASQAATYVVMPMRL

SEQ ID NO: 8883 - protein, 363 aa, Xenorhabdus bovienii
  Peptide sequence Name=Xb4151_4152.C439.gene138.pep
  Gene classification: Gene name=RecF; Function=Recombinational DNA repair ATPase (RecF pathway); Function class=L DNA replication, recombination and repair
  Homolog annotation: Query=1..357bp; Hit=1..355bp; Blast score=548; Percent Identity=76.0; E value=1e-156; Homolog= recF COG1195
MILSRLLIRDFRNIADADLTLATGFNFLVGPNGSGKTSILEAIYTLGHGRAFRSIQAGRVIRHDCEEFILHGRLEQQFHERILAVGLSKNRLGDSKVRIDGSDGHKIAELAKMLPMQLITPEGFTLLNGGPKYRRAFIDWGCFHNEPRFFTAWVNLKRLLKQRNAALRQVTRYGQIQHWDRELAPLATEISQWRAEYIAGIAEDIEKTCKQFLPEFTLSISFQQGWDKESEYAELLARQFERDRTLTYTASGPHKADLRIRVDGTPVEDMLSRGQLKLLMCALRLAQGEYFTRQSGQKCLYLLDDFASELDAGRRQLLAERLKSTQAQVFVSAITPGQVTDMIDVNSRMFRVEHGKIEVQPQD

SEQ ID NO: 8884 - protein, 804 aa, Xenorhabdus bovienii
  Peptide sequence Name=Xb4151_4152.C439.gene139.pep
  Gene classification: Gene name=GyrB; Function=DNA gyrase (topoisomerase II) B subunit; Function class=L DNA replication, recombination and repair
  Homolog annotation: Query=1..804bp; Hit=1..804bp; Blast score=1366; Percent Identity=83.0; E value=0; Homolog= gyrB COG0187
MSNTYDSSSIKVLKGLDAVRKRPGMYIGDTDDGTGLHHMVFEVVDNAIDEALAGHCDKILVTIHTDNSVSVQDDGRGIPTGIHEEEGVSAAEVIMTVLHAGGKFDDNSYKVSGGLHGVGVSVVNALSEKLELIIRRDGKVHEQTYQHGVPQAPLKTVGDTEQTGTTVRFWPSMDTFKLNTEFEYDILAKRLRELSFLNSGVSIRLVDKRTNAEDHFHYEGGIKAFVEFLSRNKTPIHPNVFYFSTEKDGIGVEISMQWNDGFQENIYCFTNNIPQRDGGAHLVGFRAAMTRTLNSYMDKEGYNKKSKINATGDDAREGLIAVISVKVPDPKFSSQTKDKLVSSEVKTAVETQMNEKLVEYLLENPNDAKTVVGKIIDAARAREAARKAREMTRRKGALDLAGLPGKLADCQERDPALSELYLVEGDSAGGSAKQGRNRKNQAILPLKGKILNVEKARFDKMLSSQEVATLITALGCGIGRDEYNPDKLRYHSIIIMTDADVDGSHIRTLLLTFFYRQMPEIIERGYVYIAQPPLYKVKKGKQEQYIKDDDAMEAYQMSIALDGASLYTNQYAPALKGEALEKLVTEFNASNKIIKRMERLYPQALLNNLIYHPTLTEDALNDQAKVEEWVSTLAISLNDKEQNGSTYSYQIHENRERQIYEPVLCIRTHGVDTNYNLDFDFIHGGEYRRITKLGELIGNLIEEGAYIERGERRQLVSNFEQALEWLTKESRRGLSIQRYKGLGEMNPDQLWETTMNPETRRMMRVTVKDAIATDLLFTTLMGDAVEPRRAFIEENALKAANIDI

SEQ ID NO: 8885 - protein, 43 aa, Xenorhabdus bovienii
  Peptide sequence Name=Xb4151_4152.C439.gene140.pep
MTTFQSGMWSLNSDRLLPAKVISSYYHRPSKIILDKKDIPFTL

SEQ ID NO: 8886 - protein, 48 aa, Xenorhabdus bovienii
  Peptide sequence Name=Xb4151_4152.C439.gene141.pep
MSLYEVNSNLGYYYLLLCIYGMVYRINSYFYSVNGISFLSSIIFEGRW

SEQ ID NO: 8887 - protein, 61 aa, Xenorhabdus bovienii
  Peptide sequence Name=Xb4151_4152.C439.gene142.pep
MLKITNSFDGYIHKTSTSSLSRSKSFNTLPPDNILSININRNNPRLINEFIPVVRETNKEK

SEQ ID NO: 8888 - protein, 86 aa, Xenorhabdus bovienii
  Peptide sequence Name=Xb4151_4152.C439.gene143.pep
MNEINNIHNTIIKDRWFSHIENINNQNKTIQKIRERKSLWDMRCHTTNRMLLKIKYKLSEPNMEYDETCTYFILYIDIAPHRSYVI

SEQ ID NO: 8889 - protein, 258 aa, Xenorhabdus bovienii
  Peptide sequence Name=Xb4151_4152.C439.gene144.pep
MLKRNNSFKDYISKIQSESLSRSKSFHSLPPDNILKANVNYNNPRLINGYIPTVRETSLEEIINAVKHIYKSIKEDRWTSHIKNVTERKNEIFQKNQKTREDAWDMRCCMTDNLLEKLQGILTILLKNGYFKTHAYFVCYINTQPIGVMLLKKYNSLYSRGTAYYPEVNFIINHPGIQNCAYLLMEKAVNTSYKIGYQGKLKLTLATGELSSKVYQKMGFTHIKGDENMKMELNPNGNSVWYLSPSYGGYFFTGIRRD

SEQ ID NO: 8890 - protein, 48 aa, Xenorhabdus bovienii
  Peptide sequence Name=Xb4151_4152.C439.gene145.pep
MQTLTANLLVELAVYFHEPNNNSVLATTKYATSGATAQPLPIEADHPR

SEQ ID NO: 8891 - protein, 384 aa, Xenorhabdus bovienii
  Peptide sequence Name=Xb4151_4152.C439.gene146.pep
  Gene classification: Gene name=Asd; Function=Aspartate-semialdehyde dehydrogenase; Function class=E Amino acid transport and metabolism
  Homolog annotation: Query=17..383bp; Hit=1..366bp; Blast score=614; Percent Identity=79.0; E value=1e-176; Homolog= asd COG0136
MISVCLINIFQDRVSMMKNVGFIGWRGMVGSVLVQRMLEERDFDEINPVFFTTSQHGLSAPEFAGKSGVLQDAFDIGALSALDIIISCQGGDYTNEIYPKLKATGWQGYWIDAASSLRMSDDATIILDPINHQHIQNSLNKGIKTFAGGNCTVSLMLMSLGGLFANDLIEWASVSSYQAASGSGARHMRELLVQMGMLHNQVADELQDPASAILDIEKRVTDFTRSGALPTDQFGVPLAGSLIPWIDKQLENGQSREEWKGQAETNKILNTGSNVIPIDGLCVRIGALRCHSQAFTLKLKKDIPIHEIETLLASHNDWVRVIPNDRELTMRELTPAAVTGTLNTPVGRLRKLNMGPEYLSAFTVGDQLLWGAAEPLRRMLRILL

SEQ ID NO: 8892 - protein, 37 aa, Xenorhabdus bovienii
  Peptide sequence Name=Xb4151_4152.C439.gene147.pep
MFIRHTDIIKADKIWRKVQVNLCPTVLSFEQQCVCRF

SEQ ID NO: 8893 - protein, 90 aa, Xenorhabdus bovienii
  Peptide sequence Name=Xb4151_4152.C439.gene148.pep
MRLPFLNHIAVGSQMSDTHSPAGIGTPSFGDLKKGKGVKRLQKKCRFLITVSFYSYLNCFKTRISFTNDIYTATETNNLTIRMSLLCCFQ

SEQ ID NO: 8894 - protein, 51 aa, Xenorhabdus bovienii
  Peptide sequence Name=Xb4151_4152.C439.gene149.pep
MTYTRPRRRTILQSGCRCFAVFNELNTCKILFICCPKMSGSVWRQLLAHGL

SEQ ID NO: 8895 - protein, 483 aa, Xenorhabdus bovienii
  Peptide sequence Name=Xb4151_4152.C439.gene150.pep
  Gene classification: Gene name=TrkA (BS); Function=Predicted flavoprotein involved in K+ transport; Function class=P Inorganic ion transport and metabolism
  Homolog annotation: Query=1..482bp; Hit=1..485bp; Blast score=577; Percent Identity=53.0; E value=1e-164; Homolog= Rv3083 COG2072
MSNQYDVLIMGAGVAGIGMACHLTRECPDKKVIILERRHAIGGTWDLFRYPGIRSDSDMMTFGYKFRPWSETSVFADGESIKNYVNKTAKEYGIDKKIQFGLKITNADWSGTTNQWSITAVEEASGETRTFTCNYLVAATGYYNYDEAYLPEFPGIEDFKGPVIHPQHWPEGLDYKGKRVVVIGSGATAATLVPTMANIAEHVTMLQRSPSYYLSVPGTDKIAEFLSKFMPKRWVYSFSRNRNIFIHRLLYKTSRYLPTLLKSFLLSSARKRVGPSFNMNHLTPKYMPWDERLCVIPNGNFLKSLKEGKSSIVTDQVKRFTENGILLQSGKELPADIIVSATGLKLLPLGGIEISIDEQKLQGNNRMLYKGTLIQDIPNFAYLFGYISSSWTLKVDLSADYVCRLLKEMDRRGAKSVTAYAQPDEMLKHENIFGELQSGYVRRGDEGLPRQGRSPNWYVSHDYKKDKEVLEKQPVEDSALRWM

SEQ ID NO: 8896 - protein, 44 aa, Xenorhabdus bovienii
  Peptide sequence Name=Xb4151_4152.C439.gene151.pep
MYFKNSSHFTGHIQVALAMRLIGSNNSLSLTMILLSHKYKWLSY

SEQ ID NO: 8897 - protein, 413 aa, Xenorhabdus bovienii
  Peptide sequence Name=Xb4151_4152.C439.gene152.pep
  Homolog annotation: Query=311..410bp; Hit=4..103bp; Blast score=75; Percent Identity=42.0; E value=2e-12; Homolog= gi|32029287|ref|ZP _00132330.1| hypothetical protein [Haemophilus somnus 2336]
MSLMKKYSVTNFVIYQVSDVLFTISIKTIGMLFTWVMLNQLGLVVELGYFLFISWALQVLTLLAFGLYGDKFSTKFYLISFCILSLLIISSLYFIESKNYFYWGIFFIITSLFSILTQPIGNSIISRILHNTNTDLAFRARGLVSSLNVVSGPAISGILISYLAYGHILVIVFCSVVISFLGFLWVSMMPSEKKADTSKVSLKILKNNPTELRLGAISGIFNFVIVPLVSYFIPFLIIDTMKLGAFDLGIAEFFFGAGMFLGSSVLVKFFNQILGKGYASLTGTILVSLGIFGVSISQSNIHINISMLIAGIGVVIYNINTTSIRMTATPSSQRHSMESVFLSLCIIPIPLGMLFSTYSIQFLSVNSILLGMSLILLFCSILIIKTPNFMHLCKMSSESLDGYYEKLYPRSVS

SEQ ID NO: 8898 - protein, 42 aa, Xenorhabdus bovienii
  Peptide sequence Name=Xb4151_4152.C439.gene153.pep
MVILVLFVTLFIIFTDILVVVISFAVIFILCIFVLYLIYIII

SEQ ID NO: 8899 - protein, 48 aa, Xenorhabdus bovienii
  Peptide sequence Name=Xb4151_4152.C439.gene154.pep
MLNVLCIALYSGQNIQVIFKSSSPCNSKNVVNYSSALQENFFYEYSYS

SEQ ID NO: 8900 - protein, 247 aa, Xenorhabdus bovienii
  Peptide sequence Name=Xb4151_4152.C439.gene155.pep
  Gene classification: Function=Predicted metal-dependent hydrolase; Function class=R General function prediction only
  Homolog annotation: Query=4..222bp; Hit=6..224bp; Blast score=187; Percent Identity=42.0; E value=6e-48; Homolog= jhp1425 COG1451
MAQLTIGKIDMQLNRKAIKNLHISVLPPDGLVRISAPMHMSDTAIRMAVISRIPWIKKQQQDFARQPRQSEREMVNGECHYLWGRRHRLNIVEHVGKQQVKTSGEKIYLYVPYGAPFEKKAQVLSDYYRAALKERIEKLLMHWQPIIGVMPSSWGIKKMKTKWGSCNTVSGSIWLNLELAKKPLECLEFILVHELVHLLERKHNERFMTYMDGYLPDWRERKRLLSILPLSNDEWVTPCVALLDISD

SEQ ID NO: 8901 - protein, 1029 aa, Xenorhabdus bovienii
  Peptide sequence Name=Xb4151_4152.C439.gene156.pep
  Gene classification: Gene name=HsdR; Function=Restriction enzymes type I helicase subunits and related helicases; Function class=L DNA replication, recombination and repair
  Homolog annotation: Query=8..1028bp; Hit=4..990bp; Blast score=895; Percent Identity=48.0; E value=0; Homolog= jhp1424 COG0610
MSTVGQRERVTQDRIVKFFQTELGYRYLGNLQDRDNKNIDVDILTAWLKKRGISGTLIGRVLRQLINTAALGDGNKLYHANKNVYNLLRYGIKEKEDVGEQHQTIWLIDWHNPEANDFAIAEEVSIKGENKKRPDIVLYVNGIALGIIELKRSSVSVSEGIRQNLDNQKKEFIRDFFSTMQLVMAGNDTQGLSYGTIGTPEKYYLEWKERIDNPYPYRLDFHLSRICSKPRFLQLIHDFIVFDAGVKKACRHNQFFGVEAAKKRILQREGGIIWHTQGSGKSLTMVWLAKWIRENVPNSRVLIVTDRTELDAQIEKVFTGVEENIYRTKSGADLIFNLNRPNPWLICSLVHKFGHRSEAEDDAATDEYIKELKKSLPSDFRAKGDLFVFVDECHRTQSGKLHDAMKSILAEAVFIGFTGTPLMKKDKKKSIEVFGSFIHTYKFDEAVSDGVILDLRYEARDIDQYLTSQKRIDEWFEANTQGLSRLGKTQLKQKWGTMQKVLSSKSRLEMIVMDIRLDMMKRPRLMDGRGNAMLVCSSIHQACTVYDLFSQTDLAGKVAIITSYKPDSASIKGEETGEGLTEQLAKYKTYRKMLADYFEQPEDKVANRVEEFETKVKQQFIDEPGQMRLLIVVDKLLTGFDAPSATYLYIDKHMSDHNLFQAICRVNRLDGDDKEYGYIIDYKDLFRSLNKAISDYTKEVFDGYDKKDIDGLLKNRLEQARLNLDAALEMVRALCEPVKAPRNTIDYIHYFCCESGADPELLSEKEALRLALYQCVAKLLRAFANIANEMTIAGYSPAQMEKIRAEVAHYEKVRDEIKLASKDKVEMKRYEPAMRSLIDMYIRADDSEVLIDFEEIGLLELIIQKGAAVGEDLPEGIRKDPEAMAETIENNVRKTIVDENPVNPRYYEHMSVLLDELIALRRQNALNYQEYLEKIRDLAKKVVRPNQNTAAYPPDIDTPPKRAFYDNFDQNTDLAICIDKTIRDTKKADWVNDRFKEREIANALRDETAEYKVDIDKIMELAKAQRDYR

SEQ ID NO: 8902 - protein, 452 aa, Xenorhabdus bovienii
  Peptide sequence Name=Xb4151_4152.C439.gene157.pep
  Gene classification: Gene name=HsdS; Function=Restriction endonuclease S subunits; Function class=L DNA replication, recombination and repair
  Homolog annotation: Query=24..451bp; Hit=8..423bp; Blast score=138; Percent Identity=28.0; E value=1e-32; Homolog= MJ0130m COG0732
MNQIAEGNSKYLAESVGNTLPIGYKQTEAGVIPEAWVVKSIGELANVIRGASPRPKGDKRYYDGKIPRLMVEDVTRDGKFVTPIVDSLTEAGAKLSRPCLRGTLTLVCSGNVGIPSILAIDACIHDGFLALTKVSKNISIDYLYHFFSTQREKFNNSATHGGVFTNLTTEGVREFLVALPFCYEEQTTIANILSDVDGLISELEKLLAKKQAIKIATMQQLLTGRTRLPQFAFREDGSKKGYKRSELREIPEDWNPISIGKDAVLKARIGWQALTTKEYLETGEYYLVTGTNFDAGTVKWEDCWYVSEWRYKQDSNIQLKEDDVLITKDGTIGKVGYVEFLRLPSTLNSGVFVIRPKNNAFHPRYLFYILTSKIFNEFMKGITAGSTITHLYQKDFVNFNFIAPNIEEQTTIATILLDMDTEIQALKQRLGKTRQIKQGMMQELLTGKTRLI

SEQ ID NO: 8903 - protein, 819 aa, Xenorhabdus bovienii
  Peptide sequence Name=Xb4151_4152.C439.gene158.pep
  Gene classification: Gene name=HsdM; Function=Type I restriction -modification system methyltransferase subunit; Function class=L DNA replication, recombination and repair
  Homolog annotation: Query=1..474bp; Hit=1..474bp; Blast score=539; Percent Identity=57.0; E value=1e-153; Homolog= HP1403_1 COG0286
MAIKKNELYSSLWASCDELRGGMDASQYKDYVLTMLFMKYVSDKYKNDRYGIIVIPEGAGFDDMVALKGKKDIGDEINKIIRKLADENGLGTMFDVANFNDEEKLGKGKEMIDRLSKLVGIFEGLDLSNNYAGGDDLMGDAYEYLMRHFATESGKSKGQFYTPAEVSLVLAKIIGINDKTPRDASVYDPTCGSGSLLLKASDEAPRGLSIFGQEMDVTTSSLAKMNMILHGHESDVHSIQQGNTIASPVFKDDKGQLKTFDFAVANPPFSNKNWTSGINPREDEFGRFGWGIPPEKNGDYAFLLHILKSLKSTGKGAVILPHGVLFRGNAESLIRENLIKQGYIRGIIGLPANLFYGTGIPACIIVLDKQDAISADFDAEGKVTRGRDIFMIDASRDFIKDGNKNRLRSQDIYKIVEVFTQQKTLPRFSRTVEFKEIVANDYNLNIPRYIDSSEPEDLHDLSAHLQGGIPNRDIDVLDKYWNVFPGIRSTLFATEREGYSHSLVEANQVKDTILNHTEFKTFAEQSLKPFAAWCQSAALKEIHRSDNPKELLNDISGYLLINYESVPLLSKYDVYQILMDYWAETMQDDVYVLVQDDWAAGKKVRELVVKQAEKLKETPDFVIKKTKYKAEIIPPALIIQNYFAGQQVKIDQLQIDADNATQALENYIEENSGDDGLLNDALNDKDKVTKASITARLKLATDNEEKTVLKQAKELFDAEIDAKKELKKYQEALDLSVLKQYSKLTDDEIKTLVVDKKWLATLEANIQAEIERVTQQLTNRVRELEERYAESLPTISKSVDSLSSKVADNLKAMGLEWVL

SEQ ID NO: 8904 - protein, 418 aa, Xenorhabdus bovienii
  Peptide sequence Name=Xb4151_4152.C439.gene159.pep
  Gene classification: Function=Uncharacterized ATPases of the AAA superfamily; Function class=R General function prediction only
  Homolog annotation: Query=13..416bp; Hit=6..409bp; Blast score=241; Percent Identity=35.0; E value=1e-63; Homolog= Rv0597c COG1373
MGIITLNNKRYPRLIAPKLKEALTDTPVVCLLGPRQVGKTTLVKELESGRAYITFDDSTLLNAAKSDPLGFVQGLPERVTLDEVQRVPEILPALKAVVDTNRTSGRFILTGSANLLLLPGVQESLAGRVEVTYLQPLSEQEKQYSSVTLLEKLLSNRISPSIKGEQAQLEGIADAVVQGGYPEPNTRTEARARQWHKQYLNAIIQRDVKDIAAIRDEEELLRLIKILALRTGNLLNISGLSKDLGLQRDTVDKYITILERLFLVRRLPAWHKNHAKRLLKTPKIHIIDSGLACVLTKLRTNDWYDFSSDFGAVLESFVVQQLICQSGWIEHELFFSHYRDKDQVEVDLVIEDGKKVWGVEVKKAASIQPKDGAGLAKLASLSGDDWQGGIMLYTGNNCLPISQVPNTYAVPMNALWKE

SEQ ID NO: 8905 - protein, 61 aa, Xenorhabdus bovienii
  Peptide sequence Name=Xb4151_4152.C439.gene160.pep
LGAISLGYRLLFNVIIPINYYIKDDGNRLFAGYCSDYLMVLHPSVCIFNIRLIAVLKCNNY

SEQ ID NO: 8906 - protein, 609 aa, Xenorhabdus bovienii
  Peptide sequence Name=Xb4151_4152.C439.gene161.pep
  Gene classification: Gene name=GlmS; Function=Glucosamine 6-phosphate synthetase, contains amidotransferase and phosphosugar isomerase domains; Function class=M Cell envelope biogenesis, outer membrane
  Homolog annotation: Query=1..609bp; Hit=1..609bp; Blast score=1030; Percent Identity=85.0; E value=0; Homolog= glmS COG0449
MCGIVGAVAQRDIAEILIEGLRRLEYRGYDSAGLAVVDSENGMTRLREVGKVQMLADEAGKQPVTGGTGIAHTRWATHGEPNELNAHPHVSEHIAVVHNGIIENYEELRELLKERGYTFFSDTDTETIAHLVHWEQKQGGSLLEVVQRVIPQLRGAYGTVIMDSRHPDVLVAARSGSPLVIGLGVGENFLASDQLALLPVTRRFIYLEEGDIVEITRRTVRIFDVTGAAVEREQIESNVQYDAGDKGIYRHYMQKEIYEQPMAIKSTLEGRLSHGQVDLSELGANAEELLSQVEHIQIVACGTSYNAGMVSRYWFESLAGIPCDVEIASEFRYRKPARRKGSLLITLSQSGETADTLAALRLSKELGYLTSLVICNVAGSSLVRESDFALMTKAGAEIGVASTKAFTTQLTVLLMLVAYMGRLKGADAALEQDVVHALQALPSRIESMLSKDKVIEALAEDFSEKHHALFLGRGDQYPIAVEGALKLKEISYIHAEAYAAGELKHGPLALIDADMPVIIVAPNNELLEKLKSNIEEVRARGGQLYVFADQDAGFTNSENMKIISLPHVEDLIAPIFYTVPLQLLSYHVALIKGTDVDQPRNLAKSVTVE

SEQ ID NO: 8907 - protein, 459 aa, Xenorhabdus bovienii
  Peptide sequence Name=Xb4151_4152.C439.gene162.pep
  Gene classification: Gene name=GlmU; Function=N-acetylglucosamine-1 -phosphate uridyltransferase (contains nucleotidyltransferase and I -patch acetyltransferase domains); Function class=M Cell envelope biogenesis, outer membrane
  Homolog annotation: Query=6..459bp; Hit=3..456bp; Blast score=724; Percent Identity=78.0; E value=0; Homolog= ZglmU COG1207
MSISANSAKSVVILAAGKGTRMYSALPKVLHSLAGKPMVQHVIDTAMALGTQNVHLVYGHGGDLMKQTLSNQNLNWVLQAEQLGTGHAMQQAAPYFADDEDILMLYGDVPLIAQDTLERLVEIKPEGGIGLLTAILNNPAGYGRIIRENGEVAGIIEQKDATDEQRKINEINTGILVANGGDLKRWLSQLDNNNAQGEYYITDIIALAHKEGRQIKAVHPSRLSEMEGVNNRLQLSALERIYQSEQAEKLLLAGVMLLDPARFDLRGTLEHGRDVVIDTNVIIEGHVALGNNVHIGSGCILKNCAIGDGTVISPYTVIEDSEIAAECTVGPFARLRPGSKLAEKAHVGNFVEMKKTSLGKGSKAGHLTYLGDSEIGNNVNIGAGTITCNYDGANKFKTIIGDDVFVGSDTQLVAPVTVAKGVTIGAGTTVTKDVAENELVISRVKQTHIQGWQRPVKKK

SEQ ID NO: 8908 - protein, 213 aa, Xenorhabdus bovienii
  Peptide sequence Name=Xb4151_4152.C439.gene163.pep
  Homolog annotation: Query=1..162bp; Hit=19..179bp; Blast score=105; Percent Identity=40.0; E value=6e-22; Homolog= gi|26250474|ref|NP _756514.1| Hypothetical protein [Escherichia coli CFT073] gi|26110904|gb|AAN83088.1|AE016769_203 Hypothetic
MQKSQLAFTNWLFILLPILHPLFCQFDYTKFCNRFRQFSRCLSIINIAVRITDVFFSLTLRFKRLGFVQILTTDRCIGQYDNAVWLNFKNSTGQVDKFFFTKLLNNTYHARFYGSKQWCVLRINTQLTFTASHLNFLYQPFKQSFFSADYVQEERHCSHINLPSAVLHLLRFFYSFVDGTNHVERLFWQVVIITLQDALKATNGFFQRDELTW

SEQ ID NO: 8909 - protein, 460 aa, Xenorhabdus bovienii
  Peptide sequence Name=Xb4151_4152.C439.gene164.pep
  Gene classification: Gene name=AtpD; Function=F0F1-type ATP synthase beta subunit; Function class=C Energy production and conversion
  Homolog annotation: Query=1..460bp; Hit=1..460bp; Blast score=852; Percent Identity=93.0; E value=0; Homolog= atpD COG0055
MATGKIIQVIGAVVDVEFPQDSVPKVYNALEVKNSEEKLVLEVQQQLGGGIVRCIAMGTSDGLRRGLDAIDLGHPIEVPVGKATLGRIMNVLGDPIDMKGEIGEEERWSIHRTAPSYEELSSSQELLETGIKVMDLICPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVARGVQSILQRYQELKDIIAILGMDELSEEDKLVVARARKIQRFLSQPFFVAEVFTGSPGKFVSLKETIRGFKGILEGDYDHLPEQAFYMVGTIDEAVEKAKKM

SEQ ID NO: 8910 - protein, 287 aa, Xenorhabdus bovienii
  Peptide sequence Name=Xb4151_4152.C439.gene165.pep
  Gene classification: Gene name=AtpG; Function=F0F1-type ATP synthase gamma subunit; Function class=C Energy production and conversion
  Homolog annotation: Query=1..287bp; Hit=1..287bp; Blast score=508; Percent Identity=89.0; E value=1e-144; Homolog= atpG COG0224
MAGAKEIRTKIASVQNTQKITKAMEMVAASKMRKTQDRMAASRPYAETIRSVIGHLALGNLEYRHPYLDEREVKRVGYLVVSTDRGLCGGLNINLFKKLLIEMKDWSDKGVQVDLALVGSKAVSFFSSVGGNIVAQVTGMGDNPSLSELIGPVNVMMQAYDAGRLDKLYIVTNRFINTMSQVPTITQLLPLPAGDDETLKKKSWDYLYEPDPKALLDTLLRRYIESQVYQGVVENLASEQAARMVAMKAATDNGGNLIKELQLVYNKARQASITQELTEIVSGASAV

SEQ ID NO: 8911 - protein, 513 aa, Xenorhabdus bovienii
  Peptide sequence Name=Xb4151_4152.C439.gene166.pep
  Gene classification: Gene name=AtpA; Function=F0F1-type ATP synthase alpha subunit; Function class=C Energy production and conversion
  Homolog annotation: Query=1..513bp; Hit=1..513bp; Blast score=909; Percent Identity=90.0; E value=0; Homolog= atpA COG0056
MQLNSTEISELIKQRIAQFNVVSEAHNEGTIVSVNDGIIRIHGLADVMQGEMISLPGNRYAIALNLERDSVGAVVMGPYADLAEGMKVKCTGRILEVPVGRGLLGRVVNTLGEPIDGKGALENDGFSPVEVIAPGVIDRQSVDQPVQTGYKSVDAMIPIGRGQRELVIGDRQTGKTALAIDAIINQRDSGIKCIYVAIGQKASTISNVVRKLEEHNALANTIVVVASASESAALQYLAPYSGCAMGEYFRDRGEDALIVYDDLSKQAVAYRQVSLLLRRPPGREAFPGDVFYLHSRLLERAARVNADYVEKFTNGEVKGKTGSLTALPIIETQAGDVSAFVPTNVISITDGQIFLESALFNAGIRPAVNPGISVSRVGGAAQTKIIKKLSGGIRTALAQYRELAAFSQFASDLDDATRKQLDHGQKVTELLKQKQYQPMSVAQQALSLFAAERGYLEDVEIAKVVSFESALLAYANREHSDLLKEIDQSGDYNGEIEAKLTALLDSFKATQSW

SEQ ID NO: 8912 - protein, 177 aa, Xenorhabdus bovienii
  Peptide sequence Name=Xb4151_4152.C439.gene167.pep
  Gene classification: Gene name=AtpH; Function=F0F1-type ATP synthase delta subunit (mitochondrial oligomycin sensitivity protein); Function class=C Energy production and conversion
  Homolog annotation: Query=1..177bp; Hit=1..177bp; Blast score=253; Percent Identity=77.0; E value=6e-68; Homolog= atpH COG0712
MSEFATVARPYAKAAFDFAVEHQSLEHWQNMLAFVAEVTRNEQVGELLSGSLAPETLANTFITLCGEQVDEHAQNFIRVMAENGRLLVLPEVFQQFTQLRASLESTINVEVISASELNEQQQAKISAAMEKRLSRKVKLNCKIDKSVIAGVVIRAGDMVIDGSIRGRLDRLTDVLQS

SEQ ID NO: 8913 - protein, 135 aa, Xenorhabdus bovienii
  Peptide sequence Name=Xb4151_4152.C439.gene168.pep
  Gene classification: Gene name=AtpF; Function=F0F1-type ATP synthase b subunit; Function class=C Energy production and conversion
  Homolog annotation: Query=1..135bp; Hit=22..156bp; Blast score=147; Percent Identity=85.0; E value=3e-36; Homolog= atpF COG0711
MKYVWPPIMAAIEKRQKEITDGLASAERAKKNLDLAQANATDQLKKAKADAQAIIEQANKQKAQIIDDAKTEAELERNKIVAQAQAEIDAERKRAREELRKQVAMLAIAGAEKIIERSVDEAANSDIVDKLVAEL

SEQ ID NO: 8914 - protein, 40 aa, Xenorhabdus bovienii
  Peptide sequence Name=Xb4151_4152.C439.gene169.pep
MAAIIGGHTYFMQNKTNRTNAMAWPRIVALIFKAQYLYFN

SEQ ID NO: 8915 - protein, 81 aa, Xenorhabdus bovienii
  Peptide sequence Name=Xb4151_4152.C439.gene170.pep
  Gene classification: Gene name=AtpE; Function=F0F1-type ATP synthase c subunit/Archaeal/vacuolar-type H+-ATPase subunit K; Function class= C Energy production and conversion
  Homolog annotation: Query=1..78bp; Hit=1..78bp; Blast score=93; Percent Identity=84.0; E value=4e-20; Homolog= BU003 COG0636
MENLNMDLLYMAAAILMGLAAIGAAIGIGILGGKFLEGAARQPDLIPLLRTQFFIVMGLVDAIPMIAVGLGLFMMFAVGGQ

SEQ ID NO: 8916 - protein, 275 aa, Xenorhabdus bovienii
  Peptide sequence Name=Xb4151_4152.C439.gene171.pep
  Gene classification: Gene name=AtpB; Function=F0F1-type ATP synthase a subunit; Function class=C Energy production and conversion
  Homolog annotation: Query=4..275bp; Hit=2..271bp; Blast score=351; Percent Identity=76.0; E value=6e-97; Homolog= atpB COG0356
MSASGEVLTSQEYISHHLKHLQLDLRTFELVNPHASGYETTFWTLNIDSLFFSVILGILFLFVFRRVAVRATDGVPGKLQTAVEMVFGFVDNTVRDMYHGKSKVIAPLALTVFVWVLLMNALDLLPIDLIPLIGERYFGLPALRIVPTADVSVTLSMALGVFVLILFYSIKMKGIRGFAKELTLQPFNHPLFIPINLILEGVSLLSKPISLALRLFGNMYAGELIFILITALLPFWSQWLLSLPWAIFHILIITLQAFIFMVLTVVYLSMASEEH

SEQ ID NO: 8917 - protein, 125 aa, Xenorhabdus bovienii
  Peptide sequence Name=Xb4151_4152.C439.gene172.pep
  Gene classification: Gene name=AtpI; Function=F0F1-type ATP synthase I subunit; Function class=C Energy production and conversion
  Homolog annotation: Query=1..124bp; Hit=5..127bp; Blast score=58; Percent Identity=47.0; E value=1e-09; Homolog= atpI COG3312
MSVSLYSGRIALKLLLLQLMTFIILSVAFCTRSIEWGASAFAGGLACWLPNAIFMLLTRFQKAKEEDVPVRIAWFFAIGEVAKVVITIAVLIVALGVFKAAFAPLGVAYLAVLIVQIIAPAVMNG

SEQ ID NO: 8918 - protein, 206 aa, Xenorhabdus bovienii
  Peptide sequence Name=Xb4151_4152.C439.gene173.pep
  Gene classification: Gene name=GidB; Function=Predicted S -adenosylmethionine-dependent methyltransferase involved in bacterial cell division; Function class=M Cell envelope biogenesis, outer membrane
  Homolog annotation: Query=1..206bp; Hit=1..205bp; Blast score=297; Percent Identity=73.0; E value=4e-81; Homolog= gidB COG0357
LLNKLESLLVKTDIVLSLEQKQQLIAYVDMLNKWNKAYNLTSVRDPEQMLVRHIMDSIVVNPFLHGTRFIDVGTGPGLPGIPLAIVRPDSHFTLLDSLGKRVRFLRQVQHELGLKNIDPVQSRVEEFIPEPPFDGVISRAFASLQDMLSWCRHLPKPAEGRFYALKGVLPENELTQLPSGVTLDTVVSLQVPELGGERHLVVLKSN

SEQ ID NO: 8919 - protein, 629 aa, Xenorhabdus bovienii
  Peptide sequence Name=Xb4151_4152.C439.gene174.pep
  Gene classification: Gene name=GidA; Function=NAD/FAD-utilizing enzyme apparently involved in cell division; Function class=D Cell division and chromosome partitioning
  Homolog annotation: Query=1..629bp; Hit=1..629bp; Blast score=1080; Percent Identity=85.0; E value=0; Homolog= gidA COG0445
MFYPEHFDVIIIGGGHAGTEAAMAAARMGRQTLLLTHNIDTLGQMSCNPAIGGIGKGHLVKEIDALGGLMAQATDQAGIQFRTLNASKGPAVRATRAQADRVLYRQAVRTALENQSNLMIFQQSVEDLIVENNTITGVVTRMGLKFKAKSVVLTVGTFLDGKIHIGLENYSGGRAGDPPAIALSHRLRELPLRVARLKTGTPPRIDARTIDFSQLEQQLGDNPTPVFSFMGNVDQHPRQIPCYITHTNEKTHEVIRNNLDRSPMYAGIIEGIGPRYCPSIEDKVMRFADRNAHQIFLEPEGLTSNEIYPNGISTSLPFDVQMQIVHSMKGMENARIVRPGYAIEYDFFDPRDLKQTLESKFINGLFFAGQINGTTGYEEAAAQGLLAGLNAARYAADENGWFPRRDQAYIGVLVDDLCTLGTKEPYRMFTSRAEYRLMLREDNADLRLTEKGRELGLVDDQRWEHYCRKVEMIEQERQRLRNIWVHPHSDSLDEINQMLKAPLSKEANGEDLLRRPEMNYELLTSLPRFTPGLTEPQAADQVEIQVKYEGYIARQQEEIEKQLRNENAALPLDLDYKQVNGLSNEVIAKLNDHKPSSIGQASRISGITPAAISILLVWLKKQGLLRRSA

SEQ ID NO: 8920 - protein, 32 aa, Xenorhabdus bovienii
  Peptide sequence Name=Xb4151_4152.C439.gene175.pep
MILYSIMIFLWKNHLSTDDRDPNNRSNKKIFK

SEQ ID NO: 8921 - protein, 146 aa, Xenorhabdus bovienii
  Peptide sequence Name=Xb4151_4152.C439.gene176.pep
  Gene classification: Gene name=FldA; Function=Flavodoxins; Function class=C Energy production and conversion
  Homolog annotation: Query=1..146bp; Hit=1..146bp; Blast score=185; Percent Identity=60.0; E value=2e-47; Homolog= mioC COG0716
MSTITLISGSTMGSSEYVAEHMAEILENHGFSTEVLHGPSLDDLRLGGLWLVVTSTHGAGDLPENLQPLADTIAQQQPDLSNVTFGAVGIGSSEYDIFCGAIKSFEHLLKDRGAKRIGDRLEIDIQKYEIPEDPAEDWVKEWAKLL

SEQ ID NO: 8922 - protein, 153 aa, Xenorhabdus bovienii
  Peptide sequence Name=Xb4151_4152.C439.gene177.pep
  Gene classification: Gene name=Lrp; Function=Transcriptional regulators; Function class=K Transcription
  Homolog annotation: Query=3..153bp; Hit=2..152bp; Blast score=239; Percent Identity=82.0; E value=7e-64; Homolog= asnC COG1522
MAEIYQIDNLDRDILHALMDNARTPYAELAKKFAVSPGTIHVRVEKMKQAGIITGTRVDISAKQLGFDVCCFIGIILKSAKDYPAALKKLDMLDEVVEVYYTTGHYSIFTKVMCRSIESLQDVLINKIQTIDEIQSTETLISLQNPIIRTIKP

SEQ ID NO: 8923 - protein, 39 aa, Xenorhabdus bovienii
  Peptide sequence Name=Xb4151_4152.C439.gene178.pep
LFINITRYFYYQILNLYLILLLNLYQQDIGSLKILRAAP

SEQ ID NO: 8924 - protein, 330 aa, Xenorhabdus bovienii
  Peptide sequence Name=Xb4151_4152.C439.gene179.pep
  Gene classification: Gene name=AsnA; Function=Asparagine synthetase A; Function class=E Amino acid transport and metabolism
  Homolog annotation: Query=1..330bp; Hit=1..330bp; Blast score=504; Percent Identity=74.0; E value=1e-143; Homolog= ZasnA COG2502
MKTSFIEKQQQISFVKSYFSRLLEKQLGLIEVQGPILSRLGDGTQDNLSGHEKAVQVKVKTLPDATFEVVHSLAKWKRKTLGRFGFQAEQGLYTHMKALRPDEDRLTPIHSVFVDQWDWEKVMGEGHRSLGYLKQTVGKIYEAIKETQKAVSKEFGLAPFLPDQIHFLHSEELLKRYPDLDAKSREREAAKEFGAIFLMGIGGKLSDGQAHDVRAPDYDDWTTPNSDGLFGLNGDIIVWNPVLQDAFEISSMGIRVDAEALQRQLELTCDEDRLQYDWHQALVKGDMPQSIGGGIGQSRLVMLLLQMAHIGQVQCGVWSPEIIESVEGVL

SEQ ID NO: 8925 - protein, 485 aa, Xenorhabdus bovienii
  Peptide sequence Name=Xb4151_4152.C439.gene180.pep
  Gene classification: Function=Uncharacterized ACR; Function class=S Function unknown
  Homolog annotation: Query=9..475bp; Hit=1..465bp; Blast score=521; Percent Identity=57.0; E value=1e-148; Homolog= ZyieM COG2425
MLTLTTLDLLLSINEGELIEEIILALLSAPQLTIFFEKYPRFKRALLKDVPAWQQTLQQRIKDTLIPASLAEEFQLYQQLLTANTTKFYQQLPDLADKLEQIKSPFTHDAHTLREALSEHTHAGQILFIQHWRTSLILQVTTFHKQLLEQEKEQLLAEIQKRLDLSGNLDPIFDENDRAAGRLWDMSKGRLHLTSHNTALFTQYAQFLKQQPELEKLAQLLGRSQAAKSIPEDSNTLEPFTQIERIPDTVPEQVSGIQQGDDIQRLLPTELAMLGIEELEYEFYRRLVDKKLLIYRLQGDNWQPRNILKPMTHHDHAEQPRGPFIVCVDTSGSMGGFNEHCAKAFCLALMRIALADNRHCHIILFSTELIHYDLTSQDGLTQAVHFLGQTFKGGTDLAFCLNAIIEKMQESIWKDADAVVISDFIAQRLPDVLIHQIQNLQQRQQHRFHAVSLSHYGKPGIMQIFDHIWHFDTGVTSRLLRRWRH

SEQ ID NO: 8926 - protein, 500 aa, Xenorhabdus bovienii
  Peptide sequence Name=Xb4151_4152.C439.gene181.pep
  Gene classification: Function=MoxR-like ATPases; Function class=R General function prediction only
  Homolog annotation: Query=3..494bp; Hit=15..502bp; Blast score=518; Percent Identity=55.0; E value=1e-147; Homolog= yieN COG0714
MQLVEKISQLSQYLEIGLYERRQTIRLCLLAALCGESVFLLGPPGIAKSLIARRLKFSFQNAHAFEYLMTRFSTPEEIFGPLSIQALKDEGRYQRLTEGYLPEAEIVFLDEIWKAGPAILNTLLTAINEKKFRNGNQEENLPMRLLVTASNELPDADSSLEALYDRMLIRIWLNNIQEKKNFRALLTDRNNENDNPVPTHFQITDEEFHQWQCKIKHVSLPDYIFELIYQLRQLLNASENLPHVSDRRWKKAIRLLQASAFFSGKNAISPLDLVLLKDCLWHDLNALKLLPQFLHDLLTEQAYQQSFLLQKMDGVYQQWIQTSRDETHLHPLQLTTNSSLFGRKIHYSLPKTINDEKLILFLYPALHLHDIEVNFIEIDSKVLENVLKNSNGELLARLNGIGFPLKISAEINEKHQLEVLDMSRNRAILCQAEAKQLTTEKTNNEWNEKLISISDAIQHQRQLFGQHQPCLFIEEHWIANIEQSFLQLIEKLKQLRSKMR

SEQ ID NO: 8927 - protein, 139 aa, Xenorhabdus bovienii
  Peptide sequence Name=Xb4151_4152.C439.gene182.pep
  Gene classification: Gene name=RbsD; Function=Uncharacterized components of ribose/xylose transport systems; Function class=G Carbohydrate transport and metabolism
  Homolog annotation: Query=1..139bp; Hit=13..151bp; Blast score=171; Percent Identity=60.0; E value=2e-43; Homolog= rbsD COG1869
MKKGVLLHSDISAVISRLGHTDQITISDAGLPIPLSTQRIDLALTQGIPDLMSVFDVVVQEVQVEAAILATEMIDHNPQIHEQIIKRIAELETKQGNAIAIEYVNHNILKEKTEKSKAIIRTGECSPYANILLCSGVTF

SEQ ID NO: 8928 - protein, 502 aa, Xenorhabdus bovienii
  Peptide sequence Name=Xb4151_4152.C439.gene183.pep
  Gene classification: Gene name=MglA; Function=ABC-type sugar (aldose) transport system, ATPase component; Function class=G Carbohydrate transport and metabolism
  Homolog annotation: Query=2..495bp; Hit=1..494bp; Blast score=761; Percent Identity=79.0; E value=0; Homolog= rbsA COG1129
MMEPLLELKEIDKAFPGVKALSGAALRVYPGKVMALVGENGAGKSTMMKVLTGIYTKDAGSIHYLGKNVVFSDPKSSQEAGIGIIHQELNLIPQLTIAENIFLGREFVNKLGIINWQKMYEEADNLLKRLNIRYSSRRLVSELSIGDQQMVEIAKVLSFQSKVIIMDEPTDALTDTETESLFHVIRELKAQDCGIVYISHRLKEIFEICDDVTVFRDGQFIGEQPVAALQEDTLIEMMVGRKLEDQYPRLDLPRGGKRLEIENLSGSGIKNVSFSLFGGEILGISGLMGAGRTELMKMIYGALPKTKGRILLDGKSLTIRNPQDGLANGIVYISEDRKRDGLVLGMSVKENMSLTALRYFSQKPYRLNHSAEQKTVTDFIKLFNIKTPSMEQSIGLLSGGNQQKVAIARGLMTRPKVLILVEPTRGVDVGAKKEIYQLINQFKKEGLSIILVSSEMPEVMGMSDRILVMHEGGISGEFSADNASQEALMVAAVGKQYGAVER

SEQ ID NO: 8929 - protein, 323 aa, Xenorhabdus bovienii
  Peptide sequence Name=Xb4151_4152.C439.gene184.pep
  Gene classification: Gene name=AraH; Function =Ribose/xylose/arabinose/galactoside ABC-type transport systems, permease components; Function class=G Carbohydrate transport and metabolism
  Homolog annotation: Query=1..320bp; Hit=1..319bp; Blast score=417; Percent Identity=87.0; E value=1e-117; Homolog= rbsC COG1172
MNFNTAATSRYWLTKAWLMEQKSLIALLILIVVVSFFSPNFFTLNNLFNILQQTSVNAIMAVGMTLVILTSGIDLSVGSLLALTGAVAASMVGTDVNALVAVAAALALGAAIGACTGVIVAKGKVQAFIATLVMMLLLRGVTRVYTDGSPINTGFSDNADLFGWFGIGRPLGVPAPVWIMLLVFATAWYILHHTRLGRYIYALGGNESATRLSGINVDKIKIIVYSLCGLLAALASIIEVARLSSAQPMAGSGYELDAIAAVVLGGTSLAGGKGRIVGTLIGALILGFLNNGLNLLGISSNYQMIVKAVVILLAVLVDNKSSK

SEQ ID NO: 8930 - protein, 296 aa, Xenorhabdus bovienii
  Peptide sequence Name=Xb4151_4152.C439.gene185.pep
  Gene classification: Gene name=RbsB; Function=Periplasmic sugar -binding proteins; Function class=G Carbohydrate transport and metabolism
  Homolog annotation: Query=1..296bp; Hit=1..296bp; Blast score=418; Percent Identity=79.0; E value=1e-117; Homolog= ZrbsB COG1879
MKMNKLATILSAVVLSATMSANALAKDSIALVISTLNNPFFVTMKDSAQKEADKLGYNLIVLDSQDNPAKELANVQDLTVRGTKLMLINPTDSDAVGNAVIMANKANIPVITLDRAANKGNVVSHIASDNRLGGKMAGDFIAEKLGNNAKIIQLEGISGTSGARERSEGFSQAAKSHQFNMLASQPADFDRTKGLNVMQNLLTAHPSVQAVFAQNDEMALGALRALQTANKKDVLVVGFDGTDDGVKAVRSGKLSATIAQRPDQIGIIGVQTADKVLKGEKVDATIPVELELVIKK

SEQ ID NO: 8931 - protein, 309 aa, Xenorhabdus bovienii
  Peptide sequence Name=Xb4151_4152.C439.gene186.pep
  Gene classification: Gene name=RbsK; Function=Sugar kinases, ribokinase family; Function class=G Carbohydrate transport and metabolism
  Homolog annotation: Query=6..308bp; Hit=7..308bp; Blast score=354; Percent Identity=67.0; E value=9e-98; Homolog= rbsK COG0524
MSMAKLAVMGSINADHILNLESFPQPGETVMGKQYQVAFGGKGANQAVAAGRCGADITFIACVGQDDIGERVRQQLVKDNINTSAIGVIEGETTGVALIFVNQQGENVIGISAGANGALTSEYFHHHEQVVKEADVLLLQLETPLETVQLAAETARKHNTKVILNPAPAQKLSEQLLSLVDIITPNETEAEYLTGIAVKDNVGAEKAAQDLHKKGIEIVIITLGSRGVWLSENGKQGKIVPGFKVKAIDTIAAGDTFNGALVTGLLEGKGIVSAIRFAHAAAAIAVTRQGAQPAVPWRREIDAFLAEQD

SEQ ID NO: 8932 - protein, 330 aa, Xenorhabdus bovienii
  Peptide sequence Name=Xb4151_4152.C439.gene187.pep
  Gene classification: Gene name=PurR; Function=Transcriptional regulators; Function class=K Transcription
  Homolog annotation: Query=1..326bp; Hit=4..329bp; Blast score=440; Percent Identity=65.0; E value=1e-123; Homolog= rbsR COG1609
MKDVARLAGVSTSTVSYVINDNRYVSERVKKKVNAAIDELNYAPSALARSLKIKKTKTIGMLVTTSNNPFYAEIVRGVERNCYERGYSLILCNTEGDVTRLIRSMETLLQKRVDGLLIMCSENAILPNDFLLRYPLIPMVTMDWSPFYVSSDVIKDNSLLGGELATSYLISRGFRKIACIAGPQDKTPARQRLAGYRKAMKDAQLEIPEGYEIHSDFEFAGGLSSMEQLLQLSKPPEAVFAGNDAMAIGAYQALHRAGFSVPDDISVIGYDDISMAPYMTPPLTTIHQPKDELGKLAIDTLLYRMGNPESEPKQLILKPKLIERNSVARR

SEQ ID NO: 8933 - protein, 460 aa, Xenorhabdus bovienii
  Peptide sequence Name=Xb4151_4152.C439.gene188.pep
  Gene classification: Gene name=ProP; Function=77 Permeases of the major facilitator superfamily; Function class=G Carbohydrate transport and metabolism
  Homolog annotation: Query=3..460bp; Hit=4..461bp; Blast score=563; Percent Identity=70.0; E value=1e-160; Homolog= yieO COG0477
MVKSARSMSGLPWIAAIAFFMQSLDATILNTALPAIAKSLNHHPLAMQPAIVSYTLTVAMLIPVSGWLADRFGTQRIFIYAVSLFSLGSLACALSSSFSFLVAARVIQGIGGAMMMPVARLALLRAYPRSELLPVLNFVTMPGLLGPILGPMLGGLLVTYATWHWIFIINIPIGLLGIIYAKKHMPNFTMPKCFFDFLGFMLFSVGLVMLSVSFDLFGNNTLPNYVPVAVMAGSIIMLSGYIFHAKRHPNPLIDLQLFQTRTFSVGITSNIATRLSTGSLSFLIPLMLQVGFGYSAVIAGIMMAPNAIGAILAKSFVTKLLTQFGYRNTLIWVTVIIGVMIAQFSLQTPEISLVFLIIPLFVLGMAMSTQFTSMNTITLGDLNNNNASAGNSLLAVTQQLSISLGVTVSAAILRFYESAEYGSTVDHFHYTFITIGVITLASSFVFLLLKKEDGRNLIKK

SEQ ID NO: 8934 - protein, 32 aa, Xenorhabdus bovienii
  Peptide sequence Name=Xb4151_4152.C439.gene189.pep
MITYWVFFSICFCSLNCMDVTCSFYLTHYTTV

SEQ ID NO: 8935 - protein, 114 aa, Xenorhabdus bovienii
  Peptide sequence Name=Xb4151_4152.C440.gene1.pep
  Homolog annotation: Query=1..114bp; Hit=38..152bp; Blast score=178; Percent Identity=74.0; E value=2e-44; Homolog= gi|37525023|ref|NP _928367.1| hypothetical protein [Photorhabdus luminescens subsp. laumondii TTO1] gi|36784449|emb|CAE13333.1
VINALNGPGDNPVYVRFDITVVGKEATSLVGRCQKAVDEDKKVLLGFTLSNPSTDIFTLKRGDHAGEQRVSLKARLIKVDWIKIGQEKVYQAEQSDSMPPQNGITQKEYAENSF

SEQ ID NO: 8936 - protein, 69 aa, Xenorhabdus bovienii
  Peptide sequence Name=Xb4151_4152.C440.gene2.pep
  Homolog annotation: Query=7..67bp; Hit=10..70bp; Blast score=68; Percent Identity=59.0; E value=3e-11; Homolog= gi|16763009|ref|NP _458626.1| hypothetical protein [Salmonella enterica subsp. enterica serovar Typhi] gi|29144496|ref|NP_807838.
MNAAPIGFLALQYCHKQLPLIVLRRRAGFYIGTMDEGIPCSRESVEYFARREQAEFALKQGQWTQRQSV

SEQ ID NO: 8937 - protein, 169 aa, Xenorhabdus bovienii
  Peptide sequence Name=Xb4151_4152.C440.gene3.pep
  Gene classification: Gene name=Ssb; Function=Single-stranded DNA -binding protein; Function class=L DNA replication, recombination and repair
  Homolog annotation: Query=1..169bp; Hit=1..171bp; Blast score=186; Percent Identity=53.0; E value=9e-48; Homolog= BU545 COG0629
MSSRGINKVILVGYLGQDPEIRYLPAGGTVAMLSMATSDNWRDKQTGEIREKTEWHRVVIFGKLADIAAEYLQKGAQVYIEGQLKTRKWQDNQGQDRYSTEVVVNVNGSMQMLGNRNEPKRMAPQQVENKPIQKQSSQPVSRERKEIPVVQTSVLPKKEEVDWNEEIPF

SEQ ID NO: 8938 - protein, 338 aa, Xenorhabdus bovienii
  Peptide sequence Name=Xb4151_4152.C440.gene4.pep
MTVYFVHGENMSHKTISPSKYVYIYHILCFYISISCLFFYIKSPAIPFIIWIGMIFITAIIVFHRKIGPLPKIKLKTKISSYTISIILSMLSSLFFLTSCFIFTFIENSSSQTDTIATFILFLLCLCISILTFTSNSINRKNDNFSSVLLTTFKIIWILLSYLFYSHSRNTVAEIFDISYESTLSKPTTIGLTIISIMIIYSIFIGLSPVLLMFFEKAKSFTRKKTKEIHYSSAPIAIPVLLSWFIIYILFNINIHKAINTIIDVTIPMETRSTFFCHEKYMILPEGNTTRYMSLENDEYRAFIKTENSWEVSKLKCQNKKPYYKLIPVKTIENINKN

SEQ ID NO: 8939 - protein, 155 aa, Xenorhabdus bovienii
  Peptide sequence Name=Xb4151_4152.C440.gene5.pep
  Homolog annotation: Query=1..153bp; Hit=62..204bp; Blast score=105; Percent Identity=41.0; E value=3e-22; Homolog= gi|10957016|ref|NP _046805.1| unknown [Pantoea citrea] gi|3169758|gb|AAC17959.1| unknown [Pantoea citrea]
MKLRKLDQAFYDDNTHLIQALDNEDGKWISGKTRGHGIVVVNINKLTFAIPLRTSIKHNAAYITQKSNQKGVKGKGLDYSKALLIINQKYISDEIFLIPAEQHKNIQGKEFFITRKFEKYVEKYIKAAKNRDRHVLNSLEYRFTTLQNYHNQLDV

SEQ ID NO: 8940 - protein, 94 aa, Xenorhabdus bovienii
  Peptide sequence Name=Xb4151_4152.C440.gene6.pep
  Gene classification: Gene name=Nlp; Function=Predicted transcriptional regulator; Function class=K Transcription
  Homolog annotation: Query=9..82bp; Hit=7..81bp; Blast score=89; Percent Identity=65.0; E value=5e-19; Homolog= sfsB COG3423
MTMTHTQKDWHPAEIICALRKRGTTLAAVSREAGLSSSTLANTLSRAWPKGEWIIANYLDVHPSEIWPSRYFDQYGQLIERTVRKTVSAESSDQ

SEQ ID NO: 8941 - protein, 178 aa, Xenorhabdus bovienii
  Peptide sequence Name=Xb4151_4152.C440.gene7.pep
  Homolog annotation: Query=57..170bp; Hit=8..122bp; Blast score=110; Percent Identity=53.0; E value=1e-23; Homolog= gi|32039772|ref|ZP _00138044.1| hypothetical protein [Pseudomonas aeruginosa UCBPP-PA14]
MRITVLMGVLVTILTGCNASSKQPSSQCAPEKAISTTQLTRNIQPVSPDIYQQTSEVVRHGRYTLVSTDPTAAQRDPLSQLIEVHIPASQHLTVADALRDVLRQSGYRLCTPEKTNDILYRQPLPSVHTQSGSVRLRTALQFMAGPAWQLEVDEVQRVVCHHLRPGYQLPQPRQGKQP

SEQ ID NO: 8942 - protein, 231 aa, Xenorhabdus bovienii
  Peptide sequence Name=Xb4151_4152.C440.gene8.pep
  Homolog annotation: Query=29..229bp; Hit=43..243bp; Blast score=239; Percent Identity=59.0; E value=3e-62; Homolog= gi|16763027|ref|NP _458644.1| putative exported protein [Salmonella enterica subsp. enterica serovar Typhi] gi|29144512|ref|N
MRLHQIGLVTWIVLISPTWAATPSPLTSQQAHTVESQKQTLRIQAGQWGLNADEYQRYQQLLNGPRGIQSPGLDPLTTLGIEAESEADRRRYAEQWVKAEFVRTEKELRFQREVDAAWQRLFPDVLPVNMAKSGEAKGRLALFVKINDCPPCDARLAEVLALMQPVDIYLVDSKGNDDTLRQWAKKHRIPVERVRNRQVTLNHDAGYWFRFGQGVMPVLLRQEEQGWHITL

SEQ ID NO: 8943 - protein, 180 aa, Xenorhabdus bovienii
  Peptide sequence Name=Xb4151_4152.C440.gene9.pep
  Homolog annotation: Query=1..178bp; Hit=1..177bp; Blast score=158; Percent Identity=47.0; E value=4e-38; Homolog= gi|37525055|ref|NP _928399.1| hypothetical protein [Photorhabdus luminescens subsp. laumondii TTO1] gi|36784481|emb|CAE13365.1|
MAYHVMIMKGLRVFPIIGMLWFNTCHAELNVIADLGGKDASPFYESINAEQRDEPVSSVQNSSPEMAGEAAMLPVKTPELTPGKVASRPLQLPGIGALFLIGDDPDSRQWLSQNAATLTKLHAVGLVVNVSEIAGLQSLRASAPGLLLSPAAGTELARRLQLQHYPVLITETQLSQQLSP

SEQ ID NO: 8944 - protein, 687 aa, Xenorhabdus bovienii
  Peptide sequence Name=Xb4151_4152.C440.gene10.pep
  Homolog annotation: Query=1..683bp; Hit=1..682bp; Blast score=966; Percent Identity=68.0; E value=0; Homolog= gi|16763031|ref|NP _458648.1| hypothetical protein [Salmonella enterica subsp. enterica serovar Typhi] gi|29144516|ref|NP_807858.1|
MSRRYVVEALLRPAVELNTALVSAVAAFVCIRAPWAIALAPSVSYVMAGGFTVLAMIRTWQGIQVIRYRRNLRRLPRYQMSTRHIPVSHRQLFLGRGFRWQQKHTQRLQDTRRPEVERFVQPSRIYQFARALERRTEYRWPTLSALLRQDSPFNPVRPLPPVGGNPAIHGIEPQEADVFMDLRERVGHTLVMGTTRVGKTRLAELLITQDIRRGEVVIVFDPKGDADLLRRIWAEAHRAGRGNELLLFHLGWPEISARYNAVGRFGRVSEVASRLAGQLSGEGNSAAFREFAWRFVNIVARALVALGHRPDYQLITRYVNNISELYQRYATRMMEERQPDLLAQINHSLSKLKEKDIPRNMQGQPDALRLWAMEMTLSSDAGKQLYDPILDGLRSAVRYDRTYFDKIVASLLPLLEKLTTGKIAELLSPDYLNMTDLRPIFDWEQVIRKNGIVYIGLDALSDSDVASAVGNSMFADLVSVAGQIYKYGMNAGLPVRHDGKLAINLHCDEFNELMGDEFIPLINKGGGAGMQVTAYTQTSSDIEARIGSPAKTAQVVGNFNTLMMLRVRDNRTAELLTSQLPEVEIYSKTLVSGHSDIADVEQGQDFTSSTQDRVGTVKTPLITPAEMINLPKGQAFALLEGGQLWKIRMPLPTGDEDDALMPASLQHIAEQMRRHYRTSENWWEEKG

SEQ ID NO: 8945 - protein, 252 aa, Xenorhabdus bovienii
  Peptide sequence Name=Xb4151_4152.C440.gene11.pep
  Homolog annotation: Query=4..252bp; Hit=2..250bp; Blast score=243; Percent Identity=54.0; E value=2e-63; Homolog= gi|37525057|ref|NP _928401.1| hypothetical protein [Photorhabdus luminescens subsp. laumondii TTO1] gi|36784483|emb|CAE13369.1|
MAQSENQSRPSSQPPRKHGLLYRLLWECPWQLIGFVVMSWLFSLLLEYLGMAFFWPEQGAAHSQTMMKAELNYLSSEFTRSLLLTEPSQTVLAWLAQVYQWLFVDSGFMNWVQGQRQYQLHNNNDFMREFNTVLHGISAHLQEYWLATVFITMVTLIRLGILLLSVPLFVMVVLVALVDGLGRRDLRRYGAGYESSFVYHHAKRGIKPACTVPCVLYLSWPEVVYPTVILLPAAIVLGIAIVITTSMFKKYI

SEQ ID NO: 8946 - protein, 230 aa, Xenorhabdus bovienii
  Peptide sequence Name=Xb4151_4152.C440.gene12.pep
MLRIDLNVPDDEYEQARKLGAHWDAAAQIWYIDNSVDPTPFMNWLPFYNVHAEYWYLAQTRTTCPHCHEHTTVTAFMLPAGHQLLEADNGDEPGTEVDYTEQDSPAFLFYIADIPSLVRSVLPGFHHTLRKAVSQRLRRQHWINHCEHCGAQQDDTELFAEVGGAFFPAAKEQAAAIQLHRIDQPFVGYCEDISHHHYHFDPKQDNRICKACDGFEWMTQVVNVPSTYRH

SEQ ID NO: 8947 - protein, 115 aa, Xenorhabdus bovienii
  Peptide sequence Name=Xb4151_4152.C440.gene13.pep
  Homolog annotation: Query=29..114bp; Hit=7..90bp; Blast score=70; Percent Identity=48.0; E value=4e-12; Homolog= gi|16763033|ref|NP _458650.1| hypothetical protein [Salmonella enterica subsp. enterica serovar Typhi] gi|29144518|ref|NP_807860
MMRCVLMRGDFSLSRSVCLLGLTVLCMPLAQAAEKDELASAKNLIEQVQMALERANLAEKQADTPTRPRYDFDYLRIKADLNTIKAGIDHYLTPSRARQQASGTLSGHYRQEHPQ

SEQ ID NO: 8948 - protein, 78 aa, Xenorhabdus bovienii
  Peptide sequence Name=Xb4151_4152.C440.gene14.pep
  Homolog annotation: Query=1..78bp; Hit=1..78bp; Blast score=79; Percent Identity=56.0; E value=1e-14; Homolog= gi|37525060|ref|NP _928404.1| hypothetical protein [Photorhabdus luminescens subsp. laumondii TTO1] gi|36784486|emb|CAE13374.1| un
MTEAQRTAFTVASGHFDITFLYLVCVGFFLATLFLWAAWAAVDVWHGWANEKIRNQTISQFALRTALLLVVAVWMFAS

SEQ ID NO: 8949 - protein, 117 aa, Xenorhabdus bovienii
  Peptide sequence Name=Xb4151_4152.C440.gene15.pep
MKKYVTRPSASLPCEPPSYWWSRSGCLPADATNIMNKEWIEHEANFYRLPSYQYAPDNQNKYLSFAVGSFLSISPGRFAGYRTAKKWRRGRITGTGERLCAGWHCDWRADPFGRRVL

SEQ ID NO: 8950 - protein, 138 aa, Xenorhabdus bovienii
  Peptide sequence Name=Xb4151_4152.C440.gene16.pep
MNSIPVGIMTQPANGIKGRLTISPNTSPSKAASPISGVVNPRNTIGSAFKRSGRKGIVCINCTLKNNAGRFRQQPNHRNQQHHTDYDDRTELCPGGFAVPHFGEGFNRRRRDLKERDGRKDQPANHNAILRIAFHLSQ

SEQ ID NO: 8951 - protein, 124 aa, Xenorhabdus bovienii
  Peptide sequence Name=Xb4151_4152.C440.gene17.pep
  Homolog annotation: Query=1..123bp; Hit=2..125bp; Blast score=127; Percent Identity=60.0; E value=3e-29; Homolog= gi|37525062|ref|NP _928406.1| hypothetical protein [Photorhabdus luminescens subsp. laumondii TTO1] gi|36784488|emb|CAE13376.1|
MQTIPFLPDRLNAEPIVFRGFTTPEMGLAALLGLVFGLMVSLPFIPLAGWVMIPTGMLFMPLLLISFGGRWLAQLKRGKPENYLWLTLEEKKRRLGIGDQALIIAAQGWSLRRSRLTHRNGSLR

SEQ ID NO: 8952 - protein, 218 aa, Xenorhabdus bovienii
  Peptide sequence Name=Xb4151_4152.C440.gene18.pep
  Homolog annotation: Query=1..217bp; Hit=1..217bp; Blast score=320; Percent Identity=72.0; E value=1e-86; Homolog= gi|16763036|ref|NP _458653.1| possible exported protein [Salmonella enterica subsp. enterica serovar Typhi] gi|29144521|ref|NP_
MSRFRHALKNRDQHILTLRLACGVLVLVLLITLTGWMASPRNLTIHNPPDLRSGSTRPWWEVPAPSVYSFAFYLFQQLNAWPKNGAQDYPAKIAALSSYLTLACQDFLQADAKTRADSGELLDRVRVVYEIPGRGYGAKSVTVRNRDNWVVRLDLVADEYYHAEPVKRALVRYPLKVVRWEGDAERNPFGLALDCYDGMPQRLEAMPQPLEEKKGVFQ

SEQ ID NO: 8953 - protein, 278 aa, Xenorhabdus bovienii
  Peptide sequence Name=Xb4151_4152.C440.gene19.pep
  Homolog annotation: Query=8..277bp; Hit=9..298bp; Blast score=288; Percent Identity=56.0; E value=9e-77; Homolog= gi|16763037|ref|NP _458654.1| hypothetical protein [Salmonella enterica subsp. enterica serovar Typhi] gi|29144522|ref|NP_80786
MKRHPSCFSACFWPGLVSLLLFSLGAKADELMKWERIPLPVTLKVCQERIIFADRNVRVGLSPSLSDKLRVQSAGGAVYLKASHAFSPTRLQLQDSENGEIILLDITATKTGSTEPVRILYPDEKSSAPKEGAQLQRKSVPSAPVPVVLTRYAAQQLYAPLRTVEPVTGIHPVSLHLPVSITTLYPSEPIAVSPLAGWGVQNYAVVALKLRNTVKRNITLDPRALQGKFVSATFQHRWLGEAGTPEDTTVLYLVTTGQPENAFLPEPIAVKPGGRDAG

SEQ ID NO: 8954 - protein, 476 aa, Xenorhabdus bovienii
  Peptide sequence Name=Xb4151_4152.C440.gene20.pep
  Homolog annotation: Query=1..463bp; Hit=1..481bp; Blast score=475; Percent Identity=53.0; E value=1e-133; Homolog= gi|37525064|ref|NP _928408.1| hypothetical protein [Photorhabdus luminescens subsp. laumondii TTO1] gi|36784490|emb|CAE13378.1
MQVKSNSLVKILVPVVLMVGGFIGIKSCSSTDTAPPATPQNNALATLSPEELQALGVGGDTPEDTLRTLVGTLNKVRSEQQRLGQQNADILKENDQLKNQRQDVAGQIDAAVAAIRQDDEQRRRELQDEQQGLLAQIDLLTERLNSAPLSAPDSPIPPGSGSIPYSANAGTGQNELIWIAPADEKPADIQTPGSGKATAQFPTSFLSEQSAAGQNKPQSPSLQNPSKEENEKPVYTLPENATLVGSQAMTALLGRVPVNGTVTDPYPFKILIGKDNLTANGIELPEVEGAVVSGSASGDWTLSCVRGQVNSITVVFQDGTVRTLPGSGQNNNTSANGIGWLSDENGIPCISGERKSNAATYLPTLFALSAMNSAGDALSESQRTAQTSGTGGITTALTGNAGQAALGKAMSGGMNDLSEWLRQRYSQTFDAVYVPPGARLVVHITQRLAIDYEVKGRKVRYGVSETAERDNQEALD

SEQ ID NO: 8955 - protein, 118 aa, Xenorhabdus bovienii
  Peptide sequence Name=Xb4151_4152.C440.gene21.pep
MEKIPSQWIFSAGSPYCLQVPVTSLAEPTRVQLYWRAVRKKECRLYLSTDRECQPLSDGDFTVFRLTETQWQAVVDGKISMAPEQWVPLPFTLSELAVHPEFATFTVLGTPEAAVCGK

SEQ ID NO: 8956 - protein, 133 aa, Xenorhabdus bovienii
  Peptide sequence Name=Xb4151_4152.C440.gene22.pep
  Homolog annotation: Query=16..133bp; Hit=29..147bp; Blast score=152; Percent Identity=63.0; E value=1e-36; Homolog= gi|16763039|ref|NP _458656.1| putative lipoprotein [Salmonella enterica subsp. enterica serovar Typhi] gi|29144524|ref|NP_807
MRKIKYYWLLGLAGLLVGCTTSKDALLPAGKQTVLAMWQGNKAGHATESARETLRRSLTVSERLRALEEPYHYSRSAAQEISQQFPRLPNPDMVMYIFPHLVAGNTPIPGYSTVFPFYSQVQYALPGERTEAL

SEQ ID NO: 8957 - protein, 921 aa, Xenorhabdus bovienii
  Peptide sequence Name=Xb4151_4152.C440.gene23.pep
  Homolog annotation: Query=7..914bp; Hit=40..939bp; Blast score=1355; Percent Identity=72.0; E value=0; Homolog= gi|37525066|ref|NP _928410.1| hypothetical protein [Photorhabdus luminescens subsp. laumondii TTO1] gi|36784492|emb|CAE13380.1| u
MEKLKALNRPGKLREADEAAIYQANPSIIDYLPWVEYLEKEQCLLLDDGISVGAVYQIESIATEGRPAERLTEIRDQLEDAIQDSLEEDDISPWVVQFFCQDDDDPADYLNTLRGYVKPWAQGTLFTDAFLTESEYHLNSIARPDGIFQDSLITGQPWRGQQRQTRMVVYRWLPPTRKSRHDSQTLSAVAALNQVCERLVSSLASAGVIARRQHGGQIHRWLLRHFNPAPDWGMAKADFYRTVSYEAPIQSDLPVSNDFAESLWFTPPVSDPDAGVWWFDGLPHKAVLVERLRRPPEPGTLTGEVKRGDNINALMDMMPAGTVVSLTIVAQAQDRLEEDFTRLTKNAVGENTESLRVRQDVQEVKELLGRRHKLYRSALAFLVRGKDLDDINHRVHQLSSTLLTAGLQPVRPEFSVSPLNAYLRALPMCFNPQKDKKHGYSRLTWVQHLAGLLPVTGRSTGTGHPGFSFFNRGGAPLTFDPMNKQDRTQNAHLLLFGPTGAGKSATLCAALIQLMAIHRPRLFIVEAGNSFGLLADYYESLGLTVNKIGIRPGCGVSLALFADAHQLLQLSPRQLRINEADIPDTDEQQEDEGDEQRDILGEMEIAARLMITGGEKREEERLTRSDRGLIREAIMMAAQTSFNEKRQMVASDLQNALYAIARNHRQDEHGQPLITAHRRARADEMASAMSMFTQGFEGELFNRPGTPWPEVDVTLIDLGTLARENYSAQMALAMVSLINKVNNLAERDQYQDRELQLVIDEGHITTTNPLLSPYMTKVVKMWRKLGAWLWLATQNLADYPDTAEKMLNMAEWWLCLTMPPDEVEQIARFKKLTEEQKAVLLSASKLPRCYTEGVVLAKKIEALFRVVPPSLYLALGMTEKEEKAERRALMREHQCSELEAAVLVARKMDIARGLKVDSGSV

SEQ ID NO: 8958 - protein, 32 aa, Xenorhabdus bovienii
  Peptide sequence Name=Xb4151_4152.C440.gene24.pep
MYLMPSFFTTLFREPLKTLNTKNKVNVALINK

SEQ ID NO: 8959 - protein, 63 aa, Xenorhabdus bovienii
  Peptide sequence Name=Xb4151_4152.C440.gene25.pep
MTLLCMTFSCFFRGKNKLIAFSSHTEIKRHEGRIFQNKPNVANHNKWPSESSQNWLAAGLPFG

SEQ ID NO: 8960 - protein, 96 aa, Xenorhabdus bovienii
  Peptide sequence Name=Xb4151_4152.C440.gene26.pep
MNQRYVLPVPGFSLFSYFVFSDRLIMVSFVTLFSEYEHDSPVPSVRVHASGWHTLYPHKCPGLYLTVPKRLQKTGYHMRRRFLSRCCESLYILYRH

SEQ ID NO: 8961 - protein, 101 aa, Xenorhabdus bovienii
  Peptide sequence Name=Xb4151_4152.C440.gene27.pep
  Homolog annotation: Query=3..65bp; Hit=49..111bp; Blast score=72; Percent Identity=50.0; E value=1e-12; Homolog= gi|18150915|ref|NP _542852.1| putative IS1246 transposase [Pseudomonas putida] gi|18077156|emb|CAC86792.1| putative IS1246 trans
LVFRKTDGQEGARALFEEAKHQLSAQGFIPRGGQLIDATLIPVPKQHNKKEENEQIRQGKTPDNWTKKNDARKIPRQPGRKSTVKVILAINLPLMSIQNIK

SEQ ID NO: 8962 - protein, 126 aa, Xenorhabdus bovienii
  Peptide sequence Name=Xb4151_4152.C440.gene28.pep
MPWPLPAHPFFEIPNRVTVWNINDIGQATKTLPAHSVKQLIFHLFIRKIMEMFQDNDANHHLSREWRASAFGRNNPWRDTVYVCQPVPRNQHIYQEQAADHLIHRFFDGDIRMPACLFLKQNEAVS

SEQ ID NO: 8963 - protein, 154 aa, Xenorhabdus bovienii
  Peptide sequence Name=Xb4151_4152.C440.gene29.pep
  Homolog annotation: Query=33..83bp; Hit=67..130bp; Blast score=92; Percent Identity=71.0; E value=3e-18; Homolog= gi|18957979|gb|AAL79614.1| putative transposase [Xenorhabdus nematophila]
MCCVYILLNFVAVKSFWRFPVVAKFNILNTQPEFEDSHGRTVRRRGWVLPLTPETKHLGSWPDIQALLVTSYFRYYLSCCQDSPAFQLAGIRKHWAIENSLHWGLDVTFREDDSRMREQIATRIFAQLRKMALNIVKRDTNSKLSLSARRKSAG

SEQ ID NO: 8964 - protein, 47 aa, Xenorhabdus bovienii
  Peptide sequence Name=Xb4151_4152.C440.gene30.pep
MEISFFIILITIYDSYPYKIKFSNNYLSIFRGFCRIKVRSGNMVLLH

SEQ ID NO: 8965 - protein, 37 aa, Xenorhabdus bovienii
  Peptide sequence Name=Xb4151_4152.C440.gene31.pep
MPAYALSLRNLEEMRAERGIEVNHDTVLIILFNEREG

SEQ ID NO: 8966 - protein, 264 aa, Xenorhabdus bovienii
  Peptide sequence Name=Xb4151_4152.C440.gene32.pep
  Gene classification: Gene name=SmtA; Function=SAM-dependent methyltransferases; Function class=Q Secondary metabolites biosynthesis, transport and catabolism
  Homolog annotation: Query=29..226bp; Hit=18..222bp; Blast score=65; Percent Identity=27.0; E value=8e-11; Homolog= PM1194 COG0500
MRSAPSSDSLSAREKQANLPKFNPATFDKYAELYERMTSWPYRQELELPTLAKLLGDLSSLNVLDFGCGPGVISRWLNERGAKRIVGYDISEGMLNYARRREEKDQRGIHYISKINEDYNVYFDIVLAVYVMPYAANYADLMAMSQTMVRVLKPGGRLLTLPIHPDFNSDPEYYRPFGFRLIEEQPRTDGSALRLHICQPPYDINIQAYYWSRPTLENTLQQVGFQTVNWKSLNVPVNTLIPNLSSYVQCPHAAILECIRGDAC

SEQ ID NO: 8967 - protein, 387 aa, Xenorhabdus bovienii
  Peptide sequence Name=Xb4151_4152.C440.gene33.pep
MYQGGCMLINVGQSAFSPLVSDIEYIDRHEWDALVSDNDFFHSHGWLGGLDYALGKGDVFTLYGNAGLLGGCALWGGEDQSGLFYLPDYFPGLDGPWQYPFLWGGARRSTHNEIPCVQGSCRGETLSTMAEMLAQLAGTRGYYATIMPFMPLHQALEVARYYPHARVLMHSGEATLSVPAGGLDSQLQQLCSHHRVRANAELAAFARLGNRVEWCRLDDYLLEAAAELIANNRGKYGSHQGIDWMQRIFDGQKKSSVINTAVAAVAKRDEQILGVTIFYRFGETLHARYYGSNYQIDDNDFRYFVLNYYSSLDYAAKNGIRECRLSISALRAKTRRGAKIEPLAALLLFENAVPLSISECEDYNRLFYQHYQQQFGTHLTHDWALLD

SEQ ID NO: 8968 - protein, 114 aa, Xenorhabdus bovienii
  Peptide sequence Name=Xb4151_4152.C440.gene34.pep
MLHLMYLLKPTQKAHLDMTAFWHWVEKRDEWFYRTLEMTGERRWYVRTIGDNVHCLEHYVTFADEAAWGQYRRAVSKLCKDPEWEKIRTEQSLWWEILDSSLLNDAPFIVNPRR

SEQ ID NO: 8969 - protein, 182 aa, Xenorhabdus bovienii
  Peptide sequence Name=Xb4151_4152.C440.gene35.pep
MNLIQRSLYLLNNARFFTLASRHADNMPWAATVNYVPLFEPLRLVWYSMRIARHSENIFYHAEVSGSLFCHDMQATAPPGLDGAQFTGCAREIPQCECECIHQDYYRLNFPEARERARWQLPLHEFYGDGARRFYELRINDWWLLDIDGWLKTKEDRRVPVPLAQLIVPKQDNESILPSVTQ

SEQ ID NO: 8970 - protein, 63 aa, Xenorhabdus bovienii
  Peptide sequence Name=Xb4151_4152.C440.gene36.pep
LANGKWLCLFFNEPTPYSSSFAKKALAFFKIAFSIFNCLFSLRSSNNSCRSSEIKEPGLDFST

SEQ ID NO: 8971 - protein, 68 aa, Xenorhabdus bovienii
  Peptide sequence Name=Xb4151_4152.C440.gene37.pep
  Homolog annotation: Query=1..68bp; Hit=45..112bp; Blast score=94; Percent Identity=66.0; E value=4e-19; Homolog= gi|21233682|ref|NP _639980.1| transposase [Proteus vulgaris] gi|21202866|dbj|BAB93582.1| transposase [Proteus vulgaris]
MLAEKLRKEGLTLSDYRTRKLMKQFGLYVRQRKNYRAPRKGKAISTACNLLNRNFNPLAPNEVWTGEI

SEQ ID NO: 8972 - protein, 54 aa, Xenorhabdus bovienii
  Peptide sequence Name=Xb4151_4152.C440.gene38.pep
VSYLSPLTYPIPLSGEKTNPSLSPDVTNPQGSLNRLYLSRPNFIRRQRIKVPVE

SEQ ID NO: 8973 - protein, 79 aa, Xenorhabdus bovienii
  Peptide sequence Name=Xb4151_4152.C440.gene39.pep
  Homolog annotation: Query=1..76bp; Hit=190..265bp; Blast score=128; Percent Identity=76.0; E value=2e-29; Homolog= gi|21233682|ref|NP _639980.1| transposase [Proteus vulgaris] gi|21202866|dbj|BAB93582.1| transposase [Proteus vulgaris]
MRTDQGDVGVCWDNAVIERFFGSLKHDWLFKTHNENPSEMKKDVLDYLHYYNLTRLHTANNYLTPVEYEMTFKKVSGFS

SEQ ID NO: 8974 - protein, 157 aa, Xenorhabdus bovienii
  Peptide sequence Name=Xb4151_4152.C440.gene40.pep
  Homolog annotation: Query=1..156bp; Hit=2..157bp; Blast score=206; Percent Identity=62.0; E value=1e-52; Homolog= gi|16122508|ref|NP _405821.1| hypothetical protein [Yersinia pestis] gi|22126003|ref|NP _669426.1| hypothetical [Yersinia pestis
MRDHQSNRGKKKLYRRVNTTTHHVYHHGGEYRWERTKQKLIREDMPHFLPMKSKHRRGLDYTPLFMFLLSKVGEQWDVIYSEAIQRLDRVDPVFWIVALHENDQRDYIRCGESSYYNGLFVDKSGFLRKVNPHLSAKDIPVLCQCCTHTFNGVQISR

SEQ ID NO: 8975 - protein, 1085 aa, Xenorhabdus bovienii
  Peptide sequence Name=Xb4151_4152.C440.gene41.pep
  Homolog annotation: Query=38..896bp; Hit=90..995bp; Blast score=342; Percent Identity=31.0; E value=3e-92; Homolog= gi|15804908|ref|NP _290949.1| putative invasin [Escherichia coli O157:H7 EDL933] gi|25500391|pir||G86131 probable invasin Z59
MPVHPKSHFFLLSKAKSFVTSLLCLSLSLNGYADSEPNNRNDTTIQLAEITSQWGQLTRSHSSGEAAKTLAAQQFSSAVTSTLTPWLNQYGNARFTLPFDSRFSLKGISFDWLLPWYNVTSSTAFSQFGVKTDHRQTTTSVGFGYRYLTDNWLWGANAFWDALWPEQYHRYGIGTEAWHDNVKLSANLYQRLSGWKTSRQVSDYDARPANGWDIRVEGGLPALPHWGGQVMFEQYYGQQVGLFGDNKRQHNPYSLTAGLTYTPVPLVTLGADVRQGKQDHRDNRFTLALNYQLGVPLAQQLDPNAVAPLRSLTFRRTDFVNRNHNMVLDYRKQTLITLDFPAQLKGDAGKIITFTPRITSKYLLARLELRADELQQAGGRIVHQTPDKIMLLLPKAIDKVIRLSGIAIDKHGNRSRPSETTLFIQPTEIHVQVTANRAQARADGQDSVMYTVMVKDRDGKPVPDQTVSWSSDKGKLSQTTQKTDAQGLAAVLLSSHHHGEHSVQVSVGDNVTVALPVHFSAVLKPVITTDKTQARADGKDAVTFTVTVKDAAGIPVPHQSVKWQTSRGKFLTLPSTTNKHGQATAALVSLPSGIAEVSVMAGEETFTASPVEFLPALTHTLTCDKSTAIADGQDSALCTIDVRDAADQPMVGREIVWSTDHGQIGDEQVITDSRGKARARVISRKAGVARVRADMSGTIITAGGVTFERQLKSVIIADKTHANGNGQEAIVLTAIVEDILGLPVENQAVIWHTDNGILSSAETRTDSQGLTQIQLTSTVAGAHRVWIQVDDKTVTAPTLWFDDVLTSTLRADKTRMIANGQDSVILTVTVKNLTGQPAVGIPVWWRSDNGHFTDAQIETDENGEARATLRSQKAGTASVTTIIDDQEVISPTVEFIPLLRIADTVAVDSQGGNANQKAFGTRGPSVFWRGAKFRIIIADNTGRVNWQSDSPAVTVSGDTVVVQQRPDGVRLTGTDEAEQQVVLTLTSDTWFERSGITKDFYFNATQICQSLGSQIAPKYALERLYEEWGNFYHYEGWVREFYVVSTDYLSASSGSMDAQTKWAFWAESDSWMRNAWHRLAFACGS

SEQ ID NO: 8976 - protein, 39 aa, Xenorhabdus bovienii
  Peptide sequence Name=Xb4151_4152.C440.gene42.pep
MPGIGWRLRVEAKAVLCLRDFAKLIHDVAPFFCQRIDSV

SEQ ID NO: 8977 - protein, 40 aa, Xenorhabdus bovienii
  Peptide sequence Name=Xb4151_4152.C440.gene43.pep
MAESIWQVEYAMSLVWSFYSNRPNQKINILLTLYHMSFSS

SEQ ID NO: 8978 - protein, 263 aa, Xenorhabdus bovienii
  Peptide sequence Name=Xb4151_4152.C440.gene44.pep
MRNSIQNEITFPEGWFLFINGEIPFYCDHGCTVADFAAARNLIGYNKKNGIYFKFAYESSEIRGYEPPPGTYVLTIRKYNYTHNSGYFGRCVYAEVKQTQCPEEFKNIMTDMLNMSAEQFTFEEVKRPKPQGKCTPQLQQCINDFFTGVKQDRTDEIMALIRSPMDENEEENILYLRKLYYGHYESPYQRDDLVKSEIHKTVVSEIYNYFESLDKTRKLENGRDLFPFLFSPKKYDISTIVPKNVSLCEVFMNMIHIQDEKLM

SEQ ID NO: 8979 - protein, 92 aa, Xenorhabdus bovienii; identical to SEQ ID NO: 6203
  Peptide sequence Name=Xb4151_4152.C440.gene45.pep

SEQ ID NO: 8980 - protein, 96 aa, Xenorhabdus bovienii; identical to SEQ ID NO: 5468
  Peptide sequence Name=Xb4151_4152.C440.gene46.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 8981 - protein, 30 aa, Xenorhabdus bovienii
  Peptide sequence Name=Xb4151_4152.C440.gene47.pep
MTKKTHSLDLAYTSSRKSKMICLGALCDDN

SEQ ID NO: 8982 - protein, 219 aa, Xenorhabdus bovienii
  Peptide sequence Name=Xb4151_4152.C440.gene48.pep
  Homolog annotation: Query=1..219bp; Hit=16..235bp; Blast score=226; Percent Identity=53.0; E value=3e-58; Homolog= gi|37524359|ref|NP _927703.1| hypothetical protein [Photorhabdus luminescens subsp. laumondii TTO1] gi|36783783|emb|CAE12641.1
MNYYVLMNDYKSSLIPRYLHALVDTKKQVNENWDYEGSDYSFPYYMKELECPNSLFLLCNRNVGALNFNYYFHGSGHIASNKFIDFFNELKTCEIISKNLIATSIKDGSVIRDDLNYLYFIGNDDFLDLNNSELEEDRSGSLMPHKLIINNPSNIDVFTIRSTLLADFLIFSESAVEKFLKMKISGVKIVPLDEAFKNYCLDYGYDIGSSRKRVKRKLP

SEQ ID NO: 8983 - protein, 90 aa, Xenorhabdus bovienii
  Peptide sequence Name=Xb4151_4152.C440.gene49.pep
MNSVENGIHIPGSKKAMQDDVGKGMKVFHSSNHNTYSGEVRQSIEEIKRRHDAGNLSDRQARDEIRKLQMKMKNKIWSGDVPSNPCKRLN

SEQ ID NO: 8984 - protein, 96 aa, Xenorhabdus bovienii; identical to SEQ ID NO: 5468
  Peptide sequence Name=Xb4151_4152.C440.gene50.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 8985 - protein, 92 aa, Xenorhabdus bovienii; identical to SEQ ID NO: 6203
  Peptide sequence Name=Xb4151_4152.C440.gene51.pep

SEQ ID NO: 8986 - protein, 62 aa, Xenorhabdus bovienii
  Peptide sequence Name=Xb4151_4152.C440.gene52.pep
  Gene classification: Function=Transposase; Function class=L DNA replication, recombination and repair
  Homolog annotation: Query=6..62bp; Hit=35..91bp; Blast score=66; Percent Identity=49.0; E value=7e-12; Homolog= insA_g5 COG3677
MTPKGCQRTFQLNYRYNGHKPGMKEKIVDMAMNGSGVRDTGRVLGLGINTVMRTLKNSRQNK

SEQ ID NO: 8987 - protein, 327 aa, Xenorhabdus bovienii
  Peptide sequence Name=Xb4151_4152.C440.gene53.pep
  Gene classification: Gene name=Qor; Function=NADPH; Function class=C Energy production and conversion
  Homolog annotation: Query=1..327bp; Hit=1..327bp; Blast score=461; Percent Identity=70.0; E value=1e-130; Homolog= qor COG0604
MVKHIEFSTSGDPEVIQYCEFTPTAPAPDEVQVQNKAIGINYIDTYMRSGLYPTANLPSGLGTEAAGIVTKIGSGVTSIKVGDRVAYAQATLGAYSEVHNVLESKLVVLPDAISFEQAAASLLKGLTVYYLFYKTHKIQAGETFLFHAAAGGVGLIACQWAKALSAKLIGTVGSDEKAALAKASGAWQTINYNRENIVERVTEITGGEKVGVVYDSVGKATWLNSLDCLKRQGLMVSFGNASGPVTGIDLGILNQKGSLFVTRPAINGYITTREELNEASKALFDLIASGKINVDVAENQKFPLSEAAKAHRTLESRVTHGSSLLIP

SEQ ID NO: 8988 - protein, 345 aa, Xenorhabdus bovienii
  Peptide sequence Name=Xb4151_4152.C440.gene54.pep
  Gene classification: Function=Predicted TIM-barrel enzymes, possibly dehydrogenases, nifR3 family; Function class=R General function prediction only
  Homolog annotation: Query=1..344bp; Hit=1..344bp; Blast score=561; Percent Identity=75.0; E value=1e-160; Homolog= yjbN COG0042
MHENTHIQKHSEFTAISTSAGKFKSSRFSVAPMLDWTDRHCRYFHRLLSKEALLYTEMVTTGAIIHGKGNYLTYNEEEHPLALQLGGSEPQALAQCAKIAQERGYDEINLNVGCPSDRVQNGRFGACLMGEAKLVADGIKAMQDVVDIPVTVKTRIGIDEQDSYEFLCDFIDTVVKNSDCDNFIIHARKAWLSGLSPKENREIPPLDYPRVYQLKKDFPQLTLSINGGIKSLEEAKQHLQYVDGVMIGREAYQNPSILAHVDRELFNETALVVNTINAIKALYPYIERELSKGTYLGHITRHILGIFQGIPGARQWRRHLSENAHKAGADIMVVEKALEMVTERM

SEQ ID NO: 8989 - protein, 369 aa, Xenorhabdus bovienii
  Peptide sequence Name=Xb4151_4152.C440.gene55.pep
  Gene classification: Gene name=XerC; Function=Integrase; Function class=L DNA replication, recombination and repair
  Homolog annotation: Query=29..342bp; Hit=17..318bp; Blast score=87; Percent Identity=26.0; E value=2e-17; Homolog= HI1572 COG0582
MAYYSIEKRPRADGTTRYRCTVGVKSGGKYIYRENRTFGKQSHAKTWGAMRVAELEQNGVPTQNDTEELTVGELLYKYINDPNLGVKAGRTKKYVLNMLLDSDLAKLTLTELSVSHIIEYCKQRHSTGITPSTINHDVSYLTSVLKSAKPIYNIDYVSNPAYEARPLLIQMGLIGKSQRRSRRPVQDEIDNLIEGLRKRSSHREGKIPYEDILNFSILSCMRIGEVCKIRWDDIDEKQRSVIVRDRKDPRKKTGNHMSVPLLGNAWEIVQRQPKTSEWIFPYNSKSVTVGFQCVRNALGIQDLRYHDLRREGASRLFEAGFSIEEVAQVTGHRSLNVLWQVYTELYPQSLHDKFNRLMQQKENDSTSTI

SEQ ID NO: 8990 - protein, 56 aa, Xenorhabdus bovienii
  Peptide sequence Name=Xb4151_4152.C440.gene56.pep
MIPPRPSKEKREIVELRERSYCHYRAEICPLAYGVSAQTKGIEEIPIPSPVSIKPK

SEQ ID NO: 8991 - protein, 285 aa, Xenorhabdus bovienii
  Peptide sequence Name=Xb4151_4152.C440.gene57.pep
  Homolog annotation: Query=17..285bp; Hit=142..375bp; Blast score=189; Percent Identity=43.0; E value=4e-47; Homolog= Pa|Phot4-254a01.q1k _g20| 20305 - 21432 664 375 aa, chain -
MQDKKPDVPVSEDSNLVIVTTPEYVKDSIKEAIAAHATSRNHPYATQAEPGFVTLNNEVNSDSELTVATSKAVKTAYDLANTANQNTKSANESADNANDNANTRLAKDQNGADIPNKEEFVKNLGLEPRMEGLALPVGVPVPWPTESPPEGWLICNGDSFDKVRYPKLAIAYPSGKLPDLRSEFIRGADAGRGIDPTINVLSAKPSQIQSHTHDYRDRYYSENSGSIDGATNWEWQPDGYNNSLGSGRTDNDNNTFLYYNGTTSSTGGTETHPRYIAFLYIVRAA

SEQ ID NO: 8992 - protein, 63 aa, Xenorhabdus bovienii
  Peptide sequence Name=Xb4151_4152.C440.gene58.pep
MHIQLIPTRTFLRVYCHASAFHLKSHTKPTHQFTAHNFPNPPNYPLISPIGYLLTADVTPYSC

SEQ ID NO: 8993 - protein, 499 aa, Xenorhabdus bovienii
  Peptide sequence Name=Xb4151_4152.C440.gene59.pep
  Homolog annotation: Query=72..491bp; Hit=59..418bp; Blast score=198; Percent Identity=33.0; E value=2e-49; Homolog= Pa|Phot3-163e06.p1k _g25| 30856 - 32115 701 419 aa, chain -
MIYSDGTTNIVSGSAIVRGTGTQWKSNINGIAAGQIISIQSGNTVIQNVIRSVNSDTELVLAFAPSVNLDNANYVISTTVPDTVSDGVRHICAINAYIILFLQNMDRWMSESGKVEVEMPNGQKVTLDSIRALQTAVEGKLVKEQNGADIPNKPEFVKNLGLAGTLKVGDFGVGATPSTAKTFTDANTLAEAGWYAGGGSSAKNFWNEYAPIMAMTRGGGMDNTGMIAQIQVDDTGLASRYRSGNQWTKWKSYVSATSEYLSGFNKIKTIGFFNSNANSSVSWTDSYTQIAVSLFSDDEFNIIIGGDLGSVPLYYRRRRYGKWDDKIEFITTKNTTFDGSGYLKKASPIIQIYPDGTFTTNDESEGATVTRLGLGHYKLSGILGYNSDGAWGVHGGISVPRDVNGNELVYVDDKVLPDGAIEIKVTHRQNAHMPARLQNRRMKSVDEPAYYTDDEPCDLPAGTRLDVRVQMPEDSIWNQKQVLASDPQQEYGVTSAVNK

SEQ ID NO: 8994 - protein, 220 aa, Xenorhabdus bovienii
  Peptide sequence Name=Xb4151_4152.C440.gene60.pep
MDWGAFLTTGNGVPWWTPKTTPLSFVRKESVWTDRYVKRIETGISTKQPCMAFMCAHTSNVWYAPYGVMFGGGSEWGIEITRGESGTETSILCEIYLFTLVYPQPVPDWGIAVWDEAGKCVITSDTRPLSIEGELSSHSSKETVVQGKKGILMQKTGWILSKYDTPDDTRTRDNETSFSTAFDGHNTRLMARVADGETNWIISERTWNLTSPYIDCTLYD

SEQ ID NO: 8995 - protein, 114 aa, Xenorhabdus bovienii
  Peptide sequence Name=Xb4151_4152.C440.gene61.pep
MHPNPYITSRSVVSNQPSLNGVVVAIRNDDLIILYQKLTFFIYLVSPVSTKKDIRKPQSFIHRLPGDSERTCRLPALQLHKASIKKGANAGITLPPLFIPDPKPVITHRRNCPI

SEQ ID NO: 8996 - protein, 1061 aa, Xenorhabdus bovienii
  Peptide sequence Name=Xb4151_4152.C440.gene62.pep
  Homolog annotation: Query=1..1037bp; Hit=1..1037bp; Blast score=1238; Percent Identity=59.0; E value=0; Homolog= gi|16122366|ref|NP _405679.1| putative phage host specificity protein [Yersinia pestis] gi|22126075|ref|NP_669498.1| putative ph
MANHLIQGSKGGGESPRTPVESPDSLQSTSYAKILLALGEGEFAGGLDGTNIFVDNTPIIGPDGQANFTGLKWEFRPGTPHQDYIKGMPAVENDITVGTELVESWVRSVTNTQLSAVRIRLLWGPLQEQKEDNGDTVGYVIDYAIDVATDGGAYQEVLKTAADGKTTTKYPRSHRIDLPKAMTGWMVRIRRLTPKQTSVRIFDTMVVEAITEVIDAKLSYPETALLFVQFDAKQFRNIPQISCEPKMRIIRVPANYDPESRHYSGVWDGSFKWAWTDNPAWVLYDLMINDRFSIGARVKAENLALAKWDLYRIAQYCDQPVPDGKGGQEPRFTCNVYIQSQEDAWTVLRDIAGIFRGMTFWANNNMNALADMPRDMDYIYTRANVRDGKFTYASASEKTHYSTAMVSWSDPQNGYQDAIEPVFENRLIRRFGVKQADITAIGCTRQSEAIRRGKWVLHTNEYDRMVSFAVGLDGKLPLPGYIIGVADEMFSGRVLGGRISAVDGRNITLDRVSSAKVGERLILNLPSGKAEGRTIQAVNGQTITVTTEYSELPATENVWAIDASDLAVQQFRVTGIKEGEDGVSFDITAIEHNPDKYDHIDTGTRIDVRPISVIPPGVQPPPKNVGISSYSVVNQGIAITTLRVTWDAAESAIAYEAEWRRDNGNWISAPRTSTQGFEVPNIYAGRYQARVRAINAAEISSLWANAPETRLKGKEGNPPAPLGFRTTPIIFGIQIDWGFAPQTDDTLKTEIQYSRTNDGEGLLLLADIPYPQRMHTMQGLAAGVAFYFRARLVDKSGNQSPWTAFIRGESSSDTNWIIDAAGKEFLSNKAGQRLQSQMDFNSEAIMENAALTGAVVQRQLQVNGNMRAEILEVKTTQVTDREAFAEKMEKVQADVGENAAAVKTKATVVFDIDGNGYALKEIEAGVKYKGQLYKAGMVIGAEVKNGEVHTNIGFNANNFVWFNPASGKMEPFMAAKNGQLFIRQAFIDQALMREAILSDAIRSKNYVQYQAGFLINAATGAFEFNDMRVRAGLRWANGAIACYDPSGRVRAAMGYIGQFRR

SEQ ID NO: 8997 - protein, 191 aa, Xenorhabdus bovienii
  Peptide sequence Name=Xb4151_4152.C440.gene63.pep
  Homolog annotation: Query=4..190bp; Hit=9..199bp; Blast score=193; Percent Identity=57.0; E value=1e-48; Homolog= gi|32043835|ref|ZP _00141097.1| COG4723: Phage-related protein, tail component [Pseudomonas aeruginosa UCBPP-PA14]
MNTLRTIRLSGVLIPQFGREYKLAVSSPIEAIRALSVIIDGFEKFLLTAKERGLTFAVFIGKRNISRDELELSGEGDIRIVPVIIGSKKAGIFQTILGAVMVVAGVFAWATPYGVPLVMSGVSMMLGGVVQMLSPMPGGLARREDPDNKPSYAFGGPVNSIAQGNPVPIGYGRRRIGGAIISAGIYAEDQQ

SEQ ID NO: 8998 - protein, 153 aa, Xenorhabdus bovienii
  Peptide sequence Name=Xb4151_4152.C440.gene64.pep
MYSHYDPGLSLAGILFILVISALIGFTISFFIMRYATRANELLDIQKKILQELKVQNELLSGDKGNSDISSFYLNELKKLQSSDVVSKSGYVNHSNVEKMAKLYKKFMEEIETKNLSIFSARKAFQSEINRLSSELNENQRMSFLNVYKERLK

SEQ ID NO: 8999 - protein, 233 aa, Xenorhabdus bovienii
  Peptide sequence Name=Xb4151_4152.C440.gene65.pep
  Gene classification: Function=Uncharacterized ACR, PAD1/JAB1-related; Function class=S Function unknown
  Homolog annotation: Query=5..124bp; Hit=7..126bp; Blast score=132; Percent Identity=47.0; E value=3e-31; Homolog= PA0639_1 COG1310
MRPHITQAIMDHAKAEYPKECCGLVIQNSRKQHYIRCRNTAPSPTEQFSMHPEDYAEAEDAGTIIAIVHSHPDATTQPSQLDIAQCDLSQVPWIIVSWPEGDIRTIMPTEGIKPLLGRPFVHGIWDCYAIVRDWYRLERNIELPDFERSNGWWERGENLYMKNYVSAGFIECSGDLQMGDVIIMQVQANEPNHAGVYIGDGLMIHHMYGQLSNRVSYSGYWQERTVIILRYIK

SEQ ID NO: 9000 - protein, 115 aa, Xenorhabdus bovienii
  Peptide sequence Name=Xb4151_4152.C440.gene66.pep
MITNLTYCGWDNGMKYRSLFVFAVLLFSSSYAMAQKEYWYEGCPKYSEKGLSELIQRTKTTPVKSASELQQYSKGEVEVYLKKAKCDMHNLEKYAKQLEKKLKENEDIQKSQTRS

SEQ ID NO: 9001 - protein, 246 aa, Xenorhabdus bovienii
  Peptide sequence Name=Xb4151_4152.C440.gene67.pep
  Homolog annotation: Query=1..246bp; Hit=1..250bp; Blast score=333; Percent Identity=62.0; E value=1e-90; Homolog= gi|16122357|ref|NP _405670.1| putative phage protein [Yersinia pestis] gi|22126082|ref|NP_669505.1| putative phage tail protein
MTINSDLQRLEPGNKVLLFSVDGSAFGGPELYFHNHPIPYTEDELESADQLPMKSIWWQGQEYKPWPVKIEGLGVSSDGSAASPTLSVANLDSTISAMCLAYQNMAQARVTIRMTFAHYLDARNFADGNPEADPTQEKIDVYYIDSKTHENNTEIHFALSSPADLQGIRIPTRQIHGLCTWCMRGLYRKSPCNYTGDRYFDEDGNPTDDPSRDACSGLLSTGCELRFGKGNQLPFGGFPGSALLRR

SEQ ID NO: 9002 - protein, 110 aa, Xenorhabdus bovienii
  Peptide sequence Name=Xb4151_4152.C440.gene68.pep
  Homolog annotation: Query=2..110bp; Hit=3..112bp; Blast score=89; Percent Identity=40.0; E value=1e-17; Homolog= gi|23471668|ref|ZP _00126997.1| COG4718: Phage-related protein [Pseudomonas syringae pv. syringae B728a]
MIKTFDFPARVGAAGEFEPVVRSVQFGDGYKQTSGDGINSQRESWPLSFVGVLSEIAPIMDFLREHQGWRSFKWRNPLSELGLYQAGKFNIQASGAYFTLSVTFTRVYHP

SEQ ID NO: 9003 - protein, 1102 aa, Xenorhabdus bovienii
  Peptide sequence Name=Xb4151_4152.C440.gene69.pep
  Homolog annotation: Query=1..949bp; Hit=1..941bp; Blast score=696; Percent Identity=46.0; E value=0; Homolog= gi|33770523|ref|NP _892060.1| tape measure protein [Bacteriophage PY54] gi|33636106|emb|CAD91775.1| tape measure protein [Bacteriop
MANLSTLTVGLLVNAVSFRSQITEAYRHAGRESEKFSGKAKSDAKKAESAYHSLGKSIKSVGGQLALLSGVGFSLGSIINTTRKYGQALSDLSAITGATGAQLKTLDDAAQQLGRTTEFGATRIATALKLMASAKPELLKSTEALVQATEKSVILAQASGIELPEATKALALSLNQFGASAEQADRYINVLAAGAKYGSSEINETAQAIKNGGTMAAQASVSFEELNAVIQILAAGGIKGAEAGTAIRNVILALEKSTDKKLKPSVVGLGAALDHLKSKKLSTAEAAKLFGRANVSAASKLVVGRGKLEELKQSLTGTQVAYEQASTRANNLSADLDVLSSAFEGLAVKVGSSADGPLRSGIQGATSAINGLSENFNMVATVALHTLIPVMATKLTAGLRENVSAWKATEKATRDAAKQQAETAKRTIESARAERERAAQQSQWMATQSVINKQNGVYVNYQKDYIANSRKIRESIITETSAKKQLAEANRKLSYSTRLMSGAAAGASGALSLLGGSFGAAILAGSALYGLYNHSVQTREGLRQLKDTTIETVEELQRLSKVKVQLKIDDWKEKLEKLQGEKKQLESKMGGYSNIKINLAKSHEKNAFGRLFNRSSKTLLKGRNETLSKLEDTYASIKQMQEAIKNGEQTFSVGKFDVPPPSPPKPEGGNNNPWTGEGAGGNDKGDKKGKQVLNQYQQLRKEIEQAHTTSLERIILSEREIQGKLIEVGKSGLVSQNELLRLKNLNAENHQKQRIELAEKYAPAKALTRQEKEASQELKAIYDARLLTEQEYLSASKTLYQTSVKEKLAEQAKGLAAPRLDMVGEVDPVIQLQNQLTQQTALYDAYYRNGLISRERHEALVAAATNKSKESQFAASKELYASQGDFQAMQMNLLDVVEQRTGNALTGMLMGTKSFSESMKELSASLAQSIIQDLVRIAMQALITKAVSGFFGGTGGGETTLANGQAVPMLPKNIKAFAKGGVLSSPSLSAYSGQVVSNPTLFKFAHGAGLMGEAGPEAILPLKRGPDGALGVRAAGGTGNQTTIKVDIVVHPEKNSEVKTTSGFESAGQDIAKFVDQRFKSLLHKSLGQGGDLNVAIKGGRR

SEQ ID NO: 9004 - protein, 31 aa, Xenorhabdus bovienii
  Peptide sequence Name=Xb4151_4152.C440.gene70.pep
MTASHCACSVSRGTGTETGRASPGRGRFFSR

SEQ ID NO: 9005 - protein, 115 aa, Xenorhabdus bovienii
  Peptide sequence Name=Xb4151_4152.C440.gene71.pep
  Homolog annotation: Query=4..115bp; Hit=12..123bp; Blast score=92; Percent Identity=44.0; E value=1e-18; Homolog= gi|33770522|ref|NP _892059.1| hypothetical protein PY54p14 [Bacteriophage PY54] gi|33636105|emb|CAD91774.1| hypothetical protei
MKNLKAALLAPRAHVKAVEIFGTAVNLRRMTATELMDLEDAVEKLSEAGNGREASRLNVQIVLDCLVDDKGKPIPAGDLPTAEELMDTHDNATIIAAINLVKRHSIGTLEDAEKN

SEQ ID NO: 9006 - protein, 155 aa, Xenorhabdus bovienii
  Peptide sequence Name=Xb4151_4152.C440.gene72.pep
  Homolog annotation: Query=4..144bp; Hit=5..145bp; Blast score=205; Percent Identity=73.0; E value=2e-52; Homolog= gi|33770520|ref|NP _892057.1| hypothetical protein PY54p12 [Bacteriophage PY54] gi|33636103|emb|CAD91772.1| hypothetical protei
MATSSPEYAVLPAGTIVKFGKPGDTVDQMKFLINCKALGATGLSGGFIDCTTLMDTNKQFISDMPEGPEKSLGFIDDPENVDFTAFLNAAQRRETVQFYIGLPNKRTATMILALSGWEMNDINAPASEVIQITVKGKQNNLVWGIATTLTKGSES

SEQ ID NO: 9007 - protein, 139 aa, Xenorhabdus bovienii
  Peptide sequence Name=Xb4151_4152.C440.gene73.pep
  Homolog annotation: Query=11..139bp; Hit=7..135bp; Blast score=131; Percent Identity=55.0; E value=2e-30; Homolog= gi|33770519|ref|NP _892056.1| hypothetical protein PY54p11 [Bacteriophage PY54] gi|33636102|emb|CAD91771.1| hypothetical prote
MRRCPMISTHLSGLEELGRKLQALETDLQTQILRKAGKAAMEIVKEDMVAHAGYDKKAKGPHLRDSIQIRSAKSKKYKGGVMITVGPANAHRMKALAQEMGTIKQVPKPFIRPALDYNQSAVLKVLAAEIRAALSVYSQ

SEQ ID NO: 9008 - protein, 175 aa, Xenorhabdus bovienii
  Peptide sequence Name=Xb4151_4152.C440.gene74.pep
MLSRRCGPLAFLSYPAWATMSSFTISIAAFPALRRIWVWRSVSSACNLRPSSSRPERCVLIIGHLRISDNKVTGDTVTFLIFGQLFHRLMQCPACHRLHRIIPDMTMPDGFPCETDFLLNLCGFRVIIQGNDPDLKAGFDQSRGRQSGIEFRVTDTLVSDPLPHCGREYQRINGQ

SEQ ID NO: 9009 - protein, 108 aa, Xenorhabdus bovienii
  Peptide sequence Name=Xb4151_4152.C440.gene75.pep
  Homolog annotation: Query=34..107bp; Hit=40..114bp; Blast score=78; Percent Identity=53.0; E value=2e-14; Homolog= gi|33770517|ref|NP _892054.1| hypothetical protein PY54p09 [Bacteriophage PY54] gi|33636100|emb|CAD91769.1| hypothetical prote
MKAGSLRHRIKLFRPVVTRDDYGTETVTSEYASETWARAEAMSNRKIRTADQQQVIEVQQFTVRPRADIDTNWLVEHQGRLFTVRTVDRNRQDRAIITTEADVRHDRA

SEQ ID NO: 9010 - protein, 100 aa, Xenorhabdus bovienii
  Peptide sequence Name=Xb4151_4152.C440.gene76.pep
  Homolog annotation: Query=5..99bp; Hit=4..106bp; Blast score=84; Percent Identity=42.0; E value=3e-16; Homolog= gi|23505453|ref|NP _700381.1| hypothetical protein [Salmonella typhimurium phage ST64B] gi|23379200|gb|AAL25887.1| Sb8 [Salmonell
MPFPTVEKLKQQCRIDSHHDAEDSLLNTYARAAIKRAENYLNRRLYDDVVPDTDPDGLLASEDVELAIMLTVGYWYENREAQTLPAGFKSLLEPYRYIPL

SEQ ID NO: 9011 - protein, 68 aa, Xenorhabdus bovienii; identical to SEQ ID NO: 6354
  Peptide sequence Name=Xb4151_4152.C440.gene77.pep

SEQ ID NO: 9012 - protein, 346 aa, Xenorhabdus bovienii; identical to SEQ ID NO: 6355
  Peptide sequence Name=Xb4151_4152.C440.gene78.pep
  Gene classification: Function=Transposase; Function class=L DNA replication, recombination and repair
  Homolog annotation: Query=15..344bp; Hit=2..335bp; Blast score=241; Percent Identity=43.0; E value=7e-64; Homolog= PA2319 COG3547

SEQ ID NO: 9013 - protein, 60 aa, Xenorhabdus bovienii
  Peptide sequence Name=Xb4151_4152.C440.gene79.pep
MFAEINTNKRNVLHDGLLLKETPCQHTAHRVVGTISLTARNYLSMVKLGCIRLFYKRLYN

SEQ ID NO: 9014 - protein, 142 aa, Xenorhabdus bovienii
  Peptide sequence Name=Xb4151_4152.C440.gene80.pep
  Homolog annotation: Query=1..79bp; Hit=1..80bp; Blast score=81; Percent Identity=57.0; E value=2e-15; Homolog= Pa|Phot5-451c10.q1k _g164| 125457 - 125828 1091 123 aa, chain -
MKIKGAYCLFFILSMGGSQALALDFSYKSEMPADNKPSEEYLKKRAGLESKSWNVDTLTQDNVLAEKREEEMGQYNKKFENKNGIGLSYDWESKHLKSLQHMQQTSHFSNRRCYRATRQKLEKDFGNGYSYSDIADTCGSFH

SEQ ID NO: 9015 - protein, 262 aa, Xenorhabdus bovienii
  Peptide sequence Name=Xb4151_4152.C440.gene81.pep
  Gene classification: Function=Predicted epimerase, PhzC/PhzF homolog; Function class=R General function prediction only
  Homolog annotation: Query=7..259bp; Hit=6..260bp; Blast score=226; Percent Identity=47.0; E value=2e-59; Homolog= PA3578 COG0384
MHSYPIYHVDAFTEKSFSGNPAAVVLLDKWLTDEALIAIAAEINLSETAFLVGNQLRWFTPKVEVNLCGHGTLATAFVLIEHQSCQDNPITFTSLSGELRVSHQEGIFTLDFAAADCHEEKTLVSIMQDALGQNINEVFASHDRYICVMDSADQVLNTQPDFNKIAALPLAGLTITAPGESPVDFVSRYFAPAKGVNEDPVTGSTHCVLTPFWGKRLNKSTLHARQLSERGGDILCKTDGNRVYLTGKAKLFSHGQILLEDQ

SEQ ID NO: 9016 - protein, 38 aa, Xenorhabdus bovienii
  Peptide sequence Name=Xb4151_4152.C440.gene82.pep
LLNLNGHQSFKLVREIRSRSADYIEARSMRCNLPSMSQ

SEQ ID NO: 9017 - protein, 30 aa, Xenorhabdus bovienii
  Peptide sequence Name=Xb4151_4152.C440.gene83.pep
MQSTFNVTITFVLQTGCVHIVTISLATRVN

SEQ ID NO: 9018 - protein, 61 aa, Xenorhabdus bovienii
  Peptide sequence Name=Xb4151_4152.C440.gene84.pep
MLYVESIMKKYILSCLLAGVTLLSSMQSYALACNFFPPDSQAWKACTEVCKLVFSPSICLK

SEQ ID NO: 9019 - protein, 35 aa, Xenorhabdus bovienii
  Peptide sequence Name=Xb4151_4152.C440.gene85.pep
LFKITSNRTVHSCRPTHVSPTPPPNILLQPQYHLL

SEQ ID NO: 9020 - protein, 68 aa, Xenorhabdus bovienii
  Peptide sequence Name=Xb4151_4152.C440.gene86.pep
  Homolog annotation: Query=1..67bp; Hit=165..231bp; Blast score=90; Percent Identity=62.0; E value=5e-18; Homolog= Pa|Phot2-74c09.q1k _g4| 1777 - 2502 295 241 aa, chain -
MKAKALSLWDRLMLRRRFLIETVIDQLKNISQIEHSKHRSQLGFLLEIAAGLIAYTFQPKKTELEFTG

SEQ ID NO: 9021 - protein, 380 aa, Xenorhabdus bovienii
  Peptide sequence Name=Xb4151_4152.C440.gene87.pep
  Gene classification: Gene name=LldD; Function=L-lactate dehydrogenase (FMN-dependent) and related alpha-hydroxy acid dehydrogenases; Function class=C Energy production and conversion
  Homolog annotation: Query=1..380bp; Hit=1..380bp; Blast score=632; Percent Identity=84.0; E value=0; Homolog= PA4771 COG1304
MIISASTDYRTAAQAKLPPFLFHYIDGGAYAEHTLKRNTEDLSNIELRQRVLKNMSELNLETRLFGEKMAMPVALAPVGLSGMYARRGEVQAARAAAKKGIPFTLSTVSVCPIEEVASAIDRPIWFQLYVLKDRGFMHNVLERAQAAGVKNLVFTVDMPIPGARYRDAHSGMSGPNASMRQILQAITHPQWAWDVGLMGKPHDLGNISAYRGIPTKLKDYIGWLGNNFDPSISWKDLEWIRDFWKGPMILKGILDPEDAKDAVRFGADGIVVSNHGGRQLDGVLSTARALPAIADAVKNDITILTDSGIRTGLDVVRMLALGADSVLLGRAFVYALAAAGEAGVSNLLDLIDKEMRVAMTLTGAKSIAEINSNLLVGKQG

SEQ ID NO: 9022 - protein, 39 aa, Xenorhabdus bovienii
  Peptide sequence Name=Xb4151_4152.C440.gene88.pep
MFCETGSRVFKPFIALFGALVMVNIMMLGGENAQISSQH

SEQ ID NO: 9023 - protein, 47 aa, Xenorhabdus bovienii
  Peptide sequence Name=Xb4151_4152.C440.gene89.pep
VFCNLVFYEDDYLIGLPQGYQGDDANLVINCDPDNYPYSPIRGSRGY

SEQ ID NO: 9024 - protein, 63 aa, Xenorhabdus bovienii
  Peptide sequence Name=Xb4151_4152.C440.gene90.pep
MFIWLPGLAGGDRPLGCIDNGDFDGFSSRLMWRERGELKGYLYYPEKESRCGDYFKFDITLNK

SEQ ID NO: 9025 - protein, 221 aa, Xenorhabdus bovienii
  Peptide sequence Name=Xb4151_4152.C440.gene91.pep
  Gene classification: Function=Predicted esterase of the alpha/beta hydrolase fold; Function class=R General function prediction only
  Homolog annotation: Query=36..220bp; Hit=3..186bp; Blast score=125; Percent Identity=38.0; E value=3e-29; Homolog= BS_ydeN COG3545
MGRDRQFYSHSVGMLLTRITSMTQQMISSSDLFFGKKIIIVHGYSASPSSHWFPWLKEVLTEQGAEVMVPAMPESLAPIPEMWAKMLTDVIPKADDDTIFIGHSLGCVTLLRHLEAISSTADRIGGYILVSGFDSPLESLPKLNIFTAEPLSYAFLREVTEHRISIISSNDYIVSPQSSHALANSLQTKIINVDNAGHFLDREGFTRLLPVYDALKTIVSG

SEQ ID NO: 9026 - protein, 118 aa, Xenorhabdus bovienii
  Peptide sequence Name=Xb4151_4152.C440.gene92.pep
  Gene classification: Function=Uncharacterized BCR; Function class=S Function unknown
  Homolog annotation: Query=3..116bp; Hit=69..182bp; Blast score=139; Percent Identity=58.0; E value=3e-34; Homolog= PA4580 COG3236
MTRLFNDSATLEKIINAKNPGAAKAYGREVCGFNQSIWDDHQLAIVIEGNLAKFSQNNALAEFLLNTADKILVEASPVDRIWGIGLAEDFANIENPLTWNGLNLLGFSLMAVREELKI

SEQ ID NO: 9027 - protein, 96 aa, Xenorhabdus bovienii; identical to SEQ ID NO: 5468
  Peptide sequence Name=Xb4151_4152.C440.gene93.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 9028 - protein, 92 aa, Xenorhabdus bovienii; identical to SEQ ID NO: 6203
  Peptide sequence Name=Xb4151_4152.C440.gene94.pep

SEQ ID NO: 9029 - protein, 73 aa, Xenorhabdus bovienii
  Peptide sequence Name=Xb4151_4152.C440.gene95.pep
VAFLYFYSGICQFKNYLLQSSAKYRLTISPPISIEAATAGGGVILESTPNQKTKIWYCYNHEIQNSMRHSQAA

SEQ ID NO: 9030 - protein, 69 aa, Xenorhabdus bovienii
  Peptide sequence Name=Xb4151_4152.C440.gene96.pep
MTLHVESNMKKYILSCLLASATLLASMQTYAHSPSDPVCFQTPTGEHCIMPFVPPQPVIPVPPYIPPAN

SEQ ID NO: 9031 - protein, 79 aa, Xenorhabdus bovienii
  Peptide sequence Name=Xb4151_4152.C440.gene97.pep
MLSNTYRGALHNALCSTTTRNSSSPLYSTGKLAKLNILIKLSRTEHSCRPLIAHRHCVLTHSCKPSIICSAVAMCFLLS

SEQ ID NO: 9032 - protein, 71 aa, Xenorhabdus bovienii
  Peptide sequence Name=Xb4151_4152.C440.gene98.pep
VTIRCRLDDDDPRCAYAGERPYPATVSNQSSSSQSLFRMYYLALQLEAGMGEIEERAKIMRAENTLPPQSK

SEQ ID NO: 9033 - protein, 189 aa, Xenorhabdus bovienii
  Peptide sequence Name=Xb4151_4152.C440.gene99.pep
  Gene classification: Function=Uncharacterized BCR; Function class=S Function unknown
  Homolog annotation: Query=3..185bp; Hit=22..200bp; Blast score=83; Percent Identity=32.0; E value=1e-16; Homolog= Z2774 COG3758
MKMKYFDYATLPRTQWSGGTGETRDIVCWPVSDDFAWRACFTSIYESEVLGQFPDIERSIVLLKGKGIRLTSPGFLEHELVKKMTPFHFSGDIHGHAELLDGSVQCFNIMTRRSCWASEISVISHEHLLPTSHSGVLYVLKGRWEMTGANCVQLAFGQGAWWLPDIREGTIKPLVTDSQLLWVDLRPIG

SEQ ID NO: 9034 - protein, 70 aa, Xenorhabdus bovienii
  Peptide sequence Name=Xb4151_4152.C440.gene100.pep
LFHLSRLTIAFSVTLHNRNISFSCHLLTTLKPCVYSRKTVNVELSTPTFANNSAYDNINVIDYPHSLSSV

SEQ ID NO: 9035 - protein, 473 aa, Xenorhabdus bovienii
  Peptide sequence Name=Xb4151_4152.C440.gene101.pep
  Gene classification: Gene name=ARO8; Function=Transcriptional regulators containing a DNA-binding HTH domain and an aminotransferase domain (MocR family) and their eukaryotic orthologs; Function class=K Transcription
  Homolog annotation: Query=1..464bp; Hit=1..463bp; Blast score=520; Percent Identity=55.0; E value=1e-147; Homolog= ydcR COG1167
MTRYEQLAGAIRQQIEDDIWQVGDKLPSLRESVKSSGLSLMTVLQAYQLLESQGWIVARPQSGYYVATRLTQFAAAKGGKGLHLSESVEISASIFDVLQACKDPKIVPFGSAFPDPSLLNEPKLSKILASVARRFVPHSSLENLPPGNEKLRRNISRRYAAHGIHVPPEEIVITAGAMESLSFSLQSVTSPGDWVVIESPAFYGALQAIERLRLKAIAIKTDPRTGIDLDALEEIVQKYPIKACWLMSRFQNPLCNTMPSENKQRLVEILNSSHIALIEDDVYGELYFDQEPPMPIKAWDKENNFMHCSSFSKCLAPGYRVGWVAAGKHAGKIQQLQMMSTVSASAPTQLAVAEYLAHGGYDNHLRRLRRQLEQRQSQVLRAISEYFPDSVKVNSARGGYFLWLEFEPPFNANRLYQLALTKGISIAPGSMFSTSAQFDHAFRLNTSFVWNDVQASAMKTLAGLCHTLLRECG

SEQ ID NO: 9036 - protein, 88 aa, Xenorhabdus bovienii
  Peptide sequence Name=Xb4151_4152.C440.gene102.pep
MISLIPSVMAICRPPAKYHPLFAGGSHQPTVRNVSYSLTLGKAVIGNKQIIVTIIPYIPVFYLSAPSNFIAPYDSTKIRGHYVWVKCP

SEQ ID NO: 9037 - protein, 445 aa, Xenorhabdus bovienii
  Peptide sequence Name=Xb4151_4152.C440.gene103.pep
  Gene classification: Gene name=CydA; Function=Cytochrome bd-type quinol oxidase, subunit 1; Function class=C Energy production and conversion
  Homolog annotation: Query=1..437bp; Hit=1..439bp; Blast score=630; Percent Identity=74.0; E value=0; Homolog= PA3930 COG1271
MFGLSALELARIQFAFTISFHIIFPAITIGLASFLALLEGLWLKTRNTDYKTLYHFWSKIFAVNFGMGVVSGLVMAYQFGTNWSFFSDFAGSITGPLLVYEVLTAFFLEAGFLGVMLFGWSRVGEKLHFFATCMVALGTIISTFWILASNSWMQTPQGHEIINNQIVPVDWFAVIFNPSFPYRLLHMGTAAFLASAFFIAASAAWHLLKGNDSSAMKKMLSMAMWLILIIAPLQAIIGDFHGLNTLKYQPAKVAAMEGHWENRPGEATPLILFGIPNQEAEETRYAVKIPYLASLILTHSTDKQVPALKEFAPEDRPNVFMVFWSFRVMVGLGILMIVAGVWGLLLRYKKRLYENRTFLRFIFLMAPSGLIAILAGWFTTEIGRQPWVVYGLMRTKDAVSAHGEIHMSISLLIFFVVYAAVFGVGYAYMMKLIRKGPNKELANGH

SEQ ID NO: 9038 - protein, 335 aa, Xenorhabdus bovienii
  Peptide sequence Name=Xb4151_4152.C440.gene104.pep
  Gene classification: Gene name=AppB; Function=Cytochrome bd-type quinol oxidase, subunit 2; Function class=C Energy production and conversion
  Homolog annotation: Query=1..335bp; Hit=1..335bp; Blast score=431; Percent Identity=69.0; E value=1e-121; Homolog= PA3929 COG1294
MGIDLPLIWFLIIIFSTMMYIVMDGFDLGIGILYPMMKGQSDRDLMMNSVAPVWDGNETWLVLGGAALFGAFPLAYAVILDALAIPLTIMLLGLIFRGVAFEFRFKATPEHQPIWDKAFISGSIIATFTQGMVVGAVIEGFPVENRTYIGGAFDWLAPFPLFCGFGLVVAYALLGCGWLVMKTEGHLQQQMYRILRPLTLLMLAVISIISLWTPIAHQAIAERWFSLPNLLFFIPVPLLVIGSSWKLLQANGNTSHYTPFLAALLLIFMGFSGLGISIWPNVIPPMINYQEAAAPPQSLGFMLVGALFIIPIILVYTFWSYYVFRGKITHEQGYH

SEQ ID NO: 9039 - protein, 60 aa, Xenorhabdus bovienii
  Peptide sequence Name=Xb4151_4152.C440.gene105.pep
MSSEEKSPMNKVITESDPPRPSLWKRLGWLVTIWLGSVLTLYAVSALFRVLMTTAGMKVK

SEQ ID NO: 9040 - protein, 416 aa, Xenorhabdus bovienii
  Peptide sequence Name=Xb4151_4152.C440.gene106.pep
  Gene classification: Function=Signal transduction histidine kinase, nitrate/nitrite-specific; Function class=T Signal transduction mechanisms
  Homolog annotation: Query=76..403bp; Hit=235..581bp; Blast score=142; Percent Identity=27.0; E value=5e-34; Homolog= ZnarX COG3850
MKTFSDSPIAATGWLCGTAITINLSVLLFLGLNTPLTLPGKLWAIFDILSILCLLSLLYKADMISLQMASFCKIKQRKITALKRDKQYLRFLISIHSQLNLNTSLSDNFHRVFFRLNQFIPFGEVRITLYHPPRKYHFEYLRSPFDANLPRIQKWDLYDRHTFHGMIQIKINQTQILSSYERDLIQSVTDALARHLSLRNTVHQQIQQGLINERENISRELHDTVAQSFLFLKIQINSLHVRHDKFSRQALIALRIIKEEITLASQQLREMLATLRAEKNHYDLYESLQSLIKEFNHRLGFQIEFHYRLTHQIIPIGHRRHLAQIIREALNNCYKHADASWISIRIYPIGKKIITVISDNGHGIHQEQIKAQFGLAIMRERVTLISGQMKIKKRKKGGTEIEIQVPLQDEQRNLEK

SEQ ID NO: 9041 - protein, 68 aa, Xenorhabdus bovienii
  Peptide sequence Name=Xb4151_4152.C440.gene107.pep
VHDIVHAESLVEQSSPPDFVIADKGYDSQAFRNHIKQQGATPMIPYRKKELNSRFYFSKLRCSSCSGT

SEQ ID NO: 9042 - protein, 32 aa, Xenorhabdus bovienii
  Peptide sequence Name=Xb4151_4152.C440.gene108.pep
MPRTMLTDLQWNKLSALMQLAVDNYGLPVHFE

SEQ ID NO: 9043 - protein, 38 aa, Xenorhabdus bovienii
  Peptide sequence Name=Xb4151_4152.C440.gene109.pep
MFCGGLLDSMMIWYNHFRQKTTKPDHHAANYVNRPPME

SEQ ID NO: 9044 - protein, 508 aa, Xenorhabdus bovienii
  Peptide sequence Name=Xb4151_4152.C440.gene110.pep
  Gene classification: Function=Signal transduction histidine kinase, glucose-6-phosphate specific; Function class=T Signal transduction mechanisms
  Homolog annotation: Query=13..507bp; Hit=24..520bp; Blast score=353; Percent Identity=44.0; E value=2e-97; Homolog= PM1339 COG3851
MINRYLINSFCGWLLFSCCWFCLWVIAYYFVNDSELAILFFPFALRLGIVLHTPKHYWPTVYGAEWLLTICLALLMGQPQWLTVLTASIASLPIVWVASRYYRGSQWQRLAVMAMVITATGLINVVAVSNHNPSLIIVFLVSLTGGAMLVPTCYLVWHYLFQSIWLPLTANVVSRQIQFRLHHVMLYALLFVLNILLQIGFPNELRYFAPFCLAIPIILLAFRYGWQGALLGTLLNSIVLIAARSGVSNMEITDLLLSLLAQTITGIMLGMAVQRQRDLNTQLKRELYRNRSLAGQLVKAEESVRRDIARELHDEIGQNITAIRTQANIIQRVEVTPIGSNCAKTIESLSLNVYDTTKRLLSCLRPKILDDLGLKEAIEQLLRDMEFENCSISVEIHWEANSAEVIEQLSDTTKVTLYRICQEALNNALKYSQADRIELHFSVRAMIRLLIKDNGIGCKAEDNMKGFGLRGMRERVQALGGQFSIHSGKRQNDSTSAGTDLSIILPKL

SEQ ID NO: 9045 - protein, 442 aa, Xenorhabdus bovienii
  Peptide sequence Name=Xb4151_4152.C440.gene111.pep
  Gene classification: Gene name=UhpC; Function=Sugar phosphate permease; Function class=G Carbohydrate transport and metabolism
  Homolog annotation: Query=19..438bp; Hit=20..439bp; Blast score=534; Percent Identity=65.0; E value=1e-152; Homolog= uhpC COG2271
MTGFSQSKPISHGNLSDAEIRDQYRYWRLHIILNLYVGYALFYFTRKSFNYAMPAMITDLGLDKSEIGLIGTLFYITYGCSKFFSGIISDRSNPRYFMGIGLIATGIINILFGLSSSIVMFTFLWILNAWFQGWGSPSCAKLLTTWYSRSERGFWWSVWNTSHHVGSALIALIVSFLTLHFSWREGFIVPGCIGILAGILLCWRLRDKPATMGLPTIGQFRNDRLEKAQENQGKGLTTREILRTYVFRNKYIWLLSFSYVLVYIVRTVINDWGNLYLTEYHHYDLVSANAVLSLFEVGGFMGSLVAGWGSDKLFGGNRGPMNLIFSMGIFLSVAALWLMPVTGLVFQSLGFFAIGFFVFGPQLLIGMAAAECSHKDSAGAATGFVGLFAYTGAAIAGYPFAIILENYHWSGLFMAISICAVMIGLLLLPFLQAQFPKQRAQS

SEQ ID NO: 9046 - protein, 39 aa, Xenorhabdus bovienii
  Peptide sequence Name=Xb4151_4152.C440.gene112.pep
LKKSSTRFYSENEWRTLSYFLRLTLCPLFRKLCLQERQQ

SEQ ID NO: 9047 - protein, 488 aa, Xenorhabdus bovienii
  Peptide sequence Name=Xb4151_4152.C440.gene113.pep
  Gene classification: Gene name=PTR2; Function=Dipeptide/tripeptide permease; Function class=E Amino acid transport and metabolism
  Homolog annotation: Query=1..482bp; Hit=1..483bp; Blast score=632; Percent Identity=72.0; E value=0; Homolog= yhiP COG3104
MSKTASVGLWDQPKPFFMIFFVELWERFGFYGVQGILAIYFVQQLGFSEEQSFITFGAFTALVYGLISVGGYVGDHILGTKRTIVLGAIVMAIGYYMIGLSIMKPELIFYALGTVAVGNGLFKANPASLLAKCYQPQDPRLDGAFTLFYMSINLGSLFSLSLAPVIAEKYGYTVTYNICGIGLIIALLVYIACRRMVHNIGSAPDHHPVKPIGLIAVLIGSVVMVGVCAWLLHNIKVANIALFAITTIVVLIFFWQAFKQNRVGRNKMFVAFILMLQAVVFFILYNQMPMSLNFFAINNVHHQILGFDVNPVSFQAFNPFWIIIVSPILAVVYTKLGAKGKDFSMPAKFTFGMFLCSLGFLTAAASGLFADAQGITSPWFIVLVYLFQSVGELMISALGLAMVAAFVPSYLTGFILGMWFLSQAVASMLASHVAALTATPVGVTDPLQTLPIYMSVFGKIGVATLIVAIIMTFMVPWLNRIMREEVKA

SEQ ID NO: 9048 - protein, 38 aa, Xenorhabdus bovienii
  Peptide sequence Name=Xb4151_4152.C440.gene114.pep
MQDLKSENYPPAGSQFLYFFWQGGSIRLYRWWISLILL

SEQ ID NO: 9049 - protein, 260 aa, Xenorhabdus bovienii
  Peptide sequence Name=Xb4151_4152.C440.gene115.pep
  Gene classification: Gene name=GrsT; Function=Predicted thioesterase involved in non-ribosomal peptide biosynthesis; Function class=Q Secondary metabolites biosynthesis, transport and catabolism
  Homolog annotation: Query=19..242bp; Hit=6..231bp; Blast score=120; Percent Identity=29.0; E value=1e-27; Homolog= PA2411 COG3208
MEKSPSCFIKLNIVSNPDIRIFCFPYAGGSSATFVPFAKKIKSNAEFLVIQPPGKGSRIREKPHDDMSRLVEDIYINIKSLLDKPYLFFGHSLGSRVAFELIRKIDAASLPLPLEFIASGSKGPQVPAIREPLSGLPDKDFINGLQTFGRVDKQVIDNAELLSLILPAIKADFKISEEYHYIGTGTLSCPLTVFGGKNDAIVTEQELYSWLDLFEKEKKVIIFEGTHFFIDDNNEPVIDAVQNIIKSKKLQQYQRYPPTI

SEQ ID NO: 9050 - protein, 35 aa, Xenorhabdus bovienii
  Peptide sequence Name=Xb4151_4152.C440.gene116.pep
MKKATPERSLEFVIRDLNRVFSFDGSVRIHYSGYW

SEQ ID NO: 9051 - protein, 177 aa, Xenorhabdus bovienii
  Peptide sequence Name=Xb4151_4152.C440.gene117.pep
MGWYRHYFNDIYKLPLQDAVKDSVKLVVSNDKQYHYFLDIPKYQPGPRLNIFGHGDPNRASFQGHSVEHPLSGTEIAGFPCREKLPDAHPLSPSDLAESIKPLILLYHIRSIRLVACYTGRTGFARDLSQFTGLPVKAPIHHVDVMEFVTTGCYWIIKRQEESEEAERNFRWFGSHQ

SEQ ID NO: 9052 - protein, 70 aa, Xenorhabdus bovienii
  Peptide sequence Name=Xb4151_4152.C440.gene118.pep
MSLNIIITKIKWLFFAHQRSCDWCRHAFPQKTKKTHRALRDPQKSALINQNHTLVDSGEVFECFIKYNFK

SEQ ID NO: 9053 - protein, 37 aa, Xenorhabdus bovienii
  Peptide sequence Name=Xb4151_4152.C440.gene119.pep
MASNECSFSSGQEYLPRSNGVQVCHKPIRSVASMQLA

SEQ ID NO: 9054 - protein, 50 aa, Xenorhabdus bovienii
  Peptide sequence Name=Xb4151_4152.C440.gene120.pep
MRLLRYLFWRILMVFSFDLSVFSKASSPWWGRVLRKKRKPDYDSALAALK

SEQ ID NO: 9055 - protein, 638 aa, Xenorhabdus bovienii
  Peptide sequence Name=Xb4151_4152.C440.gene121.pep
  Gene classification: Gene name=VgrG; Function=Uncharacterized BCR; Function class=S Function unknown
  Homolog annotation: Query=3..630bp; Hit=8..655bp; Blast score=383; Percent Identity=34.0; E value=1e-106; Homolog= PA0095 COG3501
MERIIIAHSSLGDESLIFKSLKGREKLSTIYSFEVELFSEKKDLDIKELRNKPLSIEIKNSTNISEKPRFLSGIIREATICDYYDHYYYLYKVIIQPELFILTLNKDFRIWQKKTVPEIISDVLNKYKIKFKNELNAKYQPLEYCTQYKETDFDFLSRLMEREGIYYYFQHDKNDHTLILADSPQSHSALPEQASIEYYPSHFSPKNKDKYYLYDWIVSYSINPKLYTMSDYNFLKPNAQLKETQQNPDPTVPKTELFEWPGNYTENAQGQFYVRVLQQSYTAQDLYIKAKSVESGIAPGYTFTLSKALRDGDNGDYLIVSANYEFHENPYILGDNEVDADNINKIITEFTAIPAKVNWRAPRTTSWPIAGTERATVVGASGKTIWTDEHGRVKLKFHWDRSDIKDDKSSCWIRVSNNWAGSKFGVIQVPRVGEEVIVNFINNNPDEPLVVGRSFNQNNMPPWELPAEATKMGIMSRSLEGGKDNASYLLIDDAQGKESFEIHAEKDMTVSVEHDQTVSIDGASITKIKNKQQTTVTNGKEVEVTSGGIQYKITDGYKADITGDKSEKISSSYQLEVGRNFANNISGNYNLNITGNKKESVTGNAEIKASKLSLASSTTIDINGAAKISITAGLILLG

SEQ ID NO: 9056 - protein, 864 aa, Xenorhabdus bovienii
  Peptide sequence Name=Xb4151_4152.C440.gene122.pep
  Gene classification: Function=Uncharacterized low-complexity proteins; Function class=S Function unknown
  Homolog annotation: Query=545..847bp; Hit=24..331bp; Blast score=83; Percent Identity=25.0; E value=1e-15; Homolog= slr1819 COG1357
MKIIKPLRLSLLHRPYYWRQHHYLGVSIMALTDMGASPRLRPEPELWQLAEAELKTTNSVVDLAIPKSSAEFLATGYAYTHHQPDKTTCSARIQIEQLDKTLIVSGDRHWIGDKPSTPQAFEQMRLDWSRAFGGKNYEENPYGIGFTPELQENGLETHRLPNVEDQNRQLLSPQDTPNPASFCPLEFGWPRRFTRIGKKYDKEWLENEFPGFSRDIDWRLFNAAPPDQWWEHYQALPENAAWRIWNMHPEKPMQEGKLPPWQARCFIKRLRADEDIFEEIAMRNTTVWFFPHREQMILIWHGYTRVNEDDATDVLHMLSAIELNSEAHSENDYLQVLNQRTEKEKGALYALREKDLIPESIIGPWIDTEQSEHGSPLRENLQNREKRLREQHKERMAKYGKDISTLITPCIEQPANPKADELPEFVDKIEQEAAQKYIAAEQQREKIRTIAQEQGVKVEQVAMQNTPRGPQNFHQIRDILYQQQESQKQVEPKSIELNDKKLTQIEQSLHKMYLASAQTQPPALRLTGDLSQIIRKQVQRIMREGGDFRAMDFTGADLSGMDLQGANFSGSLLESVCFNNSQLDGADFSEAMLARAEICHASLYGAKLDNASLAQAKCEQSDFSAASFKETQLQETLLNHCRFNHAIFTDLFLQRTFIKHCRFQHSQWQGCIFIEMMLPALKFSYASLNKVSFINCLLENAIFDHAVLDSCSWIETEAVAIRFRSAKLLNCVFTMKSVLNHADFSYATLTECNLRQTPLVQASFHSATLNNSDFSEANCQLADMQYLNTTQSIFIRTNFKNALLNNANLIGAFMQKCTFCSTDLREANLFRADMSQSIIDDSTLIHHAYTQRLKTLPKRDQDVI

SEQ ID NO: 9057 - protein, 357 aa, Xenorhabdus bovienii
  Peptide sequence Name=Xb4151_4152.C440.gene123.pep
  Gene classification: Function=Uncharacterized low-complexity proteins; Function class=S Function unknown
  Homolog annotation: Query=66..330bp; Hit=14..289bp; Blast score=68; Percent Identity=22.0; E value=7e-12; Homolog= slr1819 COG1357
MSMLTVNEIIAKIKQRDVIEQVNLQGISLVGQNLSGGRFWAVDFSNANFSHAILEESVFTECLFEETVFNSVRCEKTLFEQCNMIRAVFNKATLSASVFDQCVLKKTQFKVTKQNSTQFSSCQLQYADFIENEFDRATFINSVLHYAILRNSHFFLVTFFRQDLRKTDFYASQFMKTLFFECDHRDQDYRKLQFQACQFTDNQLDAVNFNQSNLTHCNFKGSSLQDAQLSNVNATQALFINADLTRACCHNSLFNGAIFIGACLERTDFRQSQLQQAIMQKVRAVNAQFVNCDMTYADLSYANMNNSDFRAAHFMRTLFHRTQQVGALFSDRQGILENDPELFAAEEWSTQQRQRKI

SEQ ID NO: 9058 - protein, 220 aa, Xenorhabdus bovienii
  Peptide sequence Name=Xb4151_4152.C440.gene124.pep
  Homolog annotation: Query=34..220bp; Hit=16..211bp; Blast score=182; Percent Identity=47.0; E value=3e-45; Homolog= Pa|Phot3-222e10.p1k _g69| 47111 - 47746 2122 211 aa, chain -
MVKSSYALSSSTLVTEQRYTEQPQTKQSSPFPSQQIVGQVVNIFQDGKLMVKNQNYGWHCRQASSCLLAPAMGDRVLLVEADEQLWILAILERAEQQDPAVIKVSGDLSIMAQGNLNLSSNGLNITAENGNCHINEMQYSGGSLSAWVSVSKIIGNQFESVWQTVTQLSHRLFRHTTQTEQVHAGQLDMQAENYMRLHAQNTVITAKAITKIDAEQVHIG

SEQ ID NO: 9059 - protein, 133 aa, Xenorhabdus bovienii
  Peptide sequence Name=Xb4151_4152.C440.gene125.pep
  Homolog annotation: Query=1..128bp; Hit=1..124bp; Blast score=111; Percent Identity=50.0; E value=3e-24; Homolog= gi|33595406|ref|NP _883049.1| hypothetical protein BPP0711 [Bordetella parapertussis] gi|33565484|emb|CAE40120.1| hypothetical
MFANTQGGGIDLAIPDICLTPCPLGAPIPMVYLNIAQGTNGICASTVNILFMGSPAHNMATMIAMTNGDNLGVDLGVASGTVMGPSRHTLGANSVLIKGSPATRLSSPTLQNSTNSVGSRAVPSQTKVDISGA

SEQ ID NO: 9060 - protein, 209 aa, Xenorhabdus bovienii
  Peptide sequence Name=Xb4151_4152.C440.gene126.pep
  Gene classification: Function=Uncharacterized BCR; Function class=S Function unknown
  Homolog annotation: Query=60..173bp; Hit=12..130bp; Blast score=63; Percent Identity=32.0; E value=1e-10; Homolog= PA0080 COG3521
MVNIKNASHTTPPCSDKTFSREIIGHKFANRCRLNFKCAMMVILFLHVLVFNLIIFNIFVLTGCSSSEQKKSPPYQLIFRATNNVNDSAPLKIHVILLKSTSEFMSADFFSLQGHAQAVLGNKLINSEQLFLLPFQHKYFLLEKNIPEANSIGIFAEYKQLDGKKWRIALPVPIPEPPAFYKFWTSPPDTLDICIQVTANGLNFIDKCN

SEQ ID NO: 9061 - protein, 447 aa, Xenorhabdus bovienii
  Peptide sequence Name=Xb4151_4152.C440.gene127.pep
  Gene classification: Function=Uncharacterized BCR; Function class=S Function unknown
  Homolog annotation: Query=1..442bp; Hit=1..443bp; Blast score=348; Percent Identity=41.0; E value=5e-96; Homolog= PA0079 COG3522
MSRSEKVIWTEGMFLRPHHFQQAENYLETYVRDWGMAQRPYYWGFLTLKLDQSLLEQGKVMVASASGIFPDGTPFNFTEAHAPVPLQLAENQTGENVVLALPIFRGGREEIIFQERKDSMARFVSVDAEVNDFNAMSVGSTTVQFGRMRLRLMLESDLTPEWTSLSIVHVISRTRDNKLLLDSRFIPPLLNCHAHPQLVSFINDLQGLLEQRRQQTSQCLLQLGQQNSSEIMYFLFLSLVNRYSGQVSHTRNIPLLHPERLFSEWLQFATELASFSQSRIPEDKLPIYDHDNLQVCFNHLMFLLRQGLSIILEEHALQLPLTEYSHGLNVATLTDANMLNTFSFVLAVYADTPKETLISRFPAQMKIAPVGRIRELVQLQLPGIPISAMPSVPRQIPWHSGCLYFELEKEGELWSQMAKSGGFALHLAGEFPGLHMEFWAVRNQSKS

SEQ ID NO: 9062 - protein, 403 aa, Xenorhabdus bovienii
  Peptide sequence Name=Xb4151_4152.C440.gene128.pep
  Gene classification: Function=Uncharacterized BCR; Function class=S Function unknown
  Homolog annotation: Query=19..230bp; Hit=61..276bp; Blast score=162; Percent Identity=39.0; E value=6e-40; Homolog= PA1668 COG3455
MTPNTPNRHTELSGDIWDNPLVTAANPLLNSIPQIRHDTESPDPTVLRRKLIDEIRHFELKCQYAKLPYEVIIGARYCLCTTLDEAAALTPWGVRSVWSGSGLLVTFHNETWGGEKLFQLLATLSQSPQKNLLLLELINFCLQLGFEGRYRVMDNGRTQLETLKQRLFQLIYSVRGNYPPELSPALQKIVAPNSPCQSSFPVWSFIAMTCLIACILYIGLNWQLDNITSPILTKIYQVNLPNMSVDDHVSSFLPPVLNLQDMLRRESAAGLLNVTNLADRSIVTLRGDGLFNTGSTQIKNNELPVIKHIAETINNIKGEILVIGYTDDVPINSSGFSSNYALSLARAKSVKREFEKYLDHPERVRTEGRGESDPLFPNDTPSHRAKNRRVEIVLLISPTHQTT

SEQ ID NO: 9063 - protein, 1171 aa, Xenorhabdus bovienii
  Peptide sequence Name=Xb4151_4152.C440.gene129.pep
  Gene classification: Gene name=IcmF; Function=Uncharacterized BCR; Function class=S Function unknown
  Homolog annotation: Query=76..1159bp; Hit=6..1088bp; Blast score=513; Percent Identity=31.0; E value=1e-145; Homolog= PA0077 COG3523
MLSAIVAIFTSRLMWSFLGITAISSIIWFIGPMTSIGNTIPLGSSTVRIIIIAILYFVWLFIQLASHLYQVWLNKKLSAPLNRGNDEGEQVRNSQYSPLSEHFSDALRLLKNAYFYGSEIQYKPKWKPFFDRRYRYQLPWYVLIGPPNSGKTTLLANSGLHFPLSDHFETLSSNEIKETDNCHWWFTNQAVLLDTPGRYTTQDTRHEQDAREWKCFVNLLKKYRTRQPLNGVILTISVADLLNPSKKVRDQHAYLLRRRLSELQAQFKIQFPIYVIITKIDLLKGFGAYFAHFDKTQRDQIWGFNFPWNKTGWDLKDIFAQQYGLLQTRLNAELSHILLHLNDLQQCAESYLFPQEFAALQPLIAQHLEIAFAKSGFDIPYSPRGLYFTSSVQEEPIHQGYFLKTLLETLFQEAGLAGQNRWWVYRNRLLKGLGYIILAAIMGLIITLFFSSYGNNKNYLTEVQNKIFPILSQSAALKKISNDIDIYALLPILNKVADLGKSKYFSPDAPPWSYQMGLYHGEQINDASLTLYTKTLQTLLLPQVARLITSQLHQTNSDNIYNTYNTLKAYQMLCQPQHYDGKFLHRWVMQYLQAHLPPTISPTQLHQIEGHLRQLLEYQIVTFPYVCDNPLIKQKQILLSKIPLAQLVYIHLKQELSDNPNLSPVGLTTLAGPEAGLVFSRINGTPITLNIAGMFTPAGYQMGIGNNLTTLIDKLYSQNAWILGQYAEISTPRELTLLVRQFYLHDYLEQWDKFLFDIRLNNIDSLEQRSNIAQFLASNASPMRNLLINISKNVNLDERLSDNHFDKKIGELVSRKADSLTKVVPNPFMSGDNLPTPEQELRKHFAQITALANNPDGKNKQIPFDHVLSQLAKLHEYLDSVQNATNIGIPAPSDEIITQLQATAERLPIPFKGIISSLAMGANSDTQASNVKNLNKQLNTEVQGFCHQAIANRYPLTPWALDDIRPDDMARMFAPQTGIMDSFFQKNLVGKVDTSHENWRLILGTDSKAKALPESHKLLLPFQQAQIIRDTLFSDGSRIPSFRVIVRTVNMDKEILSMILDVDGQQLQYSHGPQVSQSLNWPGPNGSNQARIQLNLDDGTTASLITSGPWALNRLIDHEQFAAGKPATNNHTSQRVTFNIRGHHVSLEFIPNSILSPFQLPIFVCPKLINS

SEQ ID NO: 9064 - protein, 67 aa, Xenorhabdus bovienii
  Peptide sequence Name=Xb4151_4152.C440.gene130.pep
LPLANPCECLYLCAGDIRRILKGDGYIQPSIFSFSTIRKSKPYYEHRNLTRTRQHRISLWGKSGIRS

SEQ ID NO: 9065 - protein, 351 aa, Xenorhabdus bovienii
  Peptide sequence Name=Xb4151_4152.C440.gene131.pep
  Gene classification: Function=Uncharacterized BCR; Function class=S Function unknown
  Homolog annotation: Query=1..137bp; Hit=2..138bp; Blast score=97; Percent Identity=42.0; E value=2e-20; Homolog= PA0082 COG3515
MNIETLLEPVSIESPCGENLEYDPEFMALEQSLLGKTEQQFGDITIPAETPDWIQAEKQAISLLRRTKDLRIIMALIQSWLQMRGLCGYADGLNLLQQTLERYWDEVWPKLAFEGEYDPQFRLNILAAIEDDSPLSLQAQYSTLLRNTSKELSLLEVCSLLDGTINEISGYTGGRTRLQEELKQQASSPEVLAVIRIRDHLIAILDIIRQAFSESYVSELSWLLKQLNKVIEFCPSLSKTRHRDKETDPKNIFDSTTCSEQRTPASTYSTHAVSASWHTIEASNRDEARMLLEKAKNYFVVNEPSHPAPHMIARIQRLIDRDFVDIIYDLAPDGLNQLEIIFGRSDNFDSN

SEQ ID NO: 9066 - protein, 70 aa, Xenorhabdus bovienii
  Peptide sequence Name=Xb4151_4152.C440.gene132.pep
MDSTSSKSFLVAQTILTRINRRFFNNLSSHVSFYIHPTSSCRLQTHVSVYISPLRGEISRILKGDCYISD

SEQ ID NO: 9067 - protein, 183 aa, Xenorhabdus bovienii
  Peptide sequence Name=Xb4151_4152.C440.gene133.pep
  Gene classification: Function=Uncharacterized BCR; Function class=S Function unknown
  Homolog annotation: Query=3..165bp; Hit=5..167bp; Blast score=203; Percent Identity=63.0; E value=8e-53; Homolog= PA0083 COG3516
MKSSGQKFIALNRPPRVQIEYDVELYGSEQKIQLPFVMGVMSDLTGKTLEALPEVNDRKFMEIDLDNFDERMKSTQPRVAFQVDNTLTHDGKLNVELIFEKMEDFQPDVIAKKVEPLAKLLEARTQLANLLSYMDGKSGAEQLIADILQNPALLKSLADAPKPTEGVADTESITDTEEAENKE

SEQ ID NO: 9068 - protein, 500 aa, Xenorhabdus bovienii
  Peptide sequence Name=Xb4151_4152.C440.gene134.pep
  Gene classification: Function=Uncharacterized BCR; Function class=S Function unknown
  Homolog annotation: Query=12..498bp; Hit=11..496bp; Blast score=724; Percent Identity=71.0; E value=0; Homolog= PA0084 COG3517
MSTTEQETEFQQEQLSKEYTPDELSVLLNKEFRPQSDQARSAVESAVTTLAQQALENTVTISGDTYRTIQALITEIDKKLSQQINHILHHDEFQALEGAWRGLHYLVNNTETDEMLKIRVMCISKKELGSTLKRFKGVSWDQSPVFKKIYEAEYGQFGGEPYGCLIGDYYFDHTAPDVELLREMAQISAAAHCPFLSGASPSVMQMECWQELSNPRDLTKVFQNTEYAPWHSLRESEDVRYLGLTLPRFLSRLPYGNKTNPVDNFNFEEDTEGPTHSNYTWANAAYAMAVNINRSFKLYGWCTSIHGVESGGTVENLPCYTFPTDDGGVDIKCPTEIAISDRREAELAKNGFIPLLHRKNTDMAAFIGAQSLQKPSEYYDHDATANANLSARLPYLFACCRFAHYLKCIVRDKIGTFQERNDMENWLNNWIINYVDGDPTNSSAGTKARKPLAAAEVQVEEIPSNPGYYHAKFFLRPHYQLEGLTVSLRLVSRLPSLKST

SEQ ID NO: 9069 - protein, 167 aa, Xenorhabdus bovienii
  Peptide sequence Name=Xb4151_4152.C440.gene135.pep
MSDFNSMYNTHSFVQFEGIEGESQTKGYEKWIGVQFISRAIINPANGLTDIGSWGSGKGILSHFMLHINYDKAISALEKYAVTGKHIKTTKIHILRFIGDNEPAIWAKYELTNTYISEIGSGQPSDNVITVGLKMKKFQFNYTPADYEGKKQAETTWTWDLEKNVIE

SEQ ID NO: 9070 - protein, 517 aa, Xenorhabdus bovienii
  Peptide sequence Name=Xb4151_4152.C440.gene136.pep
  Gene classification: Function=FHA-domain-containing protein; Function class=T Signal transduction mechanisms
  Homolog annotation: Query=292..501bp; Hit=190..385bp; Blast score=68; Percent Identity=25.0; E value=1e-11; Homolog= PA1665 COG3456
MRFTIVKNIGTSQPQQLSYDFMPPGGTIGRSPDNNWILPDEGQAIARLQATVSVSIDGECRMTNRGAASDILLNTIPIAPDRRIEIRDGDTLNIGDYQIQVININQGSNNTNSVNTPPLTTIRKDIPSEIWDGLENTFTPDESMPQTPQQVAKTLNDNNPLIKPQRHQERNPINPLEQMETIIDLDSLQHRATDPITMFNANTDSQQENILNDSTPSTLLQQGNQRDKPEIDPLILFSDKHRRGILHDEPLNWVMENAEPLVAQANTGSSDPQYGASDPPFHRHNNEHLDIDPVTYPPNPHQPDQAEEGVKLEGQLLAALLEGMGLNHLQNLQFDGHTLYKLGKLLSQLSQGIIALNASRTQLKYETDTGVAQILVDGNNPFALFPSGQAVLIQMIGEHMPGFMSAEQATRDILIELQAHQLGMIAGLRTITAEMLQRFDPLVVKQKAQAAGRLPRLALSSTYKAALWDYFTKHYQKNMEKIEQDHTIFGEQFRQAYESEIIRYKHSQDKLKNKDKK

SEQ ID NO: 9071 - protein, 184 aa, Xenorhabdus bovienii
  Peptide sequence Name=Xb4151_4152.C440.gene137.pep
  Gene classification: Function=Uncharacterized BCR; Function class=S Function unknown
  Homolog annotation: Query=19..177bp; Hit=2..158bp; Blast score=100; Percent Identity=37.0; E value=1e-21; Homolog= PA0087 COG3518
MKDNITLLHGGYHFRKPPARITARDRMQSSLLDRLTDNEPDKKKENMNNYLLSHRTFRQNVLRDLQWLLNSINKEPNQDFSCFPEIQRSAYNFGIAPLAGKNISDIEWSDIQNKIIKAIHIFEPRIIPNELQVNCISDIRSLSLYNTLSIEIKGFLWCIPWPIEFLFRSNLDLEHGYFTMKEAG

SEQ ID NO: 9072 - protein, 624 aa, Xenorhabdus bovienii
  Peptide sequence Name=Xb4151_4152.C440.gene138.pep
  Gene classification: Function=Uncharacterized BCR; Function class=S Function unknown
  Homolog annotation: Query=1..621bp; Hit=1..616bp; Blast score=481; Percent Identity=42.0; E value=1e-136; Homolog= PA0088 COG3519
MDSKLLEYYNRELVYLREMGKEFAERYPKIANRLGMHGIDIADPYVERLIEGFAFLTSRIQLKMDAEFQHFSQHLLEMLYPNYLAPTPSMAITELQPDMSKGDISHGFLVPHGSIMRCQSLENDGITLQYSTTQDVILQPLKLQKVELGKIPANFPLVGLNLHHYGAVSALRIRLACKGKLFLHDLDLNKLTFFLSGPDIQSQKLLELIMEHSVGMVCQTQGASPQYLTLPDIAPHHEGFDDEQALLPNDPRNFSGYRQVQEYFAFPARFRFFSICGMQPLLKETKEDVEFELILLLNKTDSRLESLIDISYLALNCTPVINLFPKMTERLTVDESTNEYHLVVDNTRPLDYEIFSVQRLLGIDAQHKQERIFRPFWSTNSDDPDNYGAYFSLRREPRILSEHAHHYGTRTSYIGTETFISIVDEHHSPWPDTLRYLSADVMCTNRDLPAMLRQKDINSFAMLDSIPISKIEFIKRPTIPRPALAEGAVSWKLISQLQINYMNFMDQNQEEGTQTLRQLLSLYADLAEPAVVRQINGIRHCSLKEVYRRVPDTGLIVFARGVSIKLEVDEQEFAGASPWLLGSVLEKLFSRLVTINAFTEMTLYSQQRGQVGFWPARMGSKKLI

SEQ ID NO: 9073 - protein, 358 aa, Xenorhabdus bovienii
  Peptide sequence Name=Xb4151_4152.C440.gene139.pep
  Gene classification: Function=Uncharacterized BCR; Function class=S Function unknown
  Homolog annotation: Query=22..337bp; Hit=18..319bp; Blast score=226; Percent Identity=40.0; E value=2e-59; Homolog= PA0089 COG3520
MKTDITAIHRVCRLPEYFWQQLTQAPWQFDLFQTLRRIDAQAGGYYRLGTAPLPRYEPLRLGQKASMAFAPSTISTVHQLKNSKLYEVLIYSFGLFGPNGPLPLHLTEYTYSREYNYQDPTLGAFTNLFHHRLILLFYRAWANAQPTSSLDRPDNQKFCHYMACLIGMGLSAQQNSNPVNHNHITRNSINNHAHYALSGHLSRQRHNAEGLKKIMLFYFKVPVKIIQNIPQWLQIETQDQARLAAGRHVPCLGKSAILGIAIHDIQHKFRIELGPLTQAEYDMFLPEQTKSQQVREWVYQYLGIEYGWDIRLILDKSDITEMRLSETGKLGLNSWLGKVNKSSHYDDLIYNPKSCKTH

SEQ ID NO: 9074 - protein, 877 aa, Xenorhabdus bovienii
  Peptide sequence Name=Xb4151_4152.C440.gene140.pep
  Gene classification: Gene name=ClpA; Function=ATPases with chaperone activity, ATP-binding subunit; Function class=O Posttranslational modification, protein turnover, chaperones
  Homolog annotation: Query=1..877bp; Hit=1..900bp; Blast score=1005; Percent Identity=57.0; E value=0; Homolog= PA0090 COG0542
MPEISRSVLFGKLNRVLFTSLENATTFCKLRSNPYVELVHWLHQLMQQQDCDLQSVIRYFALDEAKLAKDIITALDRLPRGASAISDLSEHIDSAVERAWVYGSLKFGVDKIRTAHWLIGMLKTFNLYNTLKAISRQFEQVNADTLIDNFNAICGNSSEEPENEPPSHHSQPTKPQSSDSALRQYGQNLTDLARHGDIDPVSGRDEEIRQIVDILMRRRQNNPLLTGEAGVGKTAIIEGLALRIAANEVPPPLQNVQLWLLDIGMLQAGAGIKGEFESRLRRVIDEVQSSPLPIILFIDEIHTLIGAGGQQGTGDAANLLKPVLARGQLRTLGATTWSEYKKYIEKDPALTRRFQVVQIHEPDEAKALLMLRSLVWTLEKHHRVLLLDEAVEAAIRLSHRYIPARQLPDKAVALLDTACARVAISQNAEPPQLENCRHKIDALKIELEIVEREAKMGIGDQQRSNTILNALSLLEEQLIQLENRWQQELSLINRIIHLQTQLYAPSFHQQQHNDPNALHEELIALQQQLKTLQGEIPLIFASVDSNVVSAVVSDWTGVPLGRMVKDEINAVLHLVDTLNQRIIGQYHALELIAKRVRTSRAKLDDPNKPVGVFMLCGPSGVGKTETALALAETLYGGEQNLITINMSEFQEAHTVSTLKGAPPGYVGYGEGGVLTEAVRRRPYSVVLLDEIEKAHSDVHEIFFQVFDKGWMEDGEGRHIDFRNTIIILTSNIGADLVSSLCLQQAPLPDPEKLSTALRKPLLHVFPAALLGRLIVIPYYPLSDNVMTSIVHLQLARIKKRLLENHDIVATFDEPMIKYIVGRCTEIESGGRMVDAILTNSLLPQISQLLLSANANGQQYHQLQVSLGQGEFQFQFME

SEQ ID NO: 9075 - protein, 40 aa, Xenorhabdus bovienii
  Peptide sequence Name=Xb4151_4152.C440.gene141.pep
MDDVIRAMTLKHQQPLINILLITSSFHELELKLTLSERDL

SEQ ID NO: 9076 - protein, 49 aa, Xenorhabdus bovienii
  Peptide sequence Name=Xb4151_4152.C440.gene142.pep
LEIVCRYSPITPPTLNSAFNICDRHNLQMQRYARNSSCQPNVFRQAGFT

SEQ ID NO: 9077 - protein, 242 aa, Xenorhabdus bovienii
  Peptide sequence Name=Xb4151_4152.C440.gene143.pep
MGEYRHTISNIIAMPSDVLLQKTVEVIFHQEKRFHYFLDTPKHKPGDRLNIIGHSSPVGSPILFAGAYVNSFGMNPRVFCQTINALLTDIKNRGKNIQCVRIIACYSGANNLAQKLANYINMPVKGSLGGTRVYPTMQFHSIPNINRHFIDKTDIGGHYYFEERERQLMHDPSYGLYRWYKPKSSNPDSEFDEFASQRVSRLQRSDSDSEFDTFVSQRVSRLQRSDSDSEFDTFVSQRVKRK

SEQ ID NO: 9078 - protein, 231 aa, Xenorhabdus bovienii
  Peptide sequence Name=Xb4151_4152.C440.gene144.pep
  Gene classification: Function=Putative transposase; Function class=L DNA replication, recombination and repair
  Homolog annotation: Query=8..213bp; Hit=2..214bp; Blast score=205; Percent Identity=54.0; E value=2e-53; Homolog= mll9070 COG3316
MFLIRKAFRCLHYPTDVIAQCVRWYLAYALSLRDLEGMLAERGITVDHSTLSRWVHHLIPLRVKRYRRSKPAVGRRWRMDETSIKIKGKWSYLYRAADSDGDTVYFLLTAHRDKEAALRFFKKAMRQHGQPDVVTMDKSGANKAAVDELNQGKPKDNDIIIRQNKYLNNLIEQDHRNIKRRTRPMLGFKNFRRAQTVLAGIEWVCMLRKGQYRQKEGCPISPAAFFYQLAE

SEQ ID NO: 9079 - protein, 103 aa, Xenorhabdus bovienii
  Peptide sequence Name=Xb4151_4152.C440.gene145.pep
VNHSTKKQHDTRTRLNTTEPTLFATVPFVLENVNYQTPIIRLKFPLIEVITDMAVNGGLMESLCLDDHHRTPPFRSQKDSFYSVSYLTIASCVVKTLKFDFLF

SEQ ID NO: 9080 - protein, 47 aa, Xenorhabdus bovienii
  Peptide sequence Name=Xb4151_4152.C440.gene146.pep
  Homolog annotation: Query=1..47bp; Hit=1..47bp; Blast score=92; Percent Identity=95.0; E value=2e-18; Homolog= gi|37528190|ref|NP _931535.1| Transposase, IS630 family [Photorhabdus luminescens subsp. laumondii TTO1] gi|36787627|emb|CAE16734.
MKIFITSEQKIKLERLHDTTRDGQVRDRIKAILLASEGWSSVMIVKA

SEQ ID NO: 9081 - protein, 73 aa, Xenorhabdus bovienii
  Peptide sequence Name=Xb4151_4152.C440.gene147.pep
  Homolog annotation: Query=1..67bp; Hit=1..67bp; Blast score=123; Percent Identity=88.0; E value=9e-28; Homolog= gi|37528067|ref|NP _931412.1| hypothetical protein [Photorhabdus luminescens subsp. laumondii TTO1] gi|36787504|emb|CAE16603.1| u
MNSNVYLLLNADNTRYNEILKSADIAYPQPISNDWPDLPIEFQINIDDVINLNGYLYFFKGSQYVKFGHVLNG

SEQ ID NO: 9082 - protein, 92 aa, Xenorhabdus bovienii; identical to SEQ ID NO: 6203
  Peptide sequence Name=Xb4151_4152.C440.gene148.pep

SEQ ID NO: 9083 - protein, 96 aa, Xenorhabdus bovienii; identical to SEQ ID NO: 5468
  Peptide sequence Name=Xb4151_4152.C440.gene149.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 9084 - protein, 378 aa, Xenorhabdus bovienii
  Peptide sequence Name=Xb4151_4152.C440.gene150.pep
  Gene classification: Gene name=SerA; Function=Phosphoglycerate dehydrogenase and related dehydrogenases; Function class=E Amino acid transport and metabolism
  Homolog annotation: Query=4..375bp; Hit=1..372bp; Blast score=503; Percent Identity=70.0; E value=1e-142; Homolog= pdxB COG0111
MRKVKILVDENMPYAEQLFQQLGEVQAIPGRPVPAGALEQADAFMVRSVTKVNESLLKGSSVKFVGTATAGMDHVDQQWLSQAGIGFSAAPGCNAIAVVEYVFSALMLLAERDQFQLKDKTVGIVGVGNVGGRLADRLAALGVKTLLCDPPRVDRGDEGEFWPLEKLVQEADILTFHTPLNQSGRYQTYHLADAGLLSALPDNRILINASRGEVVDNQALLSVLQSGKKLRVVLDVWEPEPNLSLPLLALVDIGTPHIAGYTLEGKARGTTQVFEAYCEFLGQPYRAELSDLLPEPDFSHITVHGEVTQSILKRLIHLVYDVRRDDAPLRQVAEQNGAFDRLRKNYPERREWSSLTVHCDSESSAQLLSEIGFNAKVI

SEQ ID NO: 9085 - protein, 336 aa, Xenorhabdus bovienii
  Peptide sequence Name=Xb4151_4152.C440.gene151.pep
  Gene classification: Gene name=Asd; Function=Aspartate-semialdehyde dehydrogenase; Function class=E Amino acid transport and metabolism
  Homolog annotation: Query=1..336bp; Hit=1..337bp; Blast score=445; Percent Identity=67.0; E value=1e-125; Homolog= usg COG0136
MSEGWNIALLGATGAVGEAILALLQERQFQVGELHLLASEQNAGKIQRFNGKSITVYDAAEFDWSQVQLAFFAATKEATAQYVEKATEAGCLVIDSSGLFAAEPDVPLVVPGVNPHALAEYRNRNIIAVADSSTSQVLTAIKPLIDLAGIARLNLTNLLPVSVHGKAAINELAGQSARLLSGVPPDESLFNKQLAFNLLPLLPDAEGSVREERRIVDQIRRILQDEGLPISVSCVQSSVFYGIAQMVSVETLRPVGTEEAREELERFAEIQVSEEGDYPTQVTDASGSDRLSIGCLRNNYGMPEMLQFWSVADNIRFGGALMAVEIAEKLMQEQFY

SEQ ID NO: 9086 - protein, 279 aa, Xenorhabdus bovienii
  Peptide sequence Name=Xb4151_4152.C440.gene152.pep
  Gene classification: Gene name=TruA; Function=Pseudouridylate synthase (tRNA psi55); Function class=J Translation, ribosomal structure and biogenesis
  Homolog annotation: Query=17..276bp; Hit=11..270bp; Blast score=435; Percent Identity=80.0; E value=1e-122; Homolog= truA COG0101
MSDAELSQSVPEAEKVKIALGIEYDGSRYYGWQRQQEVKSVQECLEKALSKVADEPISVFCAGRTDAGVHATGQVVHFKTSAQRKDAAWTMGVNSHLPPDIAVRWVKTVDDEFHARFSATARRYRYIIFNHRYRPAVLAQGVTHFHYLLDERKMHEAAQSLLGENDFTSFRAVQCQSNSPWRNMMHINVSRHGHYVVVDIKANAFVHHMVRNIVGSLLEIGCSNQDIGWMAELLALKDRTKAAATAKAEGLYLVAVDYPEHFGLPAPTMGPLFLANDLI

SEQ ID NO: 9087 - protein, 229 aa, Xenorhabdus bovienii
  Peptide sequence Name=Xb4151_4152.C440.gene153.pep
  Gene classification: Gene name=DedA; Function=Uncharacterized membrane-associated protein; Function class=S Function unknown
  Homolog annotation: Query=8..217bp; Hit=1..210bp; Blast score=316; Percent Identity=80.0; E value=1e-86; Homolog= dedA COG0586
MEFLTHFVDFAKFIVDFILHIDAHLKELVSDYGNWVYGILFLIIFCETGLVVTPFLPGDSLLFVAGALSALDSNDLNVHIMVALMITAAIIGDAVNYTIGRIFGEKLFTNPNSKIFRRSYLDKTHEFYEKHGGKAIILARFVPIIRTFAPFVAGMGKMSYRHFAAYNVIGAFIWVLLFTYAGYLFGDMPIIQQNLKLLIVAIIFISILPGIIEIWRHRRAASKKAVDGK

SEQ ID NO: 9088 - protein, 315 aa, Xenorhabdus bovienii
  Peptide sequence Name=Xb4151_4152.C440.gene154.pep
  Gene classification: Gene name=AccD; Function=Acetyl-CoA carboxylase beta subunit; Function class=I Lipid metabolism
  Homolog annotation: Query=1..285bp; Hit=1..283bp; Blast score=474; Percent Identity=82.0; E value=1e-134; Homolog= accD COG0777
MSWIEKILNKSKIMQTRKASIPEGVWTKCDSCGQVLYRAELERNLEVCPKCDHHMRISARERLHTFLDQGTGIELGSELEPKDLLKFRDTKKYKDRLVAAQKQTQEKDALIVMKGSLYEMPVVAGSFEFAFMGGSMGSVVGARFVRAVEQSLEDNCPLVCFTSSGGARMQEALMSLMQMAKTSAALAKMQDRGLPYICVLTNPTMGGVTASLGMLGDINIAEPKALIGFAGPRVIEQTVREKLPAGFQRSEFLLEKGAIDMIVRRPEMREKIANLLSMLTRQPHPGTKVETVAEMVAEPAEVETDININPNKEDV

SEQ ID NO: 9089 - protein, 432 aa, Xenorhabdus bovienii
  Peptide sequence Name=Xb4151_4152.C440.gene155.pep
  Gene classification: Gene name=FolC; Function=Folylpolyglutamate synthase; Function class=H Coenzyme metabolism
  Homolog annotation: Query=4..432bp; Hit=3..422bp; Blast score=497; Percent Identity=59.0; E value=1e-140; Homolog= folC COG0285
MSDILQIPQATSSLITWLSYLGNLHAKAIDMGLERVGALADQLDLLHPAPKVITVSGTNGKGTTCHTLESILLAAGLKVGVYSSPHLVRYTERVRIQGKEPAEQDFCRVFADIEAQRGDITLTYFEYGTLAALQLFKEADLDVVILEVGLGGRLDATNIVDSDVAAITSIALDHIDWLGADREHIGREKAGIFRQGRFAVVGEPDMPHTIAEVADELGAKLFRRGADWDFSQDANSWYWRTGDQQFSELPVPNLPLANAATAMGVIYCLLQQNDNVSQAINEQAIREGLSKAQLPGRFQIVRENPLVILDVAHNPHAAGYLVQKLAKLPRAPDSKIRGVVGMLEDKDIAGTLACLAQQVDEWYCASLHEFRGAEANILAEHLGDARTFVEVEQAWHQAMAEASVQDIIVVCGSFHTVAHVMEALEEVKEGGK

SEQ ID NO: 9090 - protein, 229 aa, Xenorhabdus bovienii
  Peptide sequence Name=Xb4151_4152.C440.gene156.pep
  Gene classification: Gene name=DedD; Function=Uncharacterized BCR; Function class=S Function unknown
  Homolog annotation: Query=1..229bp; Hit=1..219bp; Blast score=157; Percent Identity=49.0; E value=1e-38; Homolog= ZdedD COG3147
VASKFQNRLVGTLVLVALGIIVLPVLFDGDKKHNESQFASIPLALKPGDEEDIDLIAPLTQDMPSTPPEGAAEAMAKQAQELQPDMLSSSLLSEPAPMAPPPVEITQAPKATVKSEPNPQPKVDVKRETRAETKPEVKSESKTTPVKAPQGVAYVVQLGALKNAGKVDEIVAKLRLSGHQVYVIPSSPVQGELTRIYVGPNASRQTLESTLPELKELTGLQGQIKNYSP

SEQ ID NO: 9091 - protein, 46 aa, Xenorhabdus bovienii
  Peptide sequence Name=Xb4151_4152.C440.gene157.pep
LRSRFFSLLKIIRNRFKNNNRRKNLTCNYHDGKPDTSRKTPISQGL

SEQ ID NO: 9092 - protein, 168 aa, Xenorhabdus bovienii
  Peptide sequence Name=Xb4151_4152.C440.gene158.pep
  Gene classification: Gene name=CvpA; Function=Uncharacterized membrane protein, required for colicin V production; Function class =R General function prediction only
  Homolog annotation: Query=1..160bp; Hit=1..160bp; Blast score=229; Percent Identity=81.0; E value=8e-61; Homolog= ZcvpA COG1286
MVWIDYTIIAIIGFSALVSLIRGFVREALSLVTWGCAFFVASHFYTYLAAYFTRLEDELVRNGVAIAILFIATLIVGAVVNYVLGSLVQRTGLSGTDRVLGICFGALRGVLIVSAILFIADSFTPLPKSEDWQQSQLIPQFSQIIRWFFDYLQNASSFLPEKSLSPLG

SEQ ID NO: 9093 - protein, 510 aa, Xenorhabdus bovienii
  Peptide sequence Name=Xb4151_4152.C440.gene159.pep
  Gene classification: Gene name=PurF; Function=Glutamine phosphoribosylpyrophosphate amidotransferase; Function class=F Nucleotide transport and metabolism
  Homolog annotation: Query=6..510bp; Hit=1..505bp; Blast score=850; Percent Identity=81.0; E value=0; Homolog= purF COG0034
MRKNYMCGIVGIVGFTPVNQSIYDALTVLQHRGQDAAGIATIDGNNEFRLRKANGLVKDVFETRHMLRLQGTTGIGHVRYPTAGSSSASEAQPFYVNSPFGITLAHNGNLTNAHKLKKMLFEHARRHVNTTSDSEILLNIFANELTQFPDFPLEPDDIFAAIAEMHKKIRGAYACVALIIGHGLVAFRDPNGIRPLVLGKRVLEDGRNEYMVASESVALDTLGFEFLRDVASGEAIYITEKGQLFTRQCVENPALTPCLFEFVYFARPDSFIDKISVYNARLRMGRKLGEKIAREWEDLHIDVVIPVPETSCDTALEIAHILDKPYRQGFVKNRYVGRTFIMPGQQERRKSVRRKLNANRAEFRGKNVLLVDDSIVRGTTSEQIVELAREAGAKKVYFASAAPEVRFPNVYGIDMPNANELIAHGREVDEIRQLIGADALIYQDLRDLINAVREENPDIEKFECSVFDGIYVTKDIDQIYLDYLENLRKDDAMKLRGQSEIEDLEIYNEG

SEQ ID NO: 9094 - protein, 194 aa, Xenorhabdus bovienii
  Peptide sequence Name=Xb4151_4152.C440.gene160.pep
  Gene classification: Gene name=UbiX; Function=3-polyprenyl-4 -hydroxybenzoate decarboxylase; Function class=H Coenzyme metabolism
  Homolog annotation: Query=1..189bp; Hit=1..189bp; Blast score=305; Percent Identity=84.0; E value=1e-83; Homolog= ubiX COG0163
MKKLIVGLTGASGAIYGVRLLQVLQSVEGIETHLVISQSARQTLALETDYTLRDVQALADVVHDNRDIAASISSGSFKTLGMVILPCSIKTLSGIVHSYTDGLITRAADVVLKEGRKLVLSVRETPLHLGHLRLMTQAAEIGAVIMPPVPAFYHRPDHIQDIIDQTVNRVLDQFNIELPQDLFNRWQGAKQIEI

SEQ ID NO: 9095 - protein, 304 aa, Xenorhabdus bovienii
  Peptide sequence Name=Xb4151_4152.C440.gene161.pep
  Gene classification: Function=Predicted nucleoside-diphosphate sugar epimerases (SulA family); Function class=R General function prediction only
  Homolog annotation: Query=1..298bp; Hit=1..297bp; Blast score=397; Percent Identity=61.0; E value=1e-111; Homolog= yfcH COG1090
MRILITGGTGLIGYRLTCQLLSLSHSITILSRSPQKVYSLFSEQVECWATLNNKNNLNDFDAVINLAGEPIADKRWTSAQKTKLCQSRWQLTEKLSHLINASEFPPSVFISGSAVSYYGDQGQAVVSENDLPHDEFAHQLCKQWETLALQAESEKTRVCLLRTGIVLASNGGVLKKMLPLFRLGLGGKMGDGKQYIPWIHIDDMVNGIYYLLVSPELSGPFNMTAPYPVHNDLFSAALANVLHRPAFIRMPAFVLKIIIGEAAMLVLGGQQAIPKRLEEGGFGFRYFELEEAFKDLLKEEANSP

SEQ ID NO: 9096 - protein, 206 aa, Xenorhabdus bovienii
  Peptide sequence Name=Xb4151_4152.C440.gene162.pep
  Gene classification: Gene name=Gst; Function=Glutathione-S -transferases; Function class=O Posttranslational modification, protein turnover, chaperones
  Homolog annotation: Query=1..202bp; Hit=1..202bp; Blast score=283; Percent Identity=65.0; E value=1e-76; Homolog= ZyfcG COG0625
MIDLYYAPTPNGYKISLFLEEAGLPYTIYPINIGTGEQFKPEFLAISPNNKIPAIVDHQPADGGEPISIFESGAILLYLANKTGQLLSKDVRERNQQLQWLFWQVAGFGPMLGQNHHFNHYASEVVPYAINRYMEESRRLVNVLNTQLEKTPYLGGNEYSIADIATYPWARCHEHQKINLNDYPAVEKWLKKIEQRPATQAAYNNG

SEQ ID NO: 9097 - protein, 41 aa, Xenorhabdus bovienii
  Peptide sequence Name=Xb4151_4152.C440.gene163.pep
MGGILQTTQISGNVLKLYLPIRYYYQRLYDRPILCSNAKRL

SEQ ID NO: 9098 - protein, 177 aa, Xenorhabdus bovienii
  Peptide sequence Name=Xb4151_4152.C440.gene164.pep
  Gene classification: Gene name=MutT; Function=NTP pyrophosphohydrolases including oxidative damage repair enzymes; Function class=L DNA replication, recombination and repair
  Homolog annotation: Query=1..175bp; Hit=1..175bp; Blast score=257; Percent Identity=77.0; E value=4e-69; Homolog= yfcD COG0494
MVEEKSAGIEWIDIVNEGNEVIAQATRQQMRSQNLRHRATYIVVHDGMGKILVQHRTETKDFYPGRLDATAGGVVMVGENMLDSARREAEEELGIAGVPFAEHGIFYYEEKTCRTWGGLFSCVSHGPFALQEEEVSAVYWLSPEEITARCDEFTPDSLKALSLWLARNRQRELPENG

SEQ ID NO: 9099 - protein, 127 aa, Xenorhabdus bovienii
  Peptide sequence Name=Xb4151_4152.C440.gene165.pep
MIAFNLKRGLTMINYANSFWCKAINIAIVGVIYFFLMNISRVASSIGDYLIFFLFFSCIQISVEIIYDNINSFSSKYLNQTLLNNVMALIEVKGNYRGFYQLWGLITSMYWCFIFYKYYLFTPYYQK

SEQ ID NO: 9100 - protein, 2288 aa, Xenorhabdus bovienii
  Peptide sequence Name=Xb4151_4152.C440.gene166.pep
  Gene classification: Function=Polyketide synthase modules and related proteins; Function class=Q Secondary metabolites biosynthesis, transport and catabolism
  Homolog annotation: Query=22..938bp; Hit=36..881bp; Blast score=325; Percent Identity=29.0; E value=3e-88; Homolog= ML0135 COG3321
MLFTGVFYSIHEECMSETYFLHDRKVRGDIAIVGMASHFPDAPDLYKFWENIIGKKDSLTDVSTMLGDEYWQKEDFYDPNPAVADKTYGHRAGFVPPIDFDPVEFKIPPAIIDSISTAQLFALYVAKQAMLDAGLVGQENSRVDRDRIGVILGGAGNGNTSFSLASRQQAPYLRKIMVKSGLSEKVANDIIERMHGMYLEWNEDSFPGFLGNVACGRIASYFDLGGTSYMVDAACASSLAAIKAAIGELHSGSCDAVLTGGVNLENSIFSFLCFSKTPALSKSNLSRPFDQSADGMMLGDGVGMLVLKRLEDAELDGDRIYAVIKSIEASSDGRAKSIFAPRLEGQAKALRRAYASAGLSPNDIQLVEAHGTGTASGDDTELKSLHTVFGEYQVPAKSVAIGSIKSQIGHTRCAAGAASMMKVALALHHKVLPPTLNVDKPTNLLKAENSPFYVNSEARPWLRSFNSAPRRAALSAFGFGGTNFHVILEEYEKHTHGRYRLNESPWVMLFKGHNPAELLAQCEEALTRFSGNLPDIAIRQHLEQQDIDSLQPQQARVLFVSQSAEQTVELLSIAIKQLQQNSTHGWEHPRGIYYQPQGKMLDGKIVALFPGQGSQYVNMARDIANDYPEMRQSLETLDEVSISELGHELSPVVYPVPTFSDDERQIHQQRLTDTANAQPALGAISAGYFNILKGMGFVPDFVAGHSYGEVTALWAAGVFSDKNFHRVSLARGWAAASASDHRGADTDAGAMLAASLNSAQRAQILERYSGIIIANDNSQQQVVFGGATPLIHQLHDELKKRDVHCRILPVSAAFHTAFIEPAYQPYRERLAGINFQSPQCRLFSSATAEPYGNSPQAIRELLAEQLIKPVQFRQTIEAIYQEGGRLFVEVGPKGVLGKLVADILKDKEHEVISVNPNDKGEDRLQFARAQAKLLAVGVKLREINQHIRPQPMAEDKSKRLTFRMSGGFYLSQKNKARRQRALRDGDSAIVEQFIAESAPVPMAPVMPLHSQKEVNIKEEHSGKEVKPTQEVHPTQEVVVEKVENKVEKIAENKTISAQFIQQNMLTIIQRRESTMEQNNQLSENVDVNMLNGLLQAQQVMSQLHQQFQANQKDYIQLLGMLLDKQYTLLETCKDHQNLPSMLSSLSQSVQLLDKNLELYHSNHEHYFMAQQSLFQSGQVTPMIAPTHRTSSPVVDYSALAKVTTSATIASAPVSTPIPTPIPTTAPAVKVDTAPVQAKPVDPIKEIEPVRSMMPEMPVMPSVVEEAVKPIVNDTPVSQPTPVVIETKAKVLDPKVEKQFQILSQITEEKIVNQLISIVSDRTGYPQDMITPEMDLEADLGIDSIKRLEIFGAMFDAFSANVGLYNEASRNKDLENFEVDSLSNISKMGVFFKQMLDDVMNDLLGNGGDEAVAEQSPPSVETREHENTKSNVVPDSGGATGKLQSLGFFTSTVTSPEADSVKKPLAEPQLIVPSVVQPVLKNEIVLNEEESFAGSPVSRFAVVKQSLPMPDRLQGVFSSPKRWLVVDEGTTTVDDVVNALRQQGQQVAVLMLKQNPAVMESEAALDAALADIEQQHGTIEGVIYLQTPKQSVKALAEVFNEQDYRSVETTFLLAKRLQRSLNHDEQKTGYFMVIMRGDGELLTSGREHLSIVSAGLTGLTKSLNIEWKNVFCRTVDIDARVKDSDAAKMVVEELQDSRTDMGEVGRGVNGERMTLALTEENVLSAAFVNQVNAGDVLIVTGGARGITAQCVIELAKQSQATFILLGRTDITEPLPEWAEGKTTQDERKTAAMAYLKAQGIQLTPVKINGMLSRLTHLDEINGTLQAIRQAGGRVMYLHCDITDLKQVKIALTKAQQQLGQITGLIHGAGNLADKRIEKKTLADLHSVFNAKVKGLENLCRELDFTSLRHIMLFSSVSGFFGNAGQADYSLANETLNKFIYLPFKGKNSQIIRSVNWGPWDGGMVSDVLKRVYDAQNMAIIPLEEGTQRFVREFRDPGSLQITIGGANYKAEKTVKALGIGEQVDRQLSLDKNPFLYHHVIEGKSVLPMTAAIAWMARICEDRFPGYKLETITDFKVLKGIVFDNTLAESYCVAWVPNTFDESGDGRLALDVVITSKRMKHYQATLILSLQSREAQHEVVGIDLNAEVPQTLPFYDGVGGEGILFHGESFHGVQKVVHVDDDNITLKCCVMPVQLEMQGQFSTRLFNLFINDIAFQLPAIWFLQRNEMCLPNAIEKIEQYAELKFGQEFYASIEIKHQMSTEIIIDIIFYDEQGYIYSRFHNAKFTVFVE

SEQ ID NO: 9101 - protein, 1454 aa, Xenorhabdus bovienii
  Peptide sequence Name=Xb4151_4152.C440.gene167.pep
  Gene classification: Function=Polyketide synthase modules and related proteins; Function class=Q Secondary metabolites biosynthesis, transport and catabolism
  Homolog annotation: Query=2..454bp; Hit=35..469bp; Blast score=181; Percent Identity=29.0; E value=6e-45; Homolog= Rv2933 COG3321
MENIAIIGMGCLFPGADTLEKYWDNLLREKDCTTPLSALELGVDLDCYYSPVAGKPDTINYVKNGHVRDFHFDGKGYNLPEEELNSLDNLFKWTIYSAEQALNDSGYRQHKTVLEKTGLILGSIGMPTHSTKRLMSPFYQKILQPYIQQLIGRPDFHFDSVWPQANHSDQNLITGGHNATIAALALGLLGPRYCLDAACASALYAIKLGIDYLLSHKADMMLVGAICHTDHIYIDHGFNMLQVFPAKGESIPFDRSSKGVKAGEGSGIVAIKRYSDAIRDNDKIYGVIESFGLSNDAGAKHLLVPDLQGQRIALERAYQDNPQRVDYVECHATGTNIGDQVELSTIESFFGERGTMPLIGANKAINGHMLTASGMGGLLKVLLAMQHNMIPATPRVEQLVSTQKGLLNIDHVVREAKPWPVSNGPKRAGINAFGFGGVNAHMVIGEDTPERRAACTQAKLENRQKIERLSIVGIGVHMAKTEDGKTLDQTLQQGIQHFYPLPKTRWIGIEKRHDVLAMQGISQPPLGSYIETFEFDCKHFKLPPNVVGAHLSCHMFLLPIAERAFIDAGYTLNGSKRNIAVIVAGGVDYSSLRYQARNEISWQLSQSLASRGIHLSEEDTVALQEIVKDGLFPKPYPEGITGGIGNIVASRLAAHLKLNGPAFTLYGEENSPFKALELAQFMLSRQHVDAVMIASSSFGGSLENVLWDHQSNHGNQIVGDAGGVIILKREQDAIRDNTPVYAVLDGLSITYMPDHSIDFKGNEDAILAAARSGLEAAGCTADQIDYIELYAGGKPGEIAAEMSALGRVYASQNRQLTATIGTVKANYGHLFMTTGLLGIIKSALQLTQRYLPALPDYPQHQELAHYAEGKFQLPAHTQSWPAPATGPRRAAISHLGIDRAYSHVILSEPQSGKRARPTSRPESNQAGLKVLSYTAREKTVEELILNEQTLARFASLATAAHVNMAVTPADAETKVVYPEVSTLTMPLPMELNHFIRNAHTQLHYLQLEQTYYQLLKQHLAELPLIQSTTTESALVAPTKKRVTTSPVVFDEQQVLELTDGSVEKVLGADYAEVDSYPIRTRMPSPPFMFVSRITALSAVKGKLEPCYIEWEYDVPEDAWYAVNGRVPSFVALESSHAMIVAFTVIGCDLMFKGQRCYRAVDCNTTIYSEMPKTGDVLRGRVNITSVVRVGGLILVAYEYLCYVEERLVFRLVANSGFFGRKEIENAGNFDTSAYFAKGKNGIPAKPFTPLLHCDRTTFNEQDITNVMNGDLAACFGSQYQYNREGKLCVPDTRMLSRILNVDTAGGAFGLGQIVAELDIDPAHWAFKAHFKNDPVMPGTLLVEGSEQLMKFYLFYLGLNSQPDLEVHTLTEHTSGAKFRGEVKCERDVVQFRLTCKAIDALYSDDKLESITLFFIAETLYRGNVVGVSDNMGVRYERRQPHQIMAAELKQEALK

SEQ ID NO: 9102 - protein, 1026 aa, Xenorhabdus bovienii
  Peptide sequence Name=Xb4151_4152.C440.gene168.pep
  Gene classification: Gene name=HemL; Function=Glutamate-1 -semialdehyde aminotransferase; Function class=H Coenzyme metabolism
  Homolog annotation: Query=581..895bp; Hit=22..327bp; Blast score=210; Percent Identity=37.0; E value=7e-54; Homolog= MJ0603 COG0001
MSQRLSVNQSNHQLTALPLTIGISHLQALSTELRVVKVGESISLLLPDDIIAEQTTLLGRLPAVTAGSLGDAGFMADYGVNYAYYAGAMANGIHSEEMVIALGKQRILGIFGSGGLRIPRIAEAIARIRQALPEGPFGVNLLHNPGNPEWEMACVRLCIENQVRVIEASAYINLSSALVYYRASGLVQQADGTILRHHRLIAKVSRREVAQNFLRPAPEKILQKLLAEELITPEQAELARQIPMADDITVEGDSGGHTDQGVLACIFRSVVQLRDEIADETQHDYQVRIGAAGGLGTPHAILAAFALGAAYVVTGSINQACVEAGTSRAVKKMLGQAHINDVATAPSADMFELGAKVQVLKQGSMYAVRAQKLYNLYKQHDSLDTLPVQEIALLEKQIFHKPLTEIWQETIAYFQSIHQLDIIAKAEKQPKTKMALVFQWYLGQSSRWAITGDPVRNLDYQIWCGAAMGAMNEWLQGTPFEAVENRHVSDIAQLLMKGAAYLTRITLLELFNVAVPEQIKRYLPLHFYTGGENSPPNEFSHEPSNDDLTDHSQVENRHLNLMSIQKSQVRGKEPMDASTKLVLDNSKDFYKKCWELMPGGTHYNFGDPERPLVIPFNRGRNSRVWDLDGNEHLDLFCKFGALLVGHHNEAYNQSLIEYMGKVTSVDTCDLEVGVCETLVKHIPCAEMVRFCLSGTEAVQNALRLARAFTGKNRFIRFHGHYHGNADNIMGWRKKQDLTYPVPEQFNGDLLDTLGRDPKIMVDQTFMLPWNDIDVLTATIERYHNEIGAVLMEPLCINGGGIFPEEGYLEKTKALCEKHNIVLIFDEIITGVRLGLGGAQKILGVTPHLATFGKALGGGSMPISAIVGRSDIMNLYTRGKVIHAGTFNGYPLGLAAIQTTFNLIEQDPGCYDRMGNIMRQISDVFVKAAKAVDLPLVVQGMPTALVYHSQSIPVSSTEGYSDKVKFCDIIIREISKRYGIQFSPLSRMYSNLLMSQDDVRFFEERIFDAMVNARKVIDIAFKEGIDA

SEQ ID NO: 9103 - protein, 255 aa, Xenorhabdus bovienii
  Peptide sequence Name=Xb4151_4152.C440.gene169.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=4..250bp; Hit=6..244bp; Blast score=160; Percent Identity=39.0; E value=1e-39; Homolog= TM1724 COG1028
MSRQIAVVTGAAGGFGTAISKVLLDIGYLVAATDVSSQKLALLKERLGHPESLATFEMDVTDLASVEQAAQQIVETFGDTITVLVNNAGIINRAFCLSGQGFSETTKVINVNLIGAFNSTSIFVRYMARLKYGRIINIASVAGIWGAAGSSAYGASKAGLISATESWGRELGPLNISVTAVAPGVCKTDMLEQFVESGPMESAGEDKVVRSIVPVGRWGTPDDVAEVVGFLASCKTNYLNSAVIPLDGGMRVGTL

SEQ ID NO: 9104 - protein, 410 aa, Xenorhabdus bovienii
  Peptide sequence Name=Xb4151_4152.C440.gene170.pep
  Gene classification: Function=Putative dehydrogenase domain of multifunctional non-ribosomal peptide synthetases and related enzymes synthetases; Function class=Q Secondary metabolites biosynthesis, transport and catabolism
  Homolog annotation: Query=12..370bp; Hit=11..371bp; Blast score=115; Percent Identity=30.0; E value=7e-26; Homolog= PA4078_2 COG3320
MFDHNKKDVSSILLTGATGVMGGRILLEILTTTDIEVYCLIRAENSQQAMERLKGILFAYDQEKQSEHTHHRIIPVLGDVSKKRLGLTQELYRELADKVDRVIHCAANVSLVASYKKIAPVNVQGTQNVIDFCLRGNVAMLHASSFSMAGDRLYKDGFVLHETDLDVGQRFDDMDYERSKFESEKIIHSAGKKGLKWVIVRPGNIWGESTNGRYPLAHTKVKGIYYEMVKALVETGLTFNAQDDFDITPVDYVAEASLYAIFNIEKFNGKTLNLTNPNPITFNDIVSFLRDFGYRIDTINMNDYMEALSQNRLYRYDQPYRSVFTDLLGLFYSGMELTEKAKYSTQLTTELLSGSGIQCPLSDRTLLFHYFNYLVECEFIAPPQQQGERAEIREASVRGSYLEQLFDADL

SEQ ID NO: 9105 - protein, 307 aa, Xenorhabdus bovienii
  Peptide sequence Name=Xb4151_4152.C440.gene171.pep
  Gene classification: Function=Predicted amidohydrolase; Function class=R General function prediction only
  Homolog annotation: Query=46..298bp; Hit=4..255bp; Blast score=238; Percent Identity=46.0; E value=7e-63; Homolog= ZyafV COG0388
MRIYEATWLHLDPDLLQGLFIKQSNKRQVMTEICIESELAMIEQNLKVTLVQTDLVWENAEQNREHIEQHIDQITGSDLIILPEMFTTGFSMKPQAIAETMTGPSIQWMKAMAAKKDCAIVGSIIITENQRFYNRLLWVNPDGSVAHYDKKHLFTFAQEDHEYTAGNAPLVVNFKGWKIAAFICYDLRFPVWSRNVNGHYDAAIYIASWPARRSAHWCSLLQARAIENQSYIIGVNRVGQDGNQLDYDGHTMLIDPLGEILLHEMNHEVVKTVHLSLSHVQGVRERFPFLKDADLFVLNNDVLGNDT

SEQ ID NO: 9106 - protein, 53 aa, Xenorhabdus bovienii
  Peptide sequence Name=Xb4151_4152.C440.gene172.pep
MLLLPEEYSFQRGETGGSSHLPSTMQSYVRYHFLTHRCSKQRDQHLSEMGNVP

SEQ ID NO: 9107 - protein, 72 aa, Xenorhabdus bovienii
  Peptide sequence Name=Xb4151_4152.C440.gene173.pep
MQCLSQSQLFLLQGGFGLKCMFLHMHTTSGKFHCYPSYLSSFGFVGCNWKSIRYGWSEFDSASGRCSQTIRS

SEQ ID NO: 9108 - protein, 249 aa, Xenorhabdus bovienii
  Peptide sequence Name=Xb4151_4152.C440.gene174.pep
  Gene classification: Gene name=EntF; Function=Non-ribosomal peptide synthetase modules and related proteins; Function class=Q Secondary metabolites biosynthesis, transport and catabolism
  Homolog annotation: Query=23..243bp; Hit=495..697bp; Blast score=92; Percent Identity=32.0; E value=3e-19; Homolog= PA2399_1 COG1020
MKFAGGRMHMQKHTFQPKAPLEQKQLRLTQTLHQAFEQKVQRYPHAIVLNTENGLGLTYEQFNQRANQLAHYILQIKQQMGETDAFSPVIGICLEHDEEMLVSILAILKAGLAYLPINSTHGAERIGFYIEDAGVKLVIGVLQYQSLFDESKVDYLCIDSEKAFIQTMPLHNPDVSIHSDSLACIAYVSKTAGVSKSVDISHTSAMRLSAMRLLRAEKHHLDLTENNSTENDIWTLLDASTFEVHTMGK

SEQ ID NO: 9109 - protein, 42 aa, Xenorhabdus bovienii
  Peptide sequence Name=Xb4151_4152.C440.gene175.pep
LKFTRWENDVTNIYVTLFSESTTYHQMRHREFYGYSTQRESD

SEQ ID NO: 9110 - protein, 314 aa, Xenorhabdus bovienii
  Peptide sequence Name=Xb4151_4152.C440.gene176.pep
  Gene classification: Gene name=CcmA; Function=ABC-type multidrug transport system, ATPase component; Function class=Q Secondary metabolites biosynthesis, transport and catabolism
  Homolog annotation: Query=8..314bp; Hit=13..301bp; Blast score=195; Percent Identity=39.0; E value=5e-50; Homolog= TM0389 COG1131
MGIQHNEKVIEFEQVKKHYKDYQALKGISLDVYRGEFLGLLGPNGAGKTTLVEILEGLKTPDSGSVRVLGKTWQQDAPYLRQHLSGVLQQTLFIDKLSVEETLNLFGSFYGCSRKRAQEVMELVELEEKRKTYVEGLSGGQRQRLALGVSIINEPEILILDEPTTGLDPRIRHDTWDILRKLNREKHSTMILTTHYMEEAEYLCDRICIMNKGEIITQGSMDELLKKHCDGDLIEFRTHFPDRLQVLSQHAQVLNYEYDERKDKICMLIEDSTSFVAHLFEFAKQVEVDIIELMVRKKTLDDLFMTLAGRRLHE

SEQ ID NO: 9111 - protein, 365 aa, Xenorhabdus bovienii
  Peptide sequence Name=Xb4151_4152.C440.gene177.pep
  Gene classification: Function=ABC-type multidrug transport system, permease component; Function class=R General function prediction only
  Homolog annotation: Query=168..362bp; Hit=185..379bp; Blast score=69; Percent Identity=25.0; E value=5e-12; Homolog= MTH1486 COG0842
MNSALLNLMKTQFRQYIREPEILFWSFGFPLLLVWLLGVSFSSQDIPEREIGIVLPVEAVEQQQVKQWGEQLTAQEHMISGIINKKEIKRERLVKVRYNITYYPDHESVVRGLKRGDIQMFIEQDKEGKRVHYLDPQNSDALLTYYLLNQQEGIEVEKNLFILETPGLRYVDFLVPGLLAMAIMETCLIAVGWALAEKRITRVTRQMCITPMRKSTFLLAHILSCLLISITEILIIYLFADLYFDVEIQGSFYAFLLLMLTGNICFSGVAVLVASRARKAQTANGLLEVSILIQVLLSGIFFSYKNFPQWMANIIEYLPLTILADNMRKVFIEGGDLLQAVPAAIILSVIGIVTFVLGMKIFRWY

SEQ ID NO: 9112 - protein, 583 aa, Xenorhabdus bovienii
  Peptide sequence Name=Xb4151_4152.C440.gene178.pep
  Gene classification: Gene name=Uup; Function=ATPase components of ABC transporters with duplicated ATPase domains; Function class=R General function prediction only
  Homolog annotation: Query=4..496bp; Hit=77..595bp; Blast score=221; Percent Identity=33.0; E value=1e-57; Homolog= DR1635 COG0488
MSTLLSTQNLSFHHGHTPLLADISISINKGEKIGLIGYNGCGKSTLLKLLSSKLSPNEGTVTLANHCILAYTEQHLPVTLHSMTLIEAVLDKLPAEQRIEDNWRAEILLSEMGFQPEQHSLAISALSGGQHTRLLLARALIINPDLLLLDEPSNHLDLPTILWLEQFLTQWCGSFILVSHDNTLLDHLTNCTWILRDGNVSLYRLPCSQAREAQTAQDLSDEHRHNAQQKEIDRIAHSAKRLAIWGKVYDNEALSRKAKQMEKHVDRLQDCQVELAVSSQWRLKLTGDILRADRLCEFNQLTVIPAPSCPPLYKTDNLSVKSGDRIAIMGANGTGKSSLLRMILAQSQSQTLTLPDSPLVLHPRVNLGYYDQKLAQLSDSDTLSDALKPFAALLDKQRKMALISAGFPYLRHQQTVASLSGGERARLLFIGLSLAKYSLLMLDEPTNHLDMDGKNTLRDEIRLFAGGLLLVSHDRELIEQSCNRYWYIDGQRLTEYHDLDAVYQKIRHANSNTQTGSAPVSTFSLEPSSEVLSNDDEMKLAELISLEEKLATDLQRKAAHQKPILQQQWRERVAQLRRQLSLD

SEQ ID NO: 9113 - protein, 32 aa, Xenorhabdus bovienii
  Peptide sequence Name=Xb4151_4152.C440.gene179.pep
MIHCSFFQSILKCVQKLSLLSEHSPSSKYLIK

SEQ ID NO: 9114 - protein, 53 aa, Xenorhabdus bovienii
  Peptide sequence Name=Xb4151_4152.C440.gene180.pep
MSIFFHPLRLQAECIISLGVNKVNTMKLQIIYFMMFFTIYKSSFIYNLCIVYA

SEQ ID NO: 9115 - protein, 403 aa, Xenorhabdus bovienii
  Peptide sequence Name=Xb4151_4152.C440.gene181.pep
  Gene classification: Gene name=ArgD; Function=PLP-dependent aminotransferases; Function class=E Amino acid transport and metabolism
  Homolog annotation: Query=1..401bp; Hit=1..401bp; Blast score=533; Percent Identity=61.0; E value=1e-151; Homolog= cstC COG0160
MSNTIQRSWFDQYMVPCFSPAQFIPVRAKGSRVWDQEGKEYVDFAGGIAVNSLGHANDELKKVLTSQIESMWHVGNGYTNEPVLKLAKTLVENTFADKVFFCNSGAEANEAALKIARKYALDKYGSHKNEIISFENSFHGRTLFTVTVGGQPKYSQDFAPLPQQISHLPYNNIDAIKAHISENTCAVIVEPIIGEGGVIPADPAFLKALRELCDQHQALLIFDEIQTGVGRTGYFYAYEETGVEPDILTSAKGLGGGFPIGAMLVKQPIADVFQPGSHGTTFGGNPLAAAVANQVVALVNQPEFLAGVQERHHKFIKRMSDLNQRYHVFSELRGKGLLLGAELEKKYQGKAKTLSNIAAEEGLIALIAGPNVLRFAPALNIEEQDINDGFARLENALKRFVQE

SEQ ID NO: 9116 - protein, 348 aa, Xenorhabdus bovienii
  Peptide sequence Name=Xb4151_4152.C440.gene182.pep
  Gene classification: Gene name=AstA; Function=Arginine/ornithine N -succinyltransferase beta subunit; Function class=E Amino acid transport and metabolism
  Homolog annotation: Query=1..344bp; Hit=1..340bp; Blast score=333; Percent Identity=48.0; E value=2e-91; Homolog= astA COG3138
MMLFRSVQHKDLGDILDLSSRAGVGLTSLPHNQEYLTARISRSIDSFNDVNGRAQQGFLFTLEDTEKHRVVGVSALEVAVGLEDAFYNFRLQRSVRASRELGVYNTFETLMVGQDYTGCSELCTLFLDPDYQGGGNGVFLSRSRFLFISAFRHLFPKSIFAEMRGVVDLQGESPFWNALGQHFFNIPFAQADYLTGIGIRTFIAELMPFHPIYVPLLPEDAQKAIGQVHENTVPARAILEKEGFFYNDGVDIFDAGAILQAEIDNVRSIKASRLAYVKKSEKVSRQSNGVPCIVSNVHFQDFKALLLNIPDPFSYDELQLTPAEMEVLHVDEGDAVRFISLFSEGSSQ

SEQ ID NO: 9117 - protein, 492 aa, Xenorhabdus bovienii
  Peptide sequence Name=Xb4151_4152.C440.gene183.pep
  Gene classification: Gene name=PutA; Function=NAD-dependent aldehyde dehydrogenases; Function class=C Energy production and conversion
  Homolog annotation: Query=7..489bp; Hit=4..486bp; Blast score=595; Percent Identity=59.0; E value=1e-170; Homolog= astD COG1012
MNHQANYIGSGWVAGQGEPVIKYSPLDQRILWQANSASVSQVNDACQSARRAFPAWAKLTAEKRIAIIQAFADLLTQEKEAIARVISEETSKPLWETRTEVQSMIGKVAISIEGWQQRTGYSETPMPDGKAILQHRPHGVMAVFGPYNFPGHLPNGHIVPALIAGNTLVFKPSELTPMTAEKTVQLWIKAGLPAGVLNLVQGGRETGGALLDSREIDGVLFTGSAATGFHFHRVLAGQPEKMLALEMGGNNALIVDDYDDLEAAVYTIIQSAFISAGQRCTCARRLLVKRGEKGDALIQRLLDTAGQIIPSRWDADPQPFIGGVISLPAVENLLDAQSRLQALGGVSLLTMTQPDPDSTFMTPGIIDLTDAKEVPDEEYFGPLLTLKRYDTFEEAISIANDTRFGLATGLISPDAALFEHLLQEARAGIVNWNKPLTGASSAAPFGGIGASGNHRPSAYYAADYCAWPMASLTADKLVLPDAPAPGLDFFRS

SEQ ID NO: 9118 - protein, 447 aa, Xenorhabdus bovienii
  Peptide sequence Name=Xb4151_4152.C440.gene184.pep
  Gene classification: Function=Succinylarginine dihydrolase; Function class=E Amino acid transport and metabolism
  Homolog annotation: Query=1..446bp; Hit=1..446bp; Blast score=536; Percent Identity=61.0; E value=1e-152; Homolog= PA0899 COG3724
MSGIEANFDGLVGMTHHYAGLSMGNEASMTHRGQQSNPRKAALQGLMKMKSLSDMGLVQGVLPPQQRPNLPALRQLGFTGSDEQVLSKAAQYSPLLLSNLSSASSMWTANAATVSPSADSADQRVHFTVANLNNKLHRSLESTVTARVLEAVFPDQACFAHHDPLPQHGDWGDEGAANHNRFCGEYGEAGVQLFVYGRSALQEGTAPKLYPARQTLEASQAVARLHQLEAAQTVFAQQNPVAIDSGVFHNDVIAVSNRNVFFHHQQAFVNQQSVLAELEKKMVRLGQKLIAVEVPSSQVTLQDAVGSYLFNSQLLSQPNGDMMLILPEECRQNVNVWAYLQALVAGADSPIKKLHFFDLRESMRNGGGPACLRLRVVLKEQELAAVNQAALMTPELYQRLTSWVERYYRDSLYTADLVDPQLLNEVYFALDELTQILKLGSIYEFQR

SEQ ID NO: 9119 - protein, 324 aa, Xenorhabdus bovienii
  Peptide sequence Name=Xb4151_4152.C440.gene185.pep
  Gene classification: Function=Succinylglutamate desuccinylase; Function class=E Amino acid transport and metabolism
  Homolog annotation: Query=26..324bp; Hit=28..322bp; Blast score=259; Percent Identity=44.0; E value=3e-69; Homolog= ydjS COG2988
MDLLTLLFEKKLEKVLHFPPALKASWLAEGVLQLLPQESKADTLILSVGIHGNETAPVELLIQLVSQLALGSLPLQHNLLLIFGNVPAMRENKRYIDNDLNRMFGGRHQNFPSGNESQRAMELETVVRQFFREPAVRASTRRWHLDLHTAIRGSCHEQFALLPFQAREYASDFLQWLEGSDIDALVFHNAAGGTFSHFTSEHFNVESCTMEVGKARPFGQNDLSRFNNITLALRDVVAGSFLIKREKPTMKRYRVIDAIIKQEDSFRLHIPEDTKNFTALPDGFEIASQPNQFWKITSPANFILFPNAHVAIGQRAGLLLVQLT

SEQ ID NO: 9120 - protein, 474 aa, Xenorhabdus bovienii
  Peptide sequence Name=Xb4151_4152.C440.gene186.pep
  Gene classification: Gene name=AnsP; Function=Gamma-aminobutyrate permease and related permeases; Function class=E Amino acid transport and metabolism
  Homolog annotation: Query=10..457bp; Hit=11..457bp; Blast score=454; Percent Identity=56.0; E value=1e-127; Homolog= cycA COG1113
MTRTVKTPVEQSAGAQKLHRGLGKRHVQLIAIGGAIGTGLFMGTGKTIAVSGTSIILTYLLIGFFAFMVMRAMGELLLTKLDYRTFADFVADYLGEKASYFLGWTYWMSWVVSCIADVVVCGGYIQYWFPDVSLWFTALSLLGLICLCNFFSVQLFGETEFWFAMIKVVAIVALIIVGVGMVFVGWTSPNGVTASVRHLTDPEVFLPNGMFGFLAGFQIAIFSFTGIELVGTVTAETKEPEKVLPKAINTIPIRIIIFYVLSIMCIIAVTSWTNISPEVSPFVTLFALAGLPAAAAVINFVALTSAMSSANSGLYACTRMLYGLSTEKLAHGKFAQLSVSSAVPIFSLIFSVICMASGVFLLFIVPNVMKLFTIVSTVAAIMVIYSWGMILIAYLAYRKKRPDLHKISIYKMPMGIPMTWCTLIFFAFTVVIMVFDYDTRVALYGTPIWFVILEVLWRMRKNRKQRVIEKRVVN

SEQ ID NO: 9121 - protein, 45 aa, Xenorhabdus bovienii
  Peptide sequence Name=Xb4151_4152.C440.gene187.pep
MIPFYYLTNKKDDYCYKKITPAKKYGVILSVAVISSCFSQSEKTT

SEQ ID NO: 9122 - protein, 688 aa, Xenorhabdus bovienii
  Peptide sequence Name=Xb4151_4152.C440.gene188.pep
  Gene classification: Gene name=Pta; Function=Phosphotransacetylase; Function class=C Energy production and conversion
  Homolog annotation: Query=364..686bp; Hit=1..323bp; Blast score=563; Percent Identity=90.0; E value=1e-160; Homolog= pta_2 COG0280
MEQKGVRLSVFKPIAQPRHSGSQDQTTSIIRSHSSMHAAEPLDMAYVESLLTTNKKDVLMEEIVARYHANTKDAEVVLIEGLVPTRKHPFAQSLNYEIAKTLNADIVFVTALGTHSPEQLKEQIELSRAEYGGIKNQNIIGVIVNKLNAPVDEQGRTRPDLSEIFDEASKATVAYIDPKTVFKNSPLPILGCIPWSFDLIATRAIDMAKHLKADIINEGAIQSRRIKSVTFCARSIPNMLEYFRPGSLLVTSADRPDVLITACLAAMNGVDVGAVLLTGGYAIDDSIRELCERAFNTGLPVFTVKTNTWQTSLNLQSFSLEVPADDHERIEKLQNYVAQHISSEWIDSLAATSERPNRLSPPAFRYQLTELARQAGKRIVLPEGDEPRTVKAAAICAERGIAECILLGDPEEIRRVAAAQGVELGTGIELVNPAAVRERYVPRLVELRKSKGMTEVVAREQLEDNVVLGTLMLEQGEVDGLVSGAVHTTANTIRPPLQLIKTAPNSSLVSSVFFMLLPEQVLVYGDCAINPDPTAEQLSEIAIQSADSAKAFGIDPRVAMISYSTGNSGAGSDVEKVREATRLAQEKRPDLIIDGPLQYDAAIMADVAKSKAPNSPVAGQATVFIFPDLNTGNTTYKAVQRSADLVSIGPMLQGMRKPVNDLSRGALVDDIVYTVALTAIQAAQQENA

SEQ ID NO: 9123 - protein, 47 aa, Xenorhabdus bovienii
  Peptide sequence Name=Xb4151_4152.C440.gene189.pep
MERITPRLTLVKPTLVPVGINIIIRDTETSLTVARQSINVTQCYINR

SEQ ID NO: 9124 - protein, 400 aa, Xenorhabdus bovienii
  Peptide sequence Name=Xb4151_4152.C440.gene190.pep
  Gene classification: Gene name=ackA; Function=Acetate kinase; Function class=C Energy production and conversion
  Homolog annotation: Query=1..400bp; Hit=1..400bp; Blast score=698; Percent Identity=85.0; E value=0; Homolog= ackA COG0282
MSSKLVLVLNCGSSSLKFAIINPANGEEYLSGLAECFGLPEARIKWKMDGAKNEAALGAGAAHSEALNFIVNTILSEKPELSAQISAIGHRIVHGGEKFTSSVIITDEVIQGIEAAIPFAPLHNPAHLIGIAEAKKAFSHLVEKNIAVFDTAFHQTMPEESYLYALPYNLYKEHGIRRYGAHGTSHFYVTREAAKMLNKPVEELNIITCHLGNGGSVSAIVNGQCVDTSMGLTPLEGLVMGTRSGDIDPAIVFHLHDAMGMSVDQINTLLTKESGLLGLTEVTSDCRYVEDNYETKADAKRAMDVYCHRLAKYIGAYSALMEGRLDAIIFTGGIGENSSLVRELAVKKIALLGFEYDHERNLAARFGKSGVITTDNSRPALVIPTNEELVIAQDAARLTA

SEQ ID NO: 9125 - protein, 152 aa, Xenorhabdus bovienii
  Peptide sequence Name=Xb4151_4152.C440.gene191.pep
  Gene classification: Function=Uncharacterized BCR; Function class=S Function unknown
  Homolog annotation: Query=2..152bp; Hit=1..151bp; Blast score=188; Percent Identity=63.0; E value=2e-48; Homolog= yfbV COG3092
MMNTTPPVNQGWFKRVQLGQQYLKTWPLEKQLAPIFPENRIIKATRFGIRFMPPLAIFTLTWQIALGGQLGPSAATALFACSLPLQGLWWLGKRAATPLPEGLLKWFYEIREKFAEAGIAMMPVESTPTYFSLAELLKRAFKQLDNAFLDDI

SEQ ID NO: 9126 - protein, 224 aa, Xenorhabdus bovienii
  Peptide sequence Name=Xb4151_4152.C440.gene192.pep
  Gene classification: Function=Predicted phosphatase/phosphohexomutase; Function class=R General function prediction only
  Homolog annotation: Query=3..209bp; Hit=1..207bp; Blast score=223; Percent Identity=56.0; E value=9e-59; Homolog= ZyfbT COG0637
VVLKCRGFLFDLDGTLIDSLPVVERAWCQFADKMDIDRDEVLSFVHGTPAMISLRHFMPDASEEEINRTFKWIEKIESEDTEGVTALPGAIALIDKLNALDIPWAIVTSCTVPLASVRHKVAELPEPAHWVTAESIKNGKPNPEPYLLGASMLGLSPEECVVFEDAAAGIHAGLDAGCQVVVVHNSPGIPRRDELHLVLNNLEDIEISKSGGYVTIYALNEENC

SEQ ID NO: 9127 - protein, 42 aa, Xenorhabdus bovienii
  Peptide sequence Name=Xb4151_4152.C440.gene193.pep
MITNNATTSILTLLVVKRTMATNNRVNTHNSSLFNMASINSI

SEQ ID NO: 9128 - protein, 584 aa, Xenorhabdus bovienii
  Peptide sequence Name=Xb4151_4152.C440.gene194.pep
  Gene classification: Gene name=CitT; Function=Di- and tricarboxylate transporters; Function class=P Inorganic ion transport and metabolism
  Homolog annotation: Query=1..584bp; Hit=26..610bp; Blast score=751; Percent Identity=72.0; E value=0; Homolog= ZyfbS COG0471
MDVVALLVIIVFVLSGTLSLNEATIGFSDPNVLLIAALFVIGEGLVRTGVAYQMGDWLVRVAGSSETKMLALLMLSVAGLGAFMSSTGVVAIFIPVVLSVAARMKTSPGRLMMPLGFAGLISGMMTLVATPPNMVVNSELVREGLRGFDFFSITPIGILVLLAGIVYMLVTRRWLGVKALQKPDERYHRTFRDLIRDYKLTGRARRLAVREGSPLIGHALDELSLRTHYGANVVGIERWRKFRRVMVAATGETELHQQDVLLVDMSDSDVDLREFCSEQQLEPMILRGEYFSEQSRDVGMAEVSVIPESELLGKSLRDMKFRTRYGLNVVGIRRSGKAIVEKLVDEPVHLGDTLLVIGDWKLIRALKTKTPDFIVLNLPVEVESAAPAASQAPHALFCLALMVAMMLTNEIPNFVAALIACLLMGKFRCIDMESAYRAIHWPSIILIVGMMPFALALQKTGGIDLIVKGLMDIAGNMGPRVMLLCLFVLCALIGLFISNTATAVLMAPIAIAAAKQMSVSPLPFAMIIGVAASAAFMTPVSSPVNTLILGPGGYRFADFLKLGVPFTLIVMGISVAMIPILFPF

SEQ ID NO: 9129 - protein, 240 aa, Xenorhabdus bovienii
  Peptide sequence Name=Xb4151_4152.C440.gene195.pep
  Gene classification: Function=Predicted hydrolases of HD superfamily; Function class=R General function prediction only
  Homolog annotation: Query=49..239bp; Hit=4..194bp; Blast score=285; Percent Identity=76.0; E value=2e-77; Homolog= Z3552 COG1896
MPHISPTLSFSTDSNCLSQLILALNGFTSVLTPPTINHIVVPQQEEIMSHFFAQLSRLKLINRWPLMRNVRTENVSEHSLQVAFVAHALAVIKNRKFNGSLNAERIALLAMYHDASEVITGDLPTPIKYYNPQIAHEYKKIEKIAQHKLLTMLPSELQDDFRSILDDQLHTDEETAIVKQADALCAYLKCLEELSAGNAEFNQAKSRLEKTLAERHSEEMDYFLTVFVPGFSLSLDEISL

SEQ ID NO: 9130 - protein, 404 aa, Xenorhabdus bovienii
  Peptide sequence Name=Xb4151_4152.C440.gene196.pep
  Gene classification: Gene name=AvtA; Function=PLP-dependent aminotransferases; Function class=E Amino acid transport and metabolism
  Homolog annotation: Query=1..404bp; Hit=1..404bp; Blast score=754; Percent Identity=88.0; E value=0; Homolog= Z3551 COG0436
MFSINKSSKLDNVCYDIRGNTLKEAKRLEEEGNKILKLNIGNPAPFGFEAPDEILVDVIRNLATAQGYSDSKGLYSARKAIMQHYQARNMLDITVEDIFIGNGVSELIVQSMQALLNTGDEMLVPAPDYPLWTAAVSLSSGKAVHYLCDEQQGWFPDLDDIRRKITPRTRGIVIINPNNPTGAVYSKELLLEIVEIARQHNLTIFADEIYDKILYDDAQHHSIAALAPDLFTVTFNGLSKTYRVAGFRQGWMVLNGPKKQAKGYIEGLEMLASMRLCANVPMQHAIQTALGGYQSISEFIFPGGRLYEQRNRAWELINQIPGVSCVKPMGALYMFPKIDTKRFNIHDDQKMVLDLLLQEKVLLVQGTAFNWPEPDHFRIVTLPHTTDLQIAIEKFARFIGNYRQ

SEQ ID NO: 9131 - protein, 318 aa, Xenorhabdus bovienii
  Peptide sequence Name=Xb4151_4152.C440.gene197.pep
  Gene classification: Gene name=LysR; Function=Transcriptional regulator; Function class=K Transcription
  Homolog annotation: Query=1..303bp; Hit=1..303bp; Blast score=345; Percent Identity=58.0; E value=4e-95; Homolog= ZlrhA COG0583
MINANRQIINLDLDLLRTFVAVADLNTFAAAAAAVCRTQSAVSQQMQRLEHLVGRELFARHGRNKLLTEHGLQLLGYARQILRANDDATASLTYNDADGELRIGASDDTVDTLLPFLLNRIASVYPRMAVDVRIKRTQFIESMLDNHEIDLALTTAKINHHPKTVLRSSPVLWHCAPDFQLQTNEAIPLVVMDETNPFRQIALDTLDTAGISWRIAYEAASLSAVRAAVNAEVGITARPLEMQNADLRILGESEGLPRLPEIQFFLYRNSNEQNESVLTVFDAIENKKTPYTVTTIESNETDEIDESVEISSVENIDE

SEQ ID NO: 9132 - protein, 106 aa, Xenorhabdus bovienii
  Peptide sequence Name=Xb4151_4152.C440.gene198.pep
MGKNSSGCRHTRCLLIKSGVKMSAFLPAVLHHIDSWEGITTKYETVLINIINSLNRLGFYSSKQYFACMAKATTYLFTNKKPLINRLCLYIAKTCQSSKKPPTRYN

SEQ ID NO: 9133 - protein, 147 aa, Xenorhabdus bovienii
  Peptide sequence Name=Xb4151_4152.C440.gene199.pep
  Gene classification: Gene name=NuoA; Function=NADH; Function class=C Energy production and conversion
  Homolog annotation: Query=1..142bp; Hit=3..144bp; Blast score=198; Percent Identity=73.0; E value=2e-51; Homolog= nuoA COG0838
MSTSTGVFAHHWAFAVFLLGAFGLCALMLLGAYFLGGRSKGRAKHIPYESGIDSVGSARLRLSAKFYLVAMFFVIFDVEALYLYAWSVSIKESGWLGFAEASIFILVLLAGLVYLARIGALNWTPVRSQRQVSQPSADIHTNNSHMQ

SEQ ID NO: 9134 - protein, 224 aa, Xenorhabdus bovienii
  Peptide sequence Name=Xb4151_4152.C440.gene200.pep
  Gene classification: Gene name=NuoB; Function=NADH; Function class=C Energy production and conversion
  Homolog annotation: Query=1..224bp; Hit=1..220bp; Blast score=427; Percent Identity=90.0; E value=1e-120; Homolog= nuoB COG0377
MDYTLTRIEPNGENDRYPLQKQELVNDPLEQHVHRSVYMGKLEHALHDMVNWGRKNSLWPYNFGLSCCYVEMVTSFTAVHDVARFGAEVLRASPRQADFMVISGTCFVKMAPVIQRLYDQLLEPKWVISMGACANSGGMYDIYSVVQGVDKFIPVDVYIPGCPPRPEAYMQALLLLQESIGKERRPLSWVVGDQGVYRANMQSERERKRGERIAVKNLRTPDEI

SEQ ID NO: 9135 - protein, 599 aa, Xenorhabdus bovienii
  Peptide sequence Name=Xb4151_4152.C440.gene201.pep
  Gene classification: Gene name=NuoD; Function=NADH; Function class=C Energy production and conversion
  Homolog annotation: Query=202..599bp; Hit=1..399bp; Blast score=762; Percent Identity=89.0; E value=0; Homolog= nuoC_2 COG0649
MMTDQIAQESARPAWETQDHFDDPVVSELNRQFGPEAFSVQPTRTGMPVVWVRREQLLAVITFLKKLPKPYVMLFDLHGVDERQRSHRQGLPAADFSVFYHLISIERNRDIMLKVALNEKDLNIPTITSIYSNANWYERETWEMFGITFNGHPNLRRILMPDTWEGHPLRKEYSARATEFDPFMLTKQKEDLEMEALTFKPEEWGMKRGTESEDFMFLNLGPNHPSAHGAFRIVLQLDGEEIIDCVPDIGYHHRGAEKMGERQSWHSYIPYTDRVEYLGGCVNEMPYVLAVEKLAGIDVPDRVKTIRVMLSELFRINSHLLYISTFIQDVGAMSPVFFAFTDRQKVYDVVEAITGFRMHPAWFRIGGVAHDLPRGWDKLLRELLDWMPKRLNSYVKAALKNSVLKGRSVGVASYNSKQALDWGVTGAGLRATGIGFDVRKWRPYSGYENFDFEVPTGYNGDCYDRVMLKVEEIRQSMRILEQCLKNMPEGPFKADHPLTTPPPRERTLQHIETMINHFLQVSWGPVMPANESFQMIEATKGINSYYLTSDGNTMSYRTRIRTPSFAHLQQIPSVIRGSLVSDLIVYLGSIDFVMSDVDR

SEQ ID NO: 9136 - protein, 181 aa, Xenorhabdus bovienii
  Peptide sequence Name=Xb4151_4152.C440.gene202.pep
  Gene classification: Gene name=NuoE; Function=NADH; Function class=C Energy production and conversion
  Homolog annotation: Query=26..180bp; Hit=11..165bp; Blast score=271; Percent Identity=82.0; E value=3e-73; Homolog= nuoE COG1905
MQSEFNANKQVRLDVINVTDAQTQGAFVLSTAERDAIEQEKHHYEDPRAASIEALKIVQKQRGWVPDGAIYAVAEVLGIPASDVEGVATFYSQIYRQPVGRHIIRYCDSVVCHITGYQDVQAAIEMHLNIRPGQTTEDGRFTLLPTCCLGNCDKGPTMMIDEDTHSYVKPEEIEKLLEQYP

SEQ ID NO: 9137 - protein, 454 aa, Xenorhabdus bovienii
  Peptide sequence Name=Xb4151_4152.C440.gene203.pep
  Gene classification: Gene name=NuoF; Function=NADH; Function class=C Energy production and conversion
  Homolog annotation: Query=7..454bp; Hit=1..445bp; Blast score=822; Percent Identity=88.0; E value=0; Homolog= ZnuoF COG1894
MTTHSGVKEIIRVAETHPLTWRLRDDQQPVWLDEYRSKSGYKGAEKALKGMVPDEVTTLVKDAGLKGRGGAGFSTGLKWSLMPKDESMNIRYLLCNADEMEPGTYKDRLLMEQLPHLLVEGMLISAFALKAYRGYIFLRGEYVEAAVHLRRAIEEAKAAGLLGKNILGSGFDFELFVHTGAGRYICGEETALINSLEGRRANPRSKPPFPATSGVWGKPTCVNNVETLCNVPAILEYGKEWYIGLSEGKSKDAGTKLMGFSGRVKNPGVWELPFGTTAREILEDYAGGMRDGLKFKAWQPGGAGTDFLTVDHLDLPMDFENIAKAGSRLGTALAMAVDHEINIVSLTRNLEEFFARESCGWCTPCRDGLPWSVKILRAIENGKGQPGDIETLEQLCRFLGPGKTFCAHAPGAMEPLQSAIKYFRDEFEAGIVTKDYGNTNLIAGIQPNLLKQRW

SEQ ID NO: 9138 - protein, 911 aa, Xenorhabdus bovienii
  Peptide sequence Name=Xb4151_4152.C440.gene204.pep
  Gene classification: Gene name=NuoG; Function=NADH dehydrogenase/NADH; Function class=C Energy production and conversion
  Homolog annotation: Query=2..911bp; Hit=1..910bp; Blast score=1460; Percent Identity=73.0; E value=0; Homolog= nuoG COG1034
MLTMATIHVDGKEYDVNGADNLLQACLSLGLDIPYFCWHPALGSVGACRQCAVKQYQNAEDTRGRLVMSCMTPATEGTFISIDDEEAKQFRASVVEWLMTNHPHDCPVCEEGGNCHLQDMTVMTGHSFRKYRFTKRTHQNQELGPFVAHEMNRCIACYRCVRYYKDYADGTDFGVYGAHDNVYFGRTESGTLESEFSGNLVEICPTGVFTDKTHSERYNRKWDMQFAPSICQQCSIGCNTSPGERHGEVRRIENRYNGTVNHYFMCDRGRFGYGYVNRDDRPRQPQQLRGDQWISLNAEQVMQGGADILRQAKNAIGIGSPRASIESNFALRELVGEENFYSGISVEEQNRLDMILEILQQGGVYTPSLREIEGYDAVLILGEDLTQTGARMALSVRQAVKGKAREMAAAQKVADWQIAAVMNIGQHAKYPLFLTSVDDTRLDDIAAWNYRAPTDDQARFGFAVAHALNSIAPAVNDLPDELKTKVEIVAQALRDAKKPLIISGSNAGSDALIQAAANIAWALKDKGANVGLSFVAAYANSLGLAMMEAQPLDVALQRIAKGDSDTAIVVENDLYRHAAADKIDSALGSLKNLIVVDHQRTAIMDKAHLILSAASFAESDGTLVNQEGRAQRYFQVYEPSFYDKSVVMLESWRWMHSLYTTYAQCQTDWAQLDHVIEACVKAMPQFKGIVNAAPDSTFRIRGQKLARSPHRYSGRTAMLANVSVHEQRQPQDIDTAFAFSMEGNNSPFAERQQIPFAWAPGWNSPQAWNKFQAEVGGKLRFGDPGMRLIETTDGGLNYFDSIPAAFAAQKNQWYVAPYFHLFGSEELSQRAEVIQERMPEPYVMINHQDAEHLNVKEGSMMEFDCAGQQLRLAVRLSGNLVQGQIGLPLGMPGIPPVLAGKSVNNLRGMAQ

SEQ ID NO: 9139 - protein, 325 aa, Xenorhabdus bovienii
  Peptide sequence Name=Xb4151_4152.C440.gene205.pep
  Gene classification: Gene name=NuoH; Function=NADH; Function class=C Energy production and conversion
  Homolog annotation: Query=1..325bp; Hit=1..325bp; Blast score=529; Percent Identity=89.0; E value=1e-150; Homolog= nuoH COG1005
MSWFTPDVIEVLITILKAVVILLVVVVCGAFMSFGERRLLGLFQNRYGPNRVGWGGSLQLVADMLKMFFKEDWVPRFSDRAIFTLAPIIAFCSLLLAFAIVPVSPTWMVADLNIGILFFMMMAGLSVYAVLFAGWSSNNKYSLLGAMRASAQTLSYEVFLGLALMGVVAQAGSFNMVDIVNSQQHMWNVIPQFFGFLTFAIAGVAVCHRHPFDQPEAEQELADGYHVEYSGMKFGLFFVGEYIGIVTVSALIVTLFFGGWHGPLLPSFIWFALKTAFFMVMFILIRAALPRPRYDQVMSFGWKVCLPLTLLNLLATAAVILYNAQ

SEQ ID NO: 9140 - protein, 180 aa, Xenorhabdus bovienii
  Peptide sequence Name=Xb4151_4152.C440.gene206.pep
  Gene classification: Gene name=NuoI; Function=Formate hydrogenlyase subunit 6/NADH; Function class=C Energy production and conversion
  Homolog annotation: Query=1..180bp; Hit=1..180bp; Blast score=347; Percent Identity=92.0; E value=5e-96; Homolog= nuoI COG1143
MTLKELVVGFATQVRSIWMIGLHAFHKRETKMYPEEPVYLPPRYRGRIVLTRDPDGEERCVACNLCAAVCPVGCISLQKAEHKDGRWYPEFFRINFSRCIFCGLCEEACPTTAIQLTPDFELGEFKRQDLVYEKEDLLISGPGKYPDYNFYHKTGMAIDGKDKGEADNEAKPIDVKSLLP

SEQ ID NO: 9141 - protein, 175 aa, Xenorhabdus bovienii
  Peptide sequence Name=Xb4151_4152.C440.gene207.pep
  Gene classification: Gene name=NuoJ; Function=NADH; Function class=C Energy production and conversion
  Homolog annotation: Query=1..174bp; Hit=1..174bp; Blast score=212; Percent Identity=75.0; E value=2e-55; Homolog= nuoJ COG0839
MEFTFYVAGLVAILATLRVITHTNSVHALLYLITSLLALSVVFFSLGAYFAGALEIIVYAGAIMVLFVFVVMMLNLGKSVVEQERAWLQLRVWIGPAILAAVLLIVLIFAISSLPTAEISGEVVSAKEVGISLFGPYVLAVELASLLLLAGLVVAYHIGRENRQGEVISNRTEDQ

SEQ ID NO: 9142 - protein, 100 aa, Xenorhabdus bovienii
  Peptide sequence Name=Xb4151_4152.C440.gene208.pep
  Gene classification: Gene name=NuoK; Function=NADH; Function class=C Energy production and conversion
  Homolog annotation: Query=1..100bp; Hit=1..100bp; Blast score=125; Percent Identity=88.0; E value=6e-30; Homolog= nuoK COG0713
MIPLEHGLILAAILFVLGFVCLIVRRNLLFMLIGLEIMINASALAFVVAGSYWLQPDGQVMYILAITLAAAEASIGLALLLQLYRRRQSLNIDIVSEMRG

SEQ ID NO: 9143 - protein, 616 aa, Xenorhabdus bovienii
  Peptide sequence Name=Xb4151_4152.C440.gene209.pep
  Gene classification: Gene name=NuoL; Function=NADH; Function class=C Energy production and conversion
  Homolog annotation: Query=1..605bp; Hit=1..601bp; Blast score=823; Percent Identity=79.0; E value=0; Homolog= ZnuoL COG1009
MNLLYLTILLPLLGFLLLAFSRGRWSENLSAIIGSASVGLAALVTLWAGMDFHAQNGAEGLVYSQTLWNWMEADNFNIPVNLVLDGLSLTMLSVVTGVGFLIHIYASWYMRGEEGYSRFFAYTNLFIASMVVLVLADNMLLMYLGWEGVGLCSYLLIGFYYKTPANGAAAMKAFIVTRVGDVFLAIGMFILYDQLGTLSFRELAVLAPQHIEAGSTAITWATLMILGGAVGKSAQLPLQTWLADAMAGPTPVSALIHAATMVTAGVYLIARSHALFLMAPDILHLVGTIGAITLLLAGFAALVQTDIKRVLAYSTMSQIGYMFLALGVQAWDAAIFHLMTHAFFKALLFLASGSVILACHHEQNIFKMGGLSKRIPFVYLCFIVGGSALSALPLLTAGFYSKDEILWGALANGHMNLMLAGLVGALMTSLYTFRMIFIVFHGEENTKAHPVKGITHTLPLSVLLVLSTFVGALIVPPLAGVLPERSTTAGHDDKLTLEIVSGVVAVFGILLAAALYLGKRAVVKATANSIPGRFLSTWWFHAWGFDALYDWIFVKPFKGITQLLQNDPLNSLMNIPAILSRWGNKGLSLSENGQVRWYAASLGLGAVLVLALLLLI

SEQ ID NO: 9144 - protein, 506 aa, Xenorhabdus bovienii
  Peptide sequence Name=Xb4151_4152.C440.gene210.pep
  Gene classification: Gene name=NuoM; Function=NADH; Function class=C Energy production and conversion
  Homolog annotation: Query=1..506bp; Hit=1..509bp; Blast score=707; Percent Identity=80.0; E value=0; Homolog= nuoM COG1008
MLLPWLILLPFIGGLLCWQAERFGTRMPRWIALLAMGLTLLLSLQLWLQGGYTLTNPQGIPQWQSEFLIPWIPRFGISIHLALDGLSLLMVVLTALLGLMAILCSWNENQPYQGFFHLNLLWILGGVMGVFLAIDLFLFFFFWEMMLVPMYFLIALWGHRGSGGKTRITAATKFFIYTQASGLVMLISILALAFVYHDATGEWSFSYEKLLNTPMSDTVQYLLMLGFFIAFAVKMPVVPLHGWLPDAHSQAPTAGSVDLAGILLKTAAYGLLRFSLPLFPQASAEFAPIAMWLGVIGIFYGAWMAFSQTDIKRLIAYTSVSHMGFVLIAIYTGSQLAYQGAVIQMIAHGLSAAGLFIVCGQLYERLHTRDMRNMGGLWGKIQLLPAISLFFAVATLGMPGTGNFVGEFMILFGSFSKFTLITTVSVFGLVFASVYALYLMQKAYYGTPTTDKPLQRMDVREISILLLLVVLLVIVGVYPQPVLDTSAAAMSNIQNWYSASLLTTRP

SEQ ID NO: 9145 - protein, 485 aa, Xenorhabdus bovienii
  Peptide sequence Name=Xb4151_4152.C440.gene211.pep
  Gene classification: Gene name=NuoN; Function=NADH; Function class=C Energy production and conversion
  Homolog annotation: Query=61..485bp; Hit=1..425bp; Blast score=553; Percent Identity=75.0; E value=1e-157; Homolog= nuoN COG1007
MTITSEQLIALLPLLIVGLTVVVVMLSIAWRRDHLINFTLTVIGLNLALLSLYFVGQQEPMDVTPLIHVDRFAMFYTSLVLIASLATTTFAYSWLENYPDNKEEFYLLVLIAAVGGILLSSANHMASLFIGIELITLPLFGLIGYAYRQKRSLEASIKYMLLSAAASSFLLFGIALLYAESGDLSFASLGRNLSDSQLHEPLILAGLGMMLVGVGFKLSLVPFQLWTPDVYQGAPAPVSTFLATASKVAIFAVIMRLFLEAPVAESETLRIVLTVMAIASILFGNLLALTQSNIKRLLGYSSIAHLGYLLVVLVAIRSHTLAEETAGIYLAGYLFASIGAFGVVSLMSSPYRGPDADSLYSYRGLFWHKPILSAVMTIIMLSLAGIPLTFGFIGKFYVIATAVEAKLWWLTGAVVLGSAIGLYYYLRVMVSLYLPAPKTLNRDTPSNWALTSGGIVVLISGLLVLILGIWPQPVIDIVQQAKSAM

SEQ ID NO: 9146 - protein, 53 aa, Xenorhabdus bovienii
  Peptide sequence Name=Xb4151_4152.C440.gene212.pep
LAGPFFETRGKYHEIAFITVVASEWFLLCSNKKSSMCRFCRIKQCPGIMPFFC

SEQ ID NO: 9147 - protein, 115 aa, Xenorhabdus bovienii
  Peptide sequence Name=Xb4151_4152.C440.gene213.pep
  Gene classification: Function=Putative transposase; Function class=L DNA replication, recombination and repair
  Homolog annotation: Query=3..104bp; Hit=23..124bp; Blast score=137; Percent Identity=65.0; E value=1e-33; Homolog= XF2303 COG3316
MSLIRKAFKRLHYPVNIIVQCVRWYLAYALSLRDLEEMLAERGITVDHFTLSRWVHRLIPLMVKRYRRSKPAVGRRWQMDETSIKIKGKWSYLYRAVDSDGKAIASKFDALCPVL

SEQ ID NO: 9148 - protein, 373 aa, Xenorhabdus bovienii; identical to SEQ ID NO: 6510
  Peptide sequence Name=Xb4151_4152.C440.gene214.pep
  Homolog annotation: Query=7..367bp; Hit=6..372bp; Blast score=257; Percent Identity=39.0; E value=2e-67; Homolog= gi|16129419|ref|NP _415977.1| putative receptor [Escherichia coli K12] gi|140581|sp|P28917|YDCC_ECOLI H repeat-associated prote

SEQ ID NO: 9149 - protein, 71 aa, Xenorhabdus bovienii
  Peptide sequence Name=Xb4151_4152.C440.gene215.pep
  Homolog annotation: Query=1..69bp; Hit=86..154bp; Blast score=122; Percent Identity=86.0; E value=1e-27; Homolog= gi|37527343|ref|NP _930687.1| hypothetical protein [Photorhabdus luminescens subsp. laumondii TTO1] gi|36786777|emb|CAE15843.1|
MLLININPPYHESQVSMMDLRIVVPFTDMKGYHYDKSVTELLMLYTGEKKVVIPDMVVPKLKQRLKDQESK

SEQ ID NO: 9150 - protein, 401 aa, Xenorhabdus bovienii
  Peptide sequence Name=Xb4151_4152.C440.gene216.pep
  Gene classification: Function=Predicted Zn peptidase; Function class =E Amino acid transport and metabolism
  Homolog annotation: Query=106..310bp; Hit=17..205bp; Blast score=90; Percent Identity=33.0; E value=3e-18; Homolog= Rv2017_2 COG2856
MRVGISGFQPARLTQMREARGLSKISLGKLVERSPSTVTKWENGNHSPDAEILHSLSRVLNCPVGWFTKPVIKYEKKPVFFRTLSSTAKDLCISAERYMGWFQELSFKMQEYLDYPDVDIPHLDVRDYRAIDDQLIERMAFECRKAWGLGIAPIDDLLLVMENAGVVCSRFEQGSTVMDGYSQWNDVENRPYVILASDKDNYYRSRFDAAHELGHIVLHRYINKFDHINFTPIEEQAHMFASCFMLPEESFSVELPPYPTLENFLALKSRWGMSAQAMILRARNLELISPLEYQRLYKSISARGWRKGEPLDELRKPELVRLLPRCLNLLLDSGTFNKKTFLEEFGFPKGDLEDLCSVPKGFLSESPILDFQSRIQLKNSMNVNVSSVRQDTNVVNLFNRK

SEQ ID NO: 9151 - protein, 197 aa, Xenorhabdus bovienii
  Peptide sequence Name=Xb4151_4152.C440.gene217.pep
  Homolog annotation: Query=1..197bp; Hit=1..197bp; Blast score=326; Percent Identity=83.0; E value=1e-88; Homolog= gi|37527341|ref|NP _930685.1| hypothetical protein [Photorhabdus luminescens subsp. laumondii TTO1] gi|36786775|emb|CAE15841.1|
MAQHSFIKISNDTLRPATPATREYLHSKIKCSDVLQADFKKVRNPRFHRKYFALLNLGFEYWEPVGGTISPEEKAIVRGYVQFLAHFAGREDALQSAEDEYLAGLSKNRAHNITATKYFDAFRRWIIVESGHYDTYEMPDGRLYRELRSVSFAKMDELEFQSLYQSTLNVLWNFILYRNFPTKDAAENAAAQLFDFV

SEQ ID NO: 9152 - protein, 118 aa, Xenorhabdus bovienii
  Peptide sequence Name=Xb4151_4152.C440.gene218.pep
  Homolog annotation: Query=36..91bp; Hit=1..55bp; Blast score=68; Percent Identity=62.0; E value=2e-11; Homolog= gi|37527340|ref|NP _930684.1| hypothetical protein [Photorhabdus luminescens subsp. laumondii TTO1] gi|36786774|emb|CAE15840.1| u
MCCGISSYTATSLPKTQLKMPLLSYLILCEQEARPMTRNEKQWLSDVASLGCIACRNQGMGMSPADIHHVRTGQGMAQRAAHLSVLPLCPRLTGHVIPRVFMLIRKVGRQPTGQKLNY

SEQ ID NO: 9153 - protein, 214 aa, Xenorhabdus bovienii
  Peptide sequence Name=Xb4151_4152.C440.gene219.pep
  Homolog annotation: Query=87..202bp; Hit=294..412bp; Blast score=150; Percent Identity=57.0; E value=2e-35; Homolog= Pa|Phot3-163e06.p1k _g25| 30856 - 32115 701 419 aa, chain -
VAVRCGFAGLYCLQESGDGDVSSGHSSCENRTGNGTTRRSPQRSAALSSSHRACYPTGFHADPKSWQATHGTEIELLEQVKREVGEVRLTKLGLGHYKLSGVLGYNSDGAWGVHGGISVPRDVNGNELVYVDDKVLPDGAIEIRVTHRQNAHMPARLQNRRIKSQDEQTHYTDDEACDLPAGTRLDVRVQMPEDSVWNLRQKAVNGVEVGKQAE

SEQ ID NO: 9154 - protein, 251 aa, Xenorhabdus bovienii
  Peptide sequence Name=Xb4151_4152.C440.gene220.pep
MKKLIFLLAGIVLLSGCAEFERVDALLTEKKAATTDVQKFNYLMQVSKGQTYIYEHSSTEPETFESIRDRYFKEAGLTEEPKIVKKDLVYKCFNKKTYPYEDFECVYKFYSKEIDIEKSVNEANDSAARLHQIRMEDAHNIAKTVTEEGGAEFTEVNIGRFCRASSRVVATAYASVVNTYHIYDLEADKIMLLGLTDKAFVRLKKKVTSDKRGIAMVRNNPQDQEIVYEAYDMLCHANPKSYILNYKKIFR

SEQ ID NO: 9155 - protein, 74 aa, Xenorhabdus bovienii
  Peptide sequence Name=Xb4151_4152.C440.gene221.pep
VAAFFSVSKASTLSNSAHPDNKTIPANKKINFFILIPHLNSGYNNLVVLKNNMTPQEVKKWELHKSIKVGFLTF

SEQ ID NO: 9156 - protein, 93 aa, Xenorhabdus bovienii
  Peptide sequence Name=Xb4151_4152.C440.gene222.pep
MNFNTKVRIFTPIYLVIACALALPVIAFISDMIMGGVAIDLIKKEYTFYEFILFRWWLYTKLAAIGAVLGFVFWFIEYRKYRYHDELDKYFKR

SEQ ID NO: 9157 - protein, 37 aa, Xenorhabdus bovienii
  Peptide sequence Name=Xb4151_4152.C440.gene223.pep
MPPRNVMTWECWWCTVQVILTTYIDNIDTLTIRYEAL

SEQ ID NO: 9158 - protein, 101 aa, Xenorhabdus bovienii
  Peptide sequence Name=Xb4151_4152.C440.gene224.pep
VHHQHSHVITFRGGIFISTIEEITTVAVRCDIPSWVLRKSQYLLCVQIPHMSKSRFLPYSDSSFLSHRSTISRFSLGVVRSRYLINVISGLVGGRGFVFEI

SEQ ID NO: 9159 - protein, 579 aa, Xenorhabdus bovienii
  Peptide sequence Name=Xb4151_4152.C440.gene225.pep
  Gene classification: Function=Predicted hydrolase of alkaline phosphatase superfamily; Function class=R General function prediction only
  Homolog annotation: Query=1..579bp; Hit=1..586bp; Blast score=656; Percent Identity=57.0; E value=0; Homolog= yejM COG3083
MVTSRQHYREKVSQMISWGHWFALFNIMFSLVLGSRYLFASDWPGSLFGRIYALLSWLGHFSFIVFAIYLLILFPLTFIVMSQRLLRFLSAALATAGLTLLILDSSIYIRFHLHLTPLVWDLVTNPDQGELTREWQLMFICIPAIFLVQMLFGTWSWQKLRSLNRQRFGKPLAAVFIIAFIASHLMYIWADANFYRSITMQRSNLPLSYPMTARKFLEKHGLLDQQEYQRRMNQQGNPAALSVEYPLNGLSYQDNKQGYNLLLLVVDGLDNKDITNAMPSLERFTQNNIQFTQHFSTGIQNDTALFGLFYGISSGYLDGILNSRKSSALLDALTHQRYQFGLFSSDGFQTPLYRQALLTDYSFPVPTKKDDSLTVTKWRQWLDLNHGTTPWFSFLGINGFTHSTSQFDKKALDTEINNVLETLTNKGMLDKTIVVITAKHSELSAGHSPKWLTGDKFNREQIHVPLIIHWPGTPAQVINKLTSHQDVMTTLMQRLLHVSNSPDDYSQGEDLFTAQRDNPWLITGDDGSLIVTTATNTIYLSKNGEYYLYDLDGNEIQGAKPNLAQLLQILTEVKRFLAN

SEQ ID NO: 9160 - protein, 75 aa, Xenorhabdus bovienii
  Peptide sequence Name=Xb4151_4152.C440.gene226.pep
  Gene classification: Function=Uncharacterized BCR; Function class=S Function unknown
  Homolog annotation: Query=1..75bp; Hit=1..75bp; Blast score=110; Percent Identity=84.0; E value=3e-25; Homolog= yejL COG3082
MPQSSRYSDEKVEHLLAELVNVFEKNHTPTDLSLMILGNMVTNLINTSIAPAQRRHIADSFARALQSSINEDKAH

SEQ ID NO: 9161 - protein, 54 aa, Xenorhabdus bovienii
  Peptide sequence Name=Xb4151_4152.C440.gene227.pep
LRLAAYSNTVTFLLQPKNQVMEKCSQCNDPLLSFQMAKMMQQTSEWQQFTQSGN

SEQ ID NO: 9162 - protein, 335 aa, Xenorhabdus bovienii
  Peptide sequence Name=Xb4151_4152.C440.gene228.pep
  Gene classification: Function=Nucleoid-associated protein; Function class=R General function prediction only
  Homolog annotation: Query=1..335bp; Hit=1..335bp; Blast score=513; Percent Identity=76.0; E value=1e-145; Homolog= yejK COG3081
MSLEITQIALHRLIKRDEQTLEVILRDSLLTTNQVVEDMMAELHRVYSAKSKAYGLFNDESELAESLRHQRKGDEDFLGFSRAATVRLKDELTKYPFAEGGTVLFCQYRYLAVEYLLISVLNSCNSMSVNDELDVNTTQYLDIPHADIVARIDLTEWETNPESSRYLTFLKGRVGRKVSDFFMDFLAASEGMNAKVQNKGLLQAVDDYCESAQIDKNERQAYRQQVYSYCNEQLQAGEEIKLQELSQELPPLGEQNFQQFSQEQGYALEDSFPADRGTLRQLTKFAGSGGGLTINFDAMLLGERIFWDPVTDTLTIKGTPPNLRDQLQRRGSGND

SEQ ID NO: 9163 - protein, 93 aa, Xenorhabdus bovienii
  Peptide sequence Name=Xb4151_4152.C440.gene229.pep
  Gene classification: Gene name=RplY; Function=Ribosomal protein L25 (general stress protein Ctc); Function class=J Translation, ribosomal structure and biogenesis
  Homolog annotation: Query=1..93bp; Hit=1..94bp; Blast score=136; Percent Identity=75.0; E value=5e-33; Homolog= rplY COG1825
MLTINAEVRKEQGKGASRRLRRANKFPAIIYGGNQEPVSIELDHDAVINHESKPEFYEVLNLVVDGKETTVKVQAVQRHPFKPKLTHIDFLRA

SEQ ID NO: 9164 - protein, 616 aa, Xenorhabdus bovienii
  Peptide sequence Name=Xb4151_4152.C440.gene230.pep
  Gene classification: Gene name=SSL2; Function=DNA or RNA helicases of superfamily II; Function class=L DNA replication, recombination and repair
  Homolog annotation: Query=32..389bp; Hit=1..358bp; Blast score=570; Percent Identity=75.0; E value=1e-162; Homolog= yejH_1 COG1061
MENAFPTARPQKNVILSINYLLSNTHDSNITMAFTLRPYQQEAVDATIRHFRQHKDPAVIVLPTGAGKSLIIAELAKLAHGRVLILAHVKELVAQNHSKYCAYDLQADIFSAGLHQKQSERKVVFGSIQSVARNLDCFDYHFSLLIIDECHRISDDENSQYQQIIQQLKKNNPQIRILGLTATPYRLGSGWIYQYHYHGMIRGDEHCFFRDCIYELPLRYMIKHHFLVPPERLDMPVMQYDFSQVRTSQQGIFHEADLNREIKRQKRITPHIIRQIIEYAQDRRGVMIFAATVEHAKEIFQLLPAEQAALVSADTPATERDLLITAFKAQQLQYMVNVSVLTTGFDAPHVDLIAILRPTESVSLYQQIIGRGLRLSPDKKECLILDYAGNPHDIYSPEVGSSKPNSQNQPIQVFCPICQFANTFWGKCTEEGEIIEHFGRRCQGWEEDESGKRHQCDFRFRFKSCPHCGAENDIAARRCHRCQEVLVDPDDMLKAALKLKNALVLRCGGMQLTSGHDNKGEWLQITYHDEDGASVSERFRLATPAQRKVFELHFLRQHQRAPGIPLQWKTAEDIAQQLPLLRHPDFVVARKKGQFWQIREKIFDYQGRFRRADDLY

SEQ ID NO: 9165 - protein, 235 aa, Xenorhabdus bovienii
  Peptide sequence Name=Xb4151_4152.C440.gene231.pep
  Gene classification: Gene name=RsuA; Function=16S rRNA uridine-516 pseudouridylate synthase and related pseudouridylate synthases; Function class=J Translation, ribosomal structure and biogenesis
  Homolog annotation: Query=1..230bp; Hit=1..230bp; Blast score=350; Percent Identity=72.0; E value=7e-97; Homolog= rsuA COG1187
MRLDKFLSQQLGISRNDVGRELRASRVTVDDEVIKSGAYKLKPDHQIAYEGSVLEQLGGSRYFMLNKPQGYVCSTDDPTNPTILYFIDEPVAHKLHSAGRLDIDTTGLVLLTDDGQWSHRITSPKHHCEKTYLVTLEYPISDDTEMKFLAGVQLNGEKTLTKPAKLEIIEPHRVRLSIREGRYHQVKRMFAAVGNHVVELHRERVGQIYLDSTLEPGEYRALTKHEINSIQVPTP

SEQ ID NO: 9166 - protein, 376 aa, Xenorhabdus bovienii
  Peptide sequence Name=Xb4151_4152.C440.gene232.pep
  Gene classification: Gene name=ProP; Function=77 Permeases of the major facilitator superfamily; Function class=G Carbohydrate transport and metabolism
  Homolog annotation: Query=1..376bp; Hit=20..395bp; Blast score=381; Percent Identity=59.0; E value=1e-106; Homolog= Zbcr COG0477
MLMPLAIDMYLPSMPTIATNFGVDAGRVQMTLSSYILGFAIGQMVYGPMSDSLGRKPVIVGGVIVFAIASAACALSQDIDTFISMRFLHGFSAAAASVVINALMRDMFTKDEFSRSMSFVTLVMIIAPLLAPMLGGLMMVWFNWHAIFWSISIAGVITAFLVAFFIRETLPKERRQRFNLKTIFNQFAMLFRQRQVLFYILASGFSFAGMFSFLSAGAFVYIDLNGVSAQHFGYYFGLNIIFLFIMTMINSQCVRKYGASKMLHFGVFVQFVMGLWLLFSTVLDLGFISLVMGVAIYISGISMITSNAMAVVLDDYPHMAGTVASLAGTIRFSIAALVGTILSSVSAKSAWPMVGSMALCVILAMLLIIYANKAKK

SEQ ID NO: 9167 - protein, 59 aa, Xenorhabdus bovienii
  Peptide sequence Name=Xb4151_4152.C440.gene233.pep
LISIIKLTNFYICLLIARHFLSIQKSIASFAISRSWGITSKCSYYQDRIKKYWENSMIS

SEQ ID NO: 9168 - protein, 50 aa, Xenorhabdus bovienii
  Peptide sequence Name=Xb4151_4152.C440.gene234.pep
MYYRKLDIIHVLFLSETTLIHLTTSCRLSIRQNRITPQQKANKKVNKKLK

SEQ ID NO: 9169 - protein, 114 aa, Xenorhabdus bovienii
  Peptide sequence Name=Xb4151_4152.C440.gene235.pep
  Homolog annotation: Query=1..113bp; Hit=1..113bp; Blast score=165; Percent Identity=72.0; E value=1e-40; Homolog= Pa|Phot5-515h10.p1k _g48| 33815 - 34159 1142 114 aa, chain -
VDNIQLSVVHRLPQSYRWSSGFVGTKVEILPTEETDIENSLMGLKLLSHEGENAWVILHNLNQSIADMQILSAVIEWESEPCLFFAKEDESAVICRLKTLGAAIAENITALYPL

SEQ ID NO: 9170 - protein, 194 aa, Xenorhabdus bovienii
  Peptide sequence Name=Xb4151_4152.C440.gene236.pep
  Gene classification: Gene name=Spr; Function=Cell wall-associated hydrolases (invasion-associated proteins); Function class=M Cell envelope biogenesis, outer membrane
  Homolog annotation: Query=1..187bp; Hit=1..185bp; Blast score=246; Percent Identity=66.0; E value=1e-65; Homolog= spr COG0791
MVKSQPILRYILRLIPAILAAVVLTACSSPDSQMRSKKADTHAVNSQKHFLLQASQDEFETLVKNLDTKSKILNQYADWKGVAYRLGGSTKRGIDCSAFVQRTFHDQFDIDLPRSTSEQQKIGQTVSRSKLRAGDLVLFKTGIYMRHVGIYIGNNQFVHASTSNGVIVSKLTDTYWTKRYYGARRILRDVNKVS

SEQ ID NO: 9171 - protein, 50 aa, Xenorhabdus bovienii
  Peptide sequence Name=Xb4151_4152.C440.gene237.pep
LYLAFYLSFLYPSLLPMIKIMRFVKILIKCVGSHTLGTENLLIHHLLTTL

SEQ ID NO: 9172 - protein, 234 aa, Xenorhabdus bovienii
  Peptide sequence Name=Xb4151_4152.C440.gene238.pep
  Gene classification: Gene name=PgpB; Function=Membrane-associated phospholipid phosphatase; Function class=I Lipid metabolism
  Homolog annotation: Query=9..228bp; Hit=20..240bp; Blast score=236; Percent Identity=58.0; E value=2e-62; Homolog= yeiU COG0671
MTRSNPLSIFILNMFGIALFFSWYLPENHGFWFNIDAAIFHFFNEKLLPNSRFALFVAIVNIRAFDVISLLCMGLLYYSAFRKQSYAGKRRLFMIGLVMLVTAVIINQIGHKIPVSRPSPTLTFENVNRVDDMISWHTKDASKDSFPGDHGLMLLIFSCFILRYVSRGAFFIALLIMITFTLPRIMAGAHWFTDIAIGSLSLTLIGMSWVLLTPLSDIMATWLDKKLPYIRRTS

SEQ ID NO: 9173 - protein, 40 aa, Xenorhabdus bovienii
  Peptide sequence Name=Xb4151_4152.C440.gene239.pep
MLISPCLSNNMPERLLFAINFAIVLPPVNLTTTKIYFRFK

SEQ ID NO: 9174 - protein, 105 aa, Xenorhabdus bovienii
  Peptide sequence Name=Xb4151_4152.C440.gene240.pep
  Homolog annotation: Query=3..105bp; Hit=1..103bp; Blast score=72; Percent Identity=34.0; E value=1e-12; Homolog= gi|37526752|ref|NP _930096.1| hypothetical protein [Photorhabdus luminescens subsp. laumondii TTO1] gi|36786184|emb|CAE15236.1|
MLMLRKTTTFLFISLSYPVMAHDPPPSSSEFLQFHGAIVEPPCQFNWGKKRTEVAYWHNGEQINQDKKLECQKDSYYPLSKHIRIEKIRWIEENKKSGIVTITYH

SEQ ID NO: 9175 - protein, 103 aa, Xenorhabdus bovienii
  Peptide sequence Name=Xb4151_4152.C440.gene241.pep
MQNYLKLLISCLLVSWMSYGYAQSTGGKIQFSGSIVDPGCQVVVSNTQANISCYRLGKNLTVKQIISTQKTTGEVMLPGNIGVSSVKWTDSQKRVAIINVDYF

SEQ ID NO: 9176 - protein, 190 aa, Xenorhabdus bovienii
  Peptide sequence Name=Xb4151_4152.C440.gene242.pep
  Gene classification: Gene name=Efp; Function=Translation elongation factor P/translation initiation factor eIF-5A; Function class=J Translation, ribosomal structure and biogenesis
  Homolog annotation: Query=1..190bp; Hit=86..275bp; Blast score=297; Percent Identity=75.0; E value=6e-81; Homolog= yeiP COG0231
MAKANEIKRGTAISHNGKLLLVKDIDIQTPSARGASTLYKMRFTDVRTGQKVEERFKGDDILETITLTRCSVSFSYIDGDEYIFMDDEDFTPYHFKKNQIEEELLFIPEEGLPGMHVLTMDGQLLALELPQTVDMIIEETTPSIKGASASARTKPAKMSTGLTIQVPEYLSSDEKIRIHIAERRYMGRCD

SEQ ID NO: 9177 - protein, 65 aa, Xenorhabdus bovienii
  Peptide sequence Name=Xb4151_4152.C440.gene243.pep
LIYPHAPVFSLGFSYHFLPNVLTASNFVATSTFIPLFPCFYGRYLWLKPMKLSAELQSVTMANYY

SEQ ID NO: 9178 - protein, 414 aa, Xenorhabdus bovienii
  Peptide sequence Name=Xb4151_4152.C440.gene244.pep
  Gene classification: Gene name=SdaC; Function=Amino acid permeases; Function class=E Amino acid transport and metabolism
  Homolog annotation: Query=10..413bp; Hit=11..416bp; Blast score=419; Percent Identity=57.0; E value=1e-117; Homolog= PA5434 COG0814
MTIEVTQNLKRPSILGGTMIIAGTAVGAGMFSIPIATSGVWFTGSIILLVYTWACMYFSGLMILEANLNYPSGSSFHTVTKDLLGKGWSTLNGLSIAFVLYILTYAYVSAGSSVLFHNFTHFLPLPQSGTGLLFALIVAFIVWMSTKAVDRLSTILIGGMVITFIMSVGSMFTEVKLTVLFDQANTETSYLPYTFMALPYLLASFGYHGNIPGLVKYYHKDSKAVALSLFYGTLIALVIYILWQYVIQGNIPREAFKQIIADGGNIANLLQQMDNTSNNTTIAQLLNAFSYMALASSFLGVSLGLFDYLADFFGFDDSGEGRFKTALVTFIPPTVLALIFPNGFLYAIGFAGLAATIWAVIVPALMARASRMRYPNASYQAPGGSFLIAFIILFGLINATAHVLSLFDVLPAYH

SEQ ID NO: 9179 - protein, 32 aa, Xenorhabdus bovienii
  Peptide sequence Name=Xb4151_4152.C440.gene245.pep
MPSSYGKWKNSILSLKTTHLLKCFSGGLFHIT

SEQ ID NO: 9180 - protein, 174 aa, Xenorhabdus bovienii
  Peptide sequence Name=Xb4151_4152.C440.gene246.pep
  Gene classification: Function=ADP-ribose pyrophosphatase; Function class=F Nucleotide transport and metabolism
  Homolog annotation: Query=40..155bp; Hit=6..118bp; Blast score=84; Percent Identity=43.0; E value=5e-17; Homolog= PA2769 COG1051
MPREDCLSDDENKTTTDNLKSIFIIMDKFQPEEYTVSVVVGVGVIIINDKGEVLLGKRTSQHAPYWSIFGGHVDPGETFEECAIREIQEETGLTIQDPKVYGVCNNLETYHEEGKHTVSVCLLAHHPGGEPQLMEPEKCEQLIWCDPHQLPEPHFEASRNAIKLWQMEKFYLIA

SEQ ID NO: 9181 - protein, 312 aa, Xenorhabdus bovienii
  Peptide sequence Name=Xb4151_4152.C440.gene247.pep
  Gene classification: Gene name=FruK; Function=Fructose-1-phosphate kinase and related fructose-6-phosphate kinase (PfkB); Function class=G Carbohydrate transport and metabolism
  Homolog annotation: Query=1..311bp; Hit=1..311bp; Blast score=462; Percent Identity=73.0; E value=1e-130; Homolog= fruK COG1105
MSRRVATITLNPAYDLVGLCPNITKGTVNRVQTAGLHAAGKGNNVAKVLRDLGIDVTVSGFLGRENQEGFQKFFGKNNMISRFHLVSGRTRINVKLTEKYGEVTDFNFSGFHVTAEEWNYFVSDSLDWLGQFDMVVVSGSLPEGVLPESFADWMLQLKQRCPCIIFDSSREAFVAGLEASPWLVKPNRDELEIWAGKPLPDLDSVINAAHELRNRGIAHVVISLGEQGALWVNASGAWLAKPPYCEIVSTVGAGDSMVGGLVYGLLMRETSEHTLRLATAVSALTVSQPNVGIKSRTELASMMSKIELTSFR

SEQ ID NO: 9182 - protein, 280 aa, Xenorhabdus bovienii
  Peptide sequence Name=Xb4151_4152.C440.gene248.pep
  Gene classification: Gene name=Nfo; Function=Endonuclease IV; Function class=L DNA replication, recombination and repair
  Homolog annotation: Query=1..279bp; Hit=1..279bp; Blast score=449; Percent Identity=76.0; E value=1e-126; Homolog= Znfo COG0648
MKFVGAHVSAAGGVDQAVIRAHELQATAFALFTKNQRQWHAPPLSADVIDKFIANCERYGYGSQQILPHDSYLINLGHPEAEALEKSRAAFFDEMQRCEQLDIDLLNFHPGSHLKKIDIDKCLARIAESINIVLDKTQGVTAVIENTAGQGTNLGFKFEQLAAIIEGVEDKNRVGVCIDTCHAFAAGYDLRTEKDCEATFEAFDKIVGFKYLRAMHLNDAKSEFSSRVDRHHSLGEGNIGNTPFSYIMKDDRFNGIPLVLETINPGIWDQEIAWLKSQQN

SEQ ID NO: 9183 - protein, 53 aa, Xenorhabdus bovienii
  Peptide sequence Name=Xb4151_4152.C440.gene249.pep
MGSNKFHIFSSSNFVSLLWHCSSCQKNLCQKQRIQFNACSHLTQYPLDSLIDN

SEQ ID NO: 9184 - protein, 362 aa, Xenorhabdus bovienii
  Peptide sequence Name=Xb4151_4152.C440.gene250.pep
  Gene classification: Function=Uncharacterized membrane protein; Function class=S Function unknown
  Homolog annotation: Query=13..361bp; Hit=9..348bp; Blast score=337; Percent Identity=59.0; E value=2e-92; Homolog= yeiH COG2855
MSESQLGRIDRFQHNPVLILIPGFVLTAVLTAIAIHVGNMPCFINMGLSALTLAILLGIIVGNTLYPLLKPTCDKGVHFAKYYLLRAGIILYGFRLTFQQIADIGTTGLLIDAIMLSSTFFIALWLGRTFLGLDSQTAVLIGAGSSICGAAAIMATEPVVKASASKVAVAVSTVVIFGTLAIFIYPWFYQLNAHYQWLPFSQETFGIFSGSTIHEVAQVIAVGHTLGNNAENAAVISKMIRVMMLAPFLLLLSGYISRIEAKNFGSDQDQKKSPVSIPWFAIFFIATAGLNSFHLLPGSLIKHIITADTIMLAMAMVALGLTTHVSAIRQAGVKPILLAFFLFIWLIAGGLVVNQGIQRILG

SEQ ID NO: 9185 - protein, 287 aa, Xenorhabdus bovienii
  Peptide sequence Name=Xb4151_4152.C440.gene251.pep
  Gene classification: Gene name=LysR; Function=Transcriptional regulator; Function class=K Transcription
  Homolog annotation: Query=1..286bp; Hit=1..286bp; Blast score=399; Percent Identity=66.0; E value=1e-111; Homolog= yeiE COG0583
MRITLRQLEIFAEVLKSGSTTQASQHLALSQSAVSASLTDLEGQLGVQLFDRVGKRLVTNEHGRLLYPKALALLEQVGEVEQLFKLELGALRLAASSTIGNYMLPEMLSNYRQDYPDTPLELNISNTEDVIKAVVEFRVDLGLIEGLCHNPELITQPWMEDELIIFCSPKNSLSQRDFTVEDLIKEPWILREKGSGTREVLDHLLFSKMPRFNIAMELGNSEAIKHAVQYGMGISCLSRRVVQEQLKNGTLVELVIPELNLYRTLYLIYHRQKHMSNALQKLLSYCK

SEQ ID NO: 9186 - protein, 495 aa, Xenorhabdus bovienii
  Peptide sequence Name=Xb4151_4152.C440.gene252.pep
  Gene classification: Gene name=LysP; Function=Amino acid transporters; Function class=E Amino acid transport and metabolism
  Homolog annotation: Query=16..487bp; Hit=13..484bp; Blast score=760; Percent Identity=86.0; E value=0; Homolog= lysP COG0833
MSQEQSTLGEQPPRTLRRELKARHMAMIAIGGSIGTGLFVASGATISQAGPGGALLSYALIGLMVYFLMTSLGELAAYMPVSGSFSTYGSKYVDEGFGFALGWNYWYNWAVTIAVDLVAAQLVMGYWFNDVPGWVWSALFLGIIFLLNFISVKGFGEAEYWFSLIKVSTIIVFIIVGILMIIGIMKGAESAGWQNWQVGDAPFAGGFAAMIGVAMIVGFSFQGTELIGITAGESKDPAKNIPRAVRKVFWRILLFYVFAILIISLIIPYTDPNLLRNGVKDISVSPFTLVFENAGLLSAAAMMNAVILTAVLSAGNSGMYASTRMLFTLAREGKAPKIFGHLSKGGVPRNALYATTVVAGLCFFSSMFGNQTVYLWLLNTSGMTGFIAWLGIAISHYRFRKGYIAQGRDLNELPYRSGFFPVGPIFAFVLCLMITLGQNYQAFLQDNIDWYGVTATYIGIPVFLIIWFSYKLKKKTRFVKCSEMEFPSLKFTGNE

SEQ ID NO: 9187 - protein, 31 aa, Xenorhabdus bovienii
  Peptide sequence Name=Xb4151_4152.C440.gene253.pep
MALTIKQIRILINAINSGSLQFTDYILPVIP

SEQ ID NO: 9188 - protein, 366 aa, Xenorhabdus bovienii
  Peptide sequence Name=Xb4151_4152.C440.gene254.pep
  Gene classification: Gene name=FecB; Function=ABC-type cobalamin/Fe3+- siderophores transport systems, periplasmic components; Function class=P Inorganic ion transport and metabolism
  Homolog annotation: Query=1..353bp; Hit=1..328bp; Blast score=97; Percent Identity=27.0; E value=2e-20; Homolog= TM0189 COG0614
MNISLLASSAMMASFASWAETVTDVAGRTVEVPEKVNRILLGEGRLFHSLALLEGDKPLARIVGWQGDFRKLDPQTYSIYKAKFPEIDNIPLIGNTSADSVSSEKVLTLNPDVAIFGLSGHGPGKNSELVKQLEKAGIPVVFVDFRNDPLKNTLPSIRMLGKMLHREEQANAYADFYEKNQKLVTDITDQIAEAQKPSVFIELLAGFSGDCCGTAGNGNMGNFIDLAGGKNIAKDVLPSPLGMMNLEKVIVADPYIYIASGAQDPGDKDGGVQMGAQTSADIARAGLKTITVRKGINTLTAVKEGRSYGIWHHYYNSPYNVVVTQVFAKWFYPEKFADLDPQQTLKELHNKFLAVEPAGTYWISEK

SEQ ID NO: 9189 - protein, 361 aa, Xenorhabdus bovienii
  Peptide sequence Name=Xb4151_4152.C440.gene255.pep
  Gene classification: Gene name=BtuC; Function=ABC-type cobalamin/Fe3+- siderophores transport systems, permease components; Function class=P Inorganic ion transport and metabolism
  Homolog annotation: Query=24..361bp; Hit=2..343bp; Blast score=191; Percent Identity=36.0; E value=1e-48; Homolog= PAB0677 COG0609
MSITTKPMPMVKQQLSECDVKARYRHILHRRITLIFTIILVIGASLILDFTMGPSGLSLQALWQTLISPESVDVGTRVIVWDIRLPYALMAVVIGLSLGLAGAEMQTVLNNPLASPFTLGVSNAASFGAALAIVLGIGIPGIPDQWLISANAFIFALLAALMLDSITRWTRVATSGVVLFGIAMVFTFEALVSMMQFIATEDTLQGLVFWTMGSLARATWEKLGIMLLVFLIIMPISMMNSWKLTALRLGEDRAASFGINISRLRLGTLLRISILTALAVAFVGPIAFIGLIAPHIARMMFGEDHRFYLPASALIGALVLSMASIASKNLIPGIIIPVGIVTSLIGVPFFLSIILRHKGSI

SEQ ID NO: 9190 - protein, 262 aa, Xenorhabdus bovienii
  Peptide sequence Name=Xb4151_4152.C440.gene256.pep
  Gene classification: Gene name=FepC; Function=ABC-type cobalamin/Fe3+- siderophores transport systems, ATPase components; Function class=P Inorganic ion transport and metabolism
  Homolog annotation: Query=5..237bp; Hit=21..256bp; Blast score=149; Percent Identity=39.0; E value=2e-36; Homolog= VC0779 COG1120
MNQGLKINRLTAGYPKHPVIENLDVKSLPRGQITVLLGPNGSGKSTLLRSLAGLNKARGELLLNGQDLMQMNFAQRAQGVVYLPQSLPEGVHLHVLESVIVAQRASGGVSSKQCENEVMELLRQLGIEHLALSYLDQLSGGQKQLVGLAQSLIRQPTLLLLDEPLSALDLNYQYHVMDLVARETRRRNIITVVVVHDINIALRHGDHVLMLKKGELIAEGTPEQVITPDSLAQVYGVKGRIERCSQGVPQVLIDGLVTELAN

SEQ ID NO: 9191 - protein, 657 aa, Xenorhabdus bovienii
  Peptide sequence Name=Xb4151_4152.C440.gene257.pep
  Gene classification: Gene name=CirA; Function=Outer membrane receptor proteins, mostly Fe transport; Function class=P Inorganic ion transport and metabolism
  Homolog annotation: Query=5..657bp; Hit=9..652bp; Blast score=548; Percent Identity=44.0; E value=1e-156; Homolog= VC0475 COG1629
MAVFVKRKIVLGIIAAISSSAVLAANNGDDKIVVTTAAGFQQKIEDAPASISVVSREQLETKSYRDITDALKDVPGVVVTGGGSSSDISIRGMASKYTMILIDGKRVDTRSTRPNSDGSGIEQGWLPPLASIERIEVVRGPMSSLYGSDAMGGVINIITRKVQKEWHTSLRADTTLTERKNSGNSYQTSAYAAGPLIDGLLGLKVNGLFSHRNEDKFIGGFREQEMRNGAATFSLTPDEQNTFEFEAGRYEQDRDSTIGKTRDCQPKSCKDDVSRYKRNNYSISHNGVYDFGTMTSYVQRDESHNPEREMKYNDTLFNNQTTFILDDHTLSVGGQYRYEDLRDTGNKLNSAKDVNKLTRWSWALFAEDEWQMTNDFALTGGARLNKDENFGAHWTPRLYGVWHADEQWTIKGGVSTGYRSPELRQVAPNWGQTTGGRSLNGMIIGNSDLKPEKSVSEEISVIWNNQDNFNVGVTVFNTDFKDKITEVGVCDKDTENPCKPTGDITYDFINQRTNLDKANIRGIEATLNWDIVENLSLASSYTYTESEQKSGKYKGQALNKMPKHMANSTLNWQVLPEMATWTRINFRSKSTNYVYRSGVKNGTPSYTFVDLGMTYNLTKNLRVLGGIYNVFDKRVTEKTHDAVLDGRRYNIGINYDF

SEQ ID NO: 9192 - protein, 81 aa, Xenorhabdus bovienii
  Peptide sequence Name=Xb4151_4152.C440.gene258.pep
MFVFLSAAARSYNGRLWSVSIRNKIRPLGVVKNNSKQKNNWCIFTHQLFFSARILHFTPRNSKSYHTKNSLFFTIPESLME

SEQ ID NO: 9193 - protein, 71 aa, Xenorhabdus bovienii
  Peptide sequence Name=Xb4151_4152.C440.gene259.pep
  Homolog annotation: Query=1..71bp; Hit=1..69bp; Blast score=75; Percent Identity=61.0; E value=2e-13; Homolog= Pa|Phot5-515h10.p1k _g23| 16064 - 16273 611 69 aa, chain - [Photorhabdus asymbiotica]
MEQLFTFALVPIGACCCNDDYGAWPTVSSLSSNNSSFFSVYRQMRSLPTNYRLSSCISTQIEVMGGFAHVA

SEQ ID NO: 9194 - protein, 460 aa, Xenorhabdus bovienii
  Peptide sequence Name=Xb4151_4152.C440.gene260.pep
  Gene classification: Gene name=PotE; Function=Amino acid transporters; Function class=E Amino acid transport and metabolism
  Homolog annotation: Query=7..458bp; Hit=1..452bp; Blast score=563; Percent Identity=70.0; E value=1e-160; Homolog= yeeF COG0531
MSHNTTLTLDTNQTSASDRVQLRRTLTLFQVVMMGLAYMQPMTIFDTFGIVSGLTSGHVATSYALALIAILFTALSYGKLVKRFPSAGSAYTYVQKSINPHLGFMVGWSSLLDYLLMPMINILLAKIYLQALFPGIDPWIFVVTLTILMTIFNLSGINVVANLNGVIVIVQVAVMLVLVGFLVHGVYNGEGVGTLLSIQPFTSDEAKLIPMITGATILCFSFLGFDGISSLSEETPNAGKVIPKAIFMTALIGGAIFIAVSYFLQLYFPDISRFKNPDASQPEIMLYVAGALFQYIILMFSCVTVVASGMAAHAGVSRLLYVMGRDGVLPEKVFAYIHPKWRTPSINVILVGIVALSAGWLDLVTATALINFGALVAFTFVNLSVISQFYIREQRNSTLKDTIHFLILPVLGAATVGVLWMNLESSSMKLGLIWGGIGMIYMFFLTRSFRQPMPQFTESV

SEQ ID NO: 9195 - protein, 569 aa, Xenorhabdus bovienii
  Peptide sequence Name=Xb4151_4152.C440.gene261.pep
  Gene classification: Gene name=GlcD; Function=FAD/FMN-containing dehydrogenases; Function class=C Energy production and conversion
  Homolog annotation: Query=1..567bp; Hit=1..567bp; Blast score=873; Percent Identity=71.0; E value=0; Homolog= dld COG0277
MNDAKIPHNQQLIAILTNIVGSPHILTESRKTERYRKGFRSGQGNALAVVFPASLLEQWKVFKACVLADKIILMQAANTGLTEGSTPNGDDYDRDIVIISTLRMDKIQVLTSVNQVIAFPGSTLWHLEKVLKPLGREPHSVIGSSCIGASVVGGICNNSGGSLVQRGPAYTEMALYGRVNEKGQAELINHLGIWLGDTPEDILTCLEEQRYRAEDIQLDDRVASDHEYAQRVRDINAETPSRFNADERRLFEASGCAGKLVVFAVRLDTFPAQSTSQVFYIGTNQPEVLTELRRHILANFQHLPIAGEYMHRDIFDIAEVYGKDTFVMIDKLGTDKMPMFFSLKGRMDAMFGKIPFLPSHLTDRVIQGLNRLLPSHLPTRLKEYRNRFEHHLMLKMSGEGIKEASEWLESYFKQAEGEFFACTPEEGTKAFLHRFAAAGAAIRYQAIHSNEVEDILALDIALRRNDHEWFEHLPPEIDGALVHRLYYGHFMCHVFHQDYIVKKGIDVHALKVKMLKILNQRGAEYPAEHNVGHLYQAKPQLKQFYQMTDPTNTLNPGIGKTSKLKNWGR

SEQ ID NO: 9196 - protein, 35 aa, Xenorhabdus bovienii
  Peptide sequence Name=Xb4151_4152.C440.gene262.pep
MQFSWLANGPASYWLISEKEKDKILCFVFFILIPA

SEQ ID NO: 9197 - protein, 475 aa, Xenorhabdus bovienii
  Peptide sequence Name=Xb4151_4152.C440.gene263.pep
  Gene classification: Gene name=SbcB; Function=Exonuclease I; Function class=L DNA replication, recombination and repair
  Homolog annotation: Query=8..473bp; Hit=10..474bp; Blast score=663; Percent Identity=68.0; E value=0; Homolog= sbcB COG2925
LSNDKTPTFYVHDYETFGKHPALDRPAQFAGIRTDSDFNIIEDPLVVYCLPADDYLPDPEAVMITGITPQLALKKGVNEAEFARQIHEAFSKPNTCIIGYNNIRFDDEVSRNIFYRNFYDPYAYSWQKGNSRWDLLDVLRACYALRPEGIIWPENEDGLPSFKLENLTKANGVEHTQAHDAMSDVYATIAMAKRVKKAQPRLFDYFFQLRNKQKVSNQIDIPQMKPLVHVSGMFGTLRSNISLIAPLAWHPTNRNAVIMCDLAGDISPLLELSADELRERLYTRRNELQPGQAPVPIKLMHINKCPIIAPENTLRTEDAERVGLNRDQCAKNLAILRSNPQIREKVVELFSQPEEFPESDNVDTKLYSGFFSDADKTAMEIIRETAPKNLPALDLTFQDPRIKTLLFRYRARNYPATLNYDEQQRWLYHRREILTQENISQYLAAIEQLFVEYQSDEEKCRQLKALVDYAVQLAG

SEQ ID NO: 9198 - protein, 65 aa, Xenorhabdus bovienii
  Peptide sequence Name=Xb4151_4152.C440.gene264.pep
MTKSFRCHKRFQFLSEKRFFSTCEMIINNFHPISLESSDCPRYGLPYLFASFSLVETKDLVHNLS

SEQ ID NO: 9199 - protein, 43 aa, Xenorhabdus bovienii
  Peptide sequence Name=Xb4151_4152.C440.gene265.pep
MECWFICVVHFYTFFNQTDNFYADYTIQFQVTNRQVSFDNLLT

SEQ ID NO: 9200 - protein, 106 aa, Xenorhabdus bovienii
  Peptide sequence Name=Xb4151_4152.C440.gene266.pep
  Gene classification: Function=Uncharacterized BCR; Function class=S Function unknown
  Homolog annotation: Query=6..101bp; Hit=27..122bp; Blast score=139; Percent Identity=84.0; E value=7e-34; Homolog= yeeX COG2926
MDNANKPTFHNVLEFVRIFRRKNKLQREIVDNEKKVRDNQKRVLLLDNLSDYIKPGMSVEDIQGIIAHMRSDYEERVDEYIIKNAELSKERRELSKKLKAMDGGVK

SEQ ID NO: 9201 - protein, 214 aa, Xenorhabdus bovienii
  Peptide sequence Name=Xb4151_4152.C440.gene267.pep
  Gene classification: Function=Predicted nucleoside-diphosphate-sugar epimerases; Function class=M Cell envelope biogenesis, outer membrane
  Homolog annotation: Query=7..211bp; Hit=1..206bp; Blast score=191; Percent Identity=48.0; E value=6e-49; Homolog= ZchuY COG0702
MENIPAMKSWLIFGAGKGVGRHLATIALKQHRPVTVLIRNLQQAVELSAMGANVIHGDACDKMSIEKAIAQAGENPIVFSTIGGGDADHHGNMSIIDALEQAEVSRMLLVTSIGCGDSWKTLSPRAKSLFGQSIRHKSLAESYLQTSKLDFTIIRPGGLTDKSGTGHCQRYQGEVHGMVSREDVAQQLALVAEDEETYYQIYALVDPELKPHWG

SEQ ID NO: 9202 - protein, 78 aa, Xenorhabdus bovienii
  Peptide sequence Name=Xb4151_4152.C440.gene268.pep
MATSCLSVRWKRRRGWTFCNKYRNICDVKTTVIRIVIGCCNFQKNQKGLLCMESFFILKMIKNLSVSFHSLSDSNKLR

SEQ ID NO: 9203 - protein, 1061 aa, Xenorhabdus bovienii
  Peptide sequence Name=Xb4151_4152.C440.gene269.pep
  Gene classification: Gene name=CafA; Function=Ribonucleases G and E; Function class=J Translation, ribosomal structure and biogenesis
  Homolog annotation: Query=1..1061bp; Hit=1..1061bp; Blast score=983; Percent Identity=59.0; E value=0; Homolog= Zrne COG1530
MKRMLINATQQEELRVALVDGQRLYDLDIESPGHEQKKANIYKGKITRIEPSLEAAFVDYGAERHGFLPIKEIAREYFPSSYHAHGRPNIKDILKEGQEVIVQVDKEERGNKGAALTTFISLAGSYLVLMPNNPRAGGISRRIEGDDRIELKEALSSLELPEGMGLIVRTAGVGKSAEALQGDLNFRLKHWEAIKKAADNHPAPFLIHQESNVIVRAFRDYLRPDIGEILIDNPKILDLARQHITALGRPDFASKIKLYSGEVPLFSHYQIESQIESAFQREVRLPSGGSVVIDTTEALTAIDINSSRATRGGDIEETAFNTNLEAADEIARQLRLRDLGGLIVIDFIDMTPVRHQREVENRLRDAVRQDRARIQIGRISRFGLLEMSRQRLSPSLGESSHHVCPRCSGTGTIRDNESLSLSILRLIEEEALKENTHQVHAIVPVQIASYLLNEKRKAVSAIEHRQGDVGVVIVPNDQMQTPHFSVLRVRKGEEISTLSYLLPQLHEAEMTNAQDDGQHERKRPEQPAISTFDLPAETVAPVAAKTKEKKVVVSNNQQIEQPGLFSRFLCALKKIFNGEEEKQEQEKSNKSSSNDNRRSPERRNSRRQNQRRERNENDTRNNHNRERGDEQRKGRNVQQKNNAPDNIAVDIDNEAREAQQQQRREQRAERQRRRQEEKRQQQLETKVQQTSRPEITEEEVEEHQPVMPRRQRRQLEQKIRITDNVKEEVVVASLPVVTKAIIPAITEEEKKVSVPAIIDTNVEAANQPSIPQGSIAQNNEQQDNIMPRRSRRSPRHLRVSGQRRRRYRDERNLTQSPVPLVMAVASPELASGKVWVRYPVTPVTQPAEPEVSTVEETVIGAEQKESVMPIPAVAESVSVSVSTVADTQVAEQNAVTHDDIKSATNGDPLVEPVPEKPEVLVSENLEPVVNHDTQYQPEALHDMLVHDTEETRHTAEPIIVTSIAEQEQHEEQPTVTTEIYAKAEEVKAEETKIAESPIIVEKNHHASSPMTKAPAPDLAAQPVIINEWQRPAYPFAGKGGAGGHSATNIATSAMSKPQSFE

SEQ ID NO: 9204 - protein, 39 aa, Xenorhabdus bovienii
  Peptide sequence Name=Xb4151_4152.C440.gene270.pep
MASCLLQSRQPHGYRLYRGAYIVGESEFHLNTVLFIGTL

SEQ ID NO: 9205 - protein, 318 aa, Xenorhabdus bovienii
  Peptide sequence Name=Xb4151_4152.C440.gene271.pep
  Gene classification: Gene name=RluA; Function=Pseudouridylate synthases, 23S RNA-specific; Function class=J Translation, ribosomal structure and biogenesis
  Homolog annotation: Query=1..314bp; Hit=1..316bp; Blast score=489; Percent Identity=81.0; E value=1e-138; Homolog= ZyceC COG0564
MKTNNPIVQFVTIDDDEAGQRIDNFLLARLKGVPKSMIYRILRKGEVRVNKGRIKPEYKLAAADVIRIPPVRIAEKQQPPVSAKLGKVVALAECILYEDDYILVINKPSGTAVHGGSGLSFGVIEGLRALRPEARFLELVHRLDRDTSGVLLIAKKRSALRTLHEQLRLKQMQKDYFALVRGQWQSHCKVVQAPLLKNILQSGERIVKVSSEGKPSETRFKVEERYEFATLVRASPITGRTHQIRVHTLHAGHPIAFDDRYGDRAFDAQLTETGLNRLFLHASSLKFTHPSTGETLRFEAQMDDELRQCLTTLRQNNY

SEQ ID NO: 9206 - protein, 201 aa, Xenorhabdus bovienii
  Peptide sequence Name=Xb4151_4152.C440.gene272.pep
  Gene classification: Gene name=Maf (BS); Function=Nucleotide-binding protein implicated in inhibition of septum formation; Function class= D Cell division and chromosome partitioning
  Homolog annotation: Query=1..196bp; Hit=10..205bp; Blast score=246; Percent Identity=61.0; E value=8e-66; Homolog= yceF COG0424
MEKMMLPIVLSSTSIYRRLLLEKMGLPFVCTTPNIDESPQENESPTQLVMRLSQAKATALQPSYSSHLIIGSDQVCVLSGKITGKPHNFENAFAQLKKASGQCVTFYTGITLFNSKTGNTDTRCELFHVHFRDLTEPEIISYLNKEQPFNCAGSFKSEGLGITLFKKLDGRDPNTLIGLPLITLTEMLIRQGINPLTVCYQ

SEQ ID NO: 9207 - protein, 174 aa, Xenorhabdus bovienii
  Peptide sequence Name=Xb4151_4152.C440.gene273.pep
  Gene classification: Function=Predicted metal-binding, possibly nucleic acid-binding protein; Function class=R General function prediction only
  Homolog annotation: Query=1..172bp; Hit=1..172bp; Blast score=250; Percent Identity=72.0; E value=6e-67; Homolog= yceD COG1399
MQKVKLPLTIDALRAAQKRLDYEGSYSAEQASRLAESVVSVDGDINSSLSFQIDNLRLAVVKGHSDVDVTLACQRCGSNFSHHVHITYCFSPVVNDERAEALPEEYEPININEFGEIDLLAMIEDEIILSLPVVPVHDSEHCEVSDAEMVFGVLPPEAEKPNPFAALASLKKST

SEQ ID NO: 9208 - protein, 56 aa, Xenorhabdus bovienii
  Peptide sequence Name=Xb4151_4152.C440.gene274.pep
  Gene classification: Gene name=RpmF; Function=Ribosomal protein L32; Function class=J Translation, ribosomal structure and biogenesis
  Homolog annotation: Query=1..56bp; Hit=1..57bp; Blast score=72; Percent Identity=89.0; E value=8e-14; Homolog= rpmF COG0333
MAVQQNKPTRSKRGMRRSHDALTATHVSVDKTSGETHLRHHVTADGYYRGRKVINK

SEQ ID NO: 9209 - protein, 345 aa, Xenorhabdus bovienii
  Peptide sequence Name=Xb4151_4152.C440.gene275.pep
  Gene classification: Gene name=PlsX; Function=Fatty acid/phospholipid biosynthesis enzyme; Function class=I Lipid metabolism
  Homolog annotation: Query=11..342bp; Hit=1..331bp; Blast score=449; Percent Identity=69.0; E value=1e-126; Homolog= ZplsX COG0416
LANLTLALDAMGGDFGPRVTVPAALQALASNPQLKLLLVGDPETISPLLANKNAEQLSRLQIIPAEHVVSNDAKPSQAIRSSHGTSMRIALNLVKTGEAQACVSAGNTGVLMGLAKLMLKSIEGIERPALMTMIPNLKQQKTVILDLGANINCNSRMLVQFAIMGAVMAEDVTGVKNPRVALLNIGEEESKGLDNIREAAMTLQNTPTINYIGYVEGNELLTGKTDVLVCDGFAGNVTLKTMEGAIRVILSLVKSPDSQKKKSSWLRKIFKKWLLKQILKRFGHLNPDQYNGATLLGLRGIVIKSHGAANERAFKAAIDQAVQTVQNQVPDRIAARLDAVLPKSE

SEQ ID NO: 9210 - protein, 317 aa, Xenorhabdus bovienii
  Peptide sequence Name=Xb4151_4152.C440.gene276.pep
  Gene classification: Gene name=FabH; Function=3-oxoacyl-[acyl-carrier- protein] synthase III; Function class=I Lipid metabolism
  Homolog annotation: Query=1..317bp; Hit=1..317bp; Blast score=481; Percent Identity=76.0; E value=1e-136; Homolog= fabH COG0332
MYTKILGTGSYLPSQVRTNADLEKMVDTTDEWIVTRTGIRERRIAAEGETVATMGFNAAEKAIEMAGIDKTQIDLIVVATTTSSHAFPSTACQIQNSLGIQGIAAFDVAAACAGFTYALSIVDKFIKTGAAKHALVIGADIISRVVDPEDRSTVVLFGDAAGAMVVGASEEPGILSTHLHADGRYGDLLSLPNQDRLKRGSPEYVTMAGNEVFKVAVRELTSIVDETLEANNLDHSQLDWLVPHQANLRIISAAAKKLDMTMDKVVVTLDRHGNTSAASVPTAFDEAVRDGRIQRGQLVLIEAFGGGFTWGSALVRF

SEQ ID NO: 9211 - protein, 309 aa, Xenorhabdus bovienii
  Peptide sequence Name=Xb4151_4152.C440.gene277.pep
  Gene classification: Gene name=FabD; Function=(acyl-carrier-protein) S-malonyltransferase; Function class=I Lipid metabolism
  Homolog annotation: Query=1..307bp; Hit=1..307bp; Blast score=421; Percent Identity=76.0; E value=1e-118; Homolog= ZfabD COG0331
MSDFAMVFPGQGSQSLGMLADLATEFPLVEQTFAEASAVLGYDLWALVQQGTAEELNKTWKTQPVLLAASVAIWRIWQEKGGKQPSMMAGHSLGEYSALVCAGVIEFQQAIKLVELRGKLMQEAVPEGQGAMYAIIGLDNESIAKACKESAQGQVVSPVNFNSPGQVVIAGEKEAVERAGAACKAAGAKRALPLAVSVPSHCALMKSAAAQLAVALQSIVFNQPQFPVVNNVDVKVEESADGIRDALVRQLYNPVRWTESVEYIAAQGTEQLLEMGPGKVLTGLTKRIVDTLNAVAVNDVSSLTVALNK

SEQ ID NO: 9212 - protein, 244 aa, Xenorhabdus bovienii
  Peptide sequence Name=Xb4151_4152.C440.gene278.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=1..244bp; Hit=1..244bp; Blast score=360; Percent Identity=83.0; E value=1e-100; Homolog= fabG COG1028
MSFDGKIALVTGASRGIGRSIAELLVERGARVIGTATSENGAEAISAYLGDKGKGFVLNVTDSESVEKTLSNIRAEFGEIDILVNNAGITRDNLLMRMKDGEWQDIIDTNLSSIFRLSKAVMRSMMKKRYGRIISIGSVVGTMGNAGQANYAAAKAGVIGFSKSLAREVASRGITVNVVAPGFIETDMTRALTDDQRVGILSEIPASRLGDAKEIASAVAFLASDEAAYITGETLHVNGGMYMI

SEQ ID NO: 9213 - protein, 149 aa, Xenorhabdus bovienii
  Peptide sequence Name=Xb4151_4152.C441.gene1.pep
  Gene classification: Gene name=Fur; Function=Fe2+/Zn2+ uptake regulation proteins; Function class=P Inorganic ion transport and metabolism
  Homolog annotation: Query=1..146bp; Hit=1..146bp; Blast score=239; Percent Identity=83.0; E value=8e-64; Homolog= fur COG0735
MTDNNKALKNAGLKVTLPRLKILEVLQDPECHHVSAEDLYKKLIDIGEEIGLATVYRVLNQFDDAGIVTRHNFEGGKSVFELTQQHHHDHLICLDCGKVIEFSDEFIEERQKDIAERYGIKLSNHSLYLYGHCTAGDCRKDSTMHDENS

SEQ ID NO: 9214 - protein, 893 aa, Xenorhabdus bovienii
  Peptide sequence Name=Xb4151_4152.C441.gene2.pep
  Gene classification: Gene name=Chb; Function=N-acetyl-beta -hexosaminidase; Function class=G Carbohydrate transport and metabolism
  Homolog annotation: Query=7..890bp; Hit=4..883bp; Blast score=978; Percent Identity=53.0; E value=0; Homolog= VC2217 COG3525
MKSVKLRTLAALITTVGLMGCVHAEMTSQQIVDSLSQLKVNFKIKDNQAGAHGTDCAILGADGASCNRVHITLANGNQAIDSSDWAIYFHSIRQILKVDHEQYKITHITGDLHKLEPTEKFIGIKANEKILLPIFGEYWQIYSTDFMPRWYATSGDAMPKILANTDTEDLSAFLSDFTDEQWKRTTLDNNILMTPETRFVKNQQMVKISGDKLRGQVIPTPKTLTIHSQDVNLSRGVKLELGGLSNASINVIRERFASHNIKLTDNGYRIAAQINANKFTGTWRVQGAYSLNITTQGTQIVAFDQSGVFYGLQSLLSLLPANGDPTIATLTAKDAPRFDYRGIFLDVGRNFHSKEAVLRLLDQMSSYKLNKFHFHLSDDEGWRLEIPGLPELTEVGSKRCHDLSETQCLLPQLGSGPDSNNMGSGYFSRQDYIDILKYAKARQIEVIPEIDTPAHARAAVVSMEARYKNLMAQGKEQEANEYRLLDPTDTTNATSVQFYDRRSYLNPCMDSSKRFVDKIISEIALMHREAELPLKTWHFGGDEAKNIRLGTGYQDKDGPIEPGKGIINKKIEDKPWAKSQACQKMIAQGIVKDVSELDSHFAIEVSKIVNTHGIDTMQAWQDGLKHAKSAKDFATKHVAVNFWDTLYWGGYDSANDWANKGYRVVVSSPDYVYLDMPYEVSPKERGYYWATRFNDEAKIFSFAPNNMPQNAETSVDRDGNRFNTQSNKHWPGAYGLSGQSWSETVRTDDQMEYMIYPRLLPLAERAWHQASWEQNYQQGREYKGGVTHYVDTNAINNDWIDFANLMGQHELAKLDKANIAYRLPVPGGRIVSGTLEANIALPGLAIQYSLDGGKTWAIYDDRQRPHVSNNVKVRSVSTDGKRFSRDEEVKITL

SEQ ID NO: 9215 - protein, 555 aa, Xenorhabdus bovienii
  Peptide sequence Name=Xb4151_4152.C441.gene3.pep
  Gene classification: Gene name=GlnS; Function=Glutamyl- and glutaminyl-tRNA synthetases; Function class=J Translation, ribosomal structure and biogenesis
  Homolog annotation: Query=1..554bp; Hit=1..554bp; Blast score=1003; Percent Identity=85.0; E value=0; Homolog= glnS COG0008
MSEADARPTNFIRQIIDEDLATGKHTSVHTRFPPEPNGYLHIGHAKSICLNFGIAQDYQGQCNLRFDDTNPVKEDIEYVDSIKTDVQWLGFHWSGNIRYSSDYFDMLYQYAIELINKGLAYVDELSPEQIREYRGTLKEPGKNSPYRDRSVEENLALFEKMRAGEFAEGKACLRAKIDMASPFIVMRDPVIYRIKFAEHHQSGNKWCIYPMYDFTHCISDALEGITHSICTLEFQDNRRLYDWVLDNITIDCHPRQYEFSRLNLEYTVMSKRKLNQLVTENIVNGWDDPRMPTISGLRRRGYTAAAIREFCRRIGVTKQDNNVEMAALESCIRDDLNENAPRAMAVLDPVKLVIENMPEGEMILTMPNHPNKPEMGSREVPFSREVYIDRADFREEANRQYKRLVLGKEVRLRNAYVIKAEHVEKDAEGNITTIYCHYDEQTLNKDPADGRKVKGVIHWVSAVHAVPAEFYLYDRLFSVPNPGAEDDFLSTINSESLVVRKGFVEPGLVNAQPERTYQFEREGYFCADSGLSSAEHLVFNRTVGLRDTWTKISQE

SEQ ID NO: 9216 - protein, 43 aa, Xenorhabdus bovienii
  Peptide sequence Name=Xb4151_4152.C441.gene4.pep
MGFGAKLMRKSGKTNPFPRQLRENLTLVQHSLRIFEQQNKLLV

SEQ ID NO: 9217 - protein, 409 aa, Xenorhabdus bovienii
  Peptide sequence Name=Xb4151_4152.C441.gene5.pep
  Gene classification: Gene name=WecE; Function=Predicted pyridoxal phosphate-dependent enzyme apparently involved in regulation of cell wall biogenesis; Function class=M Cell envelope biogenesis, outer membrane
  Homolog annotation: Query=6..403bp; Hit=9..386bp; Blast score=246; Percent Identity=36.0; E value=3e-65; Homolog= NMB1821 COG0399
MNFPQWPSFTEKTLKDIQEPLLSGQVNYWTGKKGMEFENKFAHWIGAEMAISCNSGTSAVNIAVGALNIGPGDEVIVPSYTFIATSFAVLQCGAIPVFCDTTEEHTIDPTKIEALITPRTKAIIVVHLYGVVSDMDPIMAIARQHNLKVIEDSAQCLGGKYKGKSAGTIGDIGTFSFCQSKHFTTGGEGGMVVTNNTEIGWECRAYRDHGFDVRRKFDLLALEEVSWHVHNRIGYNYRMTEIQSIIGLNELERFDDWNMNNRKRYAKIYDEKFADIDLIHGLPLNNEDRCNAYWLYPIVFDLAKLDCTAEIILSDLKKIGIPAFKIQWPEAYGEKVFRDLRGFGSANFPFHSKEYTSPESVNYRDVVCETARSLLPRTISLYLHPTWDEEHIVYCADQLIAVLNSHRVS

SEQ ID NO: 9218 - protein, 374 aa, Xenorhabdus bovienii
  Peptide sequence Name=Xb4151_4152.C441.gene6.pep
  Gene classification: Gene name=ProP; Function=77 Permeases of the major facilitator superfamily; Function class=G Carbohydrate transport and metabolism
  Homolog annotation: Query=10..365bp; Hit=20..374bp; Blast score=147; Percent Identity=30.0; E value=1e-35; Homolog= mlr3825 COG0477
MNNVISTRIVFLAAGMGIAAWAPLIPLVKADLNIDAGELGFLLLFLGFGSIVSMPITGFLTTLFGCRKVIISSGIFAIVSLPLLILAPNVTQLGFMLFIFGASIGTVDVAMNIQAVEVEKNTNRNLMSGFHGFFSLGGIFGAAGVSILLYLNFSALAACLIISFILSVLFLFSFSGLISRHKNHGDSDSKKIVFPRGIIIVASLLCFLMGIIEGSVIDWSGVFLVSERNIDISFSGFGYAAFAAAMTIGRFMGDRVISKIGRGKVFFVGTLSIFIGFLIVVNVGTLNLSMIGFFFIGLGSSNIVPILCSISGTQKVMLPSHAVASIVTFGYFGIMIGPALIGFIAQSSGLETAFYILAIGALIMVANTKLIKKH

SEQ ID NO: 9219 - protein, 224 aa, Xenorhabdus bovienii
  Peptide sequence Name=Xb4151_4152.C441.gene7.pep
  Gene classification: Function=Predicted phosphatase/phosphohexomutase; Function class=R General function prediction only
  Homolog annotation: Query=17..170bp; Hit=9..163bp; Blast score=118; Percent Identity=40.0; E value=5e-27; Homolog= mlr4094 COG0637
MCVFYYGGVMEVINIKAILFDMDGTLVKSLSEVEAIWSIWCELNNISIKKVLDICHGVRSRDVISSIAPHLNMEEQIQLLDDLEIKYSDTAKALPGAKEFLISLAACPWAIVTSASQRVAYHRMAICGLKIPDFIIGSDDVLNGKPYPDPYLMAAERLNIAAEDCLVFEDAHAGVQSALAAGCKVIQIGGKEKMFDSVIGLINDWNEIKITEMGINSFRVNMNL

SEQ ID NO: 9220 - protein, 349 aa, Xenorhabdus bovienii; identical to SEQ ID NO: 5796
  Peptide sequence Name=Xb4151_4152.C441.gene8.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 9221 - protein, 245 aa, Xenorhabdus bovienii
  Peptide sequence Name=Xb4151_4152.C441.gene9.pep
MKKIIMIFTLLFTSINVNAQVLNENNPDKYKKFRLDYVEMVDLANPERLSYRVFYEEPSTGENSKWFDAIKQGDFETVKKMVESGQDIEAKDTGSLNQTALGWAAFIGYEDIVDYLISKKANLWATDTRDVHHTLKSAILGKNTNIVKKIHNLMKHELDLNDQTIEDDGETPVMIAASNNRIETVKYLVEQGANLNLFTITDDKSMYSYDQSALTYACERNLEEMQKLLIKHGALNHKTHNPSCN

SEQ ID NO: 9222 - protein, 83 aa, Xenorhabdus bovienii
  Peptide sequence Name=Xb4151_4152.C441.gene10.pep
MTSTMVFHNGVCMAESVKFISSIFCDYIFLFCFFWCISVPVGLIFTAMACVFKKATYRISCSILAILFLFPLIFTLMYIALSK

SEQ ID NO: 9223 - protein, 64 aa, Xenorhabdus bovienii
  Peptide sequence Name=Xb4151_4152.C441.gene11.pep
MRVLLPEQQKNIMAHNEFLESFIDVNTPIVFPVNMKNKDGMTECQFPDVVIMKAWGFYYFQKPH

SEQ ID NO: 9224 - protein, 413 aa, Xenorhabdus bovienii
  Peptide sequence Name=Xb4151_4152.C441.gene12.pep
  Gene classification: Gene name=SdaC; Function=Amino acid permeases; Function class=E Amino acid transport and metabolism
  Homolog annotation: Query=1..410bp; Hit=1..409bp; Blast score=274; Percent Identity=40.0; E value=1e-73; Homolog= yqeG COG0814
MEQKWINEYNIWFYALFGTAVGAGTLFLPIQLGLSGPLAMLVMLLIAFPFTYYPHLGLARYIITSNSDSPTLLSATKQYYGIRIARIINFFYALTFLLIIFVYAISITNSVNILLQQFWKIQFPRTLIAFMVVLGLHLIFLLGKKITLKFMGVLVLPLILYLLTLSVTLVSQWDSANIKHLISNIHTDWDSVRALWLLMPVMVFSFSHTPIMSTFSNHCKRAYKTDAEYHIKQIVKPTYALICVVILFFVFSCVLTLSPQEIQATKDNNITILSAIAQKEGLYWIAITATPVAIIAMTKSFLGTYFGALEGVRGLVGALESKILHHKENKVRDKLIGMAIVFVLTLMITIWNPNTLNVIAGITGPMIALILFVLPSLSTYLVEPLRPYRSFSNLMVLLVGLGSFGIAVFSLFS

SEQ ID NO: 9225 - protein, 78 aa, Xenorhabdus bovienii
  Peptide sequence Name=Xb4151_4152.C441.gene13.pep
MQSSFDKLNETFGKKLSQRLEITEASFDALDKRFKAACDRLENVNSRLQYRFIAWLAVSVVAVVGTLFFLKRFIFILV

SEQ ID NO: 9226 - protein, 117 aa, Xenorhabdus bovienii
  Peptide sequence Name=Xb4151_4152.C441.gene14.pep
MLFAVTLNSISDVITPKIPNTRLSEAYSGRIIATRKARLMQFRENWQNICNPHFERALRLKRIVEEIQKTTKALIIAGSQTRDEKLRQCNTFMHRRMTAGQTCCINSLGRCWQHCRA

SEQ ID NO: 9227 - protein, 31 aa, Xenorhabdus bovienii
  Peptide sequence Name=Xb4151_4152.C441.gene15.pep
MGFEALIYSRFHLRRRREAATLSPDVFCPHQ

SEQ ID NO: 9228 - protein, 89 aa, Xenorhabdus bovienii
  Peptide sequence Name=Xb4151_4152.C441.gene16.pep
MSEILHKNNIKAACQIKSSDKNSIDWINSKSGYSFVIKPLSSASTDGVTIYFHERDVFDACEVVLKNKNIFGIDNKEILVQSFLKGESI

SEQ ID NO: 9229 - protein, 81 aa, Xenorhabdus bovienii
  Peptide sequence Name=Xb4151_4152.C441.gene17.pep
MLSFLCYEQTDRNPIDRGKQGVKQSLLTDGQDLPLAIAVAPENIHDIRFVITTLVCKPTRVVMTPNSIWIKFIRRNDCKKQ

SEQ ID NO: 9230 - protein, 98 aa, Xenorhabdus bovienii
  Peptide sequence Name=Xb4151_4152.C441.gene18.pep
MSKGILALVSGVDQLLSVIGLLLGGANIIKLINFSIITLHVENNMKKYILSCLLASTTLLASMQSYAIACNFFPPDSQEWKACIEVCKLLPISPKICL

SEQ ID NO: 9231 - protein, 61 aa, Xenorhabdus bovienii
  Peptide sequence Name=Xb4151_4152.C441.gene19.pep
MLKLVNSLLLSFFFTAIVIVGIVTTPEYVKDSIKEAIEEHAASRNHPYATQVEPGFVTLNN

SEQ ID NO: 9232 - protein, 151 aa, Xenorhabdus bovienii
  Peptide sequence Name=Xb4151_4152.C441.gene20.pep
  Homolog annotation: Query=1..103bp; Hit=551..641bp; Blast score=79; Percent Identity=47.0; E value=2e-14; Homolog= gi|16082786|ref|NP _395340.1| putative phage tail protein [Yersinia pestis CO92] gi|5834689|emb|CAB55186.1| putative phage tai
LEKNQNGEDIPDKTEFVKNIGLSGTVELARNSVQGKQYIYDLTYATAAWIKIAEVTMGVPSTININLIGGSGYNVGFFGQCAITNIVLRTGNNNPHGVNAVMYTTNSGAPTDLESIPIGLYSRQLNYKPNEAWLHNFQPVFPNGPESDEND

SEQ ID NO: 9233 - protein, 133 aa, Xenorhabdus bovienii
  Peptide sequence Name=Xb4151_4152.C441.gene21.pep
  Homolog annotation: Query=1..127bp; Hit=94..223bp; Blast score=113; Percent Identity=47.0; E value=5e-25; Homolog= gi|21228333|ref|NP _634255.1| Transposase [Methanosarcina mazei Goe1] gi|20906799|gb|AAM31927.1| Transposase [Methanosarcina m
LLTDGQGLPLAIAVAPANIHDIRLVIATLDGLQTGCRGYGTKLHRDKAYEAEWLEKELKTRGYVPCIQSRKEEQDALAEQEDFKVNRWVVERTHSWLNRFRRILVRWEKRVENYEAMLHLACSLIVWNIILLG

SEQ ID NO: 9234 - protein, 135 aa, Xenorhabdus bovienii; identical to SEQ ID NO: 6015
  Peptide sequence Name=Xb4151_4152.C441.gene22.pep
  Gene classification: Function=Predicted transposase; Function class=L DNA replication, recombination and repair
  Homolog annotation: Query=11..88bp; Hit=11..83bp; Blast score=58; Percent Identity=39.0; E value=2e-09; Homolog= sll1791 COG3293

SEQ ID NO: 9235 - protein, 113 aa, Xenorhabdus bovienii
  Peptide sequence Name=Xb4151_4152.C441.gene23.pep
  Homolog annotation: Query=5..102bp; Hit=115..205bp; Blast score=65; Percent Identity=32.0; E value=2e-10; Homolog= gi|16765956|ref|NP _461571.1| Gifsy-1 prophage: similar to integrase in phage [Salmonella typhimurium LT2] gi|7467280|pir||T03
MQGLKVNAEYVLRYFELYVFPKIGKLPHDEVPLHVWLSLIADISKQVPSIGIRILTYSKTAHRWAVRRGMTNFTPLSDVERSDLGGKGADDDIDPEIGARALRVYPNRRYLIL

SEQ ID NO: 9236 - protein, 349 aa, Xenorhabdus bovienii; identical to SEQ ID NO: 5796
  Peptide sequence Name=Xb4151_4152.C441.gene24.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 9237 - protein, 123 aa, Xenorhabdus bovienii
  Peptide sequence Name=Xb4151_4152.C441.gene25.pep
  Homolog annotation: Query=1..109bp; Hit=1..109bp; Blast score=129; Percent Identity=57.0; E value=9e-30; Homolog= gi|15603332|ref|NP _246406.1| unknown [Pasteurella multocida] gi|12721849|gb|AAK03551.1| unknown [Pasteurella multocida]
MDKKIIEILQYELKAATGKEFHRIMTEISVPLHEKTGIDVISYGNSLHNSDSYYLIRAFSDFDEMNNILTAFYSSDSWINGPKIEIIEKINKSMKSIIALPNVSIDALRRSGYIVGGKNYISV

SEQ ID NO: 9238 - protein, 37 aa, Xenorhabdus bovienii
  Peptide sequence Name=Xb4151_4152.C441.gene26.pep
MTNLVHFPKEKKQIIFFIRALSQNYRKPHQYPIGFFI

SEQ ID NO: 9239 - protein, 137 aa, Xenorhabdus bovienii
  Peptide sequence Name=Xb4151_4152.C441.gene27.pep
  Homolog annotation: Query=6..124bp; Hit=8..126bp; Blast score=113; Percent Identity=51.0; E value=6e-25; Homolog= gi|32030587|ref|ZP _00133406.1| hypothetical protein [Haemophilus somnus 2336]
MNKICTLLLSAVMLCSGCATIIGEKNQLIEVNSQPSGAEFSIKDETGKVVAHGNTPQNVMLEKSNGHYFGKKNYQITFVKEHFKSFTLPLVAKPNGWYIGGNFVFGGLIGWLIVDPLNGGMYTLHPKIANAVLSEAK

SEQ ID NO: 9240 - protein, 70 aa, Xenorhabdus bovienii
  Peptide sequence Name=Xb4151_4152.C441.gene28.pep
MPVRIKQLQIIYAFLTSNYFLKLAIEKTIFLRLYRQLFRSQNSLYYIKYSWYFHDCMQDRIVLFINYINK

SEQ ID NO: 9241 - protein, 224 aa, Xenorhabdus bovienii
  Peptide sequence Name=Xb4151_4152.C441.gene29.pep
  Homolog annotation: Query=1..206bp; Hit=9..206bp; Blast score=129; Percent Identity=39.0; E value=5e-29; Homolog= Pa|Phot2-78f05.p1k _g10| 9198 - 9863 334 221 aa, chain -
MRKLSVIALSVLALTGCKVGLDTEVNLSDILAQEHKIVQGNLNVEVTSCSTSGDSRQESKSLIEAKKKIPTIFKNAEFVECYRKDFDSFAHFTIPIDVGSAQDPINQQNTDVYIYSNKKQKIIAELKLTDALIGRINKAKKDLSSMKFNFSVKIHRTKEPINVKALGVFMTSDKGQTTPMVYEDFEWSKSKYATFKLSDVAVNSLLAKGKHPLLLEIDYFEKNK

SEQ ID NO: 9242 - protein, 73 aa, Xenorhabdus bovienii
  Peptide sequence Name=Xb4151_4152.C441.gene30.pep
MKSRIIKQYYTIYALIAGVFDRMFTVSEISHGGGFDIGCSHALTSEITQLSEIARQKILPALPLNVFPKCLWM

SEQ ID NO: 9243 - protein, 327 aa, Xenorhabdus bovienii
  Peptide sequence Name=Xb4151_4152.C441.gene31.pep
  Gene classification: Gene name=RhaT; Function=7 Permeases of the drug/metabolite transporter (DMT) superfamily; Function class=G Carbohydrate transport and metabolism
  Homolog annotation: Query=30..314bp; Hit=8..292bp; Blast score=150; Percent Identity=35.0; E value=2e-36; Homolog= BS_yyaM COG0697
MISIKAIQSNVCRIKNKVITMRNTPQSAVVLTLFATFFWSSNFQVTKFALESLPPWTASVERFVFAVLPIFIFMALKSGIHGKVLRKNLLAFICLGAIGVAGFNGALFVGLQSSSPITAALIMATTPISANILEAIMNRRFPELIRVLGMGISLLGVVLVITNGQLVGGMVHMASGDAIIFAGSLGWAIYTVGTRKFITNATPLEITSWTMLFGVVILAMIAFFVESPISSMRSGTFESHLASAYMGIAGSFLAYLFWNIGVALRGAGKTAIFFNFVPIFALIIQLMMGNSPSLPQLVGIMLTIVGVLLGQGIITAWFTSKGILEKH

SEQ ID NO: 9244 - protein, 322 aa, Xenorhabdus bovienii
  Peptide sequence Name=Xb4151_4152.C441.gene32.pep
  Gene classification: Gene name=LysR; Function=Transcriptional regulator; Function class=K Transcription
  Homolog annotation: Query=22..300bp; Hit=3..284bp; Blast score=133; Percent Identity=31.0; E value=2e-31; Homolog= PA1138 COG0583
MQTKIEIDFPKMKNKTAQSLVWDDIRVFLAIARTGTLSRAADVLKIGIATVSRKIERLETTFGMPLFLRHQAGYRLTEDGKELLEKAKAMEIAASSFLLEADTRIAISGKVRLATTETFASDLVIPSLPTLQKNYPDLTLEITTDIHTVDLHRRDADLALRIVRPERGHVTVRQLGKLGFGLYGNKDYLATCSPDILRGKYEKARFIGWAETYSYLPSFRWTEKNLKSRPLSVATTSLNAQLAAVKAGLGLAVLPHFIVQYTELKCISHDLGIDQSIWLVIQADLAHSPRIRKVADFLAEIVFQNQGKLSGQTGINSVILPD

SEQ ID NO: 9245 - protein, 39 aa, Xenorhabdus bovienii
  Peptide sequence Name=Xb4151_4152.C441.gene33.pep
MTLNDLWCLSRQRKSVPLVAFPSSLYFWLITLNQVISQN

SEQ ID NO: 9246 - protein, 164 aa, Xenorhabdus bovienii
  Peptide sequence Name=Xb4151_4152.C441.gene34.pep
  Gene classification: Gene name=WecD; Function=Histone acetyltransferase HPA2 and related acetyltransferases; Function class=K Transcription
  Homolog annotation: Query=2..163bp; Hit=3..162bp; Blast score=143; Percent Identity=45.0; E value=9e-35; Homolog= yhhY COG0454
MEIIIRAAESEDAEHFQRIFSHPDVYPNTLQLPCPSREMWRERIKENKTRGTIHFVAEIDGKVVGKVSLFTLDNPRRRHVVGVGISVDADYSGKGIGSKMMEFAIDYAFNWLAAVRIELEVFTDNEKAIALYTKFGFEKEGVLRKASLRNGQYCDVMAMSIIKN

SEQ ID NO: 9247 - protein, 135 aa, Xenorhabdus bovienii
  Peptide sequence Name=Xb4151_4152.C441.gene35.pep
  Homolog annotation: Query=19..124bp; Hit=19..121bp; Blast score=62; Percent Identity=34.0; E value=1e-09; Homolog= gi|34496130|ref|NP _900345.1| conserved hypothetical protein [Chromobacterium violaceum ATCC 12472] gi|34101984|gb|AAQ58351.1|
MHQKNSAIFELLKNLEISLHKEKRNNIDWLNTILHDDFLEIAKSGYVYSKKVVIDELTTEFKMVLPIFSQDFNIKWLDKNIALITYQSYEINKSGHPFNKALRSSIWQLSVSGTWQLRFHQGTIMAAQPLSNITL

SEQ ID NO: 9248 - protein, 468 aa, Xenorhabdus bovienii
  Peptide sequence Name=Xb4151_4152.C441.gene36.pep
  Gene classification: Gene name=AnsP; Function=Gamma-aminobutyrate permease and related permeases; Function class=E Amino acid transport and metabolism
  Homolog annotation: Query=18..463bp; Hit=19..464bp; Blast score=615; Percent Identity=74.0; E value=1e-176; Homolog= cycA COG1113
MEEKIQSTHTPETEGSHLQRSLTNRHIQLIAIGGAIGTGLFMGSGKTISLAGPSIIFVYMIIGFMLFFVMRAMGELLLSNLHYKSFSDFAADLLGPWAGFFVGWTYWFCWVITGVADVVAITSYVSYWTPDFPEWATSLLCVLILLTLNLATVKLFGELEFWFAMIKIVAIVALIVIGGILIGTHFQSPAGHTAALSNVWNDGGMFPMGLSGFFAGFQIAIFAFVGIELVGTAAAETKDPMKSLPKAINAIPIRIITFYVLALIVIMSVTPWRSVVTDKSPFVGLFVLIGLPAAASIVNFVVLTSAASSANSGVFSTSRMLFGLAKEGDAPKQFSRLSRRSVPASGLIFTCLCLSFGVILIYFIPDVMRVFTLVTTVSATLFMFIWSMILCSYLVYRKRRPALHKASIYKMPFGIVMSWLCLAFFAFVLVLLSLQPDTRQALIATPVWFIILVIGFQIVKKRRTRLYR

SEQ ID NO: 9249 - protein, 92 aa, Xenorhabdus bovienii
  Peptide sequence Name=Xb4151_4152.C441.gene37.pep
LPDPINRPVPIAPPIAISCICRLVRLLCRCEPSVSGVWVDCIFSSIIVSHLFSQHGARLNPLRLCLSYHCDIDSQGINRGISIEKRDADISI

SEQ ID NO: 9250 - protein, 114 aa, Xenorhabdus bovienii
  Peptide sequence Name=Xb4151_4152.C441.gene38.pep
MLHLMYLLKPTQKAHLDMTAFWHWVEKRDEWFYRTLEMTGERRWYVRTIGDNVHCLEHYVTFADEAAWGQYRSAVSKLCKDPEWEKIRTEQSLWWEILDSSLLNDAPFIVNLRK

SEQ ID NO: 9251 - protein, 387 aa, Xenorhabdus bovienii
  Peptide sequence Name=Xb4151_4152.C441.gene39.pep
MYKGGCMLINVGQSAFSPLVSDIEHIDRHEWDALVSDNDFFHSHGWLGGLDYALGKGDVFTLYGNAGLLGGCALWGGEDQSGLFYLPDYFPGLDGPWQYPFLWGGARRSTHNEIPCVQGSCRGETLSTMAEMLAQLAGTRGYYATIMPFMPLHQALEVARYYPHARVLMHSGEATLSVPAGGLDSQLQQLCSHHRVRANAELAAFARLGNRVEWCRLDDYLLEAAAELIANNRGKYGSHQGIDWMQRIFDGQKKSSVINTAVAAVAKRDEQILGVTIFYRFGETLHARYYGSNYQIDDNDFRYFVLNYYSSLDYAAKNGIRECRLSISALRAKTRRGAKIEPLAALLLFENAVPLSISECEDYNRLFYQHYQQQFGTHLTHDWALLD

SEQ ID NO: 9252 - protein, 264 aa, Xenorhabdus bovienii
  Peptide sequence Name=Xb4151_4152.C441.gene40.pep
  Gene classification: Gene name=SmtA; Function=SAM-dependent methyltransferases; Function class=Q Secondary metabolites biosynthesis, transport and catabolism
  Homolog annotation: Query=28..226bp; Hit=11..216bp; Blast score=61; Percent Identity=27.0; E value=8e-10; Homolog= HI0912 COG0500
MRLAPSSDSLSVREKQANLPKFNPATFDKYAELYERMTSWPYRQELELPTLAKLLGDLSSLNVLDFGCGPGVISRWLNERGTKRIVGYDISEGMLSYARRREEKDQRRIHYISKINEDYNVYFDIVLAVYVMPYAANYADLMAMSQTMARVLKPGGRLLTLPIHPDFNSDPEYYRPFGFRLIEEQPRTDGSALRLHICQPPYDINIQAYYWSRPTLENTLQQVGFQTVNWKSLNVPVNTLIPNLSSYVQCPHAAILECIRGDAC

SEQ ID NO: 9253 - protein, 39 aa, Xenorhabdus bovienii
  Peptide sequence Name=Xb4151_4152.C441.gene41.pep
MRFGSGTSFWICSKTEALIRCSANATEPTDFTLSSPYLP

SEQ ID NO: 9254 - protein, 31 aa, Xenorhabdus bovienii
  Peptide sequence Name=Xb4151_4152.C441.gene42.pep
VINLNSPLRPHFLEIAQAQSVGQHWAMISTE

SEQ ID NO: 9255 - protein, 62 aa, Xenorhabdus bovienii
  Peptide sequence Name=Xb4151_4152.C441.gene43.pep
MLSYALSLRNLEEMRTERGIKVNHDTVLIMLFNEYKECHQVISLNLLFSKLFYFHENGDIPS

SEQ ID NO: 9256 - protein, 40 aa, Xenorhabdus bovienii
  Peptide sequence Name=Xb4151_4152.C441.gene44.pep
MNKFFHLTSFTSGYGCYDWHHSVYFGIFLIWRLIRSQKPD

SEQ ID NO: 9257 - protein, 114 aa, Xenorhabdus bovienii
  Peptide sequence Name=Xb4151_4152.C441.gene45.pep
  Gene classification: Function=Predicted transposase; Function class=L DNA replication, recombination and repair
  Homolog annotation: Query=15..83bp; Hit=1..69bp; Blast score=85; Percent Identity=62.0; E value=8e-18; Homolog= Z4330 COG3335
MPIIAPIPRSERRQMKKFIHKTWDKDYARRLMALLMLHEGKTVSALSRALHCSRFSVNRWINWFTLYGLEGLKSLPSGRPAIWNLAPLFLVCCRSYYSTPRSILAACVHVGVLS

SEQ ID NO: 9258 - protein, 85 aa, Xenorhabdus bovienii
  Peptide sequence Name=Xb4151_4152.C441.gene46.pep
LNVIGLLLGGANIIKLINLSIITLHVESNMKKYILSGLLAGATLLVSMQSYALACNIFPPDSPAWKACTEICKLLPLGIPIPICF

SEQ ID NO: 9259 - protein, 94 aa, Xenorhabdus bovienii
  Peptide sequence Name=Xb4151_4152.C441.gene47.pep
MESLHGNLQTATPWYSNSNLFLITSSRTVHSYRPTHSSPTQPPNILLQSQYHLFWVVLEACLIPNISPEVTHSMKQIVAHVFGDRSRKKIYSTY

SEQ ID NO: 9260 - protein, 228 aa, Xenorhabdus bovienii
  Peptide sequence Name=Xb4151_4152.C441.gene48.pep
  Gene classification: Gene name=ArsR; Function=Predicted transcriptional regulators; Function class=K Transcription
  Homolog annotation: Query=9..227bp; Hit=5..227bp; Blast score=152; Percent Identity=37.0; E value=4e-37; Homolog= BH0391 COG0640
MNDFNLEESVAMIAAVLADRTRTRMLFLMMDGRAYTATELSAASDVAPSTASVHLNRLAEGKLVICVKQGRHRYFKIHSEEVAALLESMMHFANRNHRNIAIISTPKSLRFFRTCYDHMAGEIAVKIHNSLLTNHWMTRDYQLTQRGNDFLLSIGVCCDAESSSRRKFACSCLDWSERHFHIGGFLGASLFKTFLQKKWAIRQLDSRELILTEQGKRMLMQKFGVDIN

SEQ ID NO: 9261 - protein, 36 aa, Xenorhabdus bovienii
  Peptide sequence Name=Xb4151_4152.C441.gene49.pep
MLAVIFEVEIAENQSDRYFDTAATFIYRILSNNALF

SEQ ID NO: 9262 - protein, 221 aa, Xenorhabdus bovienii
  Peptide sequence Name=Xb4151_4152.C441.gene50.pep
  Gene classification: Function=Predicted transposase; Function class=L DNA replication, recombination and repair
  Homolog annotation: Query=12..217bp; Hit=3..202bp; Blast score=62; Percent Identity=22.0; E value=5e-10; Homolog= VNG7059 COG3385
MKPVTIIAIKHQLMQFFSDISLQHIAFQCAFMKRIRNIEPHVLILSLIAALSTGKITSIAQLHQKFNGLCPDKKQPVSYRPFYNQLRKAAFVEFVKILVRFAMAQWVEKQVSSPQKLMKFKQVILQDGSSFKVHSALADVFPYRFRTTGAAVECHMTMSLLTQSPVKMTVTADTAPERAYLPVPAMLRDQLLLADAGYVDFAYFEQVSLSGGSFIVRGSMI

SEQ ID NO: 9263 - protein, 200 aa, Xenorhabdus bovienii
  Peptide sequence Name=Xb4151_4152.C441.gene51.pep
  Gene classification: Gene name=Tra5; Function=Putative transposase; Function class=L DNA replication, recombination and repair
  Homolog annotation: Query=1..198bp; Hit=83..280bp; Blast score=231; Percent Identity=55.0; E value=4e-61; Homolog= yi5B COG2801
MQTMGLKSRIRAKKYYSYKRETGSVADNLLHRQFEAEQPNMKWVTDVTEFNHRGEKLYLSPMMDLFNREIVAFRTSRKPVFDLVKNMLSDAMEKLKSHEKPLIHSDPGWQYQMIHYQNQITENGLIQSMSRKGNCLDNAAMESFFGILKSECYHGVEFSSIDELEKTITDYIYYYNHDGIKIKLNGLSPVEHRTQSIMGI

SEQ ID NO: 9264 - protein, 62 aa, Xenorhabdus bovienii
  Peptide sequence Name=Xb4151_4152.C441.gene52.pep
VLTLSVCTRTDLYADDKYHRYGFLHQHIYLFAESFSGGSRMYCVISLQPSVKFSAGKIASIR

SEQ ID NO: 9265 - protein, 181 aa, Xenorhabdus bovienii
  Peptide sequence Name=Xb4151_4152.C441.gene53.pep
  Gene classification: Function=Transposase; Function class=L DNA replication, recombination and repair
  Homolog annotation: Query=1..169bp; Hit=1..172bp; Blast score=70; Percent Identity=32.0; E value=7e-13; Homolog= yi5A COG2963
MKKKRYSQTFKLKVVLHYLSHPDCGYSRTASLFGLHRNLVNKWIDIYRVHGEHGLKKSLNRSYSFEFKKHVVLTIQHEGLSLSEAMKRFKLKDTGMISRWLALYRKGGIELLKPRKRSRKACTRNAATQYKPESTKSAKSPPELLDELAYLRAENAYLKKLTALIRKEKNTYQQKQKLSPN

SEQ ID NO: 9266 - protein, 198 aa, Xenorhabdus bovienii
  Peptide sequence Name=Xb4151_4152.C441.gene54.pep
  Gene classification: Function=Predicted transposase; Function class=L DNA replication, recombination and repair
  Homolog annotation: Query=36..128bp; Hit=200..292bp; Blast score=65; Percent Identity=34.0; E value=5e-11; Homolog= VNG6148H COG3385
VVARNGQGKLLSKLLNKPLKSITRRTNRSEVLDLICRRNGYEFRLIRRWFAEEKRFCLWLSNLSVKEFTANDIMDIYRCRWQVELLFKELKSHTNWHRFATRKETLVTGLIWLSLLALLLRRSLASRLFPAVSLLKAAQNTEVWLWPIIENLLQRAWSETCFWLEKAQAYLCQNAFKTPQRKSCKYKTLDACFERLNA

SEQ ID NO: 9267 - protein, 254 aa, Xenorhabdus bovienii
  Peptide sequence Name=Xb4151_4152.C441.gene55.pep
MNKYENFWDIGPHSPLPVEHTFHAFVRGYGGSVISDALPGNPDFKNADYSFKENGVFGELKEVETEFLNQKGAKKKFGIMMEKLREECPDWESTLKEGNFYPEWFKSELIRLFRPGITRILKKANTQIKETKKHFHAPEAYGVLFFVNDGFTGVPPNLVQDIACDALLHSYSSIDCFVYMTLNRYIEISNSNEPQLIWSPNYSNRAEVSFVEFIDNLGRKWFDFLEEKIGNFTSRHESDNRDVLHGSKAIILPK

SEQ ID NO: 9268 - protein, 52 aa, Xenorhabdus bovienii
  Peptide sequence Name=Xb4151_4152.C441.gene56.pep
MSWRQNKYRKRDFLSALLTMNATMLTERILMVVIFHCVLFYHVMCCENVTIR

SEQ ID NO: 9269 - protein, 72 aa, Xenorhabdus bovienii
  Peptide sequence Name=Xb4151_4152.C441.gene57.pep
MMLMSVADRLKLRLIHVNNLSSTHRALVINILNNCKVSKSVNNRVRVDYYLIYFINIENLWGVGKALQTLQN

SEQ ID NO: 9270 - protein, 104 aa, Xenorhabdus bovienii
  Peptide sequence Name=Xb4151_4152.C441.gene58.pep
  Homolog annotation: Query=13..103bp; Hit=1..91bp; Blast score=148; Percent Identity=76.0; E value=2e-35; Homolog= gi|37524708|ref|NP _928052.1| hypothetical protein [Photorhabdus luminescens subsp. laumondii TTO1] gi|36784133|emb|CAE13002.1|
MTSLFEVVVYWNMNKQISALRTRQQRTLEQIFKTPVSSGIKWSDIESLIKALGGEIKEGRGSRCKFLLNGSIANFHRPHPSPDTDKGAVAGLREWLESIGVTPS

SEQ ID NO: 9271 - protein, 118 aa, Xenorhabdus bovienii
  Peptide sequence Name=Xb4151_4152.C441.gene59.pep
  Homolog annotation: Query=1..117bp; Hit=3..117bp; Blast score=173; Percent Identity=70.0; E value=5e-43; Homolog= gi|37524707|ref|NP _928051.1| hypothetical protein [Photorhabdus luminescens subsp. laumondii TTO1] gi|36784132|emb|CAE13001.1|
MSKQNTNIMEIAGLSAVISYVPELGMFRGKFLGLSGYCDFVADSIAGLHAEGRLSLNEYLEDCRSANIEPYQKREKTKTFTLRYPESFGERLNQAATEHHISVNAFILETLGERLRNI

SEQ ID NO: 9272 - protein, 77 aa, Xenorhabdus bovienii
  Peptide sequence Name=Xb4151_4152.C441.gene60.pep
MVIKRVHPPPLRALAPPPRPHTKRACFCAVVHRRGDLARTGLGRGSYAGKNCAILRKIVMRFYRQKTPVFDGRCSVR

SEQ ID NO: 9273 - protein, 93 aa, Xenorhabdus bovienii
  Peptide sequence Name=Xb4151_4152.C441.gene61.pep
  Homolog annotation: Query=10..90bp; Hit=69..149bp; Blast score=72; Percent Identity=50.0; E value=1e-12; Homolog= gi|37527287|ref|NP _930631.1| hypothetical protein [Photorhabdus luminescens subsp. laumondii TTO1] gi|36786721|emb|CAE15787.1|
MNGLTRRRVLANAKTEIDTLRADVAAGRRKLRIKAICPVSETTSSRSMVDATTVELSGETGSTVLDIREDIINDRAKLKYLQDYVNTECRRNK

SEQ ID NO: 9274 - protein, 79 aa, Xenorhabdus bovienii
  Peptide sequence Name=Xb4151_4152.C441.gene62.pep
  Homolog annotation: Query=Organism:..Xylellabp; Hit=fastidiosa..bp; Blast score=; Percent Identity=; E value=; Homolog= Pa|Phot5 -476a02.p1k_g43| 25263 - 25688 1662 141 aa, chain -
MKISNKGLEFIQQWEGLKLKAYPDPATGGIPWTIGYGHTKDVKPGQVITEQQAEAFLHDDLIPAYATLERLVKMLLTQG

SEQ ID NO: 9275 - protein, 326 aa, Xenorhabdus bovienii
  Peptide sequence Name=Xb4151_4152.C441.gene63.pep
  Gene classification: Gene name=XerC; Function=Integrase; Function class=L DNA replication, recombination and repair
  Homolog annotation: Query=1..321bp; Hit=13..326bp; Blast score=283; Percent Identity=48.0; E value=2e-76; Homolog= ZintU COG0582
MPPRVFRGRSAYEFKHPDGRTIRLCALIVDKSVVWNHYEQLVNEEKATFTYGSLVDDFLHSADFIELAKDTQSDYRKYSKKVVPVFGKMNPNNIRPDHIRKYMDKRGLQSRTQANREKSFMSRVFRWGYERGLVKKNPCQGVKQYRENSRERYITDAEYQALYEVSPTVIQVAMEIAYLCCARQKDILALSKSQLMEAGIYIKQHKTGKSQIKGWSERLRKAIKLANSLPLKEGLHSLYVIHQANGKIYSRDGFNSRWLKAKEIAAQKYPELRFNFTFHDLKAKGISDLEGTLQEKQAISGHKDIGQTARYDRKTEIVPVVGNQKK

SEQ ID NO: 9276 - protein, 32 aa, Xenorhabdus bovienii
  Peptide sequence Name=Xb4151_4152.C441.gene64.pep
MPPKYFVTFHCINLFPSSLSDIPIINEVRSIH

SEQ ID NO: 9277 - protein, 81 aa, Xenorhabdus bovienii
  Peptide sequence Name=Xb4151_4152.C441.gene65.pep
MQNPISDNRTLYVTDSYSQMTVSVNDIYAQNLHNSIRGVDKRVSQKQGVNSFCPAHKVTIGIFPTVEIKTNLRKICLGWSK

SEQ ID NO: 9278 - protein, 77 aa, Xenorhabdus bovienii
  Peptide sequence Name=Xb4151_4152.C441.gene66.pep
LSCANFVRKYHLRSPSFASNYQLRTKSDYQILGFAYRHYRRSNYKQIPEFEVCLNINILPPNPELGLCSAVRFVVSH

SEQ ID NO: 9279 - protein, 45 aa, Xenorhabdus bovienii
  Peptide sequence Name=Xb4151_4152.C441.gene67.pep
MVIIFNCSCGILTTENFLQLMLLYIRDFPSCNLMTNDKSDGRAKP

SEQ ID NO: 9280 - protein, 349 aa, Xenorhabdus bovienii; identical to SEQ ID NO: 5796
  Peptide sequence Name=Xb4151_4152.C441.gene68.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 9281 - protein, 56 aa, Xenorhabdus bovienii
  Peptide sequence Name=Xb4151_4152.C441.gene69.pep
LFVNLVFLLYDREHLRNPSGALFYFLLSKENRITCFYREDENMLSSGKMFFKLSLK

SEQ ID NO: 9282 - protein, 89 aa, Xenorhabdus bovienii
  Peptide sequence Name=Xb4151_4152.C441.gene70.pep
  Gene classification: Function=Barstar, RNAse (barnase) inhibitor; Function class=K Transcription
  Homolog annotation: Query=6..87bp; Hit=6..88bp; Blast score=71; Percent Identity=46.0; E value=1e-13; Homolog= yhcO COG2732
MKKVEFDFDRIPDVETFYCEFKESFDIGDHFGANLDALWDAVTGGIGLPVEISFIHFSSQKRVYFAALVLLFEEAEEELEGELQFNIVG

SEQ ID NO: 9283 - protein, 158 aa, Xenorhabdus bovienii
  Peptide sequence Name=Xb4151_4152.C441.gene71.pep
  Homolog annotation: Query=1..158bp; Hit=1..154bp; Blast score=177; Percent Identity=58.0; E value=4e-44; Homolog= gi|37527910|ref|NP _931255.1| hypothetical protein [Photorhabdus luminescens subsp. laumondii TTO1] gi|36787346|emb|CAE16435.1|
MKKSILAGILLILAFVSITFAQGSESVGAEKSQQNTEVLESVSSEPIGVLTKPKRVAQYLREHNNSRLPDYYLTKAQARNLGWDARKGNLCQVSPNTAIGGDRFSNRENKLPKKRDRQWFEADVNYSCGHRGSDRLLYSNDGLIYLTVDHYNTFKKLE

SEQ ID NO: 9284 - protein, 481 aa, Xenorhabdus bovienii
  Peptide sequence Name=Xb4151_4152.C441.gene72.pep
  Gene classification: Gene name=TldD; Function=Predicted Zn-dependent proteases and their inactivated homologs; Function class=R General function prediction only
  Homolog annotation: Query=1..481bp; Hit=1..481bp; Blast score=773; Percent Identity=83.0; E value=0; Homolog= tldD COG0312
MSLTFVSDYLLAANNLNHQDLFSVLGQLAERRLDYADLYFQSSYHEAWILEDRIIKDGSYNIDQGVGVRAISGEKTGFAYADQITLNALQQSAQAARSIVREAGNGTVRTLGAVTHKGLYPAIDPLQSMSREEKIALLHRVDQIARAEDPRVQEVNASLTGVYEQMLVAATDGTLAADIRPLVRLSVSVLVEEDGKREHGSSGGGARYGYEYFLQTADGEVLAEQFAREAVRMALVNLSAVAAPAGTMPVVLGAGWPGVLLHEAVGHGLEGDFNRRGTSVFSGQIGEQVASELCTVVDDGTIEGRRGSLSVDDEGVPGQYNVLIENGILKGYMQDKLNARLMGVAPTGNGRRESYAHLPMPRMTNTYMLAGKSTPEEIIASVDSGLYAPNFGGGQVDITSGKFVFSTSEAYLIENGKITKPVKGATLIGSGIEAMQKISMVGNDLALDKGVGVCGKEGQSVPVGVGQPTLKLDNLTVGGTA

SEQ ID NO: 9285 - protein, 282 aa, Xenorhabdus bovienii
  Peptide sequence Name=Xb4151_4152.C441.gene73.pep
  Gene classification: Function=Predicted amidohydrolase; Function class=R General function prediction only
  Homolog annotation: Query=6..273bp; Hit=4..270bp; Blast score=249; Percent Identity=47.0; E value=2e-66; Homolog= VC0421 COG0388
MKNVNVALLQLCSGANIKHNLAQVEQQIKQLPDTVKLVLTPENALLFADADTYRKYAEEQGSGPLQQAVSEIAQRYGVWLLIGSMPMISREDPTRITSSSLLFDDQGEIRARYDKIHMFDVNINDEHGAYSESSVYQPGEHITVVDTPVGRLGMAICYDLRFPGLFQALREQGAELISVPAAFTRLTGKAHWEPLLRARAIENQCIILAPAQVGVHGTRRTWGHSMAVSGWGEVIKKNPLTVSALQLNIRRDSLTHMREQIKVAKHNRFRPQLTSLIKKNTN

SEQ ID NO: 9286 - protein, 1278 aa, Xenorhabdus bovienii
  Peptide sequence Name=Xb4151_4152.C441.gene74.pep
  Gene classification: Function=Uncharacterized membrane protein; Function class=S Function unknown
  Homolog annotation: Query=1..1276bp; Hit=1..1264bp; Blast score=1092; Percent Identity=43.0; E value=0; Homolog= Z4604 COG3164
VRRLPGILLATAAIVVIIVALLVSGLRFFLPHINDYRQQVAEKIAAVTDIPIHIGYINGHWESFGPSLEIRDISAKTKDASFQAKKVTLSLNVWRSLLQWRWHFRDLSFYQLEVNYVKPLSSGKNENLLSEPDSLSSFVLEQLNHFDLYDSRLTFQTPSGEKAQLILPQLTWLNKDDRHRAQGSVNLSSINGQEGVVQVKFDLKDINGVLDNGVIYLQADDIDMRLWLSRWLRDNTGLESSRFSLASWITLKGGRIDSGRLQLKQGEANWYVGSEKHQLAVNDLILQMCRQGEGWLFNIPNLANLKTNGQQWPVGRIAALYVMQADKYQGKDHWRLRAENIQLERLNGILPLFSSVTPNVVKGWQHRQLKGILNHFALDITPELPDSSMGIAIKWQDVSWLRWQDLPSVNHFSGTLSGSKQWGNLKFELKNSTVDYRSLFQTPFDITSSKGHFTWRNDRHGLKVWGRDLDLQAKSLWFNGAFNYLLPKNEPPVLEMLAGIRVDDAGEAWRYFPRSLMGASLADYLTHSLIKGKIENATLLFQGNPHDFPFKQNNGQFQVWVPLRHATFQYQPDWPALFDFDIDLNFQNNGLWMQVPKAKLGKVDATQLTAVIPDYGKNKLLIDGKLSGSGKNIHDYFKHSPLAESIGSTLDELQLDGKVDGKLHLDIPLEDGKVNASGEVVLQDTTLFIKPLDSKMEHVSGKFRFDNGKLQSDTLSAQWLGHPLSLRFTTQDLPKHYQVDVDLNAQWAAGKLPEVPAEIRRQLSGTLDWQGKVNIAIPAQNTSSHTKQQQNGVKYRVSINADLSHINSKLAALDTGLLREWQGIDVLAEGNTNQMQIKGSLGKQYAFNTQWQLGKTHARLQRGIINSEGNGIPILPEKPLLALNLPEIDGEKWLPLIAPLMSGSSENDGLLWPKMFEISMPSLKIGGQRWNQLVFNIVQQADGMKVSATGEKLKGNLLIYRHEPWQASIDYLYYDPQFPEDSSAGSNTLTSDTSEAKKYGLRHWPSLNVKCAECWVAGLKLGKVSGTVMPEGDSLVLTNGRLENRAGKLTLSGRWGENDIGNYTQVKGQLSGQRFDEMAAYLGFIVPIVDAPFKFDFDLGWRGTPWNPEIKTLNGTLTGETKKGAIAKLGGGRAGQLLRLISFDSLLRKLQLDFSDTFSNDFNFDSIRGDTTIKNGVMYTENFHIDGLAADIDAEGQTDLVRRQINMELVITPEISTTVGVATAFAVNPVAGAAVFAATKVLGPLWSKISVIRYRLTGSFEQPKIDEVLRQLKENKGS

SEQ ID NO: 9287 - protein, 489 aa, Xenorhabdus bovienii
  Peptide sequence Name=Xb4151_4152.C441.gene75.pep
  Gene classification: Gene name=CafA; Function=Ribonucleases G and E; Function class=J Translation, ribosomal structure and biogenesis
  Homolog annotation: Query=1..489bp; Hit=7..495bp; Blast score=778; Percent Identity=83.0; E value=0; Homolog= cafA COG1530
MTAELLVNITPSETRVAYIDGGILQEIHVEREARRGIAGNIYKGRVSRVLPGMQAAFVDIGLEKAAFLHASDIVPHTECIAGEEKKNFQVRDIAELVHQGQDLIVQVVKDPLGTKGARLTTDITLPSRYLVFMPGASHVGVSQRIESEEERDRLKSIVMDYCNEHGGFIIRTAAEGIGAEELVQDAAFLQRLWGKVIERKKRNITKNKVYGELALAQRVLRDFAGAPLNRIRVDSRQTFLQLQEFIDEYIPEMNAKLELYQGNQPIFDIYDVENEIQRALERKVELKSGGYLIIDQTEAMTTIDINTGAFVGHRNLEETIFNTNIEATQSIARQLRLRNLGGIIIIDFIDMGNEEHRRRVLASLEQALSKDRVKTTINGFSQLGLVEMTRKRTRESIEHILCDNCPTCQGRGTVKSVETVCYEILREIVRVHRLIDADRFLVYASPAVSEVLKGDESHALAEVEIFVGKQVKVQTEQLYSQEQFDVVMM

SEQ ID NO: 9288 - protein, 195 aa, Xenorhabdus bovienii
  Peptide sequence Name=Xb4151_4152.C441.gene76.pep
  Gene classification: Gene name=Maf (BS); Function=Nucleotide-binding protein implicated in inhibition of septum formation; Function class= D Cell division and chromosome partitioning
  Homolog annotation: Query=1..190bp; Hit=1..190bp; Blast score=244; Percent Identity=64.0; E value=3e-65; Homolog= yhdE COG0424
MKTLYLASGSPRRRELVGMLDFNFEILTPQVEEKWQEGESPQQYVSRLAREKAQAGVAIAPNDFPVLGADTIVVLNNRILEKPRNPQHAAEILSALSGQSHQVMTAVALSNSQHTLSEIVITDVIFRQLSQQEIQEYIATGEPMDKAGAYGIQGKGGCFVRKINGSYHAVVGLPLVETCELITRFLVLADGKHYS

SEQ ID NO: 9289 - protein, 162 aa, Xenorhabdus bovienii
  Peptide sequence Name=Xb4151_4152.C441.gene77.pep
  Gene classification: Gene name=MreD; Function=Rod shape-determining protein; Function class=M Cell envelope biogenesis, outer membrane
  Homolog annotation: Query=1..162bp; Hit=1..162bp; Blast score=155; Percent Identity=61.0; E value=1e-38; Homolog= mreD COG2891
MNQYRSRGRWVIWLSFLIAIVLQIMPWPEQFYMFRPTLLVLCLIYWLLAIPHRVSVGTGFVLGIITDLLQGSVLGAHALAFSIISFLVVFKFQLIRNMALWQQALVVVALSTLMNLCIFLAHALIPKTLFHPEVFWNGLVNGILWPWLFLLMRKIRRQFSVR

SEQ ID NO: 9290 - protein, 344 aa, Xenorhabdus bovienii
  Peptide sequence Name=Xb4151_4152.C441.gene78.pep
  Gene classification: Gene name=MreC; Function=Rod shape-determining protein; Function class=M Cell envelope biogenesis, outer membrane
  Homolog annotation: Query=1..317bp; Hit=1..317bp; Blast score=389; Percent Identity=66.0; E value=1e-108; Homolog= ZmreC COG1792
MKPIFSSGSSLQVRLFLAVIIAIILVVVDSRFGFFNKVRSYMDTAVSPFYFLANGPRQFLDGISESLATRKHLEMENNTLRNELRLQSSKLLLLGQLKHENSRLRELLGSPVRRDEHMMVSQVISGGIDPYRDQIVIDKGAKDGVYEGQAVISDRGVAGQVISVSHLSSRVLLICDPTHGLPVQVMRNDLRMIAAGAGCTEDLHLEPMASDTDIRVGDVLVTSGLGGRFPEGYPVAVVSSVKIDNQRAHVVIRARPLAELRRLRYLLLLWGSDNDPSEPLPPSAVHRAANERLMQMLPEVLPNPLEEKPQLPTQDSGEGKKGNIEGNKTLSVTKPSSSATGNRQ

SEQ ID NO: 9291 - protein, 347 aa, Xenorhabdus bovienii
  Peptide sequence Name=Xb4151_4152.C441.gene79.pep
  Gene classification: Gene name=MreB; Function=HSP70 class molecular chaperones involved in cell morphogenesis; Function class=D Cell division and chromosome partitioning
  Homolog annotation: Query=1..347bp; Hit=21..367bp; Blast score=630; Percent Identity=96.0; E value=0; Homolog= mreB COG1077
MLKKFRGMFSNDLSIDLGTANTLIYVKGQGIVLDEPSVVAIRQDRAGSPKSVAAVGSAAKQMLGRTPGNIAAIRPMKDGVIADFYVTEKMLQHFIKQVHNNSFMRPSPRVLVCVPVGATQVERRAIRESAQSAGAREVFLIEEPMAAAIGAGLPVSEATGSMVVDIGGGTTEVAVISLNGVVYSSSVRIGGDRFDEAIINYVRRNYGSLIGEATAERIKHGIGSAYPTDEVHEIEVRGRNLAEGVPRGFTLNSNEILEALQEPLTGIVSAVMVALEQCPPELASDISERGMVLTGGGALLRNLDRLLMEETGIPVIVAEDPLTCVARGGGKALEMIDMHGGDLFSED

SEQ ID NO: 9292 - protein, 46 aa, Xenorhabdus bovienii
  Peptide sequence Name=Xb4151_4152.C441.gene80.pep
MKQRQGASLTTFTTSIKVATLLFISDTQYSTLLFSNGAEKNCIKTG

SEQ ID NO: 9293 - protein, 83 aa, Xenorhabdus bovienii
  Peptide sequence Name=Xb4151_4152.C441.gene81.pep
MIKCLKNQHYSAYRDTTTPDFTASMLTCNHFCKFNQNVFFLNILTSPDSALSKRTSPSTVIGKNKDYSEQINNVIFLIVTLCI

SEQ ID NO: 9294 - protein, 329 aa, Xenorhabdus bovienii
  Peptide sequence Name=Xb4151_4152.C441.gene82.pep
  Gene classification: Gene name=Qor; Function=NADPH; Function class=C Energy production and conversion
  Homolog annotation: Query=1..323bp; Hit=1..323bp; Blast score=427; Percent Identity=66.0; E value=1e-120; Homolog= ZyhdH COG0604
MKALLLEQHETLSASIQNIDTSQLPSGDVVVDIHWSTLNYKDALAITGKGKIIRQFPMVPGVDFSGVVHHSENPRFHIGQHVLLTGWGVGENHWGGLAEQARVSGEWLTPLPQGLSARQAMIIGTAGFTAMLCIMALEQGGVTPESGEIAVTGAGGGVGSTAITLLSQLGYSVVAISSKTENQDYLLSLGAKTILPVTDFNQPSRSLEKQRWAGVIDTIGGTVLATLLAQVHYNGTVAACGMASDSQLSTTVMPFILRNVRLQGISSVTVPAVKRSDIWQRLQKLLPDAFYQQATTEISLDQVVEYANKLINNQMTGRTLVKVADKTSI

SEQ ID NO: 9295 - protein, 153 aa, Xenorhabdus bovienii
  Peptide sequence Name=Xb4151_4152.C441.gene83.pep
  Gene classification: Gene name=AroQ; Function=3-dehydroquinate dehydratase II; Function class=E Amino acid transport and metabolism
  Homolog annotation: Query=1..146bp; Hit=1..146bp; Blast score=200; Percent Identity=71.0; E value=4e-52; Homolog= VC0297 COG0757
MADKFRILLLNGPNLNLLGTREPETYGKLTLDDIVSKLSKEAHQSGVELSHLQSNAESELIERIHTARGDTDFILINPAAFTHTSVALRDALLAVDIPFIEIHLSNVHAREPFRHHSYLSDIAVGVICGLSADGYSFALQAAVNRLSTFNSFT

SEQ ID NO: 9296 - protein, 150 aa, Xenorhabdus bovienii
  Peptide sequence Name=Xb4151_4152.C441.gene84.pep
  Gene classification: Gene name=AccB; Function=Biotin carboxyl carrier protein; Function class=I Lipid metabolism
  Homolog annotation: Query=1..150bp; Hit=1..156bp; Blast score=182; Percent Identity=74.0; E value=9e-47; Homolog= accB COG0511
MDIRKIKKLIELVEESGISELEISEGEESVRISRIAAAQHMPMTQQYISAPVQQSVQAATPAIPAAEKPAEIIGHTVCSPMVGTFYRSPSPDAKAFIEIGQRVNQGDTLCIVEAMKMMNQIEADKTGVVRAILAQDGQPVEFDEPLVVIE

SEQ ID NO: 9297 - protein, 449 aa, Xenorhabdus bovienii
  Peptide sequence Name=Xb4151_4152.C441.gene85.pep
  Gene classification: Gene name=AccC; Function=Biotin carboxylase; Function class=I Lipid metabolism
  Homolog annotation: Query=1..449bp; Hit=1..449bp; Blast score=788; Percent Identity=88.0; E value=0; Homolog= accC COG0439
MLEKIVIANRGEIALRILRACKELGIKTVAVHSTADRDLKHVLLADETVCIGPAASAKSYLNIPAIISAAEITCAQAIHPGYGFLSENADFAEQVERSGFVFIGPKAETIRLMGDKVSAINAMKTAGVPCVPGSDGSLGNDTEKNKAIAKRIGYPVIIKASGGGGGRGMRVVRSDKDLEQSIAMTRAEAKAAFNNDMVYMEKFLENPRHVEIQVLADGQGHALYLAERDCSMQRRHQKVVEEAPAPGISAELRRTIGERCANACIEIGYRGAGTFEFLYENGEFYFIEMNTRIQVEHPVTEMITGVDLIKEQLRIASGLPLSIKQEDIVIEGHAIECRINAEDPKSFLPSPGKITHFHSPGGFGVRWESHIYAGYTVPPYYDSMIGKLITYGETREVAIARMKNALAELIIDGIKTNIDLQVAIMNDENFQKGGTNIHYLEKKLGLQEK

SEQ ID NO: 9298 - protein, 1878 aa, Xenorhabdus bovienii
  Peptide sequence Name=Xb4151_4152.C441.gene86.pep
  Homolog annotation: Query=6..603bp; Hit=2..583bp; Blast score=421; Percent Identity=40.0; E value=1e-116; Homolog= gi|26246313|ref|NP _752352.1| Putative adhesin [Escherichia coli CFT073] gi|26106711|gb|AAN78896.1|AE016756_79 Putative adhesi
MLKEQNRQRTDKQRHRIKLVAWVNIFSQVVFLMAGTFTPVLAAAKTHPVAQEDRSLSKPMTKLEGGGETDLTKPLSSKALADRLRQISATEPSENTTERWLANAASHAAGMLKNNNIVDSAKRQLHGLAVNEANQAVQNWLQRYGTIKLQANVDDRGRLEGSQFDMLLPLYDREKQMAFTQFGLRRIDNRTTVNVGLGQRHFLNTGMFGYNAFVDHDITRDHTRFGIGTEYARDFMKFGANGYFRASSWKDGQKMKDYEERPANGFDLRAEGYIPAYPQLGGKLIYEQYFGDEVGLLSEERRQKNPSVFTVGASYTPIPLVTLGIDRKQSAQGHGETLVNFGLNYVLGTPWSKQIDPDAVAFKRSLQGGRYDLVERNNQIVLEYRKKELIRLRMEKQISGHGGQVMSLNVNVSSKYGLKEIVWDMANLVAGGGKLEKPDTPVRGGEHYRLTLPPFHNKGNNTYILSGIAYDNQGNASERAETQIQVISLAIDLKDSGFELPHQSMAADGKTQTILRLRLIGNNGKPVTGVAGNITFISDLNSLRGEGKNPILGTEVKEVSEGSGIYEVTATAGTKPGEWKIIVTVDDKPLKHGTEIQFDVANAPTISDLIVAGVIEQSKKLSATYQFNANGGNDTDHSFFAWGAESTTADKVTSLAKATGIEETVPPPNEIQNGITSSGNVKEKGLVPEYTIPQTAVGKVLELSVLASNAIQISHFPPETVVLRKGMQGNKTTGGNSEGGVTNPDAAPVITKLTLSGDLEVGKRLTATYQFDGNSGNDTDDSKYTWHDKNALVTDDQLKSVPAVSKDSKTKTGTLTRDLKQEDAGKMLAISVKPINGEGIAGQLRTVDTSMSEQDGNKTLTPPGDKPGSIFDPAGKPAINELKLEGILEKGKTLTAKYVFESGAGDITDKSGYTWCRKQLNGQPDGTTCQAGIGPDRAGQVSEVDYLLEAKDVNRIVEFSIRAENALGVKADDTRTINTSSEGGVTNPDAAPVITKLTLSGDLAVGKRLTATYQFDGNSGNDTDDSKYTWHDKNALVTDDQLESVPAVSKDSKTKTGTLTRDLKQEDAGKMLAISVRPINGEGIAGQLRTVDTSMSEQDGNKTLTPPGDKPGSIFDPAGKPAINELKLEGILEKGKTLTAKYVFESGAGDITDKSGYTWCRKQLNGQPDGTTCQAGIGPDRAAQVSEVDYLLEAKDVNRIVEFSIRAENALGVKADDTRTINTGSEGGVTNPDAAPVITKLTLSGDLAVGKRLTATYQFDGNSGNDTDDSKYTWHDKNALVTDDQLESVPAVSKDSKTKTGTLTRDLKQEDAGKMLAISVKPINGEGIAGQLRTVDTSMSEQDGNKTLTPPGDKPGSIFDPAGKPAINELKLEGILEKGKTLTAKYVFESGAGDITDKSGYTWCRKQLNGQPDGTTCQAGIGPDRVGQVSEVDYLLEAKDVNRIVEFVIRAENALGVKADDTRTINTSMKWEEGNHTGGGNDQGSVIDPDKDPVITHLALIDPLVIGKKITATYSFDDNNGYPDDESLYAWGVYEPGEDDPTIQAIENSNDAIDKSGYIPESFGLTDQHAGKIIALTVRPKNSKGNIGSIVRAQGTVLGIAENFDVTWNVGTEEDLSNGKKAPKVKREEPITLTVKTLKSGNAIRGVPIKVELGKATGRAKTERVDPTVQLEITGKTYKSGDTYMGFTDKNGELIMTATDRNSIGLKTSVSITVNEGTGAKTETKTQDVIFTVITSPDTDLANYWGHMVEELPINAGKFSRPLLSKEVQKYYPNLSTGIVQENNEDWSAYNYENFKNLCQAKGKRAPQIGELQELGGLVQDKYQFTPTYGWPTVSSRSWYRSDTDAPNQGPHLKSSYALDNFKIGKNGPSDINMVSCI

SEQ ID NO: 9299 - protein, 80 aa, Xenorhabdus bovienii
  Peptide sequence Name=Xb4151_4152.C441.gene87.pep
  Homolog annotation: Query=1..79bp; Hit=1..79bp; Blast score=122; Percent Identity=84.0; E value=1e-27; Homolog= gi|37527932|ref|NP _931277.1| hypothetical protein [Photorhabdus luminescens subsp. laumondii TTO1] gi|36787368|emb|CAE16457.1| u
MDRRFVQSHKEARWAVSLALAYLVGWLLCAYLPSDAIGLTGLPRWFELACLLLPALFIILCWLMVKFIFKEVPLEDDNAN

SEQ ID NO: 9300 - protein, 481 aa, Xenorhabdus bovienii
  Peptide sequence Name=Xb4151_4152.C441.gene88.pep
  Gene classification: Gene name=PutP; Function=1 Na+/proline, Na+/panthothenate symporters and related permeases; Function class=E Amino acid transport and metabolism
  Homolog annotation: Query=1..471bp; Hit=3..473bp; Blast score=638; Percent Identity=80.0; E value=0; Homolog= panF COG0591
MQTEVILPLVGYLALVFLLSIYAYRRRQTGEFLNEYFLGNRSMGGFVLAMTITATYISASSFIGGPGAAYKYGIGWVLLSLIQLPAIWLSLGVLGKKFAILARRYNAVTLNDMLYARYQSRFLVWFASLSLLVAFVGAMTVQFVGGARLLETAAGIPYDTGLLIFGISIALYTAFGGFRASVLNDALQGLVMLLGTVLLLAGIIYKAGGLSEAIATLRAIDPNLVSPHGADNILTGPFMTSFWVLVCFGVIGLPHTAVRCISYRDSKAVHRGIIIGTIVMAILMFGMHLAGALGRAIIPDLTIPDQVIPTLMITVLPPVAAGIFLAAPMAAIMSTINAQLLQSSATIVKDLYLNLFPQQIRQEKKLSRISSYSTLFLGMLLLLAAWRPPEMLIWLNLLAFGGLQAVFLWPLVLGLYWEKANAYGAIGSMLIGATSYTLLASFNIQIFGFHPIVPSLLFSLLAFGIGNMIGSRKYQQIAASQ

SEQ ID NO: 9301 - protein, 301 aa, Xenorhabdus bovienii
  Peptide sequence Name=Xb4151_4152.C441.gene89.pep
  Gene classification: Gene name=PrmA; Function=Ribosomal protein L11 methylase; Function class=J Translation, ribosomal structure and biogenesis
  Homolog annotation: Query=9..300bp; Hit=1..292bp; Blast score=448; Percent Identity=79.0; E value=1e-126; Homolog= prmA COG2264
MIHRKRIFMPWIQLRLNTTGQQAEALGDELMESGAVSVTFQDSHDTPIFEPLPGETRLWGDTDVIGLYDAEMDMKAVVGQLEQVPQLGKGFLHKIEQLEDKDWEREWMDNFHPMCFGNRLWICPSWREVPEPDAVNVMLDPGLAFGTGTHPTTSLCLQWLDGLDLTGKTVIDFGCGSGILAIAALKLGAKQAIGIDIDPQAIQASRDNAERNGVSAQLTLYLSKNQPADLKCDIVIANILAGPLRELAPIIGSLPKSGGFLGLSGVLASQAEGVVQAYNNEFIIDPIAEQEEWCRITGIKK

SEQ ID NO: 9302 - protein, 327 aa, Xenorhabdus bovienii
  Peptide sequence Name=Xb4151_4152.C441.gene90.pep
  Gene classification: Function=Predicted TIM-barrel enzymes, possibly dehydrogenases, nifR3 family; Function class=R General function prediction only
  Homolog annotation: Query=1..320bp; Hit=1..320bp; Blast score=572; Percent Identity=85.0; E value=1e-163; Homolog= yhdG COG0042
MRIGQYQLKNCLIAAPMAGITDRPFRSLCYDMGAGMTVSEMLSSNPQVWKTDKSRLRMVHRDESGVRSVQIAGSDPDEMAAAARINVANGAQIIDINMGCPAKKVNRKLAGSALLRYPELVQAILSAVVNAVDVPVTLKIRTGWSPEERNCVEIAQLAERCGIQALTIHGRTRSCLFNGEAEYDNIRTVKQTVAIPIIANGDITDPLKARAVLEYTGADALMIGRAAQGRPWIFREIQHYLETGELLPPMPLGDVQHLMSEHVRELHDFYGQGKGVRIARKHVSWYLKEHAPDDQFRRTFNAIEDASEQLEALEAYFENFCVNKEKS

SEQ ID NO: 9303 - protein, 98 aa, Xenorhabdus bovienii
  Peptide sequence Name=Xb4151_4152.C441.gene91.pep
  Gene classification: Gene name=Fis; Function=Factor for inversion stimulation Fis, transcriptional activator; Function class=K Transcription
  Homolog annotation: Query=1..98bp; Hit=1..98bp; Blast score=162; Percent Identity=98.0; E value=8e-41; Homolog= fis COG2901
MFEQRVNSDVLTVATVNSQDQVTQKPLRDSVKQALKNYFAQLNGQDVNDLYELVLAEVEQPLLDMVMQYTRGNQTRAALMMGINRGTLRKKLKKYGMN

SEQ ID NO: 9304 - protein, 56 aa, Xenorhabdus bovienii
  Peptide sequence Name=Xb4151_4152.C441.gene92.pep
  Homolog annotation: Query=Organism:..Escherichiabp; Hit=coli..K12bp; Blast score=; Percent Identity=; E value=; Homolog= Pa|Phot5 -469d04.q1k_g15| 8456 - 8830 1812 124 aa, chain +
VKQDSLANALSRPWPKGEWIIANYLEIHPSEIWPSRYFDSYTGELLERKVRDKSSK

SEQ ID NO: 9305 - protein, 56 aa, Xenorhabdus bovienii
  Peptide sequence Name=Xb4151_4152.C441.gene93.pep
  Homolog annotation: Query=7..49bp; Hit=1..43bp; Blast score=66; Percent Identity=76.0; E value=9e-11; Homolog= gi|37524854|ref|NP _928198.1| hypothetical protein [Photorhabdus luminescens subsp. laumondii TTO1] gi|36784279|emb|CAE13154.1| un
MEGVAGMNNVRNDWHQADIIAALRKRGTTLAAVSREAGLTGKCSQQTVAERRMDNC

SEQ ID NO: 9306 - protein, 125 aa, Xenorhabdus bovienii
  Peptide sequence Name=Xb4151_4152.C441.gene94.pep
  Homolog annotation: Query=1..116bp; Hit=239..354bp; Blast score=202; Percent Identity=85.0; E value=7e-52; Homolog= gi|30062669|ref|NP _836840.1| putative head portal protein [Shigella flexneri 2a str. 2457T] gi|30040917|gb|AAP16647.1| putat
MEYQQLGMSNQDAEWLVSRRFTIDDIARMFNVSPIFLQEYSNSTYSNFSEASRAFLTITMRPWLANFEQQIKAALLMTLPKRGIRYQVEFDTADLLRANPKERFQSYETAIKSDVMTTPGSANPV

SEQ ID NO: 9307 - protein, 129 aa, Xenorhabdus bovienii
  Peptide sequence Name=Xb4151_4152.C441.gene95.pep
MKKILIVFIFLLYGCGNPTPKVLPKSEFLPDAVINEPYQASITITGGALNEKSVWVKIHPTGSGLTWNPKDSSFLWGGKKEIRKDYHHINITGTPKKIELIKIEIVGFTLGTMYAGKEFNKNYTIKVRE

SEQ ID NO: 9308 - protein, 77 aa, Xenorhabdus bovienii
  Peptide sequence Name=Xb4151_4152.C441.gene96.pep
  Homolog annotation: Query=1..68bp; Hit=53..120bp; Blast score=117; Percent Identity=95.0; E value=4e-26; Homolog= gi|14041734|emb|CAC38405.1| putative retrotransposase [Xenorhabdus nematophila]
MTDFGDIETSGKNHWIVWEGVVENYEKENITNNSDLNQYVNLNLFSWGKVEHQIKINKSLDYVLNHIFGGLVFNPMK

SEQ ID NO: 9309 - protein, 92 aa, Xenorhabdus bovienii; identical to SEQ ID NO: 6203
  Peptide sequence Name=Xb4151_4152.C441.gene97.pep

SEQ ID NO: 9310 - protein, 81 aa, Xenorhabdus bovienii
  Peptide sequence Name=Xb4151_4152.C441.gene98.pep
LGSCIKWLVAVICFRLFKDEVWPKLMSIAVIATNQNRSKDMGKEMADILVIAVIAAVRSFSWRIPIRPANPALKNRLSISR

SEQ ID NO: 9311 - protein, 96 aa, Xenorhabdus bovienii
  Peptide sequence Name=Xb4151_4152.C441.gene99.pep
  Homolog annotation: Query=37..93bp; Hit=1..57bp; Blast score=108; Percent Identity=98.0; E value=2e-23; Homolog= gi|14041734|emb|CAC38405.1| putative retrotransposase [Xenorhabdus nematophila]
MTRISGLDWLTLASLRDSENMIMSYDEVDDELAGITMWGKLTEWFEKSGYEKVFSNVGLSHSNIDDIVTLSDYYNKGYHVVTLISAGMLSDFGVMY

SEQ ID NO: 9312 - protein, 61 aa, Xenorhabdus bovienii
  Peptide sequence Name=Xb4151_4152.C441.gene100.pep
MAVVTIVELKGSLATFAIVAREASLTCSVFAYRFCLVAISTSHFYRNSHDDIPLKSTRISN

SEQ ID NO: 9313 - protein, 93 aa, Xenorhabdus bovienii
  Peptide sequence Name=Xb4151_4152.C441.gene101.pep
MGDDFFPFSIKIIPKPMTLFFIAYQRPLLIQFTDKCDIVISDLSRCYLFWREFFNVRITVLIPRPNIRPVSLTPEPFIAISTIFSFIPGLWPL

SEQ ID NO: 9314 - protein, 123 aa, Xenorhabdus bovienii
  Peptide sequence Name=Xb4151_4152.C441.gene102.pep
  Gene classification: Gene name=InsB; Function=Insertion element IS1 protein InsB, putative transposase; Function class=L DNA replication, recombination and repair
  Homolog annotation: Query=30..79bp; Hit=71..119bp; Blast score=64; Percent Identity=68.0; E value=1e-11; Homolog= Z1562 COG1662
MSLTPEQMQPAENCSTYWRLLIFVSSRPITGEVMPEKYLVGKIFTQRIERHNLNLRIHIKRLARRRTICYSRSMEIHEKLIGAYIEKHHYNPLESLPNIGGELNRILGDFETLFTILWNLHLI

SEQ ID NO: 9315 - protein, 57 aa, Xenorhabdus bovienii
  Peptide sequence Name=Xb4151_4152.C441.gene103.pep
LLALPKETDVIESLNSIRHAIKKRQSFPSDDSVKKGSLADHSGRIQKSRQYCSVAGV

SEQ ID NO: 9316 - protein, 54 aa, Xenorhabdus bovienii
  Peptide sequence Name=Xb4151_4152.C441.gene104.pep
MTSVSFGKASKFFDLWKDCRYTKLLIRVHNDEFGIFFQPLIVFMRKIQESKIIG

SEQ ID NO: 9317 - protein, 433 aa, Xenorhabdus bovienii
  Peptide sequence Name=Xb4151_4152.C441.gene105.pep
  Gene classification: Gene name=AroA; Function=5-enolpyruvylshikimate -3-phosphate synthase; Function class=E Amino acid transport and metabolism
  Homolog annotation: Query=4..429bp; Hit=3..413bp; Blast score=89; Percent Identity=23.0; E value=6e-18; Homolog= MTH766 COG0128
MSKVTVFPSFGLTGEVFIPSSKPHIQRALLLALLNENTTKIVNISWNVETENQINALKKFGLEILHKDGTTLLLRGVGRNLSYNGEIYAGGSGMLFRMCAALASLIDNEKIVIKCNESLFNRESVFDEDFCNYLDIHIERIENEKIIITKSETNIKKPLTVLNSTQFITFALFVTPFSKQNIVPIVMDGSKMGYIDMTIKSMSLLGSMVTYEQKHFKVTKYIPKDIEIKIPSDFTSLSYIASSILSSKGVSDVLIRNYYFNDTINERDLFKFYQSIGLIIKYDSNWNNLRIFRQSIRLWDGEFSLKELPSVAVNIIAASSNLKGKKIFSGVRGINNHKSQRAFIVNENIRTMGGSSVLIFDRVGMFESIYIEGKGPLNGGVELKSYGDHRICAANLIASLGAEKESIIYDIDKLNDGFPDYIDTLRNLGVHIK

SEQ ID NO: 9318 - protein, 445 aa, Xenorhabdus bovienii
  Peptide sequence Name=Xb4151_4152.C441.gene106.pep
  Gene classification: Gene name=AroA; Function=5-enolpyruvylshikimate -3-phosphate synthase; Function class=E Amino acid transport and metabolism
  Homolog annotation: Query=17..437bp; Hit=39..454bp; Blast score=184; Percent Identity=31.0; E value=2e-46; Homolog= DR1096 COG0128
MSKRIDKDSKFVEVIYSKRLQGTLNLPASKSSSTRALLTSSITSGKSIIRNIATGFNTIAMKSNCERLGAVFKEDKGNLIVNGIDVSSINQPLEFNPGNSGVVLRLLMGVAGFLPETKFITDYHASLGFRSQTEMVNALCMLNVQCRALGEEHRLPIRIKSDRKLNDYTEVSCRKSSQFLSGLLYLGAVMDNDLTIKVVDKITAPSMVHTTINNLKKAGIRIEYDSDFREFFVHGRCRLQASDFTVGSDPASTAAILALCGSLESEVQLNGFFEEELGNGAVIQYLIDTGTNIEFIGNETIIIRGSTEIRPLDFDGSLAPDAVPALAARASLASGTSIFYNIEHIRYKESDRISDFRKELSKLGVKSDEKHDQLIIHGNPKGYKGRVVLDGHYDHGLIMGLTTIGLHCSEPVIIKEPFHVGQTYPEYFSEIRSLGAKVNELAKLK

SEQ ID NO: 9319 - protein, 246 aa, Xenorhabdus bovienii
  Peptide sequence Name=Xb4151_4152.C441.gene107.pep
  Gene classification: Gene name=AsnB; Function=Asparagine synthase (glutamine-hydrolyzing); Function class=E Amino acid transport and metabolism
  Homolog annotation: Query=25..243bp; Hit=24..242bp; Blast score=129; Percent Identity=35.0; E value=2e-30; Homolog= VC0991 COG0367
MCGIAAIFTTKKILIEQLDNKLFSMIERIKHRGDLSRFNEHLVKEYVGLATNRLAIVERETATQPVSDEERDIHVILNGQIFNYKKIREKLIKRGHEFKGYGDAEVILKAYIEYDLEFVNMLDGMFAFVIYDNRKSKFLIGRDHVGIKPLYYAKKNDVWYVASEMKSFLALDVEVKTLEPGSLYDGNELYKYTRYDKSIEKSKDCYLVAKQKVRKLMEEAVESQVDTDLPVAVMFSGGIDGHVLNG

SEQ ID NO: 9320 - protein, 56 aa, Xenorhabdus bovienii; identical to SEQ ID NO: 7384
  Peptide sequence Name=Xb4151_4152.C441.gene108.pep

SEQ ID NO: 9321 - protein, 92 aa, Xenorhabdus bovienii; identical to SEQ ID NO: 8540
  Peptide sequence Name=Xb4151_4152.C441.gene109.pep

SEQ ID NO: 9322 - protein, 1136 aa, Xenorhabdus bovienii
  Peptide sequence Name=Xb4151_4152.C441.gene110.pep
  Gene classification: Gene name=EntF; Function=Non-ribosomal peptide synthetase modules and related proteins; Function class=Q Secondary metabolites biosynthesis, transport and catabolism
  Homolog annotation: Query=69..1004bp; Hit=69..981bp; Blast score=506; Percent Identity=34.0; E value=1e-143; Homolog= PA4225_1 COG1020
MQHFLRALQESGLQVSLSSSELAELENKNTEAGISPLTQQIHEMLCSALPLNMTIPKTLFTKESTTDDFPLTDIQYAYLIGRNPGLELGGRTSCLYTEWDVKSLDIKVLNDALNMVIGYHPMLRTALSSDGQQRVLSESLAYTISIQDGRAWPASEKDKQLADIRQKMETQLLPVDKTPSFDIRATILSDEITRLHLYFDLMFMDLHSVRLVLRDWGRVYQGCELPELGDEANFHNYIKAERYLQGQPQGQYDKTYWEQQFDNLPPSPELPLKNAPELISPPMFKRYSRKIATETLSALKKKAEQQKLTLETLLLGTYAEVLRQWSKRQTFTLTITQLGRRPYFSAVENIVGNFLQPTLLAIQGTENDSFNDRLVQLQTDFLMNRWHSSYNGVQVLRELTRRSHGSRAVSAPVVFSNTLTAHLDDVVTDMDWADTVQVYSSNQTPQVWLENQIVRVDGIVQINWNTVSELFPDGMVEAMLDSYMELLIVCAEDDSVWGKTGSLVKLPASDRAERAKANATDIDLAPRLLHEMVLQAAEKFPHSIALVQGGKYFTYAEMVKGASEVAKSLRASVQIHPNDIVAVSLPQGPALVLGVLGILMSGAAYVAIDPQLPAERRMNLLRRCSAKGIVTESSLSNEDESADLFRINLDECLMSEAMDTEQKVSAHLSSVQALDDLAYVIFTSGSTGEPKGVMASHRNAANTVLDINRKFHVTEKDTVLSVAPAGFDLSVYDYFGVLGAGGKVVFSTSEAANDPKIWFETLVKHQITIWNSVPAPVKVLVDRNGGDLAQTPLRLILMSGDWIPIDLPERIRENLPDTAIISLGGATEGSIWSICYPIEDIDKNWKSIPYGKPLANQRFHVLNNWLSPCPNWVTGELYIGGEGVTLGYLGDLEKTAQRFITHPVTGERLYKTGDLGRYMANGLIEILGREDNQVKINGYRIELGEIEACLLTHENAGHVVMDAPVHAKTGQRHIVAYVVPSVADTSEDPAHFQEQLREIARNILPSYMVPSYYVLLAHMPLTSNGKIDRKALPLPWADSEEHTAIAVDPANEIETKILQLWQSQLQHDDFDVTDGFFDIGGDSLHAVGLLSALRQEFNITPAGEQDIIEGLFMNSNIQAFSRIIETIMQSQAVSDL

SEQ ID NO: 9323 - protein, 549 aa, Xenorhabdus bovienii
  Peptide sequence Name=Xb4151_4152.C441.gene111.pep
  Gene classification: Gene name=BetA; Function=Choline dehydrogenase and related flavoproteins; Function class=N Cell motility and secretion
  Homolog annotation: Query=5..530bp; Hit=3..526bp; Blast score=231; Percent Identity=32.0; E value=2e-60; Homolog= mll3225 COG2303
MTKTYDYIVVGGGSAGCVAASRLSENGTKSVLLLEAGHASDVNDPASPLRDASRLVLEGYNWDYEANVRSEDRFADLISPSHYLQDEKKQEHKHRGRKLFNYRVGKVLGGSSAVNGAIAFRGFPSDFEQWVKMGCSRWSWEQVLPWFKHLENDVDRTGDDNHGSLGPMCLRRPQHEEIHPLDMAFAHACEQSGVPYVDDLNAGESPAVGPVPANVINGAERVDVYRSYLEPVLHRKNLRVMTDVLVAQIIFNGTVAAGVKVIQAGEEQIYHAEHIVLCAGAIGSATLLQRSGVGDPGHLRALGIPVIAELPAVGRNLTDHASVVLWSLPKTGVCTTGLPWRQIAARISSGYDTKVDVQIGLLNNVASETVPGFKDRVAYPMLVGASVMLMRPQALGRVFISTADPTVLPQIDLPLTRNPADIARLVGGVRKIWEVLRHPEVDAFLDGIQFWSHSMIYNDEIMNSAIKNLVNPGWHASGTLRMGADSDPDCATQEDGQVYGITGVTVADASLFPTIPSMPTNLTTIMTAERITSFLMEREAVIARRENEH

SEQ ID NO: 9324 - protein, 245 aa, Xenorhabdus bovienii
  Peptide sequence Name=Xb4151_4152.C441.gene112.pep
  Gene classification: Gene name=GrsT; Function=Predicted thioesterase involved in non-ribosomal peptide biosynthesis; Function class=Q Secondary metabolites biosynthesis, transport and catabolism
  Homolog annotation: Query=9..226bp; Hit=9..219bp; Blast score=76; Percent Identity=25.0; E value=3e-14; Homolog= PA2425 COG3208
MNINCRRVIYAFPHAGATTAIYRPWLNALAATKAAILQPVAIPGRGHLAKEPEIHELEPLVDRLASDIWADFQQKQAQGITEWITFGHSFGGVLSVAVGQILHERYGLTPQFGVVSCSVPPQLQPYDERHEWTDEQLIQKTREDQGTPEAILNEPALIKPIIRQLRNDYLIRSQFTQLGNMQVDYPLVLVSASQDIHVGLADMQVWKNHTSHKTSLIRIEGDHFAVYRHWDAIKQILLSDSETQQ

SEQ ID NO: 9325 - protein, 378 aa, Xenorhabdus bovienii
  Peptide sequence Name=Xb4151_4152.C441.gene113.pep
  Gene classification: Gene name=CaiA; Function=Acyl-CoA dehydrogenases; Function class=I Lipid metabolism
  Homolog annotation: Query=11..378bp; Hit=19..386bp; Blast score=362; Percent Identity=47.0; E value=1e-100; Homolog= Rv2724c COG1960
MRIEIDNFDDYRKSCREFLESEIVPEHQAWEYNGLMARSFWERLGKAGLLGISVSPEYGGLGKHDYRFAVILTEELIRAGVTVPGIVAHNDIIASYIFALGSGEQKQKWLPELCLGKRVAAIAMTEPGGGSNTADIKTVAKRQGDHYLVNGGKTYITNGINADLIVVAVKTEQGQQGQGISLLVIERDMAGFSRGEPMKKIGWNGSDTAELFFHDCKVPVTNLIGRENLGNYYFMSAMPRERLSISAVAVASAEHILQSTLAYVKERKAFDQPIGSFQYNRFILAQLDTEVKIARIYLDNAVEQFSKGLFSLVDAARIKWWTTELQMKVADRCLQLYGGAGYMRDSVAGKNWLNSRAQTIYGGTSEVLQEMISKSMGL

SEQ ID NO: 9326 - protein, 38 aa, Xenorhabdus bovienii
  Peptide sequence Name=Xb4151_4152.C441.gene114.pep
MSKAGLIPHYRTFRKYKGNVIPKGRLDKLRAIASLELG

SEQ ID NO: 9327 - protein, 167 aa, Xenorhabdus bovienii
  Peptide sequence Name=Xb4151_4152.C441.gene115.pep
  Gene classification: Function=Hemoglobin-like proteins; Function class=R General function prediction only
  Homolog annotation: Query=14..167bp; Hit=1..153bp; Blast score=145; Percent Identity=47.0; E value=2e-35; Homolog= mlr0267 COG2346
MTTSFMYSYERYVMANEKPTLFEWMGGREKLMHLMEVFYAKVEKDELLEPLFKNMKADHPGHVGMWLEEVLGGESRYTDERGGFKVMLSRHRGRSIQPEQRTRWVELLMKSADEIGLPSDPEFRSAFAAYIEWGSRRAEANSQPDAAPSRRETVPKWGWGEAPPGTP

SEQ ID NO: 9328 - protein, 280 aa, Xenorhabdus bovienii
  Peptide sequence Name=Xb4151_4152.C441.gene116.pep
  Homolog annotation: Query=2..260bp; Hit=15..272bp; Blast score=262; Percent Identity=49.0; E value=4e-69; Homolog= gi|16224015|gb|AAL15596.1|AF322256_17 Sim18 [Streptomyces antibioticus]
MLLAVSDLHVSHAANRAIVDSFRPSTPDDWLLLVGDIAEQESDFTWVISTLSQRFAQVIWTPGNHELWCSPRDPVKLPGVLRYEHLVNICRQHNVLTPEDEFQRYPMGDGTFVTIAPIFTLYDYSFRNATDYTADQAIERARRCGIISSDEFFLKTYPYKNIIEWCRERIQYTEKRLNHIQDGEGIVLMSHFPIIRKPTESLRNTEFSIWCGSEKTRQWASRKGVHMVVYGHLHIPNIEYIHGVAHVEVSLGYPREWQERGRHFCLVELDEWLEYASEYR

SEQ ID NO: 9329 - protein, 191 aa, Xenorhabdus bovienii
  Peptide sequence Name=Xb4151_4152.C441.gene117.pep
  Gene classification: Gene name=Dfp; Function =Phosphopantothenoylcysteinesynthetase/decarboxylase; Function class =H Coenzyme metabolism
  Homolog annotation: Query=14..182bp; Hit=3..166bp; Blast score=66; Percent Identity=31.0; E value=2e-11; Homolog= aq_815 COG0452
MKYDETNQKIKPRILIGATGSVDIVLLPRYLSAIKAAIDCTLTVLMTNSAIPFLPAETIALYADRVISGEKPQDWPTDKPSRIVADHDLMAVLPATANTMASAAHGATPNRLTTVILASTFPVLFFPVMGSVMWEKNATRRNIRQLNDDGYHVIEPVWHENFDASLQKMVGHPSLPDIETVISLLKQYLPK

SEQ ID NO: 9330 - protein, 35 aa, Xenorhabdus bovienii
  Peptide sequence Name=Xb4151_4152.C441.gene118.pep
MRGQQIGRKEEEYAVHMLNTVRIPEYSPYISHRFQ

SEQ ID NO: 9331 - protein, 423 aa, Xenorhabdus bovienii
  Peptide sequence Name=Xb4151_4152.C441.gene119.pep
  Gene classification: Gene name=ProP; Function=77 Permeases of the major facilitator superfamily; Function class=G Carbohydrate transport and metabolism
  Homolog annotation: Query=7..423bp; Hit=13..429bp; Blast score=506; Percent Identity=66.0; E value=1e-143; Homolog= PA5370 COG0477
MSQHYNRALNKQDYKTLSLAALGGALEFYDFIIFVFFAVVLGELFFPADIPVWLRQLQTFGIFAAGYLARPLGGIIMAHFGDLIGRKKMFSLSILLMALPTLIIGGLPTYDTIGIAAPVLLLLMRIMQGAAIGGEVPGAWVFVAEHVPHKRIGFACGILTAGLTIGILLGSLVATIITSIYTRQDVLDWAWRLPFFIGGAFGLCAMYLRRWLQETPVFREMQERKALADGLPLKSVILNHKHAIIVSMLLTWLLSAGIVVVILMAPTYMQTVFHLEQSLTLKANSLAIIMLAIGCILAGHLCDKWGASLVLVAGCVLLAVASWFFYHNISDEPGRLFSAYAVAGFSVGVLGAVPFVMVQSYPPEVRFSGISFSYNMSYAIFGGLTPIFVTLLQVYTQFAPAYYILVLSVVGILLGLHLRVRKK

SEQ ID NO: 9332 - protein, 190 aa, Xenorhabdus bovienii
  Peptide sequence Name=Xb4151_4152.C441.gene120.pep
  Gene classification: Function=Predicted membrane protein; Function class=R General function prediction only
  Homolog annotation: Query=1..186bp; Hit=1..186bp; Blast score=216; Percent Identity=70.0; E value=1e-56; Homolog= yaaH COG1584
MHSNQLANPGPLGLMGFGMTTILLNLHNAGFFPLASAILSMGIFYGGLAQVLAGIIEYKKGNTFAATAFTSYGMFWLSLIGLLFLPVMGLADATSHEFFGVYLALWGIFTLFMFFGTLKANRVLQFVFGSLTLLFALLAISNITGNTGLLTFAGYEGIVCGASAFYLAMAEVLNEQYGRTVLPIGEVKHA

SEQ ID NO: 9333 - protein, 634 aa, Xenorhabdus bovienii
  Peptide sequence Name=Xb4151_4152.C441.gene121.pep
  Gene classification: Gene name=DnaK; Function=Molecular chaperone; Function class=O Posttranslational modification, protein turnover, chaperones
  Homolog annotation: Query=1..634bp; Hit=1..638bp; Blast score=1020; Percent Identity=88.0; E value=0; Homolog= dnaK COG0443
MGKIIGIDLGTTNSCVAIMDGTTARVLENSEGDRTTPSIIAYTQDGETLVGQPAKRQAVTNPQNTLFAIKRLIGRRFQDEEVQRDVSIMPYKIIGADNGDAWLEVKDQKIAPPQISAEVLKKMKKTAEDYLGEPVTEAVITVPAYFNDAQRQATKDAGRIAGLEVKRIINEPTAAALAYGMDKEVGNRTIAVYDLGGGTFDISIIEIDEVDGEKTYEVLATNGDTHLGGEDFDSRLINYLVDEFKKEQGFDLRNDPLAMQRLKEAAEKAKIELSSAQQTDVNLPYITADATGPKHMNVKVTRAKLESLVEDLVKRSMEPLKVALNDAGLSVSDIQDVILVGGQTRMPMVQKTVADFFGKEPRKDVNPDEAVAMGAAVQGGVLSGEVKDVLLLDVTPLSLGIETMGGVMTALITKNTTIPTKHSQVFSTAEDNQSAVTIHVLQGERKRSGDNKSLGQFNLDGIQPAPRGMPQVEVTFDIDADGILHVSAKDKNSGREQKITIKASSGLNEEEIQQMVRDAEANAEADRKFEELVQIRNQADQLIHGTRKQVEEAGDKLTADDKAGIEKAVSELEVAVKGEDKAETEAKIQALVEASKKLLEIAQQQAQEGAAEAGTAKKDDDVVDAEFEEVKDKK

SEQ ID NO: 9334 - protein, 378 aa, Xenorhabdus bovienii
  Peptide sequence Name=Xb4151_4152.C441.gene122.pep
  Gene classification: Gene name=DnaJ; Function=Molecular chaperones (contain C-terminal Zn finger domain); Function class=O Posttranslational modification, protein turnover, chaperones
  Homolog annotation: Query=1..378bp; Hit=1..376bp; Blast score=605; Percent Identity=83.0; E value=1e-173; Homolog= ZdnaJ COG0484
MAKKDYYEVLGISKTTEEKEIKKAYKRLAMKYHPDRNQGDKEAESKFKEIKEAYEILTDAQKRAAYDQYGHAAFEQGGMGGGAGGFGGGADFSDVFGDVFGDIFGGGRRQQRSSRGSDLRYNMDLTLEEAVRGVTKEIRIPTLESCDTCHGSGAKAGTNPETCSTCHGAGQVHMRQGFFTVQQPCPQCHGRGKVIKETCGKCHGHGRVEKYKTLSVKIPAGVDTGDRIRLGGEGEAGEHGAPAGDLYVQVQVKAHHIFERDGSNLYCEVPINFATAALGGEIEVPTLDGRVSLKIPAETQTGKLFRMKGKGVKSVRGGAQGDLLCRVVVETPVKLNDEQKDLLRKLGESLGGKSGETNSPRSKSFIDGVKKFFDDLTK

SEQ ID NO: 9335 - protein, 327 aa, Xenorhabdus bovienii; identical to SEQ ID NO: 5470
  Peptide sequence Name=Xb4151_4152.C441.gene123.pep
  Gene classification: Gene name=Tra8; Function=Transposase, IS30 family; Function class=L DNA replication, recombination and repair
  Homolog annotation: Query=1..312bp; Hit=1..312bp; Blast score=295; Percent Identity=52.0; E value=3e-80; Homolog= NMB0443 COG2826

SEQ ID NO: 9336 - protein, 199 aa, Xenorhabdus bovienii
  Peptide sequence Name=Xb4151_4152.C441.gene124.pep
  Gene classification: Gene name=ClpP; Function=Protease subunit of ATP- dependent Clp proteases; Function class=N Cell motility and secretion
  Homolog annotation: Query=28..198bp; Hit=26..196bp; Blast score=184; Percent Identity=49.0; E value=5e-47; Homolog= PA3326 COG0740
MLEDSPKDAQKDSTNPLKDMPYEQGKLLKSRCIMISGEINQALAEKVTTQLLVLQEINNDPIKIFINSQGGHVEAGDTIHDLIKFIRPEVFIIGTGWVASAGITIFLAARKENRYSLPNTRFMIHQPLGGYQGKASDIEIEAKEFLFIRSRINKLISDATGQSIEKVEKDTDRNYWMRPQQAIEYGIVGRIITKWDDIQ

SEQ ID NO: 9337 - protein, 94 aa, Xenorhabdus bovienii
  Peptide sequence Name=Xb4151_4152.C441.gene125.pep
  Gene classification: Gene name=RimL; Function=Acetyltransferases, including N-acetylases of ribosomal proteins; Function class=J Translation, ribosomal structure and biogenesis
  Homolog annotation: Query=3..85bp; Hit=98..180bp; Blast score=73; Percent Identity=39.0; E value=5e-14; Homolog= DR1534 COG1670
LRIGCIFHPFYQRKSIGTESLGALIDISFEYFRCHRIYAKLDVLNLGSKRLVEKLGMRQEAHLLQNERVNGIWSDMYMYAILHNEWQAPKFLKR

SEQ ID NO: 9338 - protein, 349 aa, Xenorhabdus bovienii; identical to SEQ ID NO: 5796
  Peptide sequence Name=Xb4151_4152.C441.gene126.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 9339 - protein, 52 aa, Xenorhabdus bovienii
  Peptide sequence Name=Xb4151_4152.C441.gene127.pep
MNSSIKSGVRPDALKSGVRPDALKTGVRSDALKTGVRPDALKTGVRPDAIID

SEQ ID NO: 9340 - protein, 452 aa, Xenorhabdus bovienii
  Peptide sequence Name=Xb4151_4152.C441.gene128.pep
MLLLTKSIISYVSQLIAGLLSIFKTFTNEMDKNMTIDFHKEVWEGFDQKTNYGKTPFLFQSVLPLNEGFSNHETVKDAFYNLCSKSNLLKTDCRLRIYDGEKRRDDLVEKLSSETILSDETLTHFMQRLSGKERFSLVINNLEQSCPKLAADFGLFAQSFFAYKGIPIGGIEQATFCGNYSGTAFGIHEGFEHAFLCHLGPGIKYFYCWSRELYLEITGSREPTFSDSELYDKLIEKGTLYILKPGDALYLPASVYHVGRQEEFSVSIALPFYTYPLSRFMALKILPALSEQSLPFDQEGMSELIKFDNNQFDIEPLSTLLTETINKWFQQDLPKYLHYYWHRLRSNGGWELPTTISADPLKEPEHQNDLIINPDSQVSLQAPFIVSYEHGLNCSSDEIRVFIATKSVILPASSETLKLLDTLNTRQPITIHSEDVYTSLKILIGTGGLFCH

SEQ ID NO: 9341 - protein, 283 aa, Xenorhabdus bovienii
  Peptide sequence Name=Xb4151_4152.C441.gene129.pep
MYRNFPALVDDYLNKNISTANLINSIISEGKAKIDGNELIDKHLDPMITIIYNQIKDLINPSNLSQEEAKLYIGELSVFARYNSTMLLRAADNIRGFCPEFAQELTRNFLEEGGERGKLPAHYVVFSGALIADVNFRVNGWMPRTSSTRALISLIDILTWSHCPSTVLGMYYATEAIAIAETLLLQDITNRLGQITGRGTGNSLKKLDFYYRMHLDETHSAATDNVAVERGHQEGIARFIRDADLFHFQQPQIVDGFLQMLTPFVDQWVEIHHLTRTDHCYSH

SEQ ID NO: 9342 - protein, 128 aa, Xenorhabdus bovienii
  Peptide sequence Name=Xb4151_4152.C441.gene130.pep
  Gene classification: Function=Uncharacterized ACR; Function class=S Function unknown
  Homolog annotation: Query=7..121bp; Hit=7..116bp; Blast score=65; Percent Identity=33.0; E value=1e-11; Homolog= mlr7802 COG3791
MKKIEFSGGCLCGHIRFIATGEAGNPHTCSCSMCQQHSGALTLCWIEFPKAAVHWNGPGGVPSVFRSSDYSSRAFCSQCGSSLGAIDDGPTVGLLLGNFDSKNKKNLRPVSHSFISSRPRWWKIDTQS

SEQ ID NO: 9343 - protein, 295 aa, Xenorhabdus bovienii
  Peptide sequence Name=Xb4151_4152.C441.gene131.pep
  Gene classification: Gene name=LysU; Function=Lysyl-tRNA synthetase class II; Function class=J Translation, ribosomal structure and biogenesis
  Homolog annotation: Query=9..273bp; Hit=192..486bp; Blast score=98; Percent Identity=27.0; E value=1e-20; Homolog= DR0372 COG1190
MLNSPILYKAAMIRRIRTFLDSQKFIEIMTPVMRRYSGDDSRPRLSLHNGGWLRESSAFALRYNLQFYDRIYEIGPSFRPDTVDDTHLPEFTMLDLYKKDSTLDEMLQLAQSIIEIFYQGKISVLSFSDHLKQRFLVDFFEDCSAPEIFIDCLREMYCDKKTPPLNLIDRYIIENIEPLSQQCCIIVTDFPLLTEIRAKKRTGTKGIVERFEILIDGIEIVHGYTDEDDVERFETQARKRNMFGSEDEVMCTMMRNKLVSPSSAGFAIGIERLCQVALGEKQISAFATSRPFSPF

SEQ ID NO: 9344 - protein, 533 aa, Xenorhabdus bovienii
  Peptide sequence Name=Xb4151_4152.C441.gene132.pep
  Gene classification: Gene name=PotD; Function=Spermidine/putrescine -binding periplasmic protein; Function class=E Amino acid transport and metabolism
  Homolog annotation: Query=204..533bp; Hit=15..344bp; Blast score=317; Percent Identity=45.0; E value=2e-86; Homolog= mll2885 COG0687
MVTFNEWFIMAFSIALVLIVPGPTNTLLLSAGLQQGLSKSLILVIAEAIGYTVAIAIWGFFLLSLTQTLSWIYQFVKLLSAIYILWLAFKLWMYSLKIDYFTDNQMNLINISAHKSTNFLDVMVATFLNPKALLFVSTFIPISTFKSMNTFFPMLGIFLLILVPIGTLWISIGSLIHSYKYLRRFTAIFLRISSVILILFSFSLTYSGIAKAESSLVLYNWQSYTSPEMLQKFKKEHNISITLLEYKSNEEALESIQLGKINADLAVVADNFLLHWINAGLLQPINVQSMTNFKNITPRWRSSPADPQRTYGIPWSWGVVGTVVHTDVHDGDINTWKVVLEPPTSLFGTINVGSDMNDLIYAAIRYHGGKICDSNPKLLEKVKKTLLEAKKHWAAMEYGSVNMMASGKFKAGIDWNGAALRQRRINSHIQFGFPREGVLIFSDNLVILKRSKNYENARLFLNFIMQPENAALNSAFHGYDSTIEGADKFLPSWMKNALELKIPEHVLKNSDHSIMCPPFVQKKYLNIWQQLLK

SEQ ID NO: 9345 - protein, 93 aa, Xenorhabdus bovienii
  Peptide sequence Name=Xb4151_4152.C441.gene133.pep
  Homolog annotation: Query=1..57bp; Hit=1..57bp; Blast score=114; Percent Identity=92.0; E value=2e-25; Homolog= gi|37527658|ref|NP _931002.1| hypothetical protein [Photorhabdus luminescens subsp. laumondii TTO1] gi|36787093|emb|CAE16168.1| u
MSIFNFIRKIDDPRSDINKKHELMDVIFLAFSAVLCGASGWKSIQEFGELQIEWLKECLKPCMWSVLMMLNRVLPSAIVPPKAKVRKARLPGN

SEQ ID NO: 9346 - protein, 148 aa, Xenorhabdus bovienii
  Peptide sequence Name=Xb4151_4152.C441.gene134.pep
  Homolog annotation: Query=1..137bp; Hit=167..303bp; Blast score=217; Percent Identity=77.0; E value=2e-56; Homolog= gi|37527658|ref|NP _931002.1| hypothetical protein [Photorhabdus luminescens subsp. laumondii TTO1] gi|36787093|emb|CAE16168.
MDALHCQKETLGLINQRGGDFIVGLKGNQKKFYEFVKPHFAAPYDHDERAEFTEKNSSHGRKEFRHVMQIRAALPEQLQQQWPSIQSVIEIVSKRSVKGQPSCRDSRWYVSSLPLDAEIAAKAIRRHWSVENKLHWVFSGRRSITQRP

SEQ ID NO: 9347 - protein, 272 aa, Xenorhabdus bovienii
  Peptide sequence Name=Xb4151_4152.C441.gene135.pep
  Gene classification: Gene name=MhpC; Function=Predicted hydrolases or acyltransferases (alpha/beta hydrolase superfamily); Function class=R General function prediction only
  Homolog annotation: Query=22..270bp; Hit=59..302bp; Blast score=80; Percent Identity=28.0; E value=1e-15; Homolog= DR0791 COG0596
MVATHDDIQTRYANISVLDTGGSGLPVLLIHGNSSCKEIFRHQIEYLKGDYRVLALDLPGHGKSSDASDPREAYSMPGYARTIMEVLDKMDIDKVVVFGWSLGGHIGLEMLALNPKMIGLMICGTPPVAVGKENIARGFCQSKQMRLTGKAEFTDEDVRNFACETNGVNAPHEPFMIEAVARTDGLARQYMFEAFISPQATDQKLLAETSEVPLAIVNGVGDPFINHDYINGLNYRNLWQGQVFNLAGVDHAPFWEAPDIFNPILAEFLKDL

SEQ ID NO: 9348 - protein, 45 aa, Xenorhabdus bovienii
  Peptide sequence Name=Xb4151_4152.C441.gene136.pep
MKLTVSRCVQGEGLDTTEISDFNWVIAPIDGARKFSFFHIITLEC

SEQ ID NO: 9349 - protein, 241 aa, Xenorhabdus bovienii
  Peptide sequence Name=Xb4151_4152.C441.gene137.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=4..241bp; Hit=13..250bp; Blast score=285; Percent Identity=59.0; E value=2e-77; Homolog= VCA0301 COG1028
MTSSRGIGAATAILAANKGYSICLNYLNDEKSAFKVRDEILNLGAKCITVRADVSNEHQVKKMFDDIDTQLGSITHLVNNVGILKQKMPLIDMDGERFQQVLLTNVMSHFYCSSEAIKRMSISRGGSGGSIVNVSSGASKSGSPFEYIDYAASKGAVDTFTTGLSKEVAADGIRVNCVRPGGIYTDIHADGGEPSRVDRIAKNFPMQRGGTPEEVANAILWLLSDEASFVTGSFTDLCGGL

SEQ ID NO: 9350 - protein, 92 aa, Xenorhabdus bovienii; identical to SEQ ID NO: 6203
  Peptide sequence Name=Xb4151_4152.C441.gene138.pep

SEQ ID NO: 9351 - protein, 89 aa, Xenorhabdus bovienii
  Peptide sequence Name=Xb4151_4152.C441.gene139.pep
MGDHFSSYPRSCIKWLVAVICFRLFKDEVWPKLMSIAVIATNQNRSKDMGKEMADILVIAVIAAVRSFSWRIPIRPANPALKNRLSISR

SEQ ID NO: 9352 - protein, 44 aa, Xenorhabdus bovienii
  Peptide sequence Name=Xb4151_4152.C441.gene140.pep
  Gene classification: Gene name=InsB; Function=Insertion element IS1 protein InsB, putative transposase; Function class=L DNA replication, recombination and repair
  Homolog annotation: Query=2..44bp; Hit=85..127bp; Blast score=64; Percent Identity=65.0; E value=2e-11; Homolog= insB_g1 COG1662
MRLLALLTPFNIIIYMTDGWQSYEKALAGKLHVASKRYTQRIDK

SEQ ID NO: 9353 - protein, 33 aa, Xenorhabdus bovienii
  Peptide sequence Name=Xb4151_4152.C441.gene141.pep
MNKDDFPLLLLAFVNENHLCFNVDALDKENRWH

SEQ ID NO: 9354 - protein, 148 aa, Xenorhabdus bovienii
  Peptide sequence Name=Xb4151_4152.C441.gene142.pep
  Gene classification: Gene name=MarR; Function=Transcriptional regulators; Function class=K Transcription
  Homolog annotation: Query=2..122bp; Hit=7..127bp; Blast score=133; Percent Identity=55.0; E value=5e-32; Homolog= NMB1843 COG1846
MHESLTIALLQARETAMGFFRPILKSYNLTEQQWRIIRVLASSRSIDFHDLACLTCILRPSLTGILTRMERDGLIFRLKPMNDQRKLYVSLTPAGQELYEQAREQVNDGYKAIEDAFSPAKLAQLLALLDEFTSIGNLVQEDIETENE

SEQ ID NO: 9355 - protein, 225 aa, Xenorhabdus bovienii
  Peptide sequence Name=Xb4151_4152.C441.gene143.pep
  Gene classification: Gene name=MhpD; Function=2-keto-4-pentenoate hydratase/2-oxohepta-3-ene-1,7-dioic acid hydratase (catechol pathway); Function class=Q Secondary metabolites biosynthesis, transport and catabolism
  Homolog annotation: Query=3..206bp; Hit=11..219bp; Blast score=163; Percent Identity=41.0; E value=2e-40; Homolog= PA4121 COG0179
MKGTVFAVALNHRSQLDFWHEAFDELPYKTPPKTPIWFIKPRNTVIVSGDIIPHPIGETVQSGATLALLIGKTARKVSIQDAEQYIAGYALANEVSLPETSFYRPAIKEKCRDGFCPIGQIITTKSVDSLDIITEINGQAVDRWSTRDLVRSASELLAALSDFSTLNEGDVILLGTPHQRVTLHPNDIVTVKAEGFPALKNTVVLEDITLKGSDLEGMAQAGGQS

SEQ ID NO: 9356 - protein, 254 aa, Xenorhabdus bovienii
  Peptide sequence Name=Xb4151_4152.C441.gene144.pep
  Gene classification: Gene name=MhpD; Function=2-keto-4-pentenoate hydratase/2-oxohepta-3-ene-1,7-dioic acid hydratase (catechol pathway); Function class=Q Secondary metabolites biosynthesis, transport and catabolism
  Homolog annotation: Query=1..249bp; Hit=1..249bp; Blast score=337; Percent Identity=69.0; E value=1e-92; Homolog= PA4122 COG0179
MRQARVRYQNQEMSVIVDEQENILLSDGCVVSGRDVLWLPPANGTLFALGLNYADHATELEFKPPEEPLIFIKAANSLTGHRQVSVRPDNVEYMHYEAELVVVIGKPARNVSREQAMGYVAGYTVCNDYAIRDYLENYYRPNLRVKSRDTLTPIGPWIVDKNAIADPHNLILSTRVNGELRQRGTTADLIFDIPFLIAYLSSFMTLQPGDMIATGTPKGLSDVVPGDEVIVSVEGVGSLVNHIVSQQEYEENLS

SEQ ID NO: 9357 - protein, 488 aa, Xenorhabdus bovienii
  Peptide sequence Name=Xb4151_4152.C441.gene145.pep
  Gene classification: Gene name=PutA; Function=NAD-dependent aldehyde dehydrogenases; Function class=C Energy production and conversion
  Homolog annotation: Query=4..488bp; Hit=2..486bp; Blast score=807; Percent Identity=78.0; E value=0; Homolog= PA4123 COG1012
MTTINHWINGKNVASNTYFETTNPATGEVLAQVASGGQTEIDQAVAAAKDAFPKWADTPMKERARLMRRLGELIDQNVPDIAAMETKDTGLPIHQTQNVLIPRASHNFDFFAEICQQMNGRTYPVDDKMLNYTLIQPVGVCALISPWNVPFMTATWKVAPCLALGNTAVLKMSELSPLTANRLGELALEAGIPAGVLNVVQGYGNTAGDALVKHHDVRAISFTGGTATGRRIMQSAGLKKYSMELGGKSPVLIFEDADIERALDSALFTIFSLNGERCTAGSRIFIQESIYPEFVKRFAERANRLRVGDPQDPNTQVGSLISQSHWEKVSGYIRLGIEEGATLLAGGSDKPADLPDHLKKGHFLRPTVLADVNNRMRVAQEEIFGPVACLLPFKSEEDGLRMANDVEYGLASYIWTQDVSKVLRLARSIEAGMVFVNSQNVRDLRQPFGGVKASGTGREGGEYSLEVFAEVKNVCISMGDHPIPRWGV

SEQ ID NO: 9358 - protein, 296 aa, Xenorhabdus bovienii
  Peptide sequence Name=Xb4151_4152.C441.gene146.pep
  Gene classification: Function=Uncharacterized ACR; Function class=S Function unknown
  Homolog annotation: Query=1..281bp; Hit=1..281bp; Blast score=470; Percent Identity=77.0; E value=1e-133; Homolog= PM1531 COG3384
MGKLALAAKITHVPSMYLSEMPGKHHGCRQGAIDGHKEISRRCHEMGVDTIIVFDTHWLVNSAYHINCAGHFSGIYTSNELPHFIRDMTYEYDGNPELGRMIAEEARQMGVRAQSHEISSLKLEYGTLVPMRYMNSDHHFKVISISAFCTVHAFEDSRKLGEAVLRAIEKYDGTVAVLASGSMSHSFIDDQRAEEGMNSYTREFDEQMDRRVVQLWKEGQFKEFCKMLPEYAQYCRGEGNMHDTVMLLGLLGWDKYDGKVEFLTELFASSGTGQVNAVFPLSDDAVNEQTTEKIRA

SEQ ID NO: 9359 - protein, 129 aa, Xenorhabdus bovienii
  Peptide sequence Name=Xb4151_4152.C441.gene147.pep
  Gene classification: Gene name=HpaF; Function=5-Carboxymethyl-2 -hydroxymuconate isomerase; Function class=E Amino acid transport and metabolism
  Homolog annotation: Query=1..127bp; Hit=1..127bp; Blast score=162; Percent Identity=61.0; E value=6e-41; Homolog= PA4125 COG3232
MPHFYAECTENIRESARLPALFANVNQALAETGIFPLGGIRSRAIWLDTWQMADGEQDYAFVHMTLKIGAGRSLEDRQQVGEMLFTLIKTHFADLMAQRYLGLSFTMEELDPILNYKSNNVHQLFKSKD

SEQ ID NO: 9360 - protein, 494 aa, Xenorhabdus bovienii
  Peptide sequence Name=Xb4151_4152.C441.gene148.pep
  Gene classification: Gene name=PutA; Function=NAD-dependent aldehyde dehydrogenases; Function class=C Energy production and conversion
  Homolog annotation: Query=9..489bp; Hit=8..483bp; Blast score=644; Percent Identity=66.0; E value=0; Homolog= PA0265 COG1012
MTNHLETLLLRQQAYINGQWVDAHNKTTFAVINPANGEVIANVSDMGCAETQQAIEAAQTALPAWRALTAKQRSQKLKQWFHLIMDNQKSLAELLSAEQGKPHAEAMGEIAYGASFIEWFAEEGKRIYGETIPSPMPGRRLATIKQPIGVVAAITPWNFPNAMITRKVGPALAAGCTVVLKPAAETPLSALALAVLAEQAGIPAGVLNIVTGIDAKAIGETLTSSPIVRKLSFTGSTRVGKLLMAQSADTVKKLSLELGGNAPFIVFDDADLDAAVEGAMATKFRNSGQTCVSANRILVQEGVYDAFAERLVHAVKQLRVGPTHSDSSQPVPQQGPLINQAAVEKIQAHISDAVSHGARILAGGKSHTLGGLFFEPTVLADVDDSMRVSHEETFGPLAPLIKFRDEAEAIRLANDTEFGLAAYFYSRDIGRIYRVAEALESGMVGINEGLISNEVVPFGGIKQSGLGREGSRYGIEDYLEVKYLCFGGLGTKGA

SEQ ID NO: 9361 - protein, 270 aa, Xenorhabdus bovienii
  Peptide sequence Name=Xb4151_4152.C441.gene149.pep
  Gene classification: Gene name=MhpD; Function=2-keto-4-pentenoate hydratase/2-oxohepta-3-ene-1,7-dioic acid hydratase (catechol pathway); Function class=Q Secondary metabolites biosynthesis, transport and catabolism
  Homolog annotation: Query=5..270bp; Hit=2..267bp; Blast score=408; Percent Identity=74.0; E value=1e-114; Homolog= PA4127 COG0179
MQQQLQQEVISQVARRLHQAEKNRQQIRQISLDYPEITIEDAYAIQREWVNLKIAEGRVLKGHKIGLTSRAMQVSSQIEEPDYGALLDDMFFQDGSDIPCERFIVPRIEVELAFVLAKPLRGPNCTLFDVYNATDYIIPALELIDARSHNIDPETQRPRKVFDTISDNAANGGVIMGGRPIRPDELDLRWVSALLYRNGVIEESGVAAAVLNHPANGVAWLANKLALHGVQLEAGQIILGGSFTRPVPARKGDTFHVDYGAMGSISCHFV

SEQ ID NO: 9362 - protein, 268 aa, Xenorhabdus bovienii
  Peptide sequence Name=Xb4151_4152.C441.gene150.pep
  Gene classification: Function=2,4-dihydroxyhept-2-ene-1,7-dioic acid aldolase; Function class=G Carbohydrate transport and metabolism
  Homolog annotation: Query=4..253bp; Hit=1..250bp; Blast score=319; Percent Identity=63.0; E value=2e-87; Homolog= PM1535 COG3836
MDLLTNRFKQALKAGHPQIGLWLGLCSGYSAEILAGAGFDWLLIDGEHAPNHIPSILTQLQAIAPYPSQPVVRSPWNDQVLIKQLLDIGAQTLLVPMIQNAEQAREAVRATRYPPAGIRGVGSALARASRWNRIPDYLARANDEICVLVQVETREALRNLPDILTVEGVDGVFIGPADLSADMGYSGNPQHPEVKAAIEQAIRQIAASDKAAGILMTHVETAEHYLNLGALFVAVGVDTTLLTTAANSLAARFGKKQEKITPSSLSTY

SEQ ID NO: 9363 - protein, 65 aa, Xenorhabdus bovienii
  Peptide sequence Name=Xb4151_4152.C441.gene151.pep
VGKPDFLALVWLQVGCSLSLPFLLYDACRVFMETGMKTVTVLADAAIDICHVGKSIVVLSVIRMI

SEQ ID NO: 9364 - protein, 455 aa, Xenorhabdus bovienii
  Peptide sequence Name=Xb4151_4152.C441.gene152.pep
  Gene classification: Gene name=ProP; Function=77 Permeases of the major facilitator superfamily; Function class=G Carbohydrate transport and metabolism
  Homolog annotation: Query=35..419bp; Hit=25..402bp; Blast score=239; Percent Identity=41.0; E value=3e-63; Homolog= PA4126 COG0477
MSSPPEAIQEPENPAYPPQKLTDRQQNVINKLFRRLILFLFVLFVFSFLDRINIGFAGLTMGKDLGLSSTMFGLAATLFYATYVIFGIPSNVMLSVVGARRWIATIMVLWGIASTATMFATGPTSLYILRMLVGIAEAGFLPGILVYLTYWFPAYYRARANALFMIAMPVTMAFGSLASGYILEMDGIWDLRGWQWLFLLEGFPSVLLGFVVWFYLDDSPEKAKWLTREDKQCLQEMMERDKLSQVQSSRPASSKTSLWREVFTPIVLMYTFAYFCLTNTLSAINIWTPQIMQSFNQGSSHVMIGLLTAIPQFCTILGMIYWSRRSDRLQERKMHTALPYLFAAAGWVLTSLTDHSMVQLLGIIMASTGSFTAMAVFWTTPDQSISLRARAIGIAVINATGNVGSAVSPLLIGWLKDQTGSFNSGLYFVAGLLIIGALMVSFIPMKQTQRSGDNY

SEQ ID NO: 9365 - protein, 298 aa, Xenorhabdus bovienii
  Peptide sequence Name=Xb4151_4152.C441.gene153.pep
  Gene classification: Gene name=AraC; Function=AraC-type DNA-binding domain-containing proteins; Function class=K Transcription
  Homolog annotation: Query=11..296bp; Hit=7..295bp; Blast score=230; Percent Identity=43.0; E value=2e-60; Homolog= PA4120 COG2207
MPASNTRKVIITNIDISKDYDETQGSDDVHYQTFGRMAAFFGRDMQAHRHDGFFQLHYLVTGRIELQLDELRYSVQAPLFILTPPSVPHAFFTQEDTDGYVLTVRQALITPLLNSLYPTHRELVDIPAICLSVADKPDELATFNHYWALIGRESANQFAGREQSLAFLAQSLFTFLLRSIPLDDHRSGGVRGELKLFQRFNQLIEQHYHQHLAVPEYAEKLGITESRLKDMCRRFANRPPKKLIFDRLLREAKRLLLFSDSPVFEIAYQLGFKDPAYFTRFFNRLMGCAPSVWRERSV

SEQ ID NO: 9366 - protein, 161 aa, Xenorhabdus bovienii
  Peptide sequence Name=Xb4151_4152.C441.gene154.pep
  Gene classification: Function=Putative transposase; Function class=L DNA replication, recombination and repair
  Homolog annotation: Query=3..139bp; Hit=23..170bp; Blast score=172; Percent Identity=61.0; E value=2e-43; Homolog= XF2303 COG3316
MSLIRKAFKRLHYPVDIILSLRNLEEMMTERGIRVDHSPLYRWVIRLTPLLGKAFRRHKRPVARGWCMGETYIKIKGQWKYLYRAVIPPVNLLIFLLTANRDTAAALRFFRKALRHYGEPDIITLDKSGDNTAAIALLNTHNLKIRYCHRQRCFIDWLNKE

SEQ ID NO: 9367 - protein, 72 aa, Xenorhabdus bovienii
  Peptide sequence Name=Xb4151_4152.C441.gene155.pep
MNITDSGIHMVCRLKDGFNEEDIITHCRQLNLGAQPLSRYCIHSFSDNAILFGYAAHIPTEINENIKRLANF

SEQ ID NO: 9368 - protein, 256 aa, Xenorhabdus bovienii
  Peptide sequence Name=Xb4151_4152.C441.gene156.pep
  Gene classification: Gene name=HtpX; Function=Zn-dependent protease with chaperone function; Function class=O Posttranslational modification, protein turnover, chaperones
  Homolog annotation: Query=7..254bp; Hit=43..291bp; Blast score=312; Percent Identity=63.0; E value=2e-85; Homolog= yggG COG0501
MAKGNIMKIKTLVAVAVSAVILTGCKNIDHGMLASSGMQLFQAATLSDSDVKQFSDQACKDMDARNKTAPASSQYTKRLNKIAKALGSEVNGTPVNYKVYLTDDVNAWAMANGCVRVYSGLMKMMNDNEVEGVLGHEMGHVALGHSRKAMQIAYATVAARTAATSAGGVAAQLSDSQFAALGEKLINSQFSQHQESQADDFSYDLLKKRNINTGGLASGFEKLAKLGSGKSSMFDSHPPSQERAQHIRDRITADKK

SEQ ID NO: 9369 - protein, 34 aa, Xenorhabdus bovienii
  Peptide sequence Name=Xb4151_4152.C441.gene157.pep
MLKGASSAIRRIKVFFVLEPKTGAITFRLIRSSA

SEQ ID NO: 9370 - protein, 437 aa, Xenorhabdus bovienii
  Peptide sequence Name=Xb4151_4152.C441.gene158.pep
  Gene classification: Function=Na+-dependent transporters of the SNF family; Function class=R General function prediction only
  Homolog annotation: Query=4..434bp; Hit=8..444bp; Blast score=274; Percent Identity=41.0; E value=2e-73; Homolog= BS_yhdH COG0733
MSQQWTSRLGHVLAATGSAVGIGAIWKFSYVSATNGGGAFLVVFLLFSFVIGLAILLAENILGSSTGEVAIDAFKKLLGKHWGWVGFIGIFSSWCIYSFYSVVGGWTIGYTVMASTGKLNITDISQLTSIFTGFISNPWWPIITHLTFSGLTCFVVLSGVQKGLEKSVKVMMPLLFLIMIVLIIVGIRLPGSSEGLKLFLYPDFSSLTGKGVLDALGLAFFSLSIGLGIHITYSSYLPNNKGIGKSSIWVVILSCLVCILAGLMIFPALSAAGLKPNAGPGLTFMTMPIYFANLPGGSILAVTFFLLLLMAALTSSISLLEHIVAYVQTRFQWSRRKASLIVTASIMLMGIPVSLSFGPLSHVTLGGKSIFDILDFITSNVLMPLFGIIICLVFGWSRKVNALIPDNMSSWNRQCLLFIWRYVGPLCIGVILIHGLI

SEQ ID NO: 9371 - protein, 86 aa, Xenorhabdus bovienii
  Peptide sequence Name=Xb4151_4152.C441.gene159.pep
MPQTGCPLLTHANPRIDTVSARVLRPTAVSKKPAAAFETCLPACRPVIGREMIFPAPLNRAKVIKSNAQIFLDDKRYVIIIVNLLL

SEQ ID NO: 9372 - protein, 55 aa, Xenorhabdus bovienii
  Peptide sequence Name=Xb4151_4152.C441.gene160.pep
MISCNRVIILDSSQGVSTCLLELKSLTGGQLLAILAVITTIILYIMRISEYGTYH

SEQ ID NO: 9373 - protein, 92 aa, Xenorhabdus bovienii; identical to SEQ ID NO: 6203
  Peptide sequence Name=Xb4151_4152.C441.gene161.pep

SEQ ID NO: 9374 - protein, 56 aa, Xenorhabdus bovienii; identical to SEQ ID NO: 7384
  Peptide sequence Name=Xb4151_4152.C441.gene162.pep

SEQ ID NO: 9375 - protein, 36 aa, Xenorhabdus bovienii
  Peptide sequence Name=Xb4151_4152.C441.gene163.pep
MYLSLHAQKWISASPLLIIAYSLGTKLSQWNPSLLV

SEQ ID NO: 9376 - protein, 429 aa, Xenorhabdus bovienii
  Peptide sequence Name=Xb4151_4152.C441.gene164.pep
  Gene classification: Gene name=SerS; Function=Seryl-tRNA synthetase; Function class=J Translation, ribosomal structure and biogenesis
  Homolog annotation: Query=1..429bp; Hit=1..430bp; Blast score=707; Percent Identity=81.0; E value=0; Homolog= serS COG0172
MLDPNMLRNELDAVAEKLARRGYTLDVETLCKQEERRKVLQVETETLQAERNSRSKAIGAAKARGEDIEPLRQEVNQLGEKLDLAKAELETLQAEIRELALRMPNIPDDSSPYGKDDSDNQEISRWGEPRQYGFEVKDHVALGELTNGLDFAAAVKLTGSRFVVMKGQIARLHRALAQFMLDLHTEQHGYLETYVPYLVNHETLYGTGQLPKFGEDLFHTNPLEEETGSNYALIPTAEVPVTNLVRGDILDESALPLKMTAHTPCFRSEAGSYGRDTRGLIRMHQFDKIELVQIAHPEKSMDALEELTGHAEKVLQLLKLPYRKMLLCTGDMGASARKTYDLEVWLPAQNTYREISSCSNMWDFQARRMQARFRSKDDKKTQLVHTLNGSGLAVGRTLVAVMENYQQADGRIEIPEVLRPYMKGLEFIG

SEQ ID NO: 9377 - protein, 428 aa, Xenorhabdus bovienii
  Peptide sequence Name=Xb4151_4152.C441.gene165.pep
  Gene classification: Function=Uncharacterized ATPase related to the helicase subunit of the Holliday junction resolvase; Function class =L DNA replication, recombination and repair
  Homolog annotation: Query=1..428bp; Hit=20..447bp; Blast score=723; Percent Identity=84.0; E value=0; Homolog= ycaJ COG2256
MRPVTLDHYIGQQHLLAEGKPLPRAIRAGHLHSMILWGPPGTGKTTLAEIIGHYAQADIERISAVTSGIKEIRESIEKASQNRNAGRRTILFVDEVHRFNKSQQDAFLPHIEDGTITFIGATTENPSFELNSALLSRARVYLLKSLSAAEIEQVLFQAMNDKERGFGGQNIVLQDDTRQMAAELVAGDARRSLNLLEMMSDMAEANAQGQRVLTPELLKEVSGERSARFDNKGDRYYDLISALHKSIRGSAPDAALYWYARIITAGGDPLYVARRLLAIASEDVGNADPRGMQVAIAAWDCFTRVGAAEGERAIAQAIVYLACAPKSNAVYMAFKAAMVDAQDKPDYDVPEHLRNAPTKLMKEMGFGEAYRYAHDEPNAYAAGEVYFPPEMRETRYYHPTARGLEGKIGDKLNWLTEQDQNSQIKRYR

SEQ ID NO: 9378 - protein, 202 aa, Xenorhabdus bovienii
  Peptide sequence Name=Xb4151_4152.C441.gene166.pep
  Gene classification: Gene name=LolA; Function=Outer membrane lipoprotein-sorting protein; Function class=M Cell envelope biogenesis, outer membrane
  Homolog annotation: Query=1..202bp; Hit=2..203bp; Blast score=275; Percent Identity=66.0; E value=2e-74; Homolog= lolA COG2834
MKKLMLIGCLMMGVSVGTAWADASQDLQGRLGKVNSFHASFIQTVTSSDGSAIQNGEGQLWVKRPNLFNWHMTAPDESVLVSDGKTLWFYNPFVEQVTANWLKDAAGNTPFMLIARNDSADWKQYNVVQNGNNFELTPSNANGNLKHFSITVTPEGTIQKFTAVEQDGQKSAYQLKGQQNTRVDESKFKFTMPEGVTLDDQR

SEQ ID NO: 9379 - protein, 38 aa, Xenorhabdus bovienii
  Peptide sequence Name=Xb4151_4152.C441.gene167.pep
MQYPHSHPSSDNQSTSVFSCARYLQFIFIISVNSRYHI

SEQ ID NO: 9380 - protein, 1111 aa, Xenorhabdus bovienii
  Peptide sequence Name=Xb4151_4152.C441.gene168.pep
  Gene classification: Gene name=FtsK; Function=DNA segregation ATPase FtsK/SpoIIIE and related proteins; Function class=D Cell division and chromosome partitioning
  Homolog annotation: Query=492..1108bp; Hit=347..957bp; Blast score =720; Percent Identity=62.0; E value=0; Homolog= VC1903 COG1674
LNQEYTEDKRVKLKKISSSRRLLEAILLVIAICAVYFMVALVSFNPSDPSWSQTSWNGPVHNFGGSVGAWLSDILFSAFGILAYAVPLFMFLGCWNAFRQKDRQEYVDFFTLALRIIGALALVLTSCGLVALNIDDLNDFAAGGVIGNLFSKAILPWFNILGATLALLGVWAIGFTLFTGWSWLTIAEKIGAVILDSLSFMVNRSRNEPEYGELENEVTPEHLASGQNRADNVNTGDIGTTASAAKAVEVDEDDVLLSAPTMVELVKTDSVPPAMDIAQEVGSPEKVQSVQQNENRPQSIAQKAIALPESVQTESDHAEEDQEPVPYTFELPADYQLDTESEFSKTAQSELSIDSTVATNIQPIESFTFSPNDNLKNVAAGVSSAAVVMKTPQMKQGIGPEMPRPNPVRIPTRRELYGVKVPSQRLSEHLQREEKERQSDLIAETDEQQMDEQQQDTLRQQFLEQQRERYGSNFEEETKGPREEIAQIHKQSATAEFVEHSVDEPSEQEEALRVAFEQQQRERYQKIQPVIPSQAEKPAFDYSSLADGFEKSEPVEPLPLQSESSIHSEQEKRTVSVSGPSHESKIQHTVAQQPQQPQQSSLFHPFLMRNDQPLPKPTTPMPSLDLLTKPPAEEEPVDMFALEQISRLIEARLNDYRVKADVVGFSPGPVITRFELDLAPGVKASRISNLSRDLARSLSAVAVRIVEVIPGKPYVGLELPNKKRHTVYLREVLDCEKFRDNPSPLTIVLGKDIAGQPVVADLGKMPHLLVAGTTGSGKSVGVNAMILSILYKAKPEDVRFIMIDPKMLELSIYEGIPHLLTEVVTDMKDAANALRWCVNEMERRYKLMSALGVRNLAGYNDKIKQAENMGRPIPDPFWKPGDSMDVTHPMLKKEPYIVVMVDEFADLIMTVGKKVEELIARLAQKARAAGIHLVLATQRPSVDIITGLIKANIPTRIAFTVSSKIDSRTILDQGGAESLLGMGDMLYLAPNSSIPVRVHGAFVRDQEVHEVVNDWKARGRPQYIDNIIKGGEDGEGGLGLDSDEELDPLFDQAVQFVTEKRRVSISGVQRQFRIGYNRAARIVEQMEAQQIVSTPGHNGNREVLAPPPHEH

SEQ ID NO: 9381 - protein, 164 aa, Xenorhabdus bovienii
  Peptide sequence Name=Xb4151_4152.C441.gene169.pep
  Gene classification: Gene name=Lrp; Function=Transcriptional regulators; Function class=K Transcription
  Homolog annotation: Query=1..164bp; Hit=1..164bp; Blast score=304; Percent Identity=97.0; E value=3e-83; Homolog= lrp COG1522
MIDNKKRPGKDLDRIDRNILNELQKDGRISNVELSKRVGLSPTPCLERVRRLERQGFISGYTALLNPHYLDASLLVFVEITLNRGAADVFEQFNTAVQKLEEIQECHLVSGDFDYLLKTRVPDMSAYRKLLGETLLRLPGVNDTRTYVVMEEVKQSNRLVIKTR

SEQ ID NO: 9382 - protein, 35 aa, Xenorhabdus bovienii
  Peptide sequence Name=Xb4151_4152.C441.gene170.pep
MRSRSFPGRFLLSIILLLSLYIPTPITFSLSLSSS

SEQ ID NO: 9383 - protein, 31 aa, Xenorhabdus bovienii
  Peptide sequence Name=Xb4151_4152.C441.gene171.pep
MISLLCLAVLMNTSFPLSHIADLGIVGEIIS

SEQ ID NO: 9384 - protein, 319 aa, Xenorhabdus bovienii
  Peptide sequence Name=Xb4151_4152.C441.gene172.pep
  Gene classification: Gene name=TrxB; Function=Thioredoxin reductase; Function class=O Posttranslational modification, protein turnover, chaperones
  Homolog annotation: Query=1..317bp; Hit=1..318bp; Blast score=543; Percent Identity=83.0; E value=1e-154; Homolog= trxB COG0492
MSTAKHSKLIILGSGPAGYTAAVYAARANLNPVLITGVEKGGQLTTTTEVENWPGDPEGLTGPDLMERMFQHAEKFQTEIISDHIQKVDFEKKPFRLYGDDQEYTCDALIIATGASARYLGLPSEDAFKGRGVSACATCDGFFYRKQKVAVVGGGNTAVEEALYLANIAAEVHLIHRRDTFRSEKILIDRLMEKVKNGNIILHTDRTLDEVLGDDMGVTGIRIHDTKSDNAEELDVTGVFIAIGHSPNTGIFEGQLDLQNGYIKVQSGLHGNATQTSIPGVFAAGDVMDHVYRQAITSAGTGCMAALDAERFLDGLATK

SEQ ID NO: 9385 - protein, 57 aa, Xenorhabdus bovienii
  Peptide sequence Name=Xb4151_4152.C441.gene173.pep
MIQCIKKAGDTVCQRPNLMFPVKKRYRNSALRKEGLFSCQSIKKTFSIQCSHTACTC

SEQ ID NO: 9386 - protein, 589 aa, Xenorhabdus bovienii
  Peptide sequence Name=Xb4151_4152.C441.gene174.pep
  Gene classification: Gene name=MdlB; Function=ABC-type multidrug/protein/lipid transport system, ATPase component; Function class=Q Secondary metabolites biosynthesis, transport and catabolism
  Homolog annotation: Query=1..589bp; Hit=1..588bp; Blast score=701; Percent Identity=64.0; E value=0; Homolog= cydD COG1132
MDKTRQSELVRWLRQQSAPARRWLRLSMLLGLISGLLIISQAWLLASILQALIMDNIPRENLIVQFLMLIAAFTLRAIVSAIRERIGFICGKVVRQQIRSMVLDKLAQLGPVWVKGKPAGSWATIILEQIEDMQDFYSRYLPQMALATIIPLLILMTVFPVNWAAGLILLVTAPLIPLFMTLVGLGAADANRRNFVALSRLSGNFLDRLRGLETLRVFHRGEAEVKQLTESTDNFRHRTMEVLRMAFLSSAVLEFFAAVSIAVVAVYFGFSYLGELHFGSYGLGVTLFAGFLALILAPEFFQPLRDLGTFYHAKAQAVGAAESLFTLLSSEGEHSVFNGERMLPDTKSVTIEANELEIRSHDGHRLAGPLSFTIDQHQRIALVGKSGAGKSSLINLLLGFLPYRGSLKINGIELRELNLTKWREQLSWVGQNPHLPEQTLLDNIRLGQFDATQDQINDVMEQAYVSEFIYALPDGVNTVIGDNAARLSVGQAQRIAVARALLNPCQLLLLDEPAASLDAHSEQRVMMALNQASSQQTTLLVTHLLEETLEYDQIWVMENGLIIEKGHYQSLSQSQGAFSRLLSHRSVEL

SEQ ID NO: 9387 - protein, 580 aa, Xenorhabdus bovienii
  Peptide sequence Name=Xb4151_4152.C441.gene175.pep
  Gene classification: Gene name=MdlB; Function=ABC-type multidrug/protein/lipid transport system, ATPase component; Function class=Q Secondary metabolites biosynthesis, transport and catabolism
  Homolog annotation: Query=1..572bp; Hit=1..571bp; Blast score=700; Percent Identity=65.0; E value=0; Homolog= ZcydC COG1132
MRILLPFLALYRRHWFLISLGMVLAIVTLLASIGLLTLSGWFLAGTALAGFAGLYTFNYMLPAAGVRGAAIFRTAGRYGERLVSHDATFRVLAHLRVFAFQKILPLSPGGIARFRQGELLNRIVADVETLDHLYLRVISPVLSALVVIVVLTFGLSFLDVTLAYTLGGIMLGLLIILPFGFYHAGKPYGRDITLLRGQYRTLLTSALQGQAELTVFGALGRFRQSMTDVESDWLKCQQQQANLTGLSQAVMIFATGITVTLLLWLAAAGVGEHSQPGALIALFAFCALAAFEALGPVTVAFQHMGQVISSATRVSQLMHQEPEVTFPAHGPQTTDSLNLEIKNIDFTYPEQPLPVLKNISLSLASGEHIALLGKTGCGKSTLLQLLSRAWNVDHGEIQLNQQPISQYDETTLRSMMSIVPQRIHVFSHTLRENLLLAKPDASDDELVIVLKQVGLGNLLDNNEKLNCWMGEGGRQLSGGEQRRLGIARALLHNAPLMLLDEPTEGLDADTEQQILSLLRHSCQHKTLIVVTHRLTGLQHLDRICVMDEGRIIEQGKHDVLLAQQGRYYQFYQRQSYPEQE

SEQ ID NO: 9388 - protein, 229 aa, Xenorhabdus bovienii
  Peptide sequence Name=Xb4151_4152.C441.gene176.pep
  Gene classification: Gene name=Aat; Function=Leu/Phe-tRNA-protein transferase; Function class=O Posttranslational modification, protein turnover, chaperones
  Homolog annotation: Query=1..227bp; Hit=1..229bp; Blast score=262; Percent Identity=57.0; E value=2e-70; Homolog= Zaat COG2360
MTIAQLGNSYAFPHPTHALAEPNGLLAFGGDLCAERLRVAYHEGIFPWFSPDELPLWWSPDPRAVLIPGELHTGRTLRRFIRKLPYQITVNYAFDQVIYGCAQRQEGTWIGSDVQKGYQALHQEGLAHSIEVWHDCQLVGGLYGINVGTLFCGESMFSKMENASKCAFVAFYHHFLHHGGQLLDCQVLNHHTKSLGAKNIPRKEFLQHLYLCREQSLQAGCWAAQMLDL

SEQ ID NO: 9389 - protein, 42 aa, Xenorhabdus bovienii
  Peptide sequence Name=Xb4151_4152.C441.gene177.pep
MPKNPHYVKECRILNHHFPHNGYRHSRREQHKSLDFDYKSSI

SEQ ID NO: 9390 - protein, 72 aa, Xenorhabdus bovienii
  Peptide sequence Name=Xb4151_4152.C441.gene178.pep
  Gene classification: Gene name=InfA; Function=Translation initiation factor IF-1; Function class=J Translation, ribosomal structure and biogenesis
  Homolog annotation: Query=1..72bp; Hit=1..72bp; Blast score=132; Percent Identity=98.0; E value=5e-32; Homolog= infA COG0361
MAKEDNIEMQGTVLDTLPNTMFRVELENGHVVTAHISGKMRKNYIRILTGDKVTVELTPYDLSKGRIVFRSR

SEQ ID NO: 9391 - protein, 761 aa, Xenorhabdus bovienii
  Peptide sequence Name=Xb4151_4152.C441.gene179.pep
  Gene classification: Gene name=ClpA; Function=ATPases with chaperone activity, ATP-binding subunit; Function class=O Posttranslational modification, protein turnover, chaperones
  Homolog annotation: Query=1..750bp; Hit=1..751bp; Blast score=1229; Percent Identity=83.0; E value=0; Homolog= clpA COG0542
MLNQELELSLNIAFAKARDNRHEFMTVEHLLLALLSNTSARGALEACKVDLVMLRQELENFIAQTTPLLSENDDRDTQPTLSFQRVLQRAVFHVQSSGRSEVSGSNVLVAIFSEQESQAAYLLRKHDVSRLDIVNFISHGTRKDESDNESHHSVNPIQEEQVINEDRLENFTTNLNQLAQKGQIDPLVGRQHELERTVQVLCRRRKNNPLFVGESGVGKTAIAEGLAWRIVQKDVPEVIKDCTIYSLDIGSLLAGTKYRGDFEKRFKSLLKTLEQDSKSILFIDEIHTIIGAGAASGGQVDAANLIKPLLSSGRIRVIGSTTYHEFSNIFEKDRALARRFQKIDILEPSSEETVQIINGLRTKYEAHHDVRYTAKAIRAAVELSVKYITDRHLPDKAIDVIDEAGARTRLVPASRRKKTINVADIESVVARIARIPEKTVSASDKDVLRTLDDRLKMLVFGQDKAIGVLTEAIKMSRAGLGQEHKPVGSFLFAGPTGVGKTEVTLQLAKMLNIKLLRFDMSEYMERHTVSRLIGAPPGYVGYDQGGLLTDAIIKHPHSVLLLDEIEKAHPDVFNLLLQVMDNGTLTDNNGRKADFRNVILVMTTNAGVREIQRKSIGFTEQDNSIDGMEEIKRIFTPEFRNRLDGIIWFDALSAEVIQLVVDKFIVELQAQLDEKGVSLEVSADARQWLCDKGYDRAMGARPMTRVIQDNLKKPLANELLFGSLIHGGSVRINLDKDKRALIYDFKSAQKSSKKKSEDAVL

SEQ ID NO: 9392 - protein, 106 aa, Xenorhabdus bovienii
  Peptide sequence Name=Xb4151_4152.C441.gene180.pep
  Gene classification: Function=Uncharacterized ACR; Function class=S Function unknown
  Homolog annotation: Query=8..105bp; Hit=8..105bp; Blast score=152; Percent Identity=75.0; E value=7e-38; Homolog= yljA COG2127
MSEFYNSLKIEELIEDKTEQTLQPPSMYKVILNNDDYTPMEFVVDVLRKFFSYDVERATQLMLDIHYQGKAICGIYTAEVAETKAAQVNMYAKEHEHPLLCSLEKV

SEQ ID NO: 9393 - protein, 63 aa, Xenorhabdus bovienii
  Peptide sequence Name=Xb4151_4152.C441.gene181.pep
MKHSAYPLFDLWIKNPPKNRISLSISNFRYLRQLEVISVLDGVMNFTTVYFMSTALAGHLLIS

SEQ ID NO: 9394 - protein, 76 aa, Xenorhabdus bovienii
  Peptide sequence Name=Xb4151_4152.C441.gene182.pep
  Gene classification: Gene name=CspC; Function=Cold shock proteins; Function class=K Transcription
  Homolog annotation: Query=1..68bp; Hit=1..68bp; Blast score=127; Percent Identity=85.0; E value=3e-30; Homolog= cspD COG1278
METGTVKWFNNAKGFGFICPASGGDDIFAHYSTIQMDGYRTLKAGQKVNFSIHQGPKGNHASLIVPLEDDSKSKKE

SEQ ID NO: 9395 - protein, 302 aa, Xenorhabdus bovienii
  Peptide sequence Name=Xb4151_4152.C441.gene183.pep
  Gene classification: Function=Uncharacterized membrane protein; Function class=S Function unknown
  Homolog annotation: Query=1..299bp; Hit=17..314bp; Blast score=277; Percent Identity=59.0; E value=1e-74; Homolog= ybjE COG2431
MYSGLLIVLIPLILGYLIRLNNKTALATVHYLLNIIIYVILFLMGVRLAMLENLGNNLLSILLYAMTFFLCIFATNLLALILLDKRDPWIIQVNKQEKSPSQLHMVFDSIKLCGALISGFLLGLTNWSLLNFADHASEIALILLLLLVGIQLRNNGMSLKQTLLNRRGTIIALVVAISSLLGGIIAAFLLGLPTKTGLAIASGYGWYSLSGILLSNAYGSVIGSTAFFNDLARELASILLIPMLINRYRSTALGLTGAASIDFTLPILQRCGGISIVPAAIVHGFILSLMTPVFIAFFTQQA

SEQ ID NO: 9396 - protein, 53 aa, Xenorhabdus bovienii
  Peptide sequence Name=Xb4151_4152.C441.gene184.pep
MIITILCRYYCIVILMRLISLQPINYSYLSHEHSIKKHKLFLWNASGPVRYQF

SEQ ID NO: 9397 - protein, 242 aa, Xenorhabdus bovienii
  Peptide sequence Name=Xb4151_4152.C441.gene185.pep
  Gene classification: Gene name=GlnQ; Function=ABC-type polar amino acid transport system, ATPase component; Function class=E Amino acid transport and metabolism
  Homolog annotation: Query=1..242bp; Hit=1..242bp; Blast score=365; Percent Identity=73.0; E value=1e-101; Homolog= artP COG1126
MSIQLKNINCFYGTHQALFDINFECTSGETVVLLGPSGAGKSSLLRVLNLLEMPRSGQLSVATHQFDFKQQPGAKEIRTLRQKVGMVFQQYNLWPHLTVMDNLIEAPCRVLGLPRQQAREKAAKLLARLRLDEFSNRFPQHLSGGQQQRVAIARALMMEPQILLFDEPTAALDPEITSQVINIIKELAGTGITQIIVTHEVELARKAATHIVYMEKGHIIEKGDASHFLKPKTEAFAHYLSH

SEQ ID NO: 9398 - protein, 247 aa, Xenorhabdus bovienii
  Peptide sequence Name=Xb4151_4152.C441.gene186.pep
  Gene classification: Gene name=ArtI; Function=ABC-type amino acid transport system, periplasmic component; Function class=E Amino acid transport and metabolism
  Homolog annotation: Query=1..247bp; Hit=1..243bp; Blast score=338; Percent Identity=69.0; E value=4e-93; Homolog= artI COG0834
MKKLLFAALLTAMTLSTSATAAEKETLRFATEATYPPFEFIDANNKIQGFDVDLANAICAKINTECTFTNQAFDSLIPSLKFRRFDALMAGIDITPDRRKQVDFTHTYYDNSAVFIAIKGKFTHSADLKSKQVGIQNGTTHQKYLMEQHKEIKTVPYDSYQNAILDLKNGRIDAVFGDTAVANEWLKKNKELGSVGDKVTDKDYFGIGLGIAVRKGNTALLDKLNKALAEVKQDGTYNSIYKKWFEQ

SEQ ID NO: 9399 - protein, 258 aa, Xenorhabdus bovienii
  Peptide sequence Name=Xb4151_4152.C441.gene187.pep
  Gene classification: Gene name=ArtM; Function=ABC-type amino acid transport system, permease component; Function class=E Amino acid transport and metabolism
  Homolog annotation: Query=19..256bp; Hit=1..238bp; Blast score=329; Percent Identity=76.0; E value=2e-90; Homolog= ZartQ COG0765
MVLITPSIKNGLNNNRILMSELQSLINAAGITIGLAVSSLVIGLILAMLFAAWESAGWKPFAFLGSCWVTLIRGLPEILVVLFIYFGSSQLLITLSEGFDVNLIVWQFRIQMEIDNFDVSPFLCGVIALSLLYSAYASQTLRGALKAVPMGQREAGQALGLSQSRIFFRLTMPQMWRHALPGLGNQWLVLLKDTALVSLISVNDLMLQTKSIATRTQEPFTWYVIAAMIYLVITLVSQFILKRLEMRAIHFERSASDV

SEQ ID NO: 9400 - protein, 222 aa, Xenorhabdus bovienii
  Peptide sequence Name=Xb4151_4152.C441.gene188.pep
  Gene classification: Gene name=ArtM; Function=ABC-type amino acid transport system, permease component; Function class=E Amino acid transport and metabolism
  Homolog annotation: Query=1..222bp; Hit=1..222bp; Blast score=282; Percent Identity=70.0; E value=2e-76; Homolog= artM COG0765
MFEYIKDILPGLQTSLSLTVTALLAAFILSVVLTFILTMRLPILSQLVKGYITLFTGTPLLVQFFLIYYGPGQFPSIKEYPWLWQLMSEPWLCAMVTLALNSAAYSTQLFYGAVRAIPTGQWQSCQALGMSKTHSMRILLPYAFKRALSSYSNEVVLIFKSTSLASTITLLDIMGYSQLQFGRSYDVTVFVAAGVIYLCVNALLTLLMRIIERRALSFEQRH

SEQ ID NO: 9401 - protein, 377 aa, Xenorhabdus bovienii
  Peptide sequence Name=Xb4151_4152.C441.gene189.pep
  Gene classification: Gene name=TrmA; Function=SAM-dependent methyltransferases related to tRNA (uracil-5-)-methyltransferase; Function class=J Translation, ribosomal structure and biogenesis
  Homolog annotation: Query=1..373bp; Hit=1..373bp; Blast score=524; Percent Identity=68.0; E value=1e-149; Homolog= ZybjF COG2265
MQCAQYTAGHCHSCQWLNKSYSQQLSDKQQHLQQLLRETSATYWLPPVSSLISGFRNKAKMVVSGSVERPQLGMLHRDGRTVDLCDCPLYPQYFQLVFESIKIFIAKAGLVPYNVARKKGELKYILLTESRASGEMMLRFVLRSETKLAQLEHALPWLQEQLPQLTVISANIQPTHMAILEGEKEVIFTEHKMLKEIFNGIPLYIRPRSFFQTNPEIASALYATAGRWVRELNISSMWDLFCGAGGFGLHCADKETRLTGIEISAEAIACAKNSAKSLGLEQVEFQALDSTHFALDKAQLPELVLVNPPRRGIGKALCEYLSRMAPKFILYSSCNAETMAKDIAALEQYRIEKVQLFDMFPHTEHYETLALLIFDGK

SEQ ID NO: 9402 - protein, 194 aa, Xenorhabdus bovienii
  Peptide sequence Name=Xb4151_4152.C441.gene190.pep
  Homolog annotation: Query=24..194bp; Hit=1..170bp; Blast score=241; Percent Identity=76.0; E value=5e-63; Homolog= Pa|Phot2-74d05.p1k _g30| 19365 - 19877 1792 170 aa, chain -
LLLLARCFLQIACTTFWSYEVDSMDSMVVPNLVTLRNWLERLKISYFESDSNSVLHLPHMQNIDGLFDAKIDLLGDVVLFSALAEVRPTAIIPLAANLSQINASSLTAKVFLDIQDENLPKLIVCQAFPIAAGMTFPQFSHFLQQSEEQIANVIFEIHSNNFLYINNDMESEMEVEVEDEESLASTETSTFTLH

SEQ ID NO: 9403 - protein, 103 aa, Xenorhabdus bovienii
  Peptide sequence Name=Xb4151_4152.C441.gene191.pep
  Homolog annotation: Query=1..103bp; Hit=1..104bp; Blast score=124; Percent Identity=68.0; E value=2e-28; Homolog= Pa|Phot2-74d05.p1k _g32| 19963 - 20277 1965 104 aa, chain -
MKKISTKEMSSLSDMPKLVILLEVLGIGLLVLAYLSITDSIILSPLLMTTEAHIAMILLGIGCLIPAAIHIIWRAVYNLSFLGIDHKKVDKNHLTGSDDEKTK

SEQ ID NO: 9404 - protein, 87 aa, Xenorhabdus bovienii
  Peptide sequence Name=Xb4151_4152.C441.gene192.pep
  Gene classification: Gene name=GrxC; Function=Glutaredoxin and related proteins; Function class=O Posttranslational modification, protein turnover, chaperones
  Homolog annotation: Query=1..86bp; Hit=6..91bp; Blast score=140; Percent Identity=79.0; E value=2e-34; Homolog= VC1146 COG0695
MYTVIFGRPSCPYCVRAKELAEKLKAERDDFDYRYIDIWAEGITKDDLSKTVGKPVETVPQIFLDEKHIGGFTDFEAYAKEHLNLYK

SEQ ID NO: 9405 - protein, 38 aa, Xenorhabdus bovienii
  Peptide sequence Name=Xb4151_4152.C441.gene193.pep
MWILVNIMSLPLSRRKHRYFWLDSEFYGYLYKFRCSLA

SEQ ID NO: 9406 - protein, 285 aa, Xenorhabdus bovienii
  Peptide sequence Name=Xb4151_4152.C441.gene194.pep
  Gene classification: Gene name=PgpB; Function=Membrane-associated phospholipid phosphatase; Function class=I Lipid metabolism
  Homolog annotation: Query=84..285bp; Hit=1..198bp; Blast score=197; Percent Identity=51.0; E value=9e-51; Homolog= ZybjG COG0671
LVKDYRVFLFVTVLSTVQRASKSPFFAIIGILFTHLASTIVKYHGELKQKSFTESHYKITIFNNDLITLVYHICVNITLVRLTLLEQLNHNVFTFINATPDSSPAMILLAIFVAKYLVFIFPITLAVCWLWGEEKAISHQRIVVSKSCIAFAFAIACSDIIGTFVPHARPFVEGFGYNFLYHAPTASFPSNHGTAVFTFALAFTFWHRIRSGLCLMIIACVIVWARVYVGVHWPIDMIGAFLVSLMGCAFSQIFWRLYGEYWHSKLIRLYQFCCAFFIRKGWIKN

SEQ ID NO: 9407 - protein, 435 aa, Xenorhabdus bovienii
  Peptide sequence Name=Xb4151_4152.C441.gene195.pep
  Gene classification: Gene name=SdaC; Function=Amino acid permeases; Function class=E Amino acid transport and metabolism
  Homolog annotation: Query=1..434bp; Hit=1..427bp; Blast score=552; Percent Identity=74.0; E value=1e-157; Homolog= sdaC COG0814
MDTSQSGSIAASAASGKSDYTTWRKSDTVWMLGLYGTAIGAGVLFLPINAGIGGLIPLIIMTLLALPMTFFAHRGMCRFVLSGKKNGEDITGVVEEHFGKVAGFLITILYFFAIYPILLVYSVALTNTVNSFITHQLHMNAPPRALLALVLILGVMSIIRFGEQFIVKAMSVLVFPFVAVLMLLALYLIPHWNTTIFDTLSLENALSSTSGHGLLFTLWLAIPVMVFSFNHSPIISAFAVAKREEYGEDAEKKCSRILGYAHIMMVITVMFFVFSCVLSLSPENLAEAKAQNITILSYLANHFSAPTIEYIAPLIAFIAITKSFLGHYLGAREGFNGIVNKALSTQGKTIQHNSLNRITSLFMLVSAWIVATLNPSILDIIQSLGGPIIAMILFIMPMYAIHKVPAMRKYAGKPSNVFVVVTGLIAISAAVYSVM

SEQ ID NO: 9408 - protein, 38 aa, Xenorhabdus bovienii
  Peptide sequence Name=Xb4151_4152.C441.gene196.pep
MYSLRINRKMPVNCEVGWHFLWGCCYRKLLLSLDYMTE

SEQ ID NO: 9409 - protein, 401 aa, Xenorhabdus bovienii
  Peptide sequence Name=Xb4151_4152.C441.gene197.pep
  Gene classification: Gene name=DacC; Function=D-alanyl-D-alanine carboxypeptidase; Function class=M Cell envelope biogenesis, outer membrane
  Homolog annotation: Query=9..400bp; Hit=7..399bp; Blast score=537; Percent Identity=65.0; E value=1e-153; Homolog= dacC COG1686
MKKRRQVQIIKSFTVGLGIFWLMGVNTYAMDEPAAPEIDAKSYILMDYASGKILASHNPDERLDPASLTKVMTSYVVGQSIKSGKISTEDQVTVGKDAWATGNPALKGSSLMFLKPGDRVKVIDLNRGIVIQSGNDASIALADYVAGSQDAFVDLMNKYSKTLGLENTHFKTVHGLDAAGQYSTARDMALLSQAMIRDVPEEYALNKEKEFTFNNIRQPNRNRLLWNQNMNVDGVKTGHTSGAGYNLVASAAEGSMRLISVVLGAPSDRMRFSDSEKILSWGFRFYEASTPLKASDTLVTERVWFGTRSEVALGVEKDTAVTVPRGQANNLKASFTLTQTSLEAPLAKNQVVGTVNFSLNDKVIDQRPLVVKEAVEESGFFGRIWDLIVKTVSGWFNSIFG

SEQ ID NO: 9410 - protein, 207 aa, Xenorhabdus bovienii
  Peptide sequence Name=Xb4151_4152.C441.gene198.pep
  Gene classification: Gene name=Gst; Function=Glutathione-S -transferases; Function class=O Posttranslational modification, protein turnover, chaperones
  Homolog annotation: Query=2..207bp; Hit=1..206bp; Blast score=212; Percent Identity=47.0; E value=2e-55; Homolog= PA2813 COG0625
MMLTIWGRKSSSNVKKVTWCLEELNVPYQQIDVGGKFGKLNTPEYLLMNPNAVIPCLQEDDFILWESNTIVRYISAKFGENSLYPANLQERAKIDQWMDWVGCNFFPPIKQLMINIVRTPEDQRDPKVIAQILKEIEKLLKIVDDMLGKQKYLSGDKFGMADIALAPLVYPWLNIEIERPSLPNLERWYQLLTERPAFQKIVMIEIS

SEQ ID NO: 9411 - protein, 277 aa, Xenorhabdus bovienii
  Peptide sequence Name=Xb4151_4152.C441.gene199.pep
  Gene classification: Gene name=WcaG; Function=Nucleoside-diphosphate -sugar epimerases; Function class=M Cell envelope biogenesis, outer membrane
  Homolog annotation: Query=2..276bp; Hit=1..273bp; Blast score=306; Percent Identity=59.0; E value=1e-83; Homolog= yeeZ COG0451
MVKKVSIIGLGWLGMPLAQILQGYGMQVVGSKTTADGVEAARMCGIGCHLLNLTPQIICEADDLEQLMSVDVLVLTLPVSGIAGGGEGYVKAVQLIVDTALSHSVPHIIFTSSTSVYGSSVGHLNEDAPLFPETRSAKALVELENWLHRLPNTSVDIVRLAGLVGSGRHAGRFLAGRKAIEGGEKVVNLVHQDDVISAIKRLIEQQKGGHIYNLCAPEHPKREKFYLQASRQLDLTPPEFLQSEVQGTAGKVVDGSRICRELGFEYQFPDPGRMPMS

SEQ ID NO: 9412 - protein, 96 aa, Xenorhabdus bovienii
  Peptide sequence Name=Xb4151_4152.C441.gene200.pep
MGIFSANAIRRCCCKLILMPQRASSARESSLRRPDFCMAIRKRVLSSMLCFTLSQYSIYKSYKLAIKKTLGKSSEGFFIVLMPPEDLLNVFQHTTA

SEQ ID NO: 9413 - protein, 299 aa, Xenorhabdus bovienii
  Peptide sequence Name=Xb4151_4152.C441.gene201.pep
  Gene classification: Gene name=HisG; Function=ATP phosphoribosyltransferase (histidine biosynthesis); Function class=E Amino acid transport and metabolism
  Homolog annotation: Query=1..299bp; Hit=1..299bp; Blast score=496; Percent Identity=87.0; E value=1e-141; Homolog= hisG COG0040
MLDKTRLRIAMQKSGRLSDDSRALLARCGIKINLQQQRLIAFAENMPIDILRVRDDDIPGLVMDGVVDLGIIGENVLEEEQLNRRAQGEDPRYNTLRRLDFGDCRLSLAAPFDYDYTGVECLQNSRIATSYPHLLKRYLDKKGVPFKSCLLNGSVEVAPRAGLADAICDLVSTGATLEANGLREVEVIYRSKACLIQRDGEMPEAKQQLIDKLMIRIQGVIQARESKYIMLHAPSDKLEEIIALLPGAERPTILPLAGAQNRLAMHMVSSETLFWETMEKLKSLGASSILVLPIEKMME

SEQ ID NO: 9414 - protein, 438 aa, Xenorhabdus bovienii
  Peptide sequence Name=Xb4151_4152.C441.gene202.pep
  Gene classification: Gene name=HisD; Function=Histidinol dehydrogenase; Function class=E Amino acid transport and metabolism
  Homolog annotation: Query=3..432bp; Hit=1..430bp; Blast score=583; Percent Identity=71.0; E value=1e-167; Homolog= hisD COG0141
MSINFKTVIRWQECPPEQQKALLTRPAVVASENISRTVKQILETVKANGDEALQEFSQRFDKTTIDTIPLSTSEVNAAASRLTPEIKQAMQQAMNNIRLFHEAQKPAVIEVETLPGVRCQQVTRPIDSVGLYIPGGSAPLPSTVLMLGIPAGIAECRNVILCSPPPIADEILYAAQLCGINEIFQVGGAQAIAAMAFGTESVPKVDKIFGPGNAWVTEAKRQVSQRFDGAAIDMPAGPSEVLVIADSGANPAFTAADLLSQAEHGPDSQVVLVTPDEIFAEQVIREIETQLTALPRQQIAIQALQSSRIIVTDNLTQCVAISNQYGPEHLIIQTRQPEQLVEKITSAGSVFLGDWSPESAGDYASGTNHVLPTYGYTSTYSSLGLADFLKRMTVQQITPQGLRSLAPIIETLAQAEQLTAHKNAVTLRIAALNNSDVE

SEQ ID NO: 9415 - protein, 369 aa, Xenorhabdus bovienii
  Peptide sequence Name=Xb4151_4152.C441.gene203.pep
  Gene classification: Gene name=HisC; Function=Histidinol-phosphate aminotransferase/Tyrosine aminotransferase; Function class=E Amino acid transport and metabolism
  Homolog annotation: Query=2..355bp; Hit=1..353bp; Blast score=473; Percent Identity=63.0; E value=1e-133; Homolog= hisC COG0079
MMSTVFNVNSLARENVRKLVPYMSARRLGGKGDIWLNANEYPIAPDFQFSEKTLNRYPECQPASVIQRYADYAGLQPNQVLVSRGADESIELLIRVFCEPGKDAVLFCPPTYGMYSVSAETFGVEQKKIPTRADWQPDITAIENNLDRVKLIYICSPNNPTGNLIAPAALRQILELARNRAIVAIDEAYIEFCPQHTTTRWLRDYPHLVILRTLSKAFALAGLRCGFTLASPDIIALMLKVIAPYPLAIPVADIAAQALTGAGIHIMKDRVEEVVKNRTYLQQTLNELAMVEKVFPSEANYLLVKFTDAEIVFRALWEQGIILRDQRKQAGLNNCLRITIGSRNECKQLVNAIAALGSQTQPLKEAENP

SEQ ID NO: 9416 - protein, 355 aa, Xenorhabdus bovienii
  Peptide sequence Name=Xb4151_4152.C441.gene204.pep
  Gene classification: Gene name=HisB; Function=Imidazoleglycerol -phosphate dehydratase; Function class=E Amino acid transport and metabolism
  Homolog annotation: Query=151..355bp; Hit=3..207bp; Blast score=355; Percent Identity=83.0; E value=4e-98; Homolog= hisB_2 COG0131
MSQKLLFIDRDGTLITEPPTDYQVDRLDKLAFEAGVIPALLSLQKAGYKLVMITNQDGLGTDSFPQTDFEPPHALMMQIFTSQGIQFEEVMICPHKPEDNCNCRKPKLGLVEKYLTEGMVDMKNSYVIGDRETDLQLAENMGIKGILYQAQSLGWSTICEQLTHKDRHASVERKTRETGINIDIWLDREGRSEINTGVGFFDHMLDQIATHGGFRMNIQVKGDLCIDDHHTVEDTGLALGEALKQALGDKRGIARFGFTLPMDECLARCALDISGRPHLEYKAEFKHQRVGDLSTEMIEHFFRSLSYTMGCTLHLKTKGKNDHHRAESLFKVFGRTLRQAIRIEGDVLPSSKGVL

SEQ ID NO: 9417 - protein, 202 aa, Xenorhabdus bovienii
  Peptide sequence Name=Xb4151_4152.C441.gene205.pep
  Gene classification: Gene name=HisH; Function=Glutamine amidotransferase; Function class=E Amino acid transport and metabolism
  Homolog annotation: Query=2..202bp; Hit=1..196bp; Blast score=267; Percent Identity=67.0; E value=6e-72; Homolog= hisH COG0118
MMEVVILDTGCANLASVTYAIRRLGYDPIVSLDADIVRSADKLFLPGVGTAMAAMDQLQQRQLIPLIISLTQPVLGICLGMQLLAAISEESNSETNDNVSLLALIDAPVKKMATAGLPLPHMGWNQVKAQAGHPLFCHIEDNAHFYFVHSYALPVGEYTIAQTEYGNSFSSAIAKDNFFGVQFHPERSGTAGSQLLKNFLEM

SEQ ID NO: 9418 - protein, 245 aa, Xenorhabdus bovienii
  Peptide sequence Name=Xb4151_4152.C441.gene206.pep
  Gene classification: Gene name=HisA; Function=Phosphoribosylformimino- 5-aminoimidazole carboxamide ribonucleotide (ProFAR) isomerase; Function class=E Amino acid transport and metabolism
  Homolog annotation: Query=1..245bp; Hit=2..246bp; Blast score=357; Percent Identity=69.0; E value=9e-99; Homolog= ZhisA COG0106
MIIAALDLIDGNVVRLHQGDYNQQRTYGNSPLSYLQQYEKEGAKLLHLVDLTGAKDPTKRQMILLRELLAGVSVPVQVGGGIRSENDIKSLLEAGASRVVIGSTAITQPELVKQWFQRYGAESIVLALDIRISTDGAKQIAISGWQENSNTTLEQIVEQYLPVGLKHVLCTDISRDGTLNGSNIALYQEISQHYPQIQFQASGGIGNLADISLLPTTGVAGVIVGRALLEGKFTLTEAIQCWQNA

SEQ ID NO: 9419 - protein, 258 aa, Xenorhabdus bovienii
  Peptide sequence Name=Xb4151_4152.C441.gene207.pep
  Gene classification: Gene name=HisF; Function=Imidazoleglycerol -phosphate synthase; Function class=E Amino acid transport and metabolism
  Homolog annotation: Query=1..258bp; Hit=1..258bp; Blast score=444; Percent Identity=82.0; E value=1e-125; Homolog= hisF COG0107
MLAKRIIPCLDVRDGQVVKGVQFRNHEIIGDIVPLAQRYAQEGADELVFYDITASSDGRVVDKSWVAKVAEVIDIPFCVAGGIKTTEEAGQILSFGADKISINSPALADPSLISRLADRYGVQCVVIGIDTWFDENSNSYRVYQFTGDEKRTTATQWQTRDWVREVQQRGAGEIVLNMMNQDGVRNGYDLTQLKLVRDICSVPLVASGGAGTPEHFLDAFKLANVDGALAASVFHKQIINIGELKQYLATQGVEVRTC

SEQ ID NO: 9420 - protein, 206 aa, Xenorhabdus bovienii
  Peptide sequence Name=Xb4151_4152.C441.gene208.pep
  Gene classification: Gene name=HisI; Function=Phosphoribosyl-AMP cyclohydrolase; Function class=E Amino acid transport and metabolism
  Homolog annotation: Query=1..112bp; Hit=1..112bp; Blast score=181; Percent Identity=73.0; E value=5e-46; Homolog= ZhisI_1 COG0139
MLTAQQIEKLDWKKVDNLMPVIVQHAVSGVVLMMGYMNKEALNATLDSGKVTFFSRTKQRLWTKGESSGHFLNLVDIYPDCDNDTLLALVNPIGSTCHTGTESCFAPAQTEWGFLYQLEQLLASRKNAPPASSYTARLYASGTKRIAQKVGEEGIETALAATVNDREELTSEAADLIYHLLVLLQDQDLDLSCIIRQLQKRHTAKE

SEQ ID NO: 9421 - protein, 47 aa, Xenorhabdus bovienii
  Peptide sequence Name=Xb4151_4152.C441.gene209.pep
LENAIWFAKETGTTVLIEATSNQVNQPGCVRSLNIAGRNTVAKCLST

SEQ ID NO: 9422 - protein, 48 aa, Xenorhabdus bovienii
  Peptide sequence Name=Xb4151_4152.C441.gene210.pep
LEIQRNRYYNLSIAINPARQVAFTLSVRHTSEYWKMPSGLPKRQEPPY

SEQ ID NO: 9423 - protein, 57 aa, Xenorhabdus bovienii
  Peptide sequence Name=Xb4151_4152.C441.gene211.pep
MLVVLPTRFRHHTKRLWLFLKRQCNSMNIAIYMAIFKKEITFSNTELDPLLEDAQFF

SEQ ID NO: 9424 - protein, 383 aa, Xenorhabdus bovienii
  Peptide sequence Name=Xb4151_4152.C441.gene212.pep
  Gene classification: Gene name=EutG; Function=Alcohol dehydrogenase IV; Function class=C Energy production and conversion
  Homolog annotation: Query=1..383bp; Hit=1..383bp; Blast score=537; Percent Identity=73.0; E value=1e-153; Homolog= ZyiaY COG1454
MAVSTFFIPPVNKIGMGCMTEAIELMKNYGYRQALIVTDRVLNEIGVVGEVQNLLAEAGIKSAIYDGTNPNPTTINVEEGLTILRQHDCDCIISLGGGSPHDCAKGIALVAANGGDIRDYEGVDRSVKPQLPLIAINTTAGTASEMTRFCIITDVDRHIKMAIVDKNVTPILSVNDSALMAGMPEGLTAATGMDALTHAIEAYVSTAANPITDACALKAVTMISDYLRRAVANGNDMEARENMAYAQFLAGMAFNNASLGYVHAMAHQLGGFYDLPHGVCNAVLLPHVQKFNAKVSASRLKEIAAVMGADIANLNDRQGAEACIQEISKLAKDVNIPAGLSELSVKIEDLPMLASNALKDACGFTNPIQASHEEIVAIFKAAM

SEQ ID NO: 9425 - protein, 40 aa, Xenorhabdus bovienii
  Peptide sequence Name=Xb4151_4152.C441.gene213.pep
MHPIPILFTGGIKKVDTAIRNSLGFTEVFQILMQKRWVTM

SEQ ID NO: 9426 - protein, 52 aa, Xenorhabdus bovienii
  Peptide sequence Name=Xb4151_4152.C441.gene214.pep
MLIRSYGDYYMNNISTLIIVVFLIISFVLIVSLDPEVAHFIEKFAERLIQKS

SEQ ID NO: 9427 - protein, 468 aa, Xenorhabdus bovienii
  Peptide sequence Name=Xb4151_4152.C441.gene215.pep
  Gene classification: Gene name=Gnd; Function=6-phosphogluconate dehydrogenase, family 1; Function class=G Carbohydrate transport and metabolism
  Homolog annotation: Query=1..468bp; Hit=1..468bp; Blast score=816; Percent Identity=86.0; E value=0; Homolog= gnd COG0362
MSKQQIGVVGMAVMGRNLALNIESRGYSVSIFNRSSDKTDEVIAENPGKKLVPSYSIEEFVGSLEKPRRILLMVKAGEATDKTIASLTPHLDKGDILIDGGNTYFQDTIRRNRELSAQGFNFIGTGVSGGEEGALKGPSIMPGGQKEAYELVAPILKEIAAKVDGEPCVTYIGADGAGHYVKMVHNGIEYGDMQLIAEAYSLLKHSLNLSNQELADVFSDWNQGELSSYLIEITADIFRKKDEEGQYLVDVILDEAANKGTGKWTSQSSLDLGVPVTLITESVFARYISSLKDQRVAASKVLSGPEAQPFNGDKAEFIEKVRRALYLGKIVSYAQGFQQLKASSDDYNWDLNYGEIAKIFRAGCIIRAQFLQKITNAYNENAAIANLLLAPYFKQVADEYQQALRDVVSYGVQNGIPTPTFSAAISYYDSYRSAVLPANLIQAQRDYFGAHTYKRTDKEGVFHTEWLD

SEQ ID NO: 9428 - protein, 38 aa, Xenorhabdus bovienii
  Peptide sequence Name=Xb4151_4152.C441.gene216.pep
MPNSTLCQSNNVIYNKITVGNLLMRSHVNSGIGFRGSY

SEQ ID NO: 9429 - protein, 526 aa, Xenorhabdus bovienii
  Peptide sequence Name=Xb4151_4152.C441.gene217.pep
  Gene classification: Function=Hemolysins and related proteins containing CBS domains; Function class=N Cell motility and secretion
  Homolog annotation: Query=233..525bp; Hit=2..293bp; Blast score=345; Percent Identity=59.0; E value=8e-95; Homolog= yegH_2 COG1253
MEWIADPTIWAGLATLIVLEIVLGIDNLIFIAILADKLPEKQRDKARLTGLTCALVMRLLLLFSLSWLISLTTPLLTLWNHPFSARDLIMLIGGIFLLFKATMELNERLEGKMLHNNQQRKGANFWAVVVQIIVLDAVFSLDSVITAVGMVNHIGTMMAAVIIAMILMIWASKPLTKFVNAHPTIVILCLSFLLMIGFSLVAEGFGYVIPKGYLYAAIGFSIMIEALNQFSQFNRRRFLSASRSLRERTAEAVLHILNGKRENADLDNHASNLIADHEDHKAVFEPQERHMIARVLSMAQRTVSSIMTSRHDVVYLDIHAPTGKLTTLLEKQPHTRIVVTDEQASDEPLGVVHVIDILNQQLTHKSFDLRKLVQQPLIFPESLSLLQALEQFRQAQTHFAFVVDEFGSVEGVVTVTDVMETITGNLPAGGGEIDARHDIQVTEEGYWIANGFMPLDDLVLYVPLLLDGKREYQTLAGLLMEDLQRVPQQGEQLQIGEYLFEPLEVISHRINKVKITSLKTEEKIEA

SEQ ID NO: 9430 - protein, 86 aa, Xenorhabdus bovienii
  Peptide sequence Name=Xb4151_4152.C441.gene218.pep
MQNILYSYKTLILSTINRRIANPATGNFVKKFPGNMKAVVTSPPMSKSSNLLINTGEHILCVNFLSWSVVSVKTTYHDTHPPVISV

SEQ ID NO: 9431 - protein, 1075 aa, Xenorhabdus bovienii
  Peptide sequence Name=Xb4151_4152.C441.gene219.pep
  Homolog annotation: Query=4..213bp; Hit=2..213bp; Blast score=205; Percent Identity=54.0; E value=5e-51; Homolog= gi|37524053|ref|NP _927397.1| hypothetical protein [Photorhabdus luminescens subsp. laumondii TTO1] gi|36783476|emb|CAE12316.1|
MSTKYFALLTHAGTSKLENAATSGTKLEITHMAVGDGGGSLPIPNVTQSKLINEKHRAEIDVLTIDPKKPNLIIAEQVLPEGQGDWWIREIGLFDKDGTLVAVGNCADLYKPQLQEQTVSMALPVSNSDWTGWVNELFSGLATRNYVREKIKDHAESRNHPDATLKEKGLVTLSNAVDSDNETHAATSKAVRTTHALAETANKNATSAIQSADSKVPLTRKVNGKELLTDIELTALDVNAYNRAETDELIGIVKKQTDTANQNATAALQSADSKVPLTRKVNNKELLTDIDLNAADVGTYNKSEIDAHINKVEQLADTANKNATSAIQNADNKVPLTRKVNGKELLTDIELNATDIGTYNKVEINEHISKVEKLAETANQNATTAIQNADSKVPLTRKVNGKELSADIQLNAADIGAYTKVETDDHINNVKTQVGNVNKLAETANHNATTAIQSADNKVPLTRKVNDKELSADIKLSAADVNAYSQKETDDRISDVKTQVGNVNKLAETANHNATTAIQSADNKVPLTRKVNDKELSADIKLSAADVNAYSQKETDDRISDVKTQVGNVNKLAETANHNATTAIQSADNKVPLTRKVNDKELSADIKLDAADVGAYNKVETDTHINNVKVLAETANQNATTATQNADSKVPLIRKVNGKELLTDIELSAADIGTYNRTEIDDRINKVDKLAETANQNATSAIQSAGSKVPLIRKVNGKELSTDIQLIADDVGAYNKKETDDRINIVDKLADTANKNAISAIQNVDSKVPLNRKVNGRELSTDIELTATDIDVYNKADVNILFEDAKELANNANNNADNKVPLTRTVNGKSLLTDIKLQASDLNVYSKGEVDSRIDDVKELANSANNNADSRVPLTRTVNGKALLSDIKLIASDVSAYTKAETDLRISKVEDLAKSANNNASGRLEKGQNGADIPDKKAFVKNLGLSDLIGLGIESRRVGTDVTIIKLGDIIKINGLAVASEPIGEVNSFVIGGVTYYTHYYKIQLPISLPNGIISCHASIVGSNFDNQQPGYLADVKTQRNNPNGVGVSKDTLTISVTTPQVGWVPHFDYQVIGY

SEQ ID NO: 9432 - protein, 619 aa, Xenorhabdus bovienii
  Peptide sequence Name=Xb4151_4152.C441.gene220.pep
  Gene classification: Gene name=AsmA; Function=Uncharacterized protein involved in outer membrane biogenesis; Function class=M Cell envelope biogenesis, outer membrane
  Homolog annotation: Query=1..619bp; Hit=1..616bp; Blast score=468; Percent Identity=39.0; E value=1e-131; Homolog= ZasmA COG2982
MKRLLTTLVILLVVIVAGLAALVVLINPNDFRSYIVEQVQKKSGYHLVLQDDLRWHIWPKLSILTGQISLTASDAEIPAVVAENMRLDVELLPLLSHQFVVKEVMLKGAVLRFMPDSQPQKQAEAPIAPKSDIQYPVAGGQGWKLDIARIKVADSLLVWQTDTDSQLNIRDINFLMERKDQDHVNLEFSSKINKNQQELAFEFNTSVDISDYPQRLAADVSSLKYQLKGVGVPSEGIKGTGSVSLAYQSSPSSISLQKLALTVNESELNGNIAVKLQNKPQYTINLSSPKLNLDNLLGWDALPQNDLQARHDYRIENSLLKPVIATSVSPLSNYDLSLLKAFEANLSFVADKVIYQGMDIDNFVLKAVNDDGMAEILKLSGDVFGGHFALPTTIDATVNPAKLHTKPLLQNIELKPLLTALALPPVFSGQLELDGDLLGEGYDEYAITHYWQGDLNIGLENARLEGLNIPQLIQQSFSRATDQVNQPESTDDFTEAKNMSVRAQLNQGELKVDNLSAISGMLNITGQGKANLLKQNTDMSLWVQLTGGWGKQNEFVRNLQKLKVPLRVYGNWDNLQYKLDVEALLSDELQKKAKQSIRNWIEQNSRAEDRKEFENLLNK

SEQ ID NO: 9433 - protein, 193 aa, Xenorhabdus bovienii
  Peptide sequence Name=Xb4151_4152.C441.gene221.pep
  Gene classification: Gene name=Dcd; Function=Deoxycytidine deaminase; Function class=F Nucleotide transport and metabolism
  Homolog annotation: Query=1..193bp; Hit=1..193bp; Blast score=334; Percent Identity=85.0; E value=4e-92; Homolog= dcd COG0717
MRLCDRDIIKWIDEGKLVITPRPPVERINGATADVCLGNQFRVFRGHTAAYIDLSGPKAEVNAALDRVMSDEIVLPEGEVFFLHPGELALAVTLESVTLPDNLVGWLDGRSSLARLGLMVHVTAHRIDPGWHGQIVLEFYNSGKLPLALRPGMVIGALSFEPLSGSADRPYNRRQDAKYKNQQGAVGSRISED

SEQ ID NO: 9434 - protein, 213 aa, Xenorhabdus bovienii
  Peptide sequence Name=Xb4151_4152.C441.gene222.pep
  Gene classification: Gene name=Udk; Function=Uridine kinase; Function class=F Nucleotide transport and metabolism
  Homolog annotation: Query=1..213bp; Hit=19..231bp; Blast score=345; Percent Identity=78.0; E value=2e-95; Homolog= udk COG0572
MADEAHKCTIVGIAGASASGKSLIASTLYRELRAQVGDHNIGVIPEDCYYKDQTNTPLEERYKVNYDHPSSMDHSLLFEHIQALKAGKSIELPQYDYVAHTRKTESIHFEPKRVIILEGILLLTDKRLRQEMDFSIFVDTPLDICLMRRIKRDVNERGRTLDSVIEQYKKTVRPMFLQFIEPSKQYADIIVPRGGKNRVAIDILKAKIGQFYE

SEQ ID NO: 9435 - protein, 61 aa, Xenorhabdus bovienii
  Peptide sequence Name=Xb4151_4152.C441.gene223.pep
VTLPPISLLRCTGRERKFLRKFLSAQFELSNFVSIRDGTLLISNSHCDFVGIVAIWSVIGS

SEQ ID NO: 9436 - protein, 370 aa, Xenorhabdus bovienii
  Peptide sequence Name=Xb4151_4152.C441.gene224.pep
  Gene classification: Gene name=Mrp; Function=ATPases involved in chromosome partitioning; Function class=D Cell division and chromosome partitioning
  Homolog annotation: Query=1..370bp; Hit=11..379bp; Blast score=564; Percent Identity=74.0; E value=1e-161; Homolog= mrp COG0489
MNSQSPEQTSPDLLKEHVVKILATFKHPTLERDLIALKALHHCAMLDGVLHIELMMPFVWKRAFAKLKEETTQSLQTATGAKSVDWRLTYDICTLRRANNLPGVNGVRNILAVSSGKGGVGKSSTAVNLALALAQEGAKVGILDADIYGPSVPNMLGTAQERPTSPDGQHMAPIMVHGMATNSIGYLVTDDNAMVWRGPMASKALMQMLQDTLWPDLDYLVIDMPPGTGDIQLTLSQNIPVTGALVITTPQDIALIDAIKGIAMFQKVNVPVLGIIENMSIHICSNCGHQEPIFGTGGAEKLAEKYHCQLLGQIPLHISLREDLDRGEPTVISQPDSELADIYRDIAANISAQMYWQGEKIPTEISFRAV

SEQ ID NO: 9437 - protein, 43 aa, Xenorhabdus bovienii
  Peptide sequence Name=Xb4151_4152.C441.gene225.pep
LRYPSDNALDQVTSKTLFNIWKSDPNHVSSREQIIGDLCVTLC

SEQ ID NO: 9438 - protein, 675 aa, Xenorhabdus bovienii
  Peptide sequence Name=Xb4151_4152.C441.gene226.pep
  Gene classification: Gene name=MetG; Function=Methionyl-tRNA synthetase; Function class=J Translation, ribosomal structure and biogenesis
  Homolog annotation: Query=1..565bp; Hit=1..567bp; Blast score=989; Percent Identity=80.0; E value=0; Homolog= ZmetG_1 COG0143
MSQVANKLLVTCALPYANGPIHLGHILEHIQADIWVRYHRMRGKEVHFICADDAHGTPIMLKAQQSGISPEEMIAKVSLEHQQDFAGFAISYDNYHSTHSEENKELASQIYLKLKKNGYIKSRKISQLYDPEKGMFLPDRFVKGACPKCKAEDQYGDNCEVCGTTYSPTELINPRSAVSGATPEMRDTEHFFFDLPVFSDMLQKWTRSGSLQEQVANKMQEWFDAGLQQWDITRDAPYFGFEIPDEPGKFFYVWLDAPIGYMGSFQNLCSKRDDLNFDEFWSKDSEADLYHFIGKDIVYFHSLFWPAMLEGSNYRKPTNLFVHGYITVNGTKMSKSRGTFIKAETYLKHLDADCLRYYYAAKLSSRIDDIDLNLEDFVQRVNSDIVNKVVNLASRNAGFINKRFAGKLADQLADPALYQQFVDAAEGIAEDFTHREFSKAIREIMALADLANRYVDEQAPWVVAKQEGRDADLQAICSMGINLFRVLMTYLKPVLPSLTDRTEAFLNTELTWDGIRQPLLNHEVSPFKALFNRIEMAKVDAMVADSKESIEPQKTLTGPLADDPIQDTIAFDDFAKVDLRIALIKQADFVEGSDKLLKLTLDLGSETRQVFSGIRSAYPDPKALENRLTVMVANLAPRKMRFGISEGMVMAAGPGGKEIFLLSPDSGAQPGMQVK

SEQ ID NO: 9439 - protein, 147 aa, Xenorhabdus bovienii
  Peptide sequence Name=Xb4151_4152.C441.gene227.pep
  Gene classification: Function=Putative effector of murein hydrolase LrgA; Function class=R General function prediction only
  Homolog annotation: Query=7..133bp; Hit=5..131bp; Blast score=126; Percent Identity=55.0; E value=7e-30; Homolog= yohJ COG1380
MSFRNMLVIGWQYLRAFVLLYLCLIAGNITSALLPFSLPGSIIGLLLLFCLLAFQLIPAYWVKPGCSLLMKNMTLLFLPIGVGVMDYYPQLSQQMFPIVLSCIVSTVIVMIVVAYSSHYVHCKRIITGAQRKEPDLTSPPSQQSDKR

SEQ ID NO: 9440 - protein, 231 aa, Xenorhabdus bovienii
  Peptide sequence Name=Xb4151_4152.C441.gene228.pep
  Gene classification: Gene name=LrgB; Function=Putative effector of murein hydrolase; Function class=M Cell envelope biogenesis, outer membrane
  Homolog annotation: Query=1..231bp; Hit=1..231bp; Blast score=297; Percent Identity=73.0; E value=7e-81; Homolog= yohK COG1346
MLSHIWWSLPLTLLVFYCAKKLSRQLKLPIFNPLLLSMAVIIPLLLMTHTPYEHYFIGSRILNDLLQPAVVALAFPLYEQLHQIRAQWKSIISICFIGSIVAMVTGTAIALWAGASPEIAASVLPKSVTTPIAMAVADSVGGIPAISAACVITVGILGAIFGHNLFNILGIKTSASRGLAMGTASHAVGTARCAELDHIEGAYSSLALMTCGIITSLIAPFLFPVLLHLFG

SEQ ID NO: 9441 - protein, 294 aa, Xenorhabdus bovienii
  Peptide sequence Name=Xb4151_4152.C441.gene229.pep
  Gene classification: Gene name=Cdd; Function=Cytidine deaminase; Function class=F Nucleotide transport and metabolism
  Homolog annotation: Query=1..290bp; Hit=1..289bp; Blast score=291; Percent Identity=58.0; E value=7e-79; Homolog= cdd COG0295
MQARFHAIWSEITPKLQEALLPYIGNDDFPAMLTAEQVESIRQICGFDDHALALALLPLAAACAITPISHFYVGAIARGESGNLYFGANMEFAGVPLQQTVHAEQSAITHAWLRGEKKLVSITVNYSPCGHCRQFMNELNSGTQLEVCLPNRPRLTLADYLPEAFGPHDLLDAPLLLDTVNHGYQLDTCDELVLAALDAANQSHAPYSQSHAGIALLDEQDQVYTGRYAENAAFNPSLPPLQAALILMNMSGGNCQSIKRAILVEGKNSHLSQSSATESTLTALGCTKIECHRF

SEQ ID NO: 9442 - protein, 565 aa, Xenorhabdus bovienii
  Peptide sequence Name=Xb4151_4152.C441.gene230.pep
  Gene classification: Gene name=SfcA; Function=Malic enzyme; Function class=C Energy production and conversion
  Homolog annotation: Query=5..565bp; Hit=28..588bp; Blast score=845; Percent Identity=72.0; E value=0; Homolog= VC1188 COG0281
MELEHESKRPLYIPYAGPILLEFPLLNKGSAFTEEERSNFNLHGLLPQIVETIEEQAERAYRQFCDFKSDGDKHIYLRNIQDTNETLFYRLLDAHLSEIMPIIYTPTVGEACEHFSDIYRRARGLFISYPNKASIDDMLQNATKQNVKVIVVTDGERILGLGDQGIGGMGIPIGKLSLYTSCGGISPAYTLPVVLDVGTNNPQRLNDPLYMGWRHPRITGKEYDEFVDEFIQAVKRRWPNVLLQFEDFAQTNAMPLLTRYRHDLCCFNDDIQGTAAVALGSLIAASRAAGRQLRDQTVTFLGAGSAGCGIAEQIVAQMKSEGLSDEQARARVFMVDRFGLLTDKQPNLLDFQSVLVQKNSVLQSWDVSNDSISLMDVVRNAKPTVLIGVSGQSGLFTEEIIREMHKHCERPIVMPLSNPTSRVEARPEDIINWTDGKALVATGSPFAPVKYDGQEYPIAQCNNSYIFPGIGLGVIASGARRVTDDMLMVASRALADCSPLAQTGSGPLLPPIDDIQNVSRKIAKEVAKKAQIQGMATVTSEDALEQAIERNFWKPEYRVYKRTSF

SEQ ID NO: 9443 - protein, 239 aa, Xenorhabdus bovienii
  Peptide sequence Name=Xb4151_4152.C441.gene231.pep
  Gene classification: Gene name=SanA; Function=Uncharacterized membrane protein; Function class=S Function unknown
  Homolog annotation: Query=1..236bp; Hit=1..236bp; Blast score=325; Percent Identity=69.0; E value=2e-89; Homolog= sanA COG2949
MWKRLITGLVFIMAVLILTVIMLDRWISWKTAPYIYDDLNQLPEREVGMVLGTSKYYTSGAYNQYYFYRIQGAANAYNSGKVNYLLLSGDNAQLSYNEPITMQKDFIKAGIPASKVIMDFAGFRTLDSIVRTRKVFNANNFTIITQRFHCERALFIAMHMGIDAQCYAVSSPKNMMIIRFREVFARLGALADLYILKREPRFLGPLTPIPSETLIPTGIEGYPAVSPEELQELRKKPRS

SEQ ID NO: 9444 - protein, 383 aa, Xenorhabdus bovienii
  Peptide sequence Name=Xb4151_4152.C441.gene232.pep
  Gene classification: Function=Uncharacterized membrane protein; Function class=R General function prediction only
  Homolog annotation: Query=9..381bp; Hit=45..420bp; Blast score=272; Percent Identity=46.0; E value=4e-73; Homolog= Z3408 COG2311
MEKSEVMGQRIEALDSVRGFAILGILILNIFSFALPYAASMNLFYTDPISFSDVMTWSVLSLLTQGKFLFILTLLFGASLELLWQRGREWNIPRLIILAVIGLLHGILLWDGDILLLYGIVGLLAWHFIHTRHRLFGKGITFYLFGLMMFYLLGLFPVGENSAFWQPTPQDIFHESHWKTQGGLLAIEYRFRQVSGMMIVVIVQYGWQMVGVMLCGAMLLRNGWLKGEFSLSHYRRVALWLLPSGMVIQVIALSIQCLYPFSYFASWTIRHTISELATPLLALAYIALIYGFWPIISHWRVNFWLRQVGRMALTSYLLQTLICTTIFYRWEFFDQFTRLELLVFIPLVWAFNIWFACWWLKRYQQGPIEKLWRGLTRKLAGRV

SEQ ID NO: 9445 - protein, 222 aa, Xenorhabdus bovienii
  Peptide sequence Name=Xb4151_4152.C441.gene233.pep
  Gene classification: Gene name=FolE; Function=GTP cyclohydrolase I; Function class=H Coenzyme metabolism
  Homolog annotation: Query=1..218bp; Hit=1..220bp; Blast score=346; Percent Identity=88.0; E value=1e-95; Homolog= folE COG0302
MSSLSTEAALVHSALVSRGLETPLREQTLKPEVRKVLIQEHMTEIMKLLNLDLSDDSLADTPSRIAKMYVDEIFSGLDYNNFPKITLIENKMKVDEMVTVRDITLTSTCEHHFVTIDGKATVAYIPKDKVIGLSKINRIVQFFAQRPQVQERLTQQILIALQTLLGTNNVAISIDAVHYCVKARGIRDATSTTTTTSLGGLFKSSQNTRQEFLRAVRHLHLS

SEQ ID NO: 9446 - protein, 71 aa, Xenorhabdus bovienii
  Peptide sequence Name=Xb4151_4152.C441.gene234.pep
LTGNRDAYFTQISVNLTPYIQYGFTRHLLTWYPLAWYVFTLYLCTTLSARYQYQCAKFGLLTVDLIAPEDQ

SEQ ID NO: 9447 - protein, 392 aa, Xenorhabdus bovienii
  Peptide sequence Name=Xb4151_4152.C441.gene235.pep
  Gene classification: Gene name=ProP; Function=77 Permeases of the major facilitator superfamily; Function class=G Carbohydrate transport and metabolism
  Homolog annotation: Query=20..385bp; Hit=14..381bp; Blast score=216; Percent Identity=44.0; E value=2e-56; Homolog= PA1412 COG0477
MRNQIITSGRRHYQAFQIALSGFLALVVAMGIGRFTFTPQVPLMIAESQFTLTGAGIVAAFNYLGYLAGSYDAMRAQRFVEYRLWSGLWGAVIITLLSALLDGPILHSIARFFIGWASGWTLVLVAAWVNDELAKLNRPRLSAAVFAGTGMGILISGVLAVGIQSWAMGAAKAWVIYGMLALLCSIYVSRYLPRRGELHRPQTNVQKLILTPEIKRLIWSYSLAGFGYILPATFLSQMATERFPDSLFAQFVWPIFGGASVLGIVLGILLSHVSTTQIRLAITLWLQAIGILIAEVLPGIGGLVIGALLVGGGFMCVVQLALLYGRELAPNHARYMAGLLTTGYALGQLVGPMFSATSTWLTGKLEPALYIAFIGLVVAGLLVFRRNQIHSE

SEQ ID NO: 9448 - protein, 413 aa, Xenorhabdus bovienii
  Peptide sequence Name=Xb4151_4152.C441.gene236.pep
  Gene classification: Gene name=MoeA; Function=Molybdopterin biosynthesis enzyme; Function class=H Coenzyme metabolism
  Homolog annotation: Query=6..409bp; Hit=4..407bp; Blast score=548; Percent Identity=67.0; E value=1e-156; Homolog= ZmoeA COG0303
MDHCHTSGLISLEQALEKLLAQAVALTQTETISLTQSAGRITATDIISPINVPPFDNSAMDGYAVRLADLNGNQALPVAGKAFAGAPFQGEWPAGSCIRIMTGAPIPAGADAVIMQEQAEVTETDIRFSYPIQQGQNIRTIGEDITQNAVVLPKGTKLSTAQLPVIASLGIAKVEVIRRLKVAIFSTGDELQAIGEPLQAGQIYDTNRFAVRLMLEKLDCEVIDLGVIPDNPDALRNAFAEADKQADLVISSGGVSVGEADYTKPVLEEVGKINFWKLAIKPGKPFAFGKLENAWFCGLPGNPVSAVLTFYQLVQPLIVRLSGFTAWQPPMRLNAKAITPLKKSPGRLDFQRGTASINEHGELEVQTTGHQGSHIFSSYSLGNCFIVLERERGHITTGETVQIEFFNHLLKNQ

SEQ ID NO: 9449 - protein, 248 aa, Xenorhabdus bovienii
  Peptide sequence Name=Xb4151_4152.C441.gene237.pep
  Gene classification: Gene name=ThiF; Function=Dinucleotide-utilizing enzymes involved in molybdopterin and thiamine biosynthesis family 2; Function class=H Coenzyme metabolism
  Homolog annotation: Query=4..248bp; Hit=3..247bp; Blast score=364; Percent Identity=71.0; E value=1e-101; Homolog= moeB COG0476
MVIELTDEEILRYNRQIVLRDFDFDGQEKLKSSNVLIVGIGGLGCAASQYLTSAGVGTITLLDFDAVSLSNLQRQILHRDERIGIPKVHSAAQTLREINPHVTLHPIEGLLDDPSLNELIGRHDLILDCTDNVAIREQLNRLCYERKVPLVSGAAIRMEGQLAVFTYQPDEPCYRCLSRLFGENSLTCVEAGVMAPLVGIIGSLQAMEAIKLLTQYGKVSRGKVLLFDAMTLQFREIRLPKDPQCEVC

SEQ ID NO: 9450 - protein, 217 aa, Xenorhabdus bovienii
  Peptide sequence Name=Xb4151_4152.C441.gene238.pep
MQELNDKKSTEADALLSNIAKNIDFLIKKNNIDSQTLSRLTGLGIATINSLRRGVGNPTIATVSSIADVFGVNVGEITDGKLSESNKNEEIISSIPLVRYDELDGYVSGKIITKNLYKLSIQDNHEDSLFAVEFGNNLLFPYFDSNTIAIVSKTEAVCDSDVVLVKIKDAPICFRQVFVGESGIYFSILGIENERKTVLTQNYTIIGVVIRSIRNLK

SEQ ID NO: 9451 - protein, 86 aa, Xenorhabdus bovienii
  Peptide sequence Name=Xb4151_4152.C441.gene239.pep
MREKQKFKIIEERRDLSFIIQNAYSRREINEKELLIEQNIVEKIDPTSLVRIAYMSGLKDGRKISDEISKAEKIKPSKSPNLKVIK

SEQ ID NO: 9452 - protein, 232 aa, Xenorhabdus bovienii
  Peptide sequence Name=Xb4151_4152.C441.gene240.pep
  Homolog annotation: Query=36..223bp; Hit=1..189bp; Blast score=91; Percent Identity=27.0; E value=9e-18; Homolog= gi|10955991|ref|NP _052341.1| unnamed protein product [Coxiella burnetii] gi|580962|emb|CAA53111.1| unnamed protein product [Co
MTQNYPTHSKFKYDSLFISLSVTIMITCDVLVYKTLDFYDFKITFSGILFSFYFLISTIQTEVYGYRQGVKTVWIMVLCQSIFVMVIFVASHMQPENNQISMNFKSLFGEFWRVMVGTWTSVPISYFINGFVISSLKKVFLGRFFFIRYLIASMTTQAALLLSAYPISLSSKYNFNELITIITTTWSYKVVMSIILLPIGIILADKVKKLESADVYDWGISYNPFFFRGNKK

SEQ ID NO: 9453 - protein, 247 aa, Xenorhabdus bovienii
  Peptide sequence Name=Xb4151_4152.C441.gene241.pep
  Gene classification: Gene name=Icc; Function=Predicted phosphohydrolases; Function class=R General function prediction only
  Homolog annotation: Query=1..216bp; Hit=14..226bp; Blast score=83; Percent Identity=27.0; E value=2e-16; Homolog= HI0399 COG1409
MKVVNLTDIHLTRNRDKKLFDVNTYDNFDFVCEEIHRIQNLTEIELIIVSGDIANDGDVEAYRYFLNKMESLKTPYISILGNHDLNKNFEITLAEEKPKYIISSREYNNDNWYITAVDTVVEGEDYGFITQDNLAELERKIITNSNFNIAIFMHHHAMPVGTPIVDSCMLNNAKAILELCEKHRVKFIGSGHAHTPRVWHHNNMTACVSPAVSFQWLSGTNTVKISKGFGFNVIDFSPDLSITSCIY

SEQ ID NO: 9454 - protein, 550 aa, Xenorhabdus bovienii
  Peptide sequence Name=Xb4151_4152.C441.gene242.pep
  Gene classification: Gene name=Uup; Function=ATPase components of ABC transporters with duplicated ATPase domains; Function class=R General function prediction only
  Homolog annotation: Query=20..548bp; Hit=1..529bp; Blast score=919; Percent Identity=84.0; E value=0; Homolog= ybiT COG0488
MRDYRFFPNSLLSTLRAKVVLSTNNITMQFGSKPLFENISAKFGNGNRYGLIGANGAGKSTFMKILGGDLTPTAGNVSLDPNERLGKLRQDQFAFETYTVLDTVIMGHSELWEVKQERDRIYALAEMSEEDGYRVADLEVAYGEMDGYSAEARAGELLLGVGIPVDQHYGLMNAVAPGWKLRVLLAQALFSNPDVLLLDEPTNNLDIDTIRWLEQVLNERNSTMIIISHDRHFLNMVCTHMADLDYGALRLFPGNYDEYMTAATQARERQLADNAKKKAQIADLQSFVSRFSANASKSKQATSRARQIDKIQLEEVKASSRQNPYIRFEQEKKLFRNALELEGVTKSYGNEPLFKNLNLLMEVGEKMAVIGENGIGKTTLLKTLVGEAEPNSGTIKWSENNTIGYYAQDHASDFDCDLTVFEWMSQWKREGDDEQSVRSALGRLLFGQDDIKKKVKVLSGGEQGRMLFGKLMMHKPNILIMDEPTNHLDMESIESLNLALELYQGTLIFVSHDRAFVSSLASRVLEMKSDEVIDFRGTYDEYLRSQGIAE

SEQ ID NO: 9455 - protein, 91 aa, Xenorhabdus bovienii
  Peptide sequence Name=Xb4151_4152.C441.gene243.pep
  Gene classification: Gene name=MviM; Function=Predicted dehydrogenases and related proteins; Function class=R General function prediction only
  Homolog annotation: Query=4..75bp; Hit=5..77bp; Blast score=59; Percent Identity=38.0; E value=5e-10; Homolog= BH3843 COG0673
MQKIRWGIIGCGDVTEVKSGPAFYKLEGSELIAVMRRNANLAKEFAKRHNVPKWYSDAESLVNDPEIDAIYIATPPRHTKNILSWLHKPEK

SEQ ID NO: 9456 - protein, 238 aa, Xenorhabdus bovienii
  Peptide sequence Name=Xb4151_4152.C441.gene244.pep
  Gene classification: Gene name=MviM; Function=Predicted dehydrogenases and related proteins; Function class=R General function prediction only
  Homolog annotation: Query=1..156bp; Hit=99..250bp; Blast score=67; Percent Identity=29.0; E value=1e-11; Homolog= BS_yrbE COG0673
MALTFEECNEMIAACRSQNVPLFVAYYRRALPRFLKIKELIDSGAIGTPRIVNCQLFREMESRYQDPDNLPWFVKPEISGGGLFVDLACHTLDILDFLLGKIVSVKGHANSQAKAYPAEDCVSMSFMFENHIQGVGIWNFVAGDREDKVEIIGTKGKITFATFGDAAISYYDENNQLHQFHFKNPKHIQMPFIQTVIHQLQRNDISSSNGEAAARTSWVIDEVLKEYRTALYIKNKEP

SEQ ID NO: 9457 - protein, 100 aa, Xenorhabdus bovienii
  Peptide sequence Name=Xb4151_4152.C441.gene245.pep
LVAEDDNGDIKGFSIAQEQNTPPFNCLIPRTYGYVFDLIVSQDARSQGIGQRLLAGMKKWTQENNYSHLELTVLSQNFEAIRFYEKEGYNEVNKLMSITP

SEQ ID NO: 9458 - protein, 45 aa, Xenorhabdus bovienii
  Peptide sequence Name=Xb4151_4152.C441.gene246.pep
MIIRSAFIRDIDAILSLYNVLFSEMAELQPDRLKGSEQDRNLIIS

SEQ ID NO: 9459 - protein, 47 aa, Xenorhabdus bovienii
  Peptide sequence Name=Xb4151_4152.C441.gene247.pep
  Gene classification: Function=Predicted Rossmann fold nucleotide -binding protein; Function class=R General function prediction only
  Homolog annotation: Query=1..41bp; Hit=93..133bp; Blast score=62; Percent Identity=63.0; E value=1e-10; Homolog= BH3084 COG1611
MIELAEDFVALPGGFGALEEFSEVFTWSMIGWNNKPCGTFNNFSIKD

SEQ ID NO: 9460 - protein, 296 aa, Xenorhabdus bovienii
  Peptide sequence Name=Xb4151_4152.C441.gene248.pep
  Gene classification: Gene name=RhaT; Function=7 Permeases of the drug/metabolite transporter (DMT) superfamily; Function class=G Carbohydrate transport and metabolism
  Homolog annotation: Query=14..296bp; Hit=12..293bp; Blast score=293; Percent Identity=63.0; E value=2e-79; Homolog= ybiF COG0697
MSFSKHRAASFPLLPIVLLLLSMTSIQAGASLAKTVFHVIGAPGVTALRLALGTIILFLIFKPWRLKFQRESLIPLFAYGISLGAMNYLFYMALSRIPLGIAVALEFTGPLAVAMFSSRRPLDFLWIALVIAGLGFLLPVGDGVSTLDPIGVLYALGAGVFWALYIIFGQRAGAGYGAATVSIGSLIAAMIFFPVGLIQTGPELLFDPSLLPIALGIAILSTAFPYTLEMIALTRLPAKTFGTLMSLEPALGALSGIIFLNEHLTMTQWIALFCIIFASIGSTSTIKRKTKIEKLE

SEQ ID NO: 9461 - protein, 61 aa, Xenorhabdus bovienii
  Peptide sequence Name=Xb4151_4152.C441.gene249.pep
MKGISTINVIETSNMTPGELSTNLISSDEITHYTALREHHYEYSKINQPQHFPPDLYPQQR

SEQ ID NO: 9462 - protein, 169 aa, Xenorhabdus bovienii
  Peptide sequence Name=Xb4151_4152.C441.gene250.pep
  Gene classification: Gene name=Dps; Function=Starvation-inducible DNA- binding protein; Function class=L DNA replication, recombination and repair
  Homolog annotation: Query=1..136bp; Hit=1..136bp; Blast score=180; Percent Identity=65.0; E value=5e-46; Homolog= dps COG0783
MSTAKLINPNTSHLIYTRNNVNKDVKQRSITALNHMVIHFIDLSMMTKQAHWNMRGRNFIAIHEMLDGFRTALTDHLDTFAERAVQLGGTASGTVQEVHSRTLLENYPTGIHDVQDHLKALADRYAVVANDIRRRLLMQKMKIRRICLPQLPVISTNFYGLSKQILSNK

SEQ ID NO: 9463 - protein, 73 aa, Xenorhabdus bovienii
  Peptide sequence Name=Xb4151_4152.C441.gene251.pep
  Gene classification: Gene name=PhnA; Function=Uncharacterized Zn -ribbon-containing protein involved in phosphonate metabolism; Function class=P Inorganic ion transport and metabolism
  Homolog annotation: Query=1..71bp; Hit=1..72bp; Blast score=72; Percent Identity=63.0; E value=9e-14; Homolog= CC3005 COG2824
MDTEVKDSNGALLNDGDTVQVIKDLKVKGTSKTLKRGTLIKNIRLTHREDEVECNSDKIKGLVLKTCFLKKIG

SEQ ID NO: 9464 - protein, 132 aa, Xenorhabdus bovienii
  Peptide sequence Name=Xb4151_4152.C441.gene252.pep
VILSYLVCYITYQQTPNRKIYITIIHLSFTLYIFTLFFYNIIHIENKHLSYLVNFSSKRKFIFINYSLCLLLFTICGLYYIIITQSNTILLFYYSGIYSLISLINLSRSQYTKLITLCVIVLFSCLGGYIYA

SEQ ID NO: 9465 - protein, 71 aa, Xenorhabdus bovienii
  Peptide sequence Name=Xb4151_4152.C441.gene253.pep
MRPVLYYNNPIKYDITFLLFRHLLFNIINKFIKVAIYKIDHLVRYCFIFLFRRIYLCLIPKREVSITYRGQ

SEQ ID NO: 9466 - protein, 711 aa, Xenorhabdus bovienii
  Peptide sequence Name=Xb4151_4152.C441.gene254.pep
  Gene classification: Gene name=DinG; Function=Rad3-related DNA helicases; Function class=L DNA replication, recombination and repair
  Homolog annotation: Query=1..699bp; Hit=1..698bp; Blast score=907; Percent Identity=64.0; E value=0; Homolog= dinG COG1199
MALSSAIKNQISQWYKALSIHIDGFIPREPQRQMIAEVAKTLADEEGRHLVIEAPTGVGKTLSYLIPGIAVSRAEKKPLVVSTANVALQDQIYSKDLPLLRKLIPDLKFTGAFGRARYVCPRNLEAICAAEGEQIDLMLLVEDKTEIANSEERDLCRRLRSDYSTFIWDGLRDHHQLALSDSLWAKVSTDKMNCLARNCQFYHRCPFFLARREIESADVVVANHSLVIAALENESVLPDAKNLLLILDEGHHIPDVARDSLEVEGEITLFQLNGQLDTFVRNVEQYLLQFRPTKPPALANITRLQAHCEKIRECFKELADITQVLLPERREAAEYLFELGKLPENLLLCCQQLFKLTDGVRGLSEAIVNDLTDQTAKQDIVRLHHAILQTSRTLGYFENMVKLWRLASQEESSHAPISKWLTRRYEKNQSHLYFHCAGIRVSEQLTQLLWRKIPHIVVTSATLRSLNSFSRIQELTGLHENYDDRFITLSSPFEHVRQGRIIIPLMTQEPTIQNEMQHLEEMARYFRSQILMGAYRGMLVLFSSQRAMEGFLTFVKELRLMLLVQGDQPRYRLVETHCRRIDEGQPSVLIGLQSFAEGLDLKGDYLSQVHIHKIAFPPVTNPVIITESEWLKSLKRYPFEVQSLPSASFNLIQQVGRLIRSHECYGEVVIYDRRLLNKSYGSRLLNALPVFPIEQPDVPSEDELLQMKKGQ

SEQ ID NO: 9467 - protein, 51 aa, Xenorhabdus bovienii
  Peptide sequence Name=Xb4151_4152.C441.gene255.pep
MKKILLIIIVLFSLGSIGGVFLAGLNMYTRSTTPVEEPQQSQQENAPIGQQ

SEQ ID NO: 9468 - protein, 279 aa, Xenorhabdus bovienii
  Peptide sequence Name=Xb4151_4152.C441.gene256.pep
  Gene classification: Gene name=SseA; Function=Rhodanese-related sulfurtransferases; Function class=P Inorganic ion transport and metabolism
  Homolog annotation: Query=1..278bp; Hit=54..331bp; Blast score=261; Percent Identity=46.0; E value=5e-70; Homolog= ZsseA COG2897
MKNEYFVSPQWLNDHLHDENVVIVDASAPMPTQTIDYHQLWLDNHIPGAQFFNLDKIANLQTNLPHMLPEPEVFRQAVSAMGISENHLVIIYDQGNMFSAPRAWWTFKIFGTRNIRILEGGLQGWQQMGYPTESGEVTRQPQIFNSQFTPEKVCSQEQILDALHHKAPIQFIDARAEDRFQAKVPEPRPGLRMGHIPGSKNVPWTTLIDNGSYKSPDEIAAIFKKQGVDLKQPIMTSCGSGMTAAVLVLGLDMIGHKEVGLYDGSWAEWGADDSLPLEK

SEQ ID NO: 9469 - protein, 82 aa, Xenorhabdus bovienii
  Peptide sequence Name=Xb4151_4152.C441.gene257.pep
  Gene classification: Function=Predicted membrane proteins; Function class=S Function unknown
  Homolog annotation: Query=1..82bp; Hit=1..82bp; Blast score=75; Percent Identity=71.0; E value=1e-14; Homolog= yeaQ COG2261
MGILSWVIFGLIAGIIAKWVMPGDNSSGIIMTVILGIIGAVVGGYISTFFGMGKVDGFNLGSFAIAVVGAIVVLFVYHKISN

SEQ ID NO: 9470 - protein, 313 aa, Xenorhabdus bovienii
  Peptide sequence Name=Xb4151_4152.C441.gene258.pep
  Gene classification: Function=Predicted TIM-barrel enzymes, possibly dehydrogenases, nifR3 family; Function class=R General function prediction only
  Homolog annotation: Query=1..307bp; Hit=1..307bp; Blast score=531; Percent Identity=81.0; E value=1e-151; Homolog= yohI COG0042
MRVLLAPMEGVLDSLVRELLSEVNDYDLCITEFLRVVDSLLPVKSFYRLCPELEHQSRTPSGTPVRVQLLGQYPEWLAENAVRAVELGSWGVDLNCGCPSKTVNGSGGGATLLKDPELIYRGAKAMRDAVPEELPVTVKVRLGWDSGDHQFEIADAVQQAGATELVVHGRTKEDGYKAERIDWQAIGEIRRRLAIPVIANGEIWDWHSAQECMKVTGCDAVMIGRGALNVPNLSRIIKYNEPKMPWNGVLQLLQKYTYLEKRGDTGMYHVARIKQWLGYLRKEYDEADELFMQIRALKTSAAISNIIFSAAEA

SEQ ID NO: 9471 - protein, 459 aa, Xenorhabdus bovienii
  Peptide sequence Name=Xb4151_4152.C441.gene259.pep
  Gene classification: Gene name=SrmB; Function=3 Superfamily II DNA and RNA helicases; Function class=L DNA replication, recombination and repair
  Homolog annotation: Query=1..389bp; Hit=1..389bp; Blast score=627; Percent Identity=83.0; E value=1e-180; Homolog= rhlE COG0513
MNFESLGLKADILRAVEEQGYVEPTPIQQQAIPVVLSGKDLLASAQTGTGKTAGFTLPILQLLSESPAQAKGRRPVRALILTPTRELAAQVGENVCNYSKYLRLRSLVVFGGVSINPQMMKLRGGVDILVATPGRLLDLEHQNAVDLSHVEILILDEADRMLDMGFIHDIRRVLSKLPAKRQNLLFSATFSDDIKSLANKLLRDPVSIEVARRNSASEQIDQAVHFVDKKRKGELLSYMIGNQNWQQVLVFTRTKHGANRLAEQLSQDGVTAAAIHGNKSQGARTRALADFKSGRIRALVATDIAARGLDIDQLPHVVNFELPNVAEDYVHRIGRTGRAEATGQAISLVCVDEHKLLHDIERLLKREIPRIAISGYDPDPSIKAEPILNGSNSRGSQRGNGRQSPSNQGSSKPNRSNQSRSNQGSTKQHSDRPRSKGTPSGQRRQRTSSKTSNVAASGK

SEQ ID NO: 9472 - protein, 39 aa, Xenorhabdus bovienii
  Peptide sequence Name=Xb4151_4152.C441.gene260.pep
MLQTSPFLKPVQEQFYGKKTDAINRKEITQTAMHHKAAL

SEQ ID NO: 9473 - protein, 225 aa, Xenorhabdus bovienii
  Peptide sequence Name=Xb4151_4152.C441.gene261.pep
  Gene classification: Gene name=AcrR; Function=Transcriptional regulator; Function class=K Transcription
  Homolog annotation: Query=8..225bp; Hit=11..225bp; Blast score=192; Percent Identity=48.0; E value=2e-49; Homolog= ybiH COG1309
MAAKTTQTLRGEQAKQQLIESAIEIFGKSGLEGATTRNIAQHAKQNIAAISYYFGSKEGLYLAVAQFIADKLKSEFSPLVEAIDRFFVETSQPYPQAPILAFIHEGMTRYNCLIFETSSINLSRIMSHEQLTPTAAYSVIHEQGLAPVYSRLNKLIANYIGADEHQISTQIHTHALLGEILSFRLAREALLRQTGWDNLGTKEYELINQVLSQHITLLLNGLRQK

SEQ ID NO: 9474 - protein, 330 aa, Xenorhabdus bovienii
  Peptide sequence Name=Xb4151_4152.C441.gene262.pep
  Gene classification: Gene name=AcrA; Function=Membrane-fusion protein; Function class=Q Secondary metabolites biosynthesis, transport and catabolism
  Homolog annotation: Query=4..327bp; Hit=3..327bp; Blast score=326; Percent Identity=57.0; E value=3e-89; Homolog= ybhG COG0845
MNSKKFALFLLAIIIVIGAIVGIDYYQEQNDKELMLYGNVDVRTVNLGFRVAGKLAALQVDEGDTITAGQALGQLDNTPFINALNQAKATRDAAKANLAKTEAGYRTEEIAQVRAETTQKESAFRFADSFLKRQQGLWQRKMISDNDLDNAKTGQHQALAAYQAAKDKLRQFEAGYRKEEIAAAKAQLAQAQAAVAQAELNSQDTQLTSPSAGVILTRAIEPGTMLAAGNTVFTLSLTKPVWIRAYIDEPNLNQAIAGREIQIYTDGRKNQPYHGKIGFVSPTAEFTPKNVETPDLRTDLVYRLRIIVNDPDEGLKQGMPVTLRFTDSNK

SEQ ID NO: 9475 - protein, 578 aa, Xenorhabdus bovienii
  Peptide sequence Name=Xb4151_4152.C441.gene263.pep
  Gene classification: Gene name=CcmA; Function=ABC-type multidrug transport system, ATPase component; Function class=Q Secondary metabolites biosynthesis, transport and catabolism
  Homolog annotation: Query=8..576bp; Hit=11..579bp; Blast score=822; Percent Identity=71.0; E value=0; Homolog= ZybhF COG1131
MTSSAYTIVLNGVEKTFPGLEVPAVSHLNAEIQGGSVTGLVGPDGAGKTTLIRMLAGLLKPDNGNIKIMGLDPIKDSVKVRSELGYMPQKFGLYEDLTVLENLNLYAELRGVLREERKATFQKLLTFTELTHFTGRLAGKLSGGMKQKLGLACTLLGSPKVLLLDEPGVGVDPIARQELWQMVHELASDGMLILWSTSYLDEAELCRDVLLLNRGKLLYRGQPQKLTQNIVGRSFLLDVKQGSRRKILQHALTLPQVTDGVIQGRSVRLILKAGVDQSNLLQQIGLPDAKLFDAEPRFEDAFIDLLGGGPSHRSALAEIMPQIPPNPTETVIEARSLTKKFGDFAATDHVDFQVKRGEIFGLLGPNGAGKSTTFKMMCGLIIPTSGNALVLDMDLKTSSGKARQRLGYMAQKFSLYGNLTVAQNLKFFSGVYGLKGRHQREKMADMVNAFNLEPILHQTTDSLPLGFKQRLALACALMHEPDILFLDEPTSGVDPLTRREFWLHINGMVDKGVTVMVTTHFMDEAEYCDRIGLVFRGKLIAAGTPDELKLLVTTPERPNPSMEETFIDLVVNYDKEQQ

SEQ ID NO: 9476 - protein, 391 aa, Xenorhabdus bovienii
  Peptide sequence Name=Xb4151_4152.C441.gene264.pep
  Gene classification: Function=ABC-type multidrug transport system, permease component; Function class=R General function prediction only
  Homolog annotation: Query=21..391bp; Hit=7..377bp; Blast score=504; Percent Identity=72.0; E value=1e-143; Homolog= ybhS COG0842
MSHPERIRPEYQGAHKAVSFSWRRLKALCIKESKQIIRDPSSALIAVVIPLMLLFIFGYGINLDSGKLRLGILMEQQSEDARELVHAFTGSPYIDATVSDNRQLLINKMQMGGIRGIIVIPVNFDVQLARVGGHAPIQVITDGSEPNTANFVQGYAKGVWQIWLQQRGQNRAVSTTPLIDMQIRYWFNPAAISQHFLIPGAISIIMTVVGAILTSLVVAREWERGTMEALLSTQVTRTELLLAKLLPYQVLGSFVMVLCMVFTVFVLGIPYRGSLWLLALISSLYLATALGMGLLISTVTRNQFNAAMIALNAAFLPAIMLSGFVFEIDSMPAFIQATTYVIPARYFVSSLQTLFLAGNIGTVLITNLLLLIASAIVFIGLTAWKTRRHLD

SEQ ID NO: 9477 - protein, 368 aa, Xenorhabdus bovienii
  Peptide sequence Name=Xb4151_4152.C441.gene265.pep
  Gene classification: Function=ABC-type multidrug transport system, permease component; Function class=R General function prediction only
  Homolog annotation: Query=1..367bp; Hit=1..367bp; Blast score=504; Percent Identity=72.0; E value=1e-143; Homolog= ybhR COG0842
MFYSLYTLVMKELQSLLRNPQTRATLIVPVLFQMTLFPWAATLEVKNATIAIYNEDKGQASIELTQRLAKSKAFPDIILLTSSQEIRPTLDNRKALLLVRFPQNFSANIASQTPTSIQVLLDGRNSNSAQISANYIQQIVMNYQKELLGNSASLNNSDLIIRNWYNANLDYKWFVVPSLVAMITTIGVLIVTALSVAREREQGTLDQLLVAPLATWQIFLGKAIPALVVATTQASIVLLIGTLFYQIPFAGSLLLFYGCTLVYGLSLVGFGLLISAVCSTQQQAFIGVFVFMMPAILLSGYISPVENMPVWLQDITWVNPIRHFTDITKQIYLKGADFSVIWHSLWPLLVITVTTGGIAYRLFRSKIA

SEQ ID NO: 9478 - protein, 236 aa, Xenorhabdus bovienii
  Peptide sequence Name=Xb4151_4152.C441.gene266.pep
  Gene classification: Function=Integral membrane protein, interacts with FtsH; Function class=R General function prediction only
  Homolog annotation: Query=1..236bp; Hit=1..234bp; Blast score=263; Percent Identity=70.0; E value=9e-71; Homolog= ybhL COG0670
MDRYQRSSGSIVQKAGSGVQTYMAQVYGWMTCGLLLTAFVAGYVANSPEILNAIFSSSIVFYGLIIAQLALVFVLSGLVHKMSGALATGLFMLYSMLTGLTLSSIFVVYTSGSIASTFVISAAMFGALSVYGYTTKRSLSGLGSFLFMGLIGIVLASLINIWLKSPALMWAITYIGVLVFAGLTAYDTQKLKEMGAELDVNDKENLRRYSITGALTLYLDFINLFLMLLRILGDRR

SEQ ID NO: 9479 - protein, 152 aa, Xenorhabdus bovienii
  Peptide sequence Name=Xb4151_4152.C441.gene267.pep
  Gene classification: Gene name=MoaE; Function=Molybdopterin converting factor, large subunit; Function class=H Coenzyme metabolism
  Homolog annotation: Query=3..152bp; Hit=1..150bp; Blast score=223; Percent Identity=72.0; E value=7e-59; Homolog= moaE COG0314
MIMENTRMCVQRERFNVGDEYQWLSQCDDDGAVVTFTGKVRNYNLGDSVKALTLEHYPGMTEKMLQVIIDEARQRWPLQRISVIHRIGELYPGEEIVFVGVTSAHRSMAFTAAEFIMDYLKTRAPFWKKESLVEGERWVATRESDQEAAGRW

SEQ ID NO: 9480 - protein, 81 aa, Xenorhabdus bovienii
  Peptide sequence Name=Xb4151_4152.C441.gene268.pep
  Gene classification: Gene name=MoaD; Function=Molybdopterin converting factor, small subunit; Function class=H Coenzyme metabolism
  Homolog annotation: Query=1..81bp; Hit=1..81bp; Blast score=107; Percent Identity=69.0; E value=2e-24; Homolog= ZmoaD COG1977
MIKVLFFAQVRELVGADSLELPHEYLTVADLRHFLIEKGERWALALEEGKLLAAVNQSFVHAEHPLHDGDEVAFFPPVTGG

SEQ ID NO: 9481 - protein, 145 aa, Xenorhabdus bovienii
  Peptide sequence Name=Xb4151_4152.C441.gene269.pep
  Gene classification: Gene name=MoaC; Function=Molybdenum cofactor biosynthesis enzyme; Function class=H Coenzyme metabolism
  Homolog annotation: Query=1..143bp; Hit=15..157bp; Blast score=234; Percent Identity=87.0; E value=3e-62; Homolog= moaC COG0315
MVDISAKTETVREARAEAFVEMQAETLAMIVAGDHHKGDVFATARIAGIQAAKRTWELIPLCHPLLLSKVEVQLEAQAEHNRVRIESCCRLTGKTGVEMEALTAASVAALTIYDMCKAVQKDMVIGPVRLLEKSGGKSGNFKVGS

SEQ ID NO: 9482 - protein, 331 aa, Xenorhabdus bovienii
  Peptide sequence Name=Xb4151_4152.C441.gene270.pep
  Gene classification: Gene name=MoaA; Function=Molybdenum cofactor biosynthesis enzyme; Function class=H Coenzyme metabolism
  Homolog annotation: Query=5..331bp; Hit=1..329bp; Blast score=499; Percent Identity=72.0; E value=1e-141; Homolog= ZmoaA COG2896
LEGVIVEQLVDAFARKFYYLRLSITDVCNFRCTYCLPDGYHPHGHQSFLSLPEIRRVSRAFAELGTEKIRLTGGEPTMRRDFCDIIATVHENPQIKKIAITTNGYRMERDVARWKEAGLTAINVSVDSLDPRQFHAITGQDKFFQIMRGIDAAFDAGFSAVKVNAVLMKNVNDTSLPAFLAWIKHRPIQLRFIELMETGEGSELFRRRHLSGEVIRCHLLQQGWQQQQRARSDGPAQVFSHPDYQGEIGLIMPYEKNFCQSCNRLRVSAIGNLHLCLFGEQGIPLRDLLSDDTLLNDLKLRIQGGLRHKRETHFLHQGDSGITPNLSFIGG

SEQ ID NO: 9483 - protein, 302 aa, Xenorhabdus bovienii
  Peptide sequence Name=Xb4151_4152.C441.gene271.pep
  Gene classification: Function=Uncharacterized ACR; Function class=S Function unknown
  Homolog annotation: Query=1..302bp; Hit=1..302bp; Blast score=425; Percent Identity=74.0; E value=1e-119; Homolog= ybhK COG0391
MRNRTLDDLDRVVALGGGHGLGRVMSSLSSLGARLTGIVTTTDNGGSTGRIRRAEGGIAWGDTRNCLNQLITEPTVASAMFEYRFSGNGELAGHNLGNLMLKALDHLSVRPLEAINLLRSLLKVNAHLIPMSEHAVDLMAVDDQGNRVYGEVNVDQLSCVPQELMLYPHVSTTKEALEAIERADLILIGPGSFFTSLMPLLLLEDLTQSLRRSNASMIYIGNLGKELSNAAAGLSLSDKLEMMESKIGRKMIDAIIVGPCTDISSLSDRIVTQQILEAQDIPYRHDRELLRQAIENTLQKLG

SEQ ID NO: 9484 - protein, 672 aa, Xenorhabdus bovienii
  Peptide sequence Name=Xb4151_4152.C441.gene272.pep
  Gene classification: Gene name=UvrB; Function=Helicase subunit of the DNA excision repair complex; Function class=L DNA replication, recombination and repair
  Homolog annotation: Query=3..672bp; Hit=2..673bp; Blast score=1051; Percent Identity=83.0; E value=0; Homolog= uvrB COG0556
MTNKVFKLHSDFEPGGDQPDAIRKLQEGLEDGLAHQTLLGVTGSGKTFTIANVIANLNRPTMILAPNKTLAAQLYSEMKEFFPENSVEYFVSYYDYYQPEAYVPSSDTFIEKDASVNEHIEQMRLSATKALLERRDVVVVASVSAIYGLGDPDSYLKMMLHLTDGMLIDQRAILHRLAELQYTRNDQAFQRGTFRVRGEVIDIFPAESNEHALRVELFDDEVERLSLFDPLTGQIQYNVPRYTVYPKTHYVTPRERITQAMEDIKVELEQRRKMLLASDKLLEEQRITQRTQFDLEMMNELGYCSGIENYSRYLSGRAEGEPPPTLFDYLAADGLLVVDESHVTIPQIGGMYRGDRSRKETLVDYGFRLPSALDNRPLRFEEFEALAPQTIYVSATPGRYELEKSGNELVEQVVRPTGLIDPEIEVRPVATQVDDLLSEIRIRAEKNERVLVTTLTKRMAEDLTEYLEEHGERVRYLHSDIDTVERVEIIRDLRLGEFDVLVGINLLREGLDMPEVSLVAILDADKEGFLRSERSLIQTIGRAARNLHGKAILYGDRITDSMAKAIGETERRRAKQQAFNEEHGIVPKGLNKKIGDLLKIGQPVSGKGKAKGRGKISPDTDDYRKLSAKELENKIRELEEKMYQYARDLEFEQAANIRDQVQALRVQFIANS

SEQ ID NO: 9485 - protein, 354 aa, Xenorhabdus bovienii
  Peptide sequence Name=Xb4151_4152.C441.gene273.pep
  Gene classification: Gene name=XerC; Function=Integrase; Function class=L DNA replication, recombination and repair
  Homolog annotation: Query=1..328bp; Hit=1..328bp; Blast score=350; Percent Identity=53.0; E value=2e-96; Homolog= ZintT COG0582
MAINKQPNGKWLVELYPNGRNGRRIRKQFTTKGEAIACERHILDETVEKPWLGEKQDKRLLSELIDIWYRAHGITLSDGEHRKKRMFFACKEMDHPFVTEFDNKLFSIYREKRLNGYADKLKPVAPSTVNNELAYFRAMFNELHRLGEWKAGNPLKNIRAFNTGEKEMAFLSNQQIITLLNFCAKSRAKDLLIIVKIALSTGARWSEAAGLTDSQITPYKITFTKTKGKRNRTVPITKELYDEIPKRKGKLFSSCYNAFRTAVKQAGIELPSHQSSHVMRHTFASHFMMSGGNIIVLQRILGHTDIKMTMRYAHFAPDHLNDALIYNPLSQLQNGGKMAAENLNPQYSPALIVS

SEQ ID NO: 9486 - protein, 284 aa, Xenorhabdus bovienii
  Peptide sequence Name=Xb4151_4152.C441.gene274.pep
MLFISGLLLCYLSYRWILLHRKKNKPESSHSLVTDRNSSITDRISAEFKKENNKLNAEESTNNSSTEYTPASSTDSKELKKHTYTMVNDEATIWTGNINNISFSFLNDNEKKQRITGELNRIFLHKKGDFYLSIIDGDGINHIINEQYVETKFLVRSSRYEFVELCREILKLNNSDVFEYANIIRDIAATAKIIKETLPIRTSFTYTYFKNELRVREKYDVLIDQYLENEYGHQWISGLDSNTGKRHIFQKSKIDTMLNSEGHKKHKFDEWLSVIFGIENNGNK

SEQ ID NO: 9487 - protein, 195 aa, Xenorhabdus bovienii
  Peptide sequence Name=Xb4151_4152.C441.gene275.pep
  Homolog annotation: Query=11..189bp; Hit=9..185bp; Blast score=146; Percent Identity=43.0; E value=2e-34; Homolog= gi|9634086|ref|NP _052279.1| CI repressor [Enterobacteria phage 186] gi|6094118|sp|P08707|RPC1_BP186 REPRESSOR PROTEIN CI gi|3
MGTYDFVSCENNAEVLDRIIEAYGFSSKIMLAEHFNMAASSLSGRYKRSIFPADMVIRCMHETGANLEWLAFGTGHPFDHEKVDILKLPNHRLVDGNLKQSGHIMFDKVMLTNGALLPSDPVSIQEDKDYYVIDRKFADVFDGKWLVDIEGKISIRELTRIPIKRVRVTGAGIPFDCDLSDLTVLGRVIKEIKDY

SEQ ID NO: 9488 - protein, 80 aa, Xenorhabdus bovienii
  Peptide sequence Name=Xb4151_4152.C441.gene276.pep
  Homolog annotation: Query=1..70bp; Hit=36..105bp; Blast score=60; Percent Identity=44.0; E value=9e-09; Homolog= gi|141342|sp|P21315|YR7A_ECOLI HYPOTHETICAL 12.2 KD PROTEIN (ORFA) (RETRON EC67) gi|95951|pir||JQ0856 hypothetical 12.2K protei
MRPIISINVTEPYLPLEEFCRRTAMPKNTVRDMVNDGRLPVREKSVDKKRGKVLINMMALTVEALNASNVAAISFNTQYE

SEQ ID NO: 9489 - protein, 194 aa, Xenorhabdus bovienii
  Peptide sequence Name=Xb4151_4152.C441.gene277.pep
  Homolog annotation: Query=26..192bp; Hit=19..183bp; Blast score=168; Percent Identity=49.0; E value=5e-41; Homolog= gi|26246826|ref|NP _752866.1| Hypothetical protein [Escherichia coli CFT073] gi|26107226|gb|AAN79409.1|AE016758_13 Hypothetic
MRVTLLLFHLTRNMSKAFRFWRKKAMFDYRVSKQSYFDNACRAFSNAHSGDLVQIAESIGMTPQILRNKLNPEQPHMLTCVDLMKLTDATEDASILDGLLEQLQCQPSVPVNEVCDANMPSYLLGATAEVGKLASEAVSGEHLNQTRVAEFKKTVNNAVRLLTLAGVTMSSRLYSNPAFNTTVDVVAGMGATLV

SEQ ID NO: 9490 - protein, 44 aa, Xenorhabdus bovienii
  Peptide sequence Name=Xb4151_4152.C441.gene278.pep
MNALKQQQYQYKLTGESFKANKGDGFIFPIVLCAFAYFILFLIR

SEQ ID NO: 9491 - protein, 117 aa, Xenorhabdus bovienii
  Peptide sequence Name=Xb4151_4152.C441.gene279.pep
  Homolog annotation: Query=16..117bp; Hit=11..113bp; Blast score=77; Percent Identity=39.0; E value=6e-14; Homolog= gi|16766045|ref|NP _461660.1| Fels-2 prophage: similar to E. coli retron Ec67 [Salmonella typhimurium LT2] gi|16421279|gb|AAL2
MNTEYQFESTEQRAFPMSFEMRANGLNQLAQIRAQHLKSGNEQLATFIDEMRDKRNEHYADNIRMLGAMFYLAHIPKERHKLKLNQFTSEERINLIKAVNLIKAASAVLPEGLSLPN

SEQ ID NO: 9492 - protein, 85 aa, Xenorhabdus bovienii
  Peptide sequence Name=Xb4151_4152.C441.gene280.pep
MENKNLIIGYDPAQGRDVSVCVSIEQLIKDVRMEERKHCADLYSARLVKLSARVLKNKMVHSDSAALLQSESENIDRQAQEWNYV

SEQ ID NO: 9493 - protein, 105 aa, Xenorhabdus bovienii
  Peptide sequence Name=Xb4151_4152.C441.gene281.pep
MDLFEISTDERSFTRLLNHGNEYISVLDDTLNFTVGTVLIIREEILKGYEPPKFTGRKLTAKIVSVIRSFGCVQNMYPSPPFVYVYELNVLPMSFFYQTEYSDDK

SEQ ID NO: 9494 - protein, 102 aa, Xenorhabdus bovienii
  Peptide sequence Name=Xb4151_4152.C441.gene282.pep
MTNKSISELEKKRTHSLIISGVHFNFMAVVDGDRKTAFVKDDRDYKSGDFLALNEIDNDGNFTGSLMAARITDVAAIDKNLYPQIAGEFVFLSFELVSVNYL

SEQ ID NO: 9495 - protein, 740 aa, Xenorhabdus bovienii
  Peptide sequence Name=Xb4151_4152.C441.gene283.pep
  Homolog annotation: Query=64..627bp; Hit=55..622bp; Blast score=478; Percent Identity=44.0; E value=1e-133; Homolog= gi|93578|pir||S10632 replication initiation gene A protein [similarity] - phage 186
MNIAVKEEHNSDALLSMCRQQFQPEMPQIATLAERVMWEVNPADYTWCHQYFGHLPDSLAVYFVNRYANIFKQSGRDGRRRANKFLRQFSKNVLPRFNLVSEQYQFQSLAVGAEPFPFIEQLDRLPTLGRKEIRLLAHGVARYMTDSYEHFVNHSATPDNEQEARQRLIYIYTQLAKLTQQIGTAAPYSQQFTKGRVSPTEDQLCASLLRMMSDQWWYARLKRLRDIRAEHMAMAVGQVQKAASSYVSRQTLHEWTEQKRRNWEYLQEFELENEEGERVSLSDKVLGSIANPAVRRCELMIRMRGFEDLANEMGCVGDFYTITAPSKYHSAHSGGGFVKNWNGASPRDTQKYLCGVWAKIRAAYSRAGISVFGFRVVEPHHDGTPHWHLLLFMQPEHVEDMREIVRQYATQEDAHELNSEAARNARFLVKPIDPEKGSATGYIAKYISKNIDGYALDGEVDNETGGNLKDMSRSVSAWASRWRIRQFQQIGGAPVSVWRELRRLRGDKQILPDEDMDNVRFAADVGNWSAYTEFQGGALVSRKNLTVRLSYEVTEQGSIYGEDVQRISGIYSPRLGESSSFITRTVKWKIVPKSSAAPAGDGFGVSSNSGGSAASWSSVNNCTEARSTVSNGSDLCLDEFHQNWSQMSEKEKIQRVYESAKLNDIEMSDGLALGLLRGNSMTVEGQYYRLSMFGHLCPAKPPHTERAKIILKRLNETGRVKININAIIRDPKGYYLNALE

SEQ ID NO: 9496 - protein, 67 aa, Xenorhabdus bovienii
  Peptide sequence Name=Xb4151_4152.C441.gene284.pep
MSDSLNKFVLLERIELISKIGGGDSFNDKDRQVALYWVGELAEQVKQMIIEKPLKSGSTELCGASLQ

SEQ ID NO: 9497 - protein, 106 aa, Xenorhabdus bovienii
  Peptide sequence Name=Xb4151_4152.C441.gene285.pep
  Homolog annotation: Query=22..95bp; Hit=1..74bp; Blast score=86; Percent Identity=55.0; E value=1e-16; Homolog= gi|17975123|ref|NP _536645.1| zinc-finger protein [Bacteriophage K139] gi|17865405|gb|AAL47512.1|AF125163_18 orf13 [Bacteriophage
MSKKMVKSRKIDTLGMRNMRVLKIICPECGAKAIIRKTNRMHREIADVYCSCFDVECGHTFVMNLTFSHTISPSAKTGNILLQTVINNLNPQQRQMALDLLQTSAA

SEQ ID NO: 9498 - protein, 342 aa, Xenorhabdus bovienii
  Peptide sequence Name=Xb4151_4152.C441.gene286.pep
  Homolog annotation: Query=38..336bp; Hit=35..342bp; Blast score=332; Percent Identity=53.0; E value=5e-90; Homolog= gi|17981829|ref|NP _536820.1| orf15 [Haemophilus phage HP2] gi|13752202|gb|AAK37797.1| orf15 [Haemophilus phage HP2]
MSKKTLRKTAKAQTNHRQRKMSLITLGKPEPILTTMTDYQKIWYDNDYDHYTLPIDRLALAQLTNMNGTHGGIIYSRHNMISSDYLGGGLTHEQFKAAMINFLIFGDVAILKVRNFWGDLVRLDVLPSLYLRRRKDGDFVVLQEGEPLVYSPEEVIFIKQYDPQQQVYGLPDYIGGIHAALLNSEATIFRRRYYHNGGHTGGMIYINDPNISDEAEEEIERKLAQSKGIGNFETLFVSIPNGDPDGIKFIPVGDISANDEFANVKSISSQDVLTAHRFPAGLAGIIPTNVGGLGDPEKARDAYRKDEVIPVQNMFMSAINSRELPEILHLRFQQDNVSSDAE

SEQ ID NO: 9499 - protein, 594 aa, Xenorhabdus bovienii
  Peptide sequence Name=Xb4151_4152.C441.gene287.pep
  Homolog annotation: Query=2..588bp; Hit=12..601bp; Blast score=635; Percent Identity=52.0; E value=0; Homolog= gi|9628620|ref|NP _043485.1| orf16 [Haemophilus phage HP1] gi|1722793|sp|P51718|VPP _BPHP1 PROBABLE TERMINASE, ATPASE SUBUNIT (ORF1
MAKYSDELIKVAKSLYLRRSTPAEIAEELNLPNRRIVYYWAEKWNWADMLSHESVIEAINRRAALLSERNNKTALELDELDRLIIHHVKLMAQENKHKEKLADIKARAQSDNDSDYAPSGDGEPKKKKRYRKNDISALTAEDFQTFIDSNLFGYQKHLRDNKHQQVRNILKSRQIGATWYFAFEAFEDAVLTGKPQVFLSASKPQAQVFRSYIVNFAEQLFGITLSGEHIRLSNGAELRFLSTNKNTAQSYSGHLYCDEYFWIPDFKRFNEVASAMATHDHWRTTYFSTPSAKTHPAYSLWTGDEWRGNDPKRKNVAFPAFDELRDGGRDCPDGQWRYVITLEDAIKGGFNLASIDRLRNKYNPDSFNMLFMCVFVDSGASVFTYSQVDKCGVDINLWEDHAPNASRPFGEREVWGGFDPARSGDTSTFVIVAPPMMANEAFRVLATFYWQGMNWKHQAKLIEELFKRYRFTHIGIDTTGIGHGVYEMVQDFAPRQTQAIHYSQQSKNQLVMKMIDVVSEERLEWDQEQKELLASFLSIRHTTTAKGGAMTFVADRSQETGHADVFWAVSHALMNEPLNYEKKRTSKYKFAKAA

SEQ ID NO: 9500 - protein, 279 aa, Xenorhabdus bovienii
  Peptide sequence Name=Xb4151_4152.C441.gene288.pep
  Homolog annotation: Query=2..268bp; Hit=4..276bp; Blast score=142; Percent Identity=37.0; E value=5e-33; Homolog= gi|17981831|ref|NP _536822.1| scaffold [Haemophilus phage HP2] gi|13752204|gb|AAK37799.1| orf17 [Haemophilus phage HP2]
MSQLMTNWICIAMEGDTVDGRVMEPQWILDAAELYDPQLYTALIWPEHERWTGTMGEVLAVKAERGEDGALRLYAQLRPNHRLLDANRDGQLLFTSVEFTIDGNWRGTGKSYLEGLAVTSSPASVGTTRLQFSKKKKSHRSGTYSPLVIDEVREFKQKGTKMAKSTKKTWRSRFGIEEPEETSAENTGDDALQAIAEALAEMDKRMAAVESKLKSTEQEVEEVQGDIETVKEVVDTEEFARLRDSLPDILKKFGKLDGIATHLPSKNPKGNKNKSFNYL

SEQ ID NO: 9501 - protein, 343 aa, Xenorhabdus bovienii
  Peptide sequence Name=Xb4151_4152.C441.gene289.pep
  Homolog annotation: Query=3..301bp; Hit=5..303bp; Blast score=293; Percent Identity=49.0; E value=4e-78; Homolog= gi|17975128|ref|NP _536650.1| putative major capsid protein [Bacteriophage K139] gi|17865410|gb|AAL47517.1|AF125163_23 orf18 [B
MQLNQRAHAFLQNYSVGLAKAYGVTDTSRYFALSDPKETALRAALLESVEFLNMITCADVDHLSGQVVSVGNPGLFTGRKKDGRFMRATGIDGNEYKLVETDSGAALKWDLLSIWANSGSEEEFFLRMQAFTNESFALDMLRVGFNGQRIAETTNPDENPNGEDVNKGWHQIAKEWNGGKQVITTPVTLDQHGDHKSLDSMASDLINTCIPQQFIHDPRLVVLVGADLVAAEQYRLYQSADRPTEKIAAQMLGSSIAGRPAMVPPFMPGKRMVVTMLPNLQILTQRNTRQRKAEFVDDRKQFENKYLRNEGYALETPELYAAYDESAVTIGKVAEPAEKTGTD

SEQ ID NO: 9502 - protein, 235 aa, Xenorhabdus bovienii
  Peptide sequence Name=Xb4151_4152.C441.gene290.pep
  Homolog annotation: Query=3..219bp; Hit=1..224bp; Blast score=194; Percent Identity=47.0; E value=9e-49; Homolog= gi|31194915|ref|XP _306405.1| ENSANGP00000022466 [Anopheles gambiae] gi|30179559|gb|EAA45863.1| ENSANGP00000022466 [Anopheles g
MLSPAQRHRAAVELRQKLARQQAVAIADGASMHLQARALEQDVKRLRQLALTAERVEMKKRELLPNYQPTAERYLAEGEVYRNPIFAHCIIWLFDIGDFDKGLDWADIAIEQGQLTPDYFKSGFPAFVADTVLLWSQAEAEAGNPVEPYFSRTFQNVTEKWKVHEKIKAKYYKFAALNLLKGDNPDIKVSSVDSLGVLEQADSWLAKAHKCNQKSGVKTYRQRIAARLRALTTEP

SEQ ID NO: 9503 - protein, 32 aa, Xenorhabdus bovienii
  Peptide sequence Name=Xb4151_4152.C441.gene291.pep
MLMAVETGQPAFYSGRKARCLMATPSIIGMHR

SEQ ID NO: 9504 - protein, 150 aa, Xenorhabdus bovienii
  Peptide sequence Name=Xb4151_4152.C441.gene292.pep
  Homolog annotation: Query=1..150bp; Hit=1..153bp; Blast score=110; Percent Identity=39.0; E value=5e-24; Homolog= gi|17975130|ref|NP _536652.1| putative head completion protein [Bacteriophage K139] gi|17865412|gb|AAL47519.1|AF125163_25 orf20
MFNGNTVDYRDAPLTNDGFWPDLNLKEFQVNRKLPADLDNDMLANALLATVAEINLDLQRLKSRLQAKGYPCAADVLGISINGNNALVSQYKKAVYARAKADLLGEYTTLVSRAPNPGQESPEARNRLLAEASVVLRNMKGLKRATVRLI

SEQ ID NO: 9505 - protein, 166 aa, Xenorhabdus bovienii
  Peptide sequence Name=Xb4151_4152.C441.gene293.pep
  Homolog annotation: Query=5..148bp; Hit=10..151bp; Blast score=67; Percent Identity=29.0; E value=7e-11; Homolog= gi|17981835|ref|NP _536826.1| orf21 [Haemophilus phage HP2] gi|13752208|gb|AAK37803.1| orf21 [Haemophilus phage HP2]
MSKLQQLTAFLRENLPERLCETEFTSEMDEIRFIPAQRDLGLGQYQMFVQQYEVVIAWGRFPYRECDPRNIPLLIDIWLTEQGESLGDANVEQERPSLTVEVDGDTAVVVVSLSLAEPVVIREDPKGMIPFDGKRWSLAEPEVWFAEQGAVHSVDETGAQIGQVRS

SEQ ID NO: 9506 - protein, 224 aa, Xenorhabdus bovienii
  Peptide sequence Name=Xb4151_4152.C441.gene294.pep
  Homolog annotation: Query=6..207bp; Hit=7..213bp; Blast score=66; Percent Identity=31.0; E value=4e-10; Homolog= gi|17981836|ref|NP _536827.1| orf22 [Haemophilus phage HP2] gi|13752209|gb|AAK37804.1| orf22 [Haemophilus phage HP2]
MINGQLNRNQLKALQDELSRLELPPKKRQRLLWRIAKYGVIQAAKRNVRNQQSPDGSSWPVRKSPWRKKMLRNMPKLLHIREMPENNAVRIYLQGGHYRNGSQPVPAGVVGYAQQHGMRFQVSRRQVQKNVDRERMATIKQAKKLRELGYQVRKGKRWRKPPIKEITANMKFIQAGSLIRELSGKVAKSAWTVDVPSREFLGMNDEEFSQALARQLQSIGYGAP

SEQ ID NO: 9507 - protein, 373 aa, Xenorhabdus bovienii
  Peptide sequence Name=Xb4151_4152.C441.gene295.pep
  Homolog annotation: Query=1..366bp; Hit=1..370bp; Blast score=384; Percent Identity=55.0; E value=1e-105; Homolog= gi|17981837|ref|NP _536828.1| tail sheath [Haemophilus phage HP2] gi|13752210|gb|AAK37805.1| orf23 [Haemophilus phage HP2]
MWPHVQVNQVNQLQGETKVIERVLLFVGAGKTHVGKTLAVNTQTDFDAVLGTAQTALKRQVLAAMANAGQNWSGYVHVLPESADELAFVEAVIAAQTIASVEGYVLTVGATKAIIKAAQTLRANTIAQFGRWQWAILAVDGTQSKEPWADYVTRLAELQKGEAVPSVQLVPCLWGHEAGVLAGRLCNRAVTVADSPARVQTGALMDLGATDFPKDGAGQTLDLATLQALEKLRFSVPMWYPDYDGLYWSDGRTLDVEGGDYQSIENLRIVDKVARRVRLQAIAKIADRSLNSTPGSIATHQAYFARTLREMSRSTEINGVTFPGEVKSPLDGDVAITWRNKNTVEIYITVRTYECPKGISVSLLLDSSLEKTA

SEQ ID NO: 9508 - protein, 151 aa, Xenorhabdus bovienii
  Peptide sequence Name=Xb4151_4152.C441.gene296.pep
  Homolog annotation: Query=3..151bp; Hit=2..150bp; Blast score=154; Percent Identity=51.0; E value=5e-37; Homolog= gi|9628628|ref|NP _043493.1| orf24 [Haemophilus phage HP1] gi|1730862|sp|P51726|YO24 _BPHP1 PUTATIVE TAIL TUBE PROTEIN (ORF24) g
MSKRISGQSVDFNMDGDLVHAEKVNLSITDNTAAAQTQGVPDGYISGDVAAEGEIELSTKYLDIVTAKARSAGSWRGISPVDLMWYAKAGNEEMKVEAYGCKLIVSDILDVDPKGGSVMTHKVKFVVTSPDFVRINGIPYLEAELTQSLIG

SEQ ID NO: 9509 - protein, 97 aa, Xenorhabdus bovienii
  Peptide sequence Name=Xb4151_4152.C441.gene297.pep
  Homolog annotation: Query=1..86bp; Hit=1..86bp; Blast score=79; Percent Identity=51.0; E value=1e-14; Homolog= gi|30065712|ref|NP _839857.1| gpY [Bacteriophage L-413C] gi|30025906|gb|AAP04445.1| gpY [Bacteriophage L-413C]
MEEHEKTFVTLVLLGALIALGKMLTGHEPITLRLFVGRIILGSAVSVMAGALLIWWPGISPVAVTGIGSAMGIAGYQLIEVWLRKRGSAWLTGKLKK

SEQ ID NO: 9510 - protein, 112 aa, Xenorhabdus bovienii
  Peptide sequence Name=Xb4151_4152.C441.gene298.pep
MTLSEKQQLFSVLIAQLILWADEHGYRVTFGEAYRTPEQAALNAKKGMGIRNSLHSQRLAVDLNLFIQGTYQTSSTAYLPLGEYWESLGGTWGGRFSRPDGNHFSLAHNGVK

SEQ ID NO: 9511 - protein, 129 aa, Xenorhabdus bovienii
  Peptide sequence Name=Xb4151_4152.C441.gene299.pep
MPKARMLYFFVVALAFGAGWRVNHYYRDSLELKITRTAAETGAKIRQELHAISSASARQLEEKLEGIAHAAPREIRTEVVKPVFTAVCVSPEFVRMYNETADSIERTLSGKLTDKMSGHITETDRNDRK

SEQ ID NO: 9512 - protein, 89 aa, Xenorhabdus bovienii
  Peptide sequence Name=Xb4151_4152.C441.gene300.pep
  Homolog annotation: Query=8..89bp; Hit=1..82bp; Blast score=77; Percent Identity=51.0; E value=4e-14; Homolog= gi|31195103|ref|XP _306499.1| ENSANGP00000001476 [Anopheles gambiae] gi|21290115|gb|EAA02260.1| ENSANGP00000001476 [Anopheles gamb
MSKENKMITLIIGETEINFEPNMVAYNSMINDMAMDNKIVPIVSYLRRIVQPASKAALDELLLIPGAAMQIVEKVNSEYAPKLDIEIKN

SEQ ID NO: 9513 - protein, 702 aa, Xenorhabdus bovienii
  Peptide sequence Name=Xb4151_4152.C441.gene301.pep
  Homolog annotation: Query=5..605bp; Hit=7..624bp; Blast score=252; Percent Identity=30.0; E value=2e-65; Homolog= gi|17981843|ref|NP _536834.1| orf27 [Haemophilus phage HP2] gi|13752216|gb|AAK37811.1| orf27 [Haemophilus phage HP2]
MMGQLDFTLSLIDKLTQPLAGAKAAVSGFAQSSQDAFGKLAVGGAGLAASFWSIKGFLDPAIEMDDALKSASLQGIDSGVMAKVAKDAMTFSSQYGKSSVEFVQSASEISKAVNGLSQSDLPQMTQIANTTAAALKSSATDTASYMGKMFAQFSSHAKEVGHLQFAEELADKAVVMSKTFGTSMTEIADLMEGARAAGTNFGVGIDEQLAVLGELQRSLGTESSGAYESFLTGAVSGAKTLGLSFVNASGQMLSMPDMLEKLQAKYGKSIEGNLKAQAEIEAAFGDSAVVVKQLYGNVDVLRKNMTSLGANDGMKRTRDMAAQMANPWERLQAIWQNIRIAVGSTLLPVISSLVNRLANASQLLVRWLKLFPNIARWVGYITVGILSFAAAGAAANIIMGVSKFIWLGLKGIWVACTLIMKLWTAAVWICNGAIIVWNTTLRVLRGVLLAVRIAAFLAGISFSFMTWPILLIIAAIALLAIGIYLLIKHWDTIKAAIMNTTAFKVVAAYVKWVGGIFSAVWDWIAEGWNNLCNWFSSFSLADTFSGMVDGLSNIFGGLWDWLKGSFSDTYNWIVDKLNYLPGINIETQAIEKTVTEPMGKVTAPTGGMGENTQKLIAQPHGLLQGQPQARIQPVKAIKPPETEGVLTGGKKQGIGKQGLMKEVTTNSQTLTDNSRRFENVTFNVANGMTPEQLTEWEHVAYG

SEQ ID NO: 9514 - protein, 114 aa, Xenorhabdus bovienii
  Peptide sequence Name=Xb4151_4152.C441.gene302.pep
  Homolog annotation: Query=6..107bp; Hit=2..103bp; Blast score=121; Percent Identity=63.0; E value=2e-27; Homolog= gi|17981844|ref|NP _536835.1| orf28 [Haemophilus phage HP2] gi|13752217|gb|AAK37812.1| orf28 [Haemophilus phage HP2]
MWLMDEPKYIDLLITEGSFTLNSGNEPRFCHNRISIGQDCVHAIMESGLATELVAERSPTLRADIRTQIEILVEDDERIIPGTVIINEETPTQLWITAETYDFGRLNVSVGHGH

SEQ ID NO: 9515 - protein, 394 aa, Xenorhabdus bovienii
  Peptide sequence Name=Xb4151_4152.C441.gene303.pep
  Homolog annotation: Query=12..392bp; Hit=1..381bp; Blast score=416; Percent Identity=52.0; E value=1e-115; Homolog= gi|17981845|ref|NP _536836.1| orf29 [Haemophilus phage HP2] gi|13752218|gb|AAK37813.1| orf29 [Haemophilus phage HP2]
MDTKPTIDYEKVLRDSGMPTTETDISAAFATVVDEAGLITNTSRMSPFWRLINTIVTRPVLWLKEALINVTLKNMYLATAAGAWLDMFAWGVNLKRKPATAAQGVIRFYKAAGASAVTVPAGTVIQTERINGEIYRVSTTESGVMAEGVTRALLPVTADATGGAFNLAPGYFRLLPVAVSGIERVQNEEGWLLTPGADAESDDDLRDRCRNQYNLVGNYHTDAVYRGMIATVAGLSIDRIFFLHDAPRGAGTANAYLLLDSGVISQPFIEAVNDYITNQGHHGHGDDMQCLPMPETHHALTVTLFVGHLANYSQEQIARLKTDVGNLIRCAFRENTDYPVKKTWPYSRFSFSNLGREIHREFSEIESLTFSLGDILSELSVPRLQSLSVEVKDV

SEQ ID NO: 9516 - protein, 218 aa, Xenorhabdus bovienii
  Peptide sequence Name=Xb4151_4152.C441.gene304.pep
  Homolog annotation: Query=36..218bp; Hit=2..184bp; Blast score=306; Percent Identity=81.0; E value=1e-82; Homolog= gi|37527904|ref|NP _931249.1| hypothetical protein [Photorhabdus luminescens subsp. laumondii TTO1] gi|36787340|emb|CAE16429.1
MSEFRERLKRLALPSWMDKGEPAKLLRAARAFWLSVYDWLTWPLAQLDAETCAAALLSMLAYQRDIQRFNGEPLPLFRKRVKYAFINARDAGSIAGFIAIFERLGVGYVELLERQPEIDWDVIILRVSDGQIAENPDLLMNIIRQYGRTCRRYRFEVIAKNQLLMRVGSVGADYCCYYAAMPIQPLLLRVGHLSGESVCENARLKENSAPNVTYGASL

SEQ ID NO: 9517 - protein, 671 aa, Xenorhabdus bovienii
  Peptide sequence Name=Xb4151_4152.C441.gene305.pep
  Homolog annotation: Query=1..423bp; Hit=1..396bp; Blast score=489; Percent Identity=61.0; E value=1e-137; Homolog= gi|37527903|ref|NP _931248.1| hypothetical protein [Photorhabdus luminescens subsp. laumondii TTO1] gi|36787339|emb|CAE16428.1
MSSVITTDFEKWKAQQTAAGNPVVLDEFVFAYVPDLDPAQAINRDEKLPADNHIVHRQAVNKTGLASENAVAYSVTLGTEVGSFDFNWIGLLNSASGVIGMITHAPTQKKIKTANGLQGNVLTRSFLLEFEGAAKETAITTTAETWQIDFTARLTGIDEMQRLINIDSYGEAAFFGDGFAVVRHGEQYLVKKGLAYVGGLRGMLEFDQTLNSQRNTRVYADFSYQGNLVSQWKTAGQITVANELQNYIDAAGYPHYVFAVANIDNNGDISDLRPKGTLSDRDLAELDEELGKVKQDYAPKKWVAGSFARGDESSVVIKGSYPRVNFMQSNINSDYLAFEADFNSDTRDLYMYRRDAQGDNIYVLGFPKKMGMLATLDDINSGLADTKELAENAAPREWVAEGFARGNDSSVVIQGNYPRVNFMQSNSNSDYLAFEAAFNSDTRDLYLYRRNAQGDNIYVLGFPKKTGMLATLDDISDGLAGTKQVADNAAPKLWVANNFARGSDSTVVIKGGYPRVNFMQPNSNSDYLAFEADFNNDTPDLYLYQRNARGDNIYVLGFPQETGTLARLEDITKSSALKSNDGWWECGDTGMIVQFGTVSVGDNEVVTEKFPVTFPNKCTSLVVTARSESRNGGADVLSAYGVAISQSHMRVSISTNFSAAIAGVSFIAIGY

SEQ ID NO: 9518 - protein, 138 aa, Xenorhabdus bovienii
  Peptide sequence Name=Xb4151_4152.C441.gene306.pep
  Homolog annotation: Query=1..137bp; Hit=9..147bp; Blast score=150; Percent Identity=57.0; E value=3e-36; Homolog= gi|37528197|ref|NP _931542.1| hypothetical protein [Photorhabdus luminescens subsp. laumondii TTO1] gi|36787634|emb|CAE16741.1|
MYVYSAKTNSFYPVKLQLRYIDAGSWPDDGIEVSEETYLEFSTPPEGKMLIADDDGLPVWADIPPPTSKELQRGAESKKQHLIKIAKEKIDIFQDAVDLGLATDAEKSTLTQWRRYRVLLNRVDCAIASHIDWPEQPE

SEQ ID NO: 9519 - protein, 242 aa, Xenorhabdus bovienii
  Peptide sequence Name=Xb4151_4152.C441.gene307.pep
  Homolog annotation: Query=41..242bp; Hit=1..202bp; Blast score=277; Percent Identity=72.0; E value=1e-73; Homolog= gi|37527369|ref|NP _930713.1| hypothetical protein [Photorhabdus luminescens subsp. laumondii TTO1] gi|36786803|emb|CAE15869.1
MRWQRKTLQLSPTLSGLSAAIVPVHPFIYGVGQQADSGSYLSPANALHYLSNKLMGAENLNAVVLMICAKTHDEFMQSLTQFSSVLPLPVFFQVTRMAKTADSLAATKMQLPGKQGGGLPLPQPLSTSTSRLAVNAQRIEQAKAQASAGSSLAGLKSQLSGFTTARQNALQHVTDTLNGIKDKSARVWTFSGKGNGALLAEKMHKDIPEPDAVYTLATLFVGDDISPLERMLSHEPDYHPRP

SEQ ID NO: 9520 - protein, 181 aa, Xenorhabdus bovienii
  Peptide sequence Name=Xb4151_4152.C441.gene308.pep
  Homolog annotation: Query=7..177bp; Hit=1..171bp; Blast score=250; Percent Identity=83.0; E value=8e-66; Homolog= gi|37527368|ref|NP _930712.1| hypothetical protein [Photorhabdus luminescens subsp. laumondii TTO1] gi|37527901|ref|NP_931246.1
MSQIITLALDGEAIPLKSLTVTPSMMFQDADQSGQSSSTAVAEQGIKPKELRITGIIPFTEQKTFARLFALAEAKENGNLKRYRVANLTAQAINFRIGTFTSTLDASKVDGKQAWQVTFTLREHLSVSEKRDARAVGTIQSKKQTRQGAGAAKEEPEQLSWFEREVLKPINDKIGAADETP

SEQ ID NO: 9521 - protein, 548 aa, Xenorhabdus bovienii
  Peptide sequence Name=Xb4151_4152.C441.gene309.pep
  Homolog annotation: Query=1..548bp; Hit=1..549bp; Blast score=963; Percent Identity=85.0; E value=0; Homolog= gi|37527900|ref|NP _931245.1| hypothetical protein [Photorhabdus luminescens subsp. laumondii TTO1] gi|36787336|emb|CAE16422.1| unn
MKPLNRLSLSGDAVHLVDANLMLELSSCGRGFITAETGTDYTGKLVRLDVGYTDLILRWFTGYVERSQPAQNGYQRLFVRELVGVFDRLWPCSFQHPTLRQMTDWLQAHSGLTFTLPDAPYTDKPVPHYTHNGTGYQLLASLGQVFSIEDYIWQQLPDGSVYLGSWAHSMFAGKPVKIPNEFSQHQSAGNAMTLPMIQSLRPGVVVNQQRLNKVNLNNENMVITWEAINKLTGQPESKTPMQRQIDAAYPELSAGLHLPQFARIEAHTENTASGDISDPFRPRYAVDVQLLDDDGRDAAAPVYRAVPLPLPMAGGEAGMFQYPPIGTRVEIAFEGGRPDKPFIRQTLSQGNTLPDIKPGEQLQQQRAEVSQRVTQEGSWIRQTDQTINESSMHREVRADTETRTVVARETTVQATDKTTVLGTSTLLAGAIQQVTDGDHSLASSNYLASVGKDATIDVGQKLIEKIGLLKQSIAGVKQEIVAPVVWVGSQQINVMQLMLDTLGVVKELAELTAAHTHHNTGTPENASAIRNTADKSDGLKQKYSPVIG

SEQ ID NO: 9522 - protein, 75 aa, Xenorhabdus bovienii
  Peptide sequence Name=Xb4151_4152.C441.gene310.pep
VLFTWLVASTIARHSQANIVSLIPIALNINLWYGVEDLTQINDIHPITGEYFCFSPSDLSAVFLIALAFSGVPVL

SEQ ID NO: 9523 - protein, 41 aa, Xenorhabdus bovienii
  Peptide sequence Name=Xb4151_4152.C441.gene311.pep
MLSSACSSFRERDLPNRCLYTACPVGFHQRWLENGAPWPRH

SEQ ID NO: 9524 - protein, 34 aa, Xenorhabdus bovienii
  Peptide sequence Name=Xb4151_4152.C441.gene312.pep
MRSKRMKAFKGFIDTAIIVLKALVALLELIRAFL

SEQ ID NO: 9525 - protein, 104 aa, Xenorhabdus bovienii
  Peptide sequence Name=Xb4151_4152.C441.gene313.pep
MALHLLLTIKPTEAYNFLPLHKRNQTHTAPFTHQLTDHLCLIWIASLHRSYAAQSPRNKRKPDVKRTTPHPPARFGSKNYFSFKIRQREPPERASTGGVREIAN

SEQ ID NO: 9526 - protein, 40 aa, Xenorhabdus bovienii
  Peptide sequence Name=Xb4151_4152.C441.gene314.pep
KRSLARATRARGEPCALRFIKVLSHKIIRGLRKICCYSLL

SEQ ID NO: 9527 - protein, 85 aa, Xenorhabdus bovienii
  Peptide sequence Name=Xb4151_4152.C442.gene1.pep
MLPLSLSMKRVTCQCTPKVIFFCSVKQSPLLPAYCACHLVLMVMQIQNLTIGTILQSSLGGIPAQWGQLTRSHSFGEAAKHWQLS

SEQ ID NO: 9528 - protein, 157 aa, Xenorhabdus bovienii; identical to SEQ ID NO: 8974
  Peptide sequence Name=Xb4151_4152.C442.gene2.pep
  Homolog annotation: Query=1..156bp; Hit=2..157bp; Blast score=206; Percent Identity=62.0; E value=1e-52; Homolog= gi|16122508|ref|NP _405821.1| hypothetical protein [Yersinia pestis] gi|22126003|ref|NP _669426.1| hypothetical [Yersinia pestis

SEQ ID NO: 9529 - protein, 921 aa, Xenorhabdus bovienii
  Peptide sequence Name=Xb4151_4152.C442.gene3.pep
  Homolog annotation: Query=7..914bp; Hit=40..939bp; Blast score=1349; Percent Identity=71.0; E value=0; Homolog= gi|37525066|ref|NP _928410.1| hypothetical protein [Photorhabdus luminescens subsp. laumondii TTO1] gi|36784492|emb|CAE13380.1| u
MEKPKALNRPGKLREADETTIYHANPSIIDYLPWVEYLEDGQCLLLDDGISVGAVYQIESIATEGRPAERLTEIRDQLEDAIQDSLEEDDISPWVVQFFCQDDDDPADYLNTLRGYVKPWAQGTLFTDAFLTESEHHLNSIARPDGIFQDSLITGQPWRGQQRQTRMVVYRWLPDGRRSHVSNPALSAVAALNQVCERLVSSLASAGVIARRQHGGQIHSWLLRHFNPAPDWGMAKADFYHTVSYGTTTLSDLPVNNDFAESLWFTPPVSDPDAGVWWFDGLPHKAVLVERLRRPPEPGTLTGEVKRGDNINTLMDMMPAGTVVSLTIVAQAQDRLEEDFTRLTKNAVGENTESLRVRQDVQEVKELLGRRHKLYRSALAFLVRGRDLDDINHRVHQLSSTLLTAGLQPVRPEFSVSPLNAWLRALPMCFNPQKDKKHGYSRLTWVQHLAGLLPVTGRSTGTGHPGFSFFNRGGAPLTFDPMNKQDRTQNAHLLLFGPTGAGKSATLCASLIQLMAVHRPRLFIVEAGNSFGLLADYYESLGLTVNKIGIRPGCGVSLALFADAHQLLKLSPKQLRINEADIPDTDEQQEEEGDEQRDILGEMEIAARLMITGGEKREEERLTRSDRGLIREAIMMAAQTSFNEKRQMVASDLQNALYAIARNHRQDEHGQPLITAHRRARADEMASAMSMFTQGFEGELFNRPGTSWPEVDVTLIDLGTLARENYSAQMALAMVSLINKVNNLAERDQYQDRELQLVIDEGHITTTNPLLSPYMTKVVKMWRKLGTWLWLATQNLADYPDTAEKMLNMAEWWLCLTMPPDEVEQIARFKKLTEEEKAVLLSASKLPRCYTEGVVLAKKIEALFRVVPPSLYLALGMTEKEEKAERRALMREHQCSELEAAFLVARKMDIARGLKVDSGSV

SEQ ID NO: 9530 - protein, 133 aa, Xenorhabdus bovienii
  Peptide sequence Name=Xb4151_4152.C442.gene4.pep
  Homolog annotation: Query=15..133bp; Hit=23..142bp; Blast score=150; Percent Identity=63.0; E value=3e-36; Homolog= gi|37525065|ref|NP _928409.1| hypothetical protein [Photorhabdus luminescens subsp. laumondii TTO1] gi|36784491|emb|CAE13379.
MWKIKYYGIVCLAGLLAGCATSKETLLPAGEQTVLAMWQGNKAGHATASARETLRRSLTVSERLRALEEPYHYSRSAAQEISQQFPRLPNPDMVMYVFPHLVAGNTPIPGYSTVFPFYSQVQYALSGERTEAL

SEQ ID NO: 9531 - protein, 118 aa, Xenorhabdus bovienii
  Peptide sequence Name=Xb4151_4152.C442.gene5.pep
MEKTPSQWIFSAGSPYCLQVPVTSRAEPAQVQLYWRTVRKKECRLYLSAGRECQPLSDGDFTVFRLTETQWQAVVDGKVSMAPEQWKPLPFTLSELAVHPEFATFTVFGTPETAVCGK

SEQ ID NO: 9532 - protein, 476 aa, Xenorhabdus bovienii
  Peptide sequence Name=Xb4151_4152.C442.gene6.pep
  Homolog annotation: Query=1..463bp; Hit=1..481bp; Blast score=478; Percent Identity=54.0; E value=1e-133; Homolog= gi|37525064|ref|NP _928408.1| hypothetical protein [Photorhabdus luminescens subsp. laumondii TTO1] gi|36784490|emb|CAE13378.1
MQVKSNSLVKILVPMVLMVGGFIGIKSCSSTDTTAPDTPPNNVLATLSPEELQALGVGGDTPEDTLRTLVGTLNKVRSEQQRLGQQNADILKENDQLKNQRQDVAGQIDAAVAAIRQDDEQRRRELQDEQQGLLAQIDLLTERLNSAPLSAPDSPIPLGSGSIPYSANAGTGQNELIWITPADEKPADIQTPGSGKATAQFPTSFLSEQSAAGQSKPQSPSLQNPSKEENEQPVYTLPENATLVGSQAMTALLGRVPVNGAVTDPYPFKILIGKDNLTANGIELPEVEGAVVSGSASGDWTLSCVRGQVNSITVVFQDGTVRTLPGSGQNNNTSANGIGWLSDENGIPCISGERKSNAATYLPTLFALSAMHSAGDALSESQRTAQTSGTGGITTALTGNAGQAALGKAMSGGMNDMSEWLRQRYSQTFDAIYVPPGARVVVHITQRLAIDYETKGRKVRYGVREAAQRDNQEALD

SEQ ID NO: 9533 - protein, 278 aa, Xenorhabdus bovienii
  Peptide sequence Name=Xb4151_4152.C442.gene7.pep
  Homolog annotation: Query=27..278bp; Hit=27..302bp; Blast score=288; Percent Identity=56.0; E value=6e-77; Homolog= gi|37525063|ref|NP _928407.1| hypothetical protein [Photorhabdus luminescens subsp. laumondii TTO1] gi|36784489|emb|CAE13377.
MKRYPSCSSACFWLGLVSLVLFSLGAKADELMKWERIPLSIALKVGQERIIFADRNVRVGLSPSLSDKLRVQSAGGAIYLKASQSFPSTRLQLQDSENGEIILLDITATKTGPTEPVRILYPDEKNSVPKEGAPHQRKSAPLAPAPVILTRYAAQQLYAPLRTVEPVTGIHPVSLHLPAAITTVYPSEPIAVSPLAGWGMQNYTVVALKLRNTAKRNITLDPRALQGQFVAATFQHRWLGEAGTPEDTTVLYLVTRGQPDNAFIPEPVTVKPGGRHAG

SEQ ID NO: 9534 - protein, 218 aa, Xenorhabdus bovienii
  Peptide sequence Name=Xb4151_4152.C442.gene8.pep
  Homolog annotation: Query=1..217bp; Hit=1..217bp; Blast score=316; Percent Identity=72.0; E value=2e-85; Homolog= gi|16763036|ref|NP _458653.1| possible exported protein [Salmonella enterica subsp. enterica serovar Typhi] gi|29144521|ref|NP_
MSRFRHALKNRDQHILTLRLVCGVLILVLLITLTGWMTSPRSLTIHNPPDLRSGSTRPWWEVPAPSVYSFAFYLFQQLNAWPKNGAQDYPAKIAALSPYLTPACQDFLQEDAKTRADSGELLDRVRVVYEIPGRGYGTKSVTVRNRDNWVVRLDLVADEYYHAEPVKRALVRYSLKVVRWEGDAERNPFGLALDCYDRMPQRLEAMPQPVEEKKGVFQ

SEQ ID NO: 9535 - protein, 124 aa, Xenorhabdus bovienii
  Peptide sequence Name=Xb4151_4152.C442.gene9.pep
  Homolog annotation: Query=1..123bp; Hit=2..125bp; Blast score=129; Percent Identity=62.0; E value=6e-30; Homolog= gi|37525062|ref|NP _928406.1| hypothetical protein [Photorhabdus luminescens subsp. laumondii TTO1] gi|36784488|emb|CAE13376.1|
MQTIPFLPDRLNAEPVVFRGFTTPEMGLAALLGLAFGLMVSLPFIPLAGWVMIPTGMLFMPLLLISFGGRWLAQLKRGKPENYLWLTLEEKKRRLGIGDPALIIAAQGWSLRRSRLTHRNGSLR

SEQ ID NO: 9536 - protein, 125 aa, Xenorhabdus bovienii
  Peptide sequence Name=Xb4151_4152.C442.gene10.pep
  Homolog annotation: Query=10..125bp; Hit=13..128bp; Blast score=100; Percent Identity=59.0; E value=6e-21; Homolog= gi|37525061|ref|NP _928405.1| hypothetical protein [Photorhabdus luminescens subsp. laumondii TTO1] gi|36784487|emb|CAE13375.
MKPIFTVCRRLSANLITRISTLLLLFGFSCQSAWADLPAIEPPKSGGGGGLLGQVKGYAQDGIVIGGLILSAVAFFKVASAAVETFSEVRDGKATWTQFGSIIVVGVVLLVAVIWLLAKSAGIIF

SEQ ID NO: 9537 - protein, 78 aa, Xenorhabdus bovienii
  Peptide sequence Name=Xb4151_4152.C442.gene11.pep
  Homolog annotation: Query=1..78bp; Hit=1..78bp; Blast score=78; Percent Identity=56.0; E value=2e-14; Homolog= gi|37525060|ref|NP _928404.1| hypothetical protein [Photorhabdus luminescens subsp. laumondii TTO1] gi|36784486|emb|CAE13374.1| un
MTEAQRTAFTVASGHFDITFLYLVCVGFFLATLFLWAAWAAVDVWNGWANEKVRNQTISQFAMRTAILLVVAVWMFAS

SEQ ID NO: 9538 - protein, 110 aa, Xenorhabdus bovienii
  Peptide sequence Name=Xb4151_4152.C442.gene12.pep
  Homolog annotation: Query=25..110bp; Hit=7..90bp; Blast score=70; Percent Identity=48.0; E value=7e-12; Homolog= gi|16763033|ref|NP _458650.1| hypothetical protein [Salmonella enterica subsp. enterica serovar Typhi] gi|29144518|ref|NP_807860
MFMHGYFSLSRSACLLSLILMCVPIAQAAEKDELASAKNLIEQVQMALERANLAEKQADTPTRPRYDFDYLRIKADLNTIKSGIDHYLTPSRAQQQESNVLSGHYRQERP

SEQ ID NO: 9539 - protein, 230 aa, Xenorhabdus bovienii
  Peptide sequence Name=Xb4151_4152.C442.gene13.pep
MLRIDLNVPDDEYEQARKLGAHWDAAAQIWYIDNSFDPTPFMNWLPFYNVHAEFWYLAQTQTSCPHCHEHTTVTAFMLPAGHQLLEADNGDEPGTEVDYTEQDSPAFLFYLADIPSLVRNVLPGFHHRLRKAVSQRLHRQHWINHCEHCGAQQDDTELFAEIGGAFFPASREQAATLQLHRIDQPFVGYCEDISHHHYHFDPKQDNRICKACDGFEWMTQVVNAPSKYQH

SEQ ID NO: 9540 - protein, 40 aa, Xenorhabdus bovienii
  Peptide sequence Name=Xb4151_4152.C442.gene14.pep
MKPFTKKWQRMRINILFIRRIILMLYDDAVYGDADGSLNI

SEQ ID NO: 9541 - protein, 217 aa, Xenorhabdus bovienii
  Peptide sequence Name=Xb4151_4152.C442.gene15.pep
  Homolog annotation: Query=1..217bp; Hit=1..222bp; Blast score=171; Percent Identity=46.0; E value=6e-42; Homolog= gi|16761448|ref|NP _457065.1| hypothetical protein [Salmonella enterica subsp. enterica serovar Typhi] gi|29140855|ref|NP_80419
MENQFDTFLSAIKRKNKNTVLNPMPSEKLNRLRLRKYRAPNRTETAPLPKSLSALLAYDCDLTNPYGNKVFEYLIDSIEKNIITSWDPDEFAFYGSYYVSNIPDVEMEDLMPIWNDSPDLPALFSIAHPGDQRIWIYTSELDENGEYPITRQEVEEFWLSECSLIDYLSGIFEIVEEIDPENTFQEKREKYELRDAALLEKERLHEAFYEKMAAYED

SEQ ID NO: 9542 - protein, 252 aa, Xenorhabdus bovienii
  Peptide sequence Name=Xb4151_4152.C442.gene16.pep
  Homolog annotation: Query=1..252bp; Hit=1..250bp; Blast score=249; Percent Identity=57.0; E value=2e-65; Homolog= gi|37525057|ref|NP _928401.1| hypothetical protein [Photorhabdus luminescens subsp. laumondii TTO1] gi|36784483|emb|CAE13369.1|
MAQSENPSRQSSQPPRKHGLLYRLLWEWPWQLIGFMVMSWLFSLLLEYLGMAFFWPEQGAAHSQNMMKTELNYLSSEFTRSLLLSEPSQTVSAGLAQAYQWLFVDSGFMNWVQGQSQYQFHSRNDFMRELNSVLQGVSGYLQEYWLATVFITMVTLIRLVILLLYVPLFVMVILVALVDGLGRRDLRRYGAGYESSFVYHHAKRGIKPACTVPCVLYLSWPNVVYPMVILLPAALFLGMAVVITTSMFKKYL

SEQ ID NO: 9543 - protein, 687 aa, Xenorhabdus bovienii
  Peptide sequence Name=Xb4151_4152.C442.gene17.pep
  Homolog annotation: Query=1..683bp; Hit=1..682bp; Blast score=972; Percent Identity=68.0; E value=0; Homolog= gi|16763031|ref|NP _458648.1| hypothetical protein [Salmonella enterica subsp. enterica serovar Typhi] gi|29144516|ref|NP_807858.1|
MSRHYVVEALLRPAVELNTAVVSVVAAFVCIRAPWAIALAPSVSYVMAGGFAVLAMIRTWQGIQVIRYRRNLRRLPRYQMSTRQIPVSHRQLFLGRGFRWQQKHTQRLQDTRRPEVERFVQPSQAYQLARALERRTEYRWPALSALLRKDSPFNPVRPLPPVGGNPALHGIEPQETDVFMDLRERVGHTLVMGTTRVGKTRLAELLITQDIRRGEVVIVFDPKGDADLLRRIWAEAHRAGRGNELSLFHLGWPEISARYNAVGRFGRVSEVASRLAGQLSGEGNSAAFREFAWRFVNIVARALVALGHRPDYQLITRYVNNISELYQRYATRMMEERQPDLLAQINHSLSKLKEKDIPRNMQGQPDALRLWAMEMTLSSDAGKQLYDPILDGLRSAVRYDRTYFDKIVASLLPLLEKLTTGKIAELLSPDYLNMADLRPIFDWEQVIRKNGIVYIGLDALSDSDVASAVGNSMFADLVSVAGQIYKYGMNAGLPVRHDGKLAINLHCDEFNELMGDEFIPLINKGGGAGMQVTAYTQTSSDIEARIGSMAKTAQVIGNFNTLIMLRVRDNRTAELLTSQLPEVEIYSKTLVSGHSDIADVEQGQDFTSSTQDRVGTVKTPLITPAEMINLPKGQAFALLEGGQLWKIRMPLPTGDDDDALMPANLQNIAEQMRRHYRTSENWWEEKG

SEQ ID NO: 9544 - protein, 179 aa, Xenorhabdus bovienii
  Peptide sequence Name=Xb4151_4152.C442.gene18.pep
  Homolog annotation: Query=1..177bp; Hit=2..177bp; Blast score=154; Percent Identity=47.0; E value=6e-37; Homolog= gi|37525055|ref|NP _928399.1| hypothetical protein [Photorhabdus luminescens subsp. laumondii TTO1] gi|36784481|emb|CAE13365.1|
MANHIIMKRLSVFPVIGLLWISACHAELNIIADLGGKDASPFYESINAEQRDEPVSSVQNSSPEMAGEAAMLPVKTLELTPGKVSSRPLQLPGIGALFLIGDDPGSRRWLSQNAATLTKLHAVGLVVNVREMAGLQSLRALAPDLLLSPASGTELARRLQLQHYPVLITETQLSQQLSP

SEQ ID NO: 9545 - protein, 232 aa, Xenorhabdus bovienii
  Peptide sequence Name=Xb4151_4152.C442.gene19.pep
  Homolog annotation: Query=29..231bp; Hit=43..245bp; Blast score=243; Percent Identity=59.0; E value=2e-63; Homolog= gi|16763027|ref|NP _458644.1| putative exported protein [Salmonella enterica subsp. enterica serovar Typhi] gi|29144512|ref|N
MRLHQIGLVTWIVLISPTWAATPSPLTSQQAHTVESQKQTLRIQAGQWGLSTDEYRRYQQLLNGPRGIQSPGLDPLTTLGIEAESDAERRRYAEQWVKAEFARTEKELRFQREVDAAWQRLFPDMLPVNMEKSGEAKGRLALFVKINDCPPCDARLAEVLALMQPIDIYLVDSKGNDDTLRQWAKKHRIPVERVRNRHITLNHDAGYWFRFGQGIMPILLRQGEQGWQITSL

SEQ ID NO: 9546 - protein, 178 aa, Xenorhabdus bovienii
  Peptide sequence Name=Xb4151_4152.C442.gene20.pep
  Homolog annotation: Query=30..170bp; Hit=22..168bp; Blast score=125; Percent Identity=52.0; E value=4e-28; Homolog= gi|32481697|gb|AAP84211.1| PilL2 [Pseudomonas aeruginosa]
MRITVLMGVLVTILTGCNAPSNKPPSQCASEKAISATQLTRNIQPVSPDIYQQAPEVVRYGRYILVSTDPTAAQRDPLSQLIEVHIPASQHPTVADALRDVLRQSGYRLCAPEKTNDILYRQPLPSVHYQLGPVRLRTALQLMAGPAWQLEVDEVQREVCHHLRPGYQLPQPRQGKQP

SEQ ID NO: 9547 - protein, 101 aa, Xenorhabdus bovienii
  Peptide sequence Name=Xb4151_4152.C442.gene21.pep
MAVQAGETNVSPVECTRYLRIPVLNRHHSIIKRRGSRYDYDSHSERLAPSRNYLRITQAWYNTRRRLPRSRIKLFNSRQHPVPRLAKRGMDHCKLSRCSSL

SEQ ID NO: 9548 - protein, 47 aa, Xenorhabdus bovienii
  Peptide sequence Name=Xb4151_4152.C442.gene22.pep
MCKFNKLIKLLDYAFCINLTHKKTRLFAHSLNERLSVAGVLNHDYTH

SEQ ID NO: 9549 - protein, 363 aa, Xenorhabdus bovienii
  Peptide sequence Name=Xb4151_4152.C442.gene23.pep
  Homolog annotation: Query=28..363bp; Hit=1..335bp; Blast score=595; Percent Identity=86.0; E value=1e-169; Homolog= gi|37527181|ref|NP _930525.1| hypothetical protein [Photorhabdus luminescens subsp. laumondii TTO1] gi|36786615|emb|CAE15676.
MKPVTNNDHLSRIKITGYKSIAECDLPMGCLNVLIGANGAGKSNFISFFRLIATVLDHRLQSLVGKMGGPDTLLHFSRKKTEYMSSELYFGHNGYKFELESTNDNRMMFRHESLFGNISGDYDIGSGHFESQVDKHHTGINDDTLPAMLRWRVYHFHDTSDSARVKQTHRINDNDYLREDGANLAAFLYRLQKHHPQHYRRIIKTLQMVAPFFGDFYLRSTPDNADYIQLEWTEKEQDIPFKASELSDGTLRFILLATVLLQPENYMPGSIIIDEPELGLHPYAINVLAGLIKNASNKHQIIISTQSVELVNQFDADDLIVVDKQQGASTFKRLNHEMLSEWLEDYSLGELWKKNLLGGRPQR

SEQ ID NO: 9550 - protein, 223 aa, Xenorhabdus bovienii
  Peptide sequence Name=Xb4151_4152.C442.gene24.pep
  Homolog annotation: Query=1..213bp; Hit=13..225bp; Blast score=388; Percent Identity=87.0; E value=1e-107; Homolog= gi|37527180|ref|NP _930524.1| hypothetical protein [Photorhabdus luminescens subsp. laumondii TTO1] gi|36786614|emb|CAE15675.
MIRINVFVEGQTEETFVRDVLAPYFSAQQIYLSPILAQTSASQKGGITSYGKVKHQITRLCRQDPSAFVTTLIDYYGLPTDFPDYNKQRDNAASERVVKLEQAFADDIGQANFIPHLLLHEFEALLFCQPEKFADWLDDSAPIAALQAIRSEFATPEDINNSPQTAPSKRILTIIPHYHKTLHGPLIAGDIGLDTIRSQCPHFNQWLEMLTNLIARIQFAPKK

SEQ ID NO: 9551 - protein, 183 aa, Xenorhabdus bovienii
  Peptide sequence Name=Xb4151_4152.C442.gene25.pep
  Gene classification: Gene name=Ssb; Function=Single-stranded DNA -binding protein; Function class=L DNA replication, recombination and repair
  Homolog annotation: Query=14..183bp; Hit=1..171bp; Blast score=188; Percent Identity=54.0; E value=2e-48; Homolog= BU545 COG0629
MDTTSPPITGENKMSSRGVNKVILLGYLGQDPEIRYLPTGGTVATLSLATSENWKDKQTGELREKTEWHRVVIFGKLAEIAEEYLHKGTQVYIEGQLQTRKWQDNQGQDRYSTEVVVNVNGSMQMLGSRNDSKSMAPQQAGHKPAQKQPPPKPANQERKNTQPVQVSVSPEEDETDWDSAIPF

SEQ ID NO: 9552 - protein, 69 aa, Xenorhabdus bovienii
  Peptide sequence Name=Xb4151_4152.C442.gene26.pep
  Homolog annotation: Query=7..66bp; Hit=10..69bp; Blast score=68; Percent Identity=60.0; E value=2e-11; Homolog= gi|16763009|ref|NP _458626.1| hypothetical protein [Salmonella enterica subsp. enterica serovar Typhi] gi|29144496|ref|NP_807838.
MNAAPIGFLALQYCHKQLPLIVLRRRAGFYIGTMDEGIPCSRESVEYFARREQAEFALKQGQWTQRHPR

SEQ ID NO: 9553 - protein, 185 aa, Xenorhabdus bovienii
  Peptide sequence Name=Xb4151_4152.C442.gene27.pep
  Homolog annotation: Query=36..185bp; Hit=2..152bp; Blast score=218; Percent Identity=70.0; E value=4e-56; Homolog= gi|37525023|ref|NP _928367.1| hypothetical protein [Photorhabdus luminescens subsp. laumondii TTO1] gi|36784449|emb|CAE13333.1
MRLTPGGKNHSRQGTGFSPSHLIFYLHGEHRMSENTASLTKNDYFNLNIKGLGYLNNIRHVSTASGTFLSCVINALNGPGDNPVYVRFDITVVGKEATSLVGRCQKAVDEDKKVLLGFTLSNPSTDIFTLKRGDHAGEQRVSLKARLIKVDWIKIGQEKVYQAEQSDSMPPQNGITQKEYAENSF

SEQ ID NO: 9554 - protein, 66 aa, Xenorhabdus bovienii
  Peptide sequence Name=Xb4151_4152.C442.gene28.pep
VTEKILSPDGNDFSRRVSDAYVADVLIKNKKTFTATGLTISAFKGGQMYRNHALPFRLREFSAKTA

SEQ ID NO: 9555 - protein, 670 aa, Xenorhabdus bovienii
  Peptide sequence Name=Xb4151_4152.C442.gene29.pep
  Gene classification: Gene name=TopA; Function=Topoisomerase IA; Function class=L DNA replication, recombination and repair
  Homolog annotation: Query=92..668bp; Hit=34..613bp; Blast score=506; Percent Identity=45.0; E value=1e-143; Homolog= XF1776 COG0550
MQGGGDMPLYLCEKPSQARDIARVLGVKQRGQGYLFGDSITVTWAIGHLLEMAAPEHYGEQFGPPWRMEPLPVLPVQWQWTVKKETADQFAVIRQLLKQADEVIIATDADREGEVIARELLEYCRFTGPVRRLWLSALDETSIRQALAAILLGEQTEPLWQAGLGRARADWLMGINLTRLYTLKAQAQGFGEVLSIGRVQTPTLALVVNRDNDIARFEPKPYWQVMAALQKDDISFRVKWLPAPDDCDEEKRCIREDIAQSVVQRCQQAQDAVVTELTQKREKTPPPLCFDLGMLQQVASRQWGMGAGQVLTIAQSLYEIHKATTYPRTDCGYLPVSMREDIPAVFTALTRTDPAMNAIISQLDASTLSRVWNDSQITAHHAIIPTRHTFDMTKLTADELKIYQLIRHYYLAQFLPVQETDVTDVTFTIGGQVFQAKGRVSVVTGWKTLFADEKQVQEQDDNTALPALKKEEICPVLRAEIQPRQTRPPAPFTEGTLIAAMKNAAAFIHDPQLKKVLRENAGLGTEATRAGIIEALFNRQLLARKKKNLHATPLAQELIAGLPDVLTHPGMTALWEQSLDDIARGRATLDGFMQKQAQWLAHLVEKGKTQPIRFTLPKTPACPRCGGPMQKRAGKTTPFWGCTRYPACKGMLNANAVTGSRKTRRGNSPD

SEQ ID NO: 9556 - protein, 241 aa, Xenorhabdus bovienii
  Peptide sequence Name=Xb4151_4152.C442.gene30.pep
  Homolog annotation: Query=15..236bp; Hit=11..230bp; Blast score=225; Percent Identity=53.0; E value=6e-58; Homolog= gi|37525021|ref|NP _928365.1| hypothetical protein [Photorhabdus luminescens subsp. laumondii TTO1] gi|36784447|emb|CAE13331.
MSEPDEKTAPSPPRRAGALKSTLTIELHTHYAIRLWAGRKKEDVTGRRQYPDIIGMPQVIKRAGTISEDAAADNPYADSWLMKLEQALVAASASLQQRIATLQETLNALPAQVTLSAVSSVEPLNIGVYSHSPLGYRCVWLLVGFDQLAMKTFQAFHYGFISRSERDALLHNGSRVIRQIYGLVRSYRPLKVTRADIEEKTPAGLEAIKWLGEPDPDILSGRLRSDFSPPLRTVAQDAGRG

SEQ ID NO: 9557 - protein, 407 aa, Xenorhabdus bovienii
  Peptide sequence Name=Xb4151_4152.C442.gene31.pep
  Homolog annotation: Query=4..396bp; Hit=17..424bp; Blast score=387; Percent Identity=56.0; E value=1e-106; Homolog= gi|37525020|ref|NP _928364.1| hypothetical protein [Photorhabdus luminescens subsp. laumondii TTO1] gi|36784446|emb|CAE13330.
MINLSADSLIAHTMAKMKSRLEQRPDDDVSQLRSGLLFMGNIQDAYPRRLLLDDRLSPLDKTGWMMIRLYAQQNEGAVFPSYDELQLLLASPYKGKASRETVSRVLLMLRITGWLSLCKRIRDEHGRVRGNIYAQHDEPLTCRDAEILDPHWLNTVAEACRSKNRTISQTAREVLTDIQEDPLMRHRHSHIRLLEARLNAVQTPQQRVMRQALQQGKQQTELREMKPGSETESGQLKGQNKPNSETELSVKSMTCRQTTKPNCYVRSFTQSVNKKTYVDTPSAIFLPEKLCRQLEPEDGGMLNSQLQALPAEQAQTVLTCLDKALQAGKIGNPVGWLLAMMKRAREGKLYVQAEPAVTTTAAAKKPVEFTRETARSVPPSSQAHVSSVVKDIRQRLAQAKYHRDDMG

SEQ ID NO: 9558 - protein, 109 aa, Xenorhabdus bovienii
  Peptide sequence Name=Xb4151_4152.C442.gene32.pep
MAATGCIRIGLCEKTGIKRVIQETMSGKLTEIMPGLHVPVTAPLSFRRKAQYQVKCYRRGQRNYVRLKEKGTGYLKINVGLFWRLLSRDSGQSWELMHHERYNNEIRKS

SEQ ID NO: 9559 - protein, 193 aa, Xenorhabdus bovienii; identical to SEQ ID NO: 6349
  Peptide sequence Name=Xb4151_4152.C442.gene33.pep
  Homolog annotation: Query=1..178bp; Hit=1..177bp; Blast score=201; Percent Identity=59.0; E value=4e-51; Homolog= gi|37525019|ref|NP _928363.1| hypothetical protein [Photorhabdus luminescens subsp. laumondii TTO1] gi|36784445|emb|CAE13329.1|

SEQ ID NO: 9560 - protein, 518 aa, Xenorhabdus bovienii
  Peptide sequence Name=Xb4151_4152.C442.gene34.pep
  Homolog annotation: Query=1..495bp; Hit=8..549bp; Blast score=427; Percent Identity=48.0; E value=1e-118; Homolog= gi|37525017|ref|NP _928361.1| hypothetical protein [Photorhabdus luminescens subsp. laumondii TTO1] gi|36784443|emb|CAE13327.1
MGNALLQQGRQAAATLSEQPPVSEMPMVLTLDQLRPNPDNPRTSRNPRYEDIKASIKVRGLDTVPKVTRDPEGDDVYIFSDGGNTRYQILSELWQETGDERFYRVHCLFKPWPGRLQCVIGHLAENELRGELSFIEKALGVCKARTLFEVEKQQKITQSELSALLGEAGFPVSRSYISRMEDTVQYLYPWMPDLLNSGLKVPQIRLLLALRQDAEAVWLQHVVSAISEPACSFDAIFGACCRKFDSPESWSPEMFRDELIGDLLQVLPHPQLNYDRWVLELDPKESNRRQLFGEQATPLDPVPEKPDTPKADRIRAPDREPNRRIMSQPATDAEQASETTCAPVDKTPVPAPSSRNNPVLPPYQPDSPPEPALSEPEADDLHFARTGLEPVSSVWHISPMQDDIDHLQNMAFRLAFELAEVMGCDRDLLPVSDERSAGFCLIDGPDVHPFSCLLHSLTGEISTDRHELTLTAVLLGTAGREAVPLLDDSQTVKFLRLLRIIRRLRELQREMVPEMLAM

SEQ ID NO: 9561 - protein, 459 aa, Xenorhabdus bovienii
  Peptide sequence Name=Xb4151_4152.C442.gene35.pep
  Gene classification: Gene name=DnaB; Function=Replicative DNA helicase; Function class=L DNA replication, recombination and repair
  Homolog annotation: Query=16..458bp; Hit=25..462bp; Blast score=397; Percent Identity=49.0; E value=1e-110; Homolog= VC0371 COG0305
MDMAHEHLQIISEEAPSYAYAEVGVLGGLVLENERWDSVVQLLVADDFYFPAHRIIFQAIAELSEKNCPFDLITLTDRLTQRGQIDRACGFAYVAEVCKNTPSAANIEEYARIVAEKSRLRQLLALGKSLSADVFQPNIQSDTLIEQAESQLFNLAEKGSTRQHQEMTLLQGADSLIAHLERIQGSQGITGTPTGFQDLDEKTGGLQAGDLILLAARPSMGKTALGLACCLGVLRHRDDAVVQIFSLEMPAAQLMLRLTAMEGGVSLSALRSGMLDDEQWGRISQSLDQFTRWDQRLVIDDCSHQTPALLRARARRYTRKYGKPALIMVDYLQLMCAPGQENRTQEIADISRNLKALGKELGCPVLALSQLNRQVENRSDKRPNNGDLRDSGSLEQDADLILHLYRDEVYHPDTPDTGIAEIIIGKQRQGPTGVVRVGFDGQYTRFLDLSADSDGYGGK

SEQ ID NO: 9562 - protein, 143 aa, Xenorhabdus bovienii
  Peptide sequence Name=Xb4151_4152.C442.gene36.pep
MGGKIRRGIDCATDRRGAMNVIWRAVCFRYERVELLFSDDERFVFVDAPDRETAQAKLQILLPAVPDVSPEGVEHYYPRMRRQAMRPDASPDLALLECGWENDQPQYLTHNEVLFWVSSPHLQQRLIAALNAISREAADGHGA

SEQ ID NO: 9563 - protein, 295 aa, Xenorhabdus bovienii
  Peptide sequence Name=Xb4151_4152.C442.gene37.pep
  Gene classification: Gene name=Soj (BS); Function=ATPases involved in chromosome partitioning; Function class=D Cell division and chromosome partitioning
  Homolog annotation: Query=1..285bp; Hit=1..273bp; Blast score=160; Percent Identity=37.0; E value=2e-39; Homolog= XF1785 COG1192
MIILPIISPKGGEGKSTHSANLAGFFADAGLRVLLIDADYSQPTASSIFPLNYEAPAGLYELLMQTVDLNQSEQIISRSVIKNLDILISNDPDELLPTAMLHAPDGRLRLRNVLQHPLFSQYDIIFIDSKGATGVMNELVVLAATQGVLGVIKPILPDVREFLRGTLRMLTRLRPFEHYGIRLPAIQILVNGIEGTNLDRDTLSELADIINNQRYDASALGGRQVYQLLETRIDLLDIYKLGHVRAQPVHRLEYKTTRKSPAAAQTMHRLACELVPLWAEKFDAVLTVQPTGEAQ

SEQ ID NO: 9564 - protein, 335 aa, Xenorhabdus bovienii
  Peptide sequence Name=Xb4151_4152.C442.gene38.pep
  Homolog annotation: Query=6..333bp; Hit=2..323bp; Blast score=326; Percent Identity=55.0; E value=4e-88; Homolog= gi|37525134|ref|NP _928478.1| hypothetical protein [Photorhabdus luminescens subsp. laumondii TTO1] gi|36784560|emb|CAE13460.1|
MLNNEETMGWDALLDEYFFSRMLRPATEWSYRKVVRVFIRYLGETESPESVTHRDVLRWRRHLLTEKNQSRYTWNNKVAHLRAIFNFGMERKLLSHPKNPFNDASVKKEKKQKKTLSKAQITGIYLRMQQYEEEERLQTSPRGGRCALYPTGYWLTVLDTFRLTGMRLNQLLHLRLRDINLDNSYIELRVEGSKNHSEWRVPMIPQLKPRLVQLVEQAKACGAKENDPLFDLTRLRFRYHGRHVSYQYHHDREKQHLRSFFNRLSKECGFAVSPHRFRHTLATELMKAPDRNLQLVRCLLGHRSLATTMEYIDIDMEIAGKTLANELAFYLDIAE

SEQ ID NO: 9565 - protein, 501 aa, Xenorhabdus bovienii
  Peptide sequence Name=Xb4151_4152.C442.gene39.pep
  Gene classification: Function=Transposase; Function class=L DNA replication, recombination and repair
  Homolog annotation: Query=78..499bp; Hit=45..465bp; Blast score=243; Percent Identity=33.0; E value=4e-64; Homolog= Z4340 COG3436
MKIDIDALPNDPAELKRLLIKQSQRLAFLEEQFRLAQQKRFGASSEAFPGQGELFNEAEEIALPAETAAAQETLTPPRRKPTRNPLPKDLPRETVFHDIAEEEKQCACCGGRLHQMGADRSEKLLFIPAQIRVVEHVRPKYACRECEKSGIQTPVKQASLPAMPIKKGMATSSLLSQLITSKYQYGLPLYRQESVFKQYGIDLSRQTQSDWILKSAQLFTPLVARFREMLLQQPVLHADETPVKVVTSEKTTHYMWVYCVGTDTPEPAALTPNIVLYDHQASRSGTCAADYLAGFQGYLQVDGYQGYEQTGARLVGCMAHARRKFMEAKQAQGKNKTGKADIALSLIQSLYRVEHQVKGLSPAEKYRIRQEKALPIWDKLSAWLVKTRSQVIPKSKLGEAVTYLSNQWAKLIRYREDGRLSIDNNRAERAIKPFVIGRKAWLFSHTSRGAQASAILYSVIETAKANGLIPFDYVMTCLDELCQPTPDLEKLLPWKKVISKV

SEQ ID NO: 9566 - protein, 117 aa, Xenorhabdus bovienii
  Peptide sequence Name=Xb4151_4152.C442.gene40.pep
  Gene classification: Function=Transposase; Function class=L DNA replication, recombination and repair
  Homolog annotation: Query=6..101bp; Hit=7..101bp; Blast score=70; Percent Identity=39.0; E value=3e-13; Homolog= SPy0133 COG3436
MKMFVDVPEVYLCRSFIDFRKSINGLAVWVELEMQLSPTQTALFLFCNKKRDKLKILYWDKTGFALWYKRLENAKFKWPTAVNSASLTLTEQQLHGLLSGYDVIGHQPFSVQDCHVA

SEQ ID NO: 9567 - protein, 115 aa, Xenorhabdus bovienii
  Peptide sequence Name=Xb4151_4152.C442.gene41.pep
MMEKTHMSQSRFTQAEWRDLFEQQKKSELTVPQFCQKIGVSTTRFYHHRQRTSHPPKKPSGLASPSAFIKVSTAQKKSASSSTLPILFETPHGTLRFPAGTDKHVIIAIIRGLAA

SEQ ID NO: 9568 - protein, 59 aa, Xenorhabdus bovienii
  Peptide sequence Name=Xb4151_4152.C442.gene42.pep
MDLSWLGGVPRTLTFIFHIVTFYTLRKQGIPALMRCIWIISNRYRYHLYYFSSEFHSSA

SEQ ID NO: 9569 - protein, 297 aa, Xenorhabdus bovienii
  Peptide sequence Name=Xb4151_4152.C442.gene43.pep
  Homolog annotation: Query=11..273bp; Hit=16..275bp; Blast score=198; Percent Identity=43.0; E value=1e-49; Homolog= gi|37525133|ref|NP _928477.1| hypothetical protein [Photorhabdus luminescens subsp. laumondii TTO1] gi|36784559|emb|CAE13459.
MFQRFKSRFTRDPSPSQKAPGQAPERIRGAGGYFRPQSAEVLLATSERGQYLRQLWENSALPAGLYQQFYLDPLRQLCARVQHVPATQEGIWSCRGGFIDLTLQFTACAVRLAKGHMLPPGVAPETQAAQSLLWQAVVFWAALFYHLPLLRQLEGELEDGHHWQPGLWIPERRFRFRFQAPGPELPVLYKTLLAARLLPEEAVTWLSLVPGAWQCLMLHLGGHPSSVPLTDSLLQSAAEQVQSPLLNPVESAKQATDTRLSSSEPDPVIPPVTPGTAPAPDTAEDTRTLLSLFQAEE

SEQ ID NO: 9570 - protein, 228 aa, Xenorhabdus bovienii
  Peptide sequence Name=Xb4151_4152.C442.gene44.pep
  Homolog annotation: Query=6..222bp; Hit=15..230bp; Blast score=232; Percent Identity=52.0; E value=3e-60; Homolog= Pa|Phot3-157a10.p1k _g89| 48504 - 49733 4802 409 aa, chain -
MASRTDHQKEFISLFKQTARYHTRYQVFRDFCNCAMAAIHNKHCFSEELEQYYLKTINKYERADVDRIVQLFSHVVLGLVQEPGDFLGSVFMQLELGDKDLQQFFTPWSVARMMAQMQLQDAAGLLQTQPFVTLCEPCVGAGCITLAAADVLRELGHDPLCSLWVYAIDIDPLAAVMAYIQFSLTGIPAAITIGNALHDGGDKRTRYTPAHYLGNWSQRLREAELIAA

SEQ ID NO: 9571 - protein, 42 aa, Xenorhabdus bovienii
  Peptide sequence Name=Xb4151_4152.C442.gene45.pep
MSTERGTDPLFGACFPFFAFCSARKTPNGLPNRSSERIHFTV

SEQ ID NO: 9572 - protein, 307 aa, Xenorhabdus bovienii
  Peptide sequence Name=Xb4151_4152.C442.gene46.pep
  Homolog annotation: Query=1..269bp; Hit=41..311bp; Blast score=206; Percent Identity=40.0; E value=3e-52; Homolog= Pa|Phot3-157a10.p1k _g91| 49883 - 50923 4655 346 aa, chain -
MAEWCTNQLEITGKSVCLDVMQQWVCGEEVPRYRQAVLQSLRLFLAGCAGILKPTKPQTYTPYPALVRGTAVPTAQHLAFEQWLLLLQNNVPLNNDNIKRIDNLYRQSGLSLMQWDKVPEAARDIIARLLTRQYIDWFGMVGWSDTPDIGACWDKLNVYPQAAQPCDMLMMMSTNLATEINGNSGLLKGIPTTAQFYEEQYGLEWPFGHHVRWERRNVSSLTVRFDSPWAPPSAELMGELSAMFDCEIRHWYSDASGSLKGYDCYDQGEHVDSGHGQSGRENRPALYLVTGEQTEAALALPAIAVGQ

SEQ ID NO: 9573 - protein, 98 aa, Xenorhabdus bovienii
  Peptide sequence Name=Xb4151_4152.C442.gene47.pep
MTTLRLTVWQVIAAALLKRHFGLNLTDTVLCETGTVAALIARGVRPSEAINELVDKYDLIRLNTQVIPRNTPYLDIHDELTVIFDSGLADRLFRQTGQ

SEQ ID NO: 9574 - protein, 182 aa, Xenorhabdus bovienii
  Peptide sequence Name=Xb4151_4152.C442.gene48.pep
MIPAPDDTGTALREELFTAQVSGLRQHPKAPQSLQPETLMMCEAATVTEVVQRLKVIHLLGDWPVPERLSAQVSGTFFPLTVMIFDAQDRKVLGGRFDEEIIWAQPVTLTSERLSLEQQQQRLCQAAMLEQSWQNTPTARALWHKAHLLSLHGVASCYQQCHEVRDILRYGVSVSVFSEGTL

SEQ ID NO: 9575 - protein, 58 aa, Xenorhabdus bovienii
  Peptide sequence Name=Xb4151_4152.C442.gene49.pep
MRYRYHPVPVSSGAGKKMGFMVLSLDFTLNKENTRPIPGRCFRFPGQALKKSVNSLMG

SEQ ID NO: 9576 - protein, 153 aa, Xenorhabdus bovienii
  Peptide sequence Name=Xb4151_4152.C442.gene50.pep
MPNNELIMLDSLALSVVFPDKTPLERLFLGFLLANTASTLCGDYQPEQWTSRQVSESLTYMVPIRAETYSVYLPDTQLTVTLSADAFGLAVTAIVSARIAVLETPNEEVYRFCALQAYAQQHPESGLIASVMTLKPREDVISPSLIPDKNNHH

SEQ ID NO: 9577 - protein, 145 aa, Xenorhabdus bovienii
  Peptide sequence Name=Xb4151_4152.C442.gene51.pep
MQQNTPPAIVPASEHAPFAEIFPHTGSLELMLLEHTFIKAAAVLCDDDRCDQWQYRKVSDTIAYIVPVRPEPAVVRVEPTDFKGEVSAEAFGLMVTLSVLGYLTTLLKLDGYAERFCALREYALQHPQAQCIRAALGLKGEYNAK

SEQ ID NO: 9578 - protein, 52 aa, Xenorhabdus bovienii
  Peptide sequence Name=Xb4151_4152.C442.gene52.pep
MIDDICFQRCADVPHIGVLPCRLQECCCRCPKVILTSDRIIDKTYHANKWKS

SEQ ID NO: 9579 - protein, 61 aa, Xenorhabdus bovienii
  Peptide sequence Name=Xb4151_4152.C442.gene53.pep
MEIIRSMGNSFSGTENNIRISIPSFFLTILAIHLPDIAPRIAGQNGIACCAALAYPPVRHC

SEQ ID NO: 9580 - protein, 165 aa, Xenorhabdus bovienii
  Peptide sequence Name=Xb4151_4152.C442.gene54.pep
MKKNHWLYIALSLLSIILLIVLFKIINMSNKKNNIEIRCTGELTSRRKVNNTDLANLNEKFFLFLYDNGTGFLTQKGILSIGNKNYIMDREVNVNYTDFDKDYIYTFQIINVKLRANDNIPSTVETIFPILGRVPLSSYLNITSVDKDLYIFNELSGPFFLCKRF

SEQ ID NO: 9581 - protein, 267 aa, Xenorhabdus bovienii
  Peptide sequence Name=Xb4151_4152.C442.gene55.pep
  Gene classification: Function=DNA-binding winged-HTH domains; Function class=K Transcription
  Homolog annotation: Query=2..109bp; Hit=19..126bp; Blast score=58; Percent Identity=29.0; E value=5e-09; Homolog= VC0984 COG3710
LKYVIKFTIIYSPADRKLSLLNDSNHEITLSNQAARLLLEMITNSNETLHREDLLKRVWEDYGFTRSNNSLNVAVSEIRKSFESLGRDPKIIITIPKVGFRFEGAVEPVIKQSENNTFPIDESEVQLKQSTDKTIFIRQKKQQIKKFVICMTFVFLCGYASYEAFIKFKHLNVRHEKTTFLYSVGKCDVYALGDLPIDVGENYIDIAKQDINKEIINCDLAKGNIYYKKTRSGSQDTQISFIGICGLDDNNKPKDCRSILNNLGVNL

SEQ ID NO: 9582 - protein, 56 aa, Xenorhabdus bovienii
  Peptide sequence Name=Xb4151_4152.C442.gene56.pep
MKNSTLTSCNLSPVFPCHTAHLVEQRTSVTTATMIENKKTNKTLYLFISLKRFLFR

SEQ ID NO: 9583 - protein, 47 aa, Xenorhabdus bovienii
  Peptide sequence Name=Xb4151_4152.C442.gene57.pep
MDKMYIYIKNNRVIDPQLWGMSRYGEPIYSLFVESTINEVIAKLRVI

SEQ ID NO: 9584 - protein, 2517 aa, Xenorhabdus bovienii
  Peptide sequence Name=Xb4151_4152.C442.gene58.pep
  Homolog annotation: Query=1..2517bp; Hit=1..2524bp; Blast score=4085; Percent Identity=81.0; E value=0; Homolog= gi|31335147|gb|AAM77229.2| insecticidal toxin A2 [Xenorhabdus nematophila]
MYSTAVLLNKISPTRDGLTMTLADLQHLSFSELRKTFDDQLSWGESHYLYREAVEQKKRHRLLEARIFTCANPQLSGAIRRGIEQDDASRSYDKMFGSRSSSFVNPGSVASMFSPAGYLTELYREAKDLHFTSSAYHLDNRRPDLADLTLSQNNMDSEISTLALSNELLLAHITRQTGGDSDALMEILSTYRKAVDTPYHQPYETVRQVIMAHDSTLSALSRNPEVMAQAEGASLLAIQANISPELYHVLTEEITEENADTLFAKNFSENITPENFASQAWIAKHYGLELSDVQKYLGILQNGYSDNTSVYVDNISTGLVADDEGKLDAYKITRIPGGDYAKHLNFWDLLYKGDSDFVIRANFKKSSGGLTIRKSGVGTTNDSKVIGTISAPTDANTVYQSEILSPLTVDDLKNGATIFAYNRGGNKNIEGTAVFTFESYPLSIFALKLNKAIRLCLASELSPNELQTIVLSDNAQGIINNSVLTKVFYTLFYSTRYALSADDAQVLNGSVINQYADDDSVSHFNRIFNTPPLKGKIFEADGNTVSIDPNEEPATFACSALIRGLGINSGELYQLGRLAGVLDTKNNITLSVSVISSLYRLKLLAHTHQLTVNELCMLYGFSPFRGKATASLSSGELAQLVIWLYQVTQWLTEAAITTEELWLLCTPEFSGNISPEINNLLNTLRPRISEDMAQGGDRELQAEILAPFIAATLHLASPDMARYILLWTDNLRPGGLNIAGFMTRVLKETLSPDETIQLVQFCHVMAQLSLSVQTLRLSEAELSVLVISGFTVLGVRSQPAGQHNIDTLFSLYRFHQWINALGNLSSDTLDMLRQQTLTADRLASVMGLDISMVTQAIACADVSSLQSWQNINAVLQWMDVASELHTMPSVIRRLVNIRYVTVPNKAESDLPSWDEWQTLAENMEAGLSTQQAQALADHTAERLSSVLCHWFLANIQPEGIFLQSRDDLYSYFLIDNQVSSAIKTTRLAEAIAGIQLYINRALNRIESNARADVSTRQFFTDWAMNNRYSTWGGVSRLVYYPENYIDPTQRIGQTRMMDELLENISQSKLSRDTVEEAFKTYLTRFETVADLKVVSAYHDNVNSDSGLIWFVGQTRENLPDYYWRNVDISRRQAGKLAANAWKEWTKIDTAVTPYKDVIRPVVFKERLHLIWVEKEEVAENGTDPVKTSDRFTLKLAFLRHDGSWSAPWSYDITTQVKAVTDDKPDAERLGLAASGFQGEDTLLVFVYKTGESYPDFGGSNKNVAGMVIYGDGSLKQMDSTALSRYSPLKNTFDTINTKDNNLVRKASYRFAQDFEVPTSLNMGSAQDDRHLVVIENAAIPEITSQSSSESFTITLQNATFTVRYDGSGNALRSKQIRAMKLGGLGGLPGDDFILANSARYAGGVRDLGGPIAIYNKTKNYIISVQDSYEPSLHLRYLRLSPINDSGPILISPAPSYPKDGTNVIAYLGGDRSSDFKKCYYAFDRGNKKIGPFQDWSSYYSYGGWLEVGSGANPAGTQITVVAGSKPYHFTAENHAVSLPPNSFEGMQYTFKPLVIDAAGLVYLNNAAPVDITFEVEGMGKISQTLTVRKLDYGQENILCLQETDTGVQYMQLGVYRIRLNTLLAPKLVSRANTGIDTILTMATQQLPEPQLGKGFYATFTLPPYNPATHGTSRAFKLNLKHVVDDNVHIIYSGLLQDTELAVRLFIPLDDTPLYEKFIAKVFLTTQKNPNDVPWAGPHFTDDSGKIGIHGSSNVSMFTGVQPHNGTTTEPLDFNSACALYYWELFYYTPMMCFQRLLQEKQFDDATKWMNYVYNPAGYIVHGEIAPWIWNCRPLEETTSWHANPLDAIDPDAVAQNDPTHYKVATFMRLLDQLITRGDMAYRELTRDALNEAKMWYVRTLELLGDEPEDYGSSQWAAPSLSMAASQTVQAAYQQDLTALDSGEVSMQPRTANSLVGLFLPEYNPALTDYWKTLRLRLFNLRNNLSIDGQPLSLAIYAEPTDPQALLTSMVQASQGGSVLPTGTLSLYRFPVMLERARNLGAQLTQFGASLLSMAEHDDADELTTLLLQQGMELSTQSIRIQQRTVDEVDADITVLAESRRSAQNRLEKYQQLYDEDINHGEQRAMSLFDAAAGQSLAGQVLTAAEGVADLVPNVFGFACGGSRWGSALRAAASVISLSATASQYSAEKISRSETYRRRRQEWEIQRDNADGEIRQMDAQLEALKIRREAAQMQVEYQETQQAQTQTQLELLQRKFTNKALYSWMRGKLSAIYYQFFDLTQSFCLMAQEALRRELSDNGVTFIRGGAWNGTTAGLMAGETLLLNLAEMEKAWLERDERALEVTRTVSLVQVYQALSSDSFSLTEKLTQFLSEGKGSAGTSGNELKLSSGQIAASVRLSDLNIFGDYPESLGRTRQLKQVSVTLPALVGPYEDIRAVLNYGGSVMMPRGCSAIALSHGMNDSGQFVLDFNDARYLPFEGIPVDDSGSLTLSFPDATDRQKEILQSLSDIILHIRYTIRS

SEQ ID NO: 9585 - protein, 1481 aa, Xenorhabdus bovienii
  Peptide sequence Name=Xb4151_4152.C442.gene59.pep
  Homolog annotation: Query=1..1481bp; Hit=1..1482bp; Blast score=1702; Percent Identity=57.0; E value=0; Homolog= gi|3265037|gb|AAC38625.1| insecticidal toxin complex protein TcaC [Photorhabdus luminescens] gi|16416891|gb|AAL18451.1| toxin c
MQNTAPLQIGTPSLPKGGGTLRGMGETFTGGGPDGMATLSLPLPISSGRGTAPALSLTYSSGSGNGAFGMGWHCATLAVSLRTSHGVPRYEGNDTFLSPMGDVMQVAPNEQGKPDIRTTNQLQGVTLDESWQVTRYQPRIIHDFSRLEYWQPEQGNTQKPFWVMFSLEGQVHLFGKNAHARMANPADDNQIAQWLLEETVTPTGEHVYYQYCAEDDAGCDEPEKGQHPLSGAQRYLMQVHYGNITPQASLFALDKALPANDQWLFHLVFDYGERAGSLYDVPAFQATSGNWPVRPDCFSRFEYGFEMRTRRLCRQVLMFHRLKALAGEDTAPETPALVSRLMLAYDLNHCVSTLVSARQVAHENDGAPVTLPPLELDYQRLDTASLPVWQPMPQLDKLNHLQPYQFVDLYGEGLPGILYQDAPHAWWYRSPIRDTTAEARDTVAYGEIKPLPQIPAQQNNTSLMDINGDGKLDWVVTSAGVNGYHTMAPNGQWSPFVPLSALPVEYFHPQAQLADLTGAGLADLVMIGPRSVRLYANQPTGWKKGNTVIQSDGMTLPIPGADARKLVAFADMLGSGQQHLVEISADGVTCWPNLGHGRFGHPIRLAGLTVSAKNFNPDQVYLADIDGSGTTDILYVHSTYLELFMNESGNQFAAPVRINLPEHVRFDRACQLHIADTQGLGVSSIILTVPHMTVRHWRLDMTQHKPGLLNTINNNMGAETTLFYRSSAQFWLDEKHQAENVGRAVTSYLPFPVHVLWRAKVLDEITGNRLTSEQDYAHGAWDGREREFRGFGRVSQKDTDKLAQATDSSVTDPLSPAITISWFATGVPTVDARLAEEFWQGDKQAFPPFTCRFTHFDLDKEQDVTLVPSTEEAYWLHRALQGQPLHSEVYGDDGTAQAGIPYTVMDSRPQVRLLTGLPGNSSTVWPSVIEQRTWQYEQIADDPQCHQQVVLNSDRYGFPRETVDIAYPRRPKPAVSPYPDTLPATLFDSSYDEQQQQLRLTRQRQRYHHLADTEYQVLGLPDVVRSDAWAYPAERVPREGFTLEDLLAENSLIAPGTPLTYVGHQRVAYTGTTGTEEKPTRQALVAYTETAVFDELALQAFNGALSPEALEKKLIESGYLHVSRPLNTGAESAVWVARQGYTDYGGAEAFYRPLAQRTTVQIGKNTLHWDTHYCAVIRMQDAAGLYTDAAYDYRFLTPVQITDANDNQQHITLTALGQVSSGRFWGTEAGTAQGYTPPEDRPFTPPSSVEEALDLKPDLPVANCRVYAPLSWMPLAHTCQEYIAGFTGQALLDAGVVTEDKRVCALGFRRWVQRQGIVLNGQALADSREPVHVLTLATDRYDTDPDQQLRKSVTYSDGFGRLLQSAIYHAPGEAWQRAADGSLITDEKGAPLVAHTPTRWAVSGRTEYDGKGQPVRTYQPFFLNAWQYLSDDSARQDLYADTHCYDPLGREYQVRTAKGYLRQNLLTPWFVVNEDENDTLS

SEQ ID NO: 9586 - protein, 932 aa, Xenorhabdus bovienii
  Peptide sequence Name=Xb4151_4152.C442.gene60.pep
  Homolog annotation: Query=8..684bp; Hit=4..681bp; Blast score=926; Percent Identity=69.0; E value=0; Homolog= gi|10956818|ref|NP _065279.1| SepC [Serratia entomophila] gi|9963680|gb|AAG09644.1| SepC [Serratia entomophila]
MTVNRGDNLHQKTPEVTVLDNRGLTVRELRYHRHPNTPITTDERITRHRFTLAGQLAHSIDPRLFDLQQADNTINPNMVYETALTGEVVRIRSVDAGNTLMLNDITGRPVLAINATGVTRTWQYEDDTLPGRPLSITEQPADEVARITERFVWAGNSEAEKNSNLAGQCVRHYDTAGLNQTDSIALNGIPLSVTRRLLPDGTDADWQGNNESAWNDRLAPESFTTLSTADATGAVLTTTDAAGNLQRLAYDVAGLLTGSWLRLAGGTEQVIVKSLAYSAAGQKLREAHGNGVVTTYTYEPETQRLVGIKTERPPGHAQGAKVLQDLRYEYDPVGNVVKVANDAEVTRFWRNQKVVPENTYTYDSLYQLVSATGREMANIGQQSSLLPPPSLIDSSTYSNYSRTYNYDRGDNLTQIRHSAPANDNSYTTKMTVSDRSNRAVLSTLTENPAEVDALFTTGGQQNQLLPGQSLVWTPRGELLKVAPVVRDGQVSDQESYRYDADSQRIIKTHVQQTANSSQTQSTLYLSGLERHTTTNGTTVKEVLHVITIGEAGRAQVRVLHWKNGKPDSISNDQIRYSYDNLIGSSGLEVDGDGQIISMEEYYPYGGTAVWTARNQTEAGYKTVRYSGKERDATGLYYYGYRYYQPWAGRWLSADPAGTVDGLNLFRMVRNNPVSGYDNVGLVWTPVTKAVGSGILGAATLGYEAYKHSKSKNEPVQLSSNTLGNNKIHEFHKAVTDKNNKFSVTEEVKENLSGRGKVIKNFLTKGEVPAHDSIMNQKENLITIAKYSQNGDVSKLDKGKLAIASVSDASNNLPIRIYQAYKGFRTATSVTPEGVDEVMESVATAKDNVKSTLNVGIGVGVIGNSLLSVAKVFVPGAAIPITAGQALWAVSSVGKTVNQVNKAVKENIEKSPISHEFKEELFRQMGKPTNKDG

SEQ ID NO: 9587 - protein, 67 aa, Xenorhabdus bovienii
  Peptide sequence Name=Xb4151_4152.C442.gene61.pep
  Gene classification: Function=Predicted transposase; Function class=L DNA replication, recombination and repair
  Homolog annotation: Query=30..66bp; Hit=80..116bp; Blast score=68; Percent Identity=75.0; E value=1e-12; Homolog= Z1827 COG3328
MSYASQLRIEKNCGHGKWQRARYNSPYADVWLAIQTASKKWTMPIQNWRLAMVRFMIEFGDRLNGHV

SEQ ID NO: 9588 - protein, 140 aa, Xenorhabdus bovienii
  Peptide sequence Name=Xb4151_4152.C442.gene62.pep
  Gene classification: Gene name=PinR; Function=Site-specific recombinases, DNA invertase Pin homologs; Function class=L DNA replication, recombination and repair
  Homolog annotation: Query=47..140bp; Hit=89..188bp; Blast score=154; Percent Identity=81.0; E value=3e-38; Homolog= XFa0019 COG1961
MTEQPRISPDDKRFDRSFRPVIVNRQPSILPYAYRSGWRAAPVKRPQFKSLTDSIDTPSGRFFFYVMASLTEMERELIVERTRAGLDVARQLSRKPKMTDSKIESAKKLLTSGVPPKDVAKNLGVSVPTLYRWVPASTHT

SEQ ID NO: 9589 - protein, 48 aa, Xenorhabdus bovienii
  Peptide sequence Name=Xb4151_4152.C442.gene63.pep
MDPFKLLPLTGSPLACQISPLLGTLLLRTIKSPHYQQDENLDHRLLLR

SEQ ID NO: 9590 - protein, 90 aa, Xenorhabdus bovienii
  Peptide sequence Name=Xb4151_4152.C442.gene64.pep
  Homolog annotation: Query=1..76bp; Hit=1..76bp; Blast score=71; Percent Identity=46.0; E value=3e-12; Homolog= gi|24114677|ref|NP _709187.1| AGR_C_1711p [Agrobacterium tumefaciens] [Shigella flexneri 2a str. 301] gi|24053885|gb|AAN44894.1|AE
MAITRLRQQGGAVVVTIPSDVATATGWSVGTKLDVKTSGDGISIKPTGRIARGRKSLSELLQGIDETEVRTFNEATGDDLNSHPVGNEVI

SEQ ID NO: 9591 - protein, 30 aa, Xenorhabdus bovienii; identical to SEQ ID NO: 6724
  Peptide sequence Name=Xb4151_4152.C442.gene65.pep

SEQ ID NO: 9592 - protein, 107 aa, Xenorhabdus bovienii
  Peptide sequence Name=Xb4151_4152.C442.gene66.pep
  Gene classification: Function=Predicted transposase; Function class=L DNA replication, recombination and repair
  Homolog annotation: Query=1..91bp; Hit=1..91bp; Blast score=57; Percent Identity=35.0; E value=2e-09; Homolog= slr1357 COG3335
MGYSLDFRKRVLAYKDKHSLTFEQTSAHFEISMRTLFRWCNKIEPCMTRDKPATKIPDEVLIADVQNFPDDYQWERAKRLGVSQSAIHYALKRLNITPKKNAPTPSR

SEQ ID NO: 9593 - protein, 134 aa, Xenorhabdus bovienii
  Peptide sequence Name=Xb4151_4152.C442.gene67.pep
  Gene classification: Function=Predicted transposase; Function class=L DNA replication, recombination and repair
  Homolog annotation: Query=6..118bp; Hit=24..138bp; Blast score=71; Percent Identity=32.0; E value=3e-13; Homolog= slr1283 COG3335
MPRKQGYSEKGLRCFGTHDWHAKGRLNVIGAILENTFVTLSLFTGNINADVSYAWMTQDLLPKLPHGAVIVMDNAPFHKRNDTTQAIADSRCQLEWLPAYNPDLNPIEHKWGGAKAIRRQKRCSVDELFTEHIE

SEQ ID NO: 9594 - protein, 48 aa, Xenorhabdus bovienii
  Peptide sequence Name=Xb4151_4152.C442.gene68.pep
MLILLYVVTYNRKLLLIVGHYRYRLVLVHLGVSGDVECYILYFLRFIT

SEQ ID NO: 9595 - protein, 83 aa, Xenorhabdus bovienii
  Peptide sequence Name=Xb4151_4152.C442.gene69.pep
MLHTLFFEVYNMTLKYQLADLQKKAKERTVKTQNIEYDLETLVKKIDRKTIKLNPDYQRRHRWTTEASSRLIESLILNIPVMY

SEQ ID NO: 9596 - protein, 92 aa, Xenorhabdus bovienii; identical to SEQ ID NO: 6203
  Peptide sequence Name=Xb4151_4152.C442.gene70.pep

SEQ ID NO: 9597 - protein, 96 aa, Xenorhabdus bovienii; identical to SEQ ID NO: 5468
  Peptide sequence Name=Xb4151_4152.C442.gene71.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 9598 - protein, 56 aa, Xenorhabdus bovienii
  Peptide sequence Name=Xb4151_4152.C442.gene72.pep
  Homolog annotation: Query=6..43bp; Hit=5..42bp; Blast score=67; Percent Identity=76.0; E value=7e-11; Homolog= gi|26249082|ref|NP _755122.1| Hypothetical protein [Escherichia coli CFT073] gi|26109489|gb|AAN81692.1|AE016765_94 Hypothetical pr
MDMQSRKYGRTFHYPFSPGTTSDDRINHGWWQDVQKIKHLIHTITNFFIIGKSSIG

SEQ ID NO: 9599 - protein, 45 aa, Xenorhabdus bovienii
  Peptide sequence Name=Xb4151_4152.C442.gene73.pep
MWNINTVIVLMIYFLEKLILYGNKNPLPNTTTRDYSYIFNIYSRE

SEQ ID NO: 9600 - protein, 381 aa, Xenorhabdus bovienii
  Peptide sequence Name=Xb4151_4152.C442.gene74.pep
  Gene classification: Gene name=TyrB; Function=Aspartate/aromatic aminotransferase; Function class=E Amino acid transport and metabolism
  Homolog annotation: Query=1..380bp; Hit=17..396bp; Blast score=574; Percent Identity=71.0; E value=1e-164; Homolog= tyrB COG1448
MEAFKKDPRAEKINLSIGLYYDEQGITPQLQAVATAEEQMSALPQSASLYLPMEGLLAYRSAIQELLFGKDHPLLGQKRIATIQTVGGSGALKVGADFLHRYFPDSEVWCCDPTWENHASIFAGAGINVNYYPYFDDKTKGVKFDKMLATFNQLPAKSIILMHPCCHNPTGSDLTNDQWDQVVQVAKERELIPFLDIAYQGFADGVEEDAYAIRAMANAELPCLVCNSFSKIFSLYGERVGGLSVVCDDAKAGECVLGQLKASVRRIYSSPPNFGAQVVARVLSDPELKALWLKEVEQMRLRIKEMRTVLVNALKSALPEKNFDHLLKQRGMFSYTGFSQEQVDRLREEFGVYLVISGRICMAGVNHQNVQKIAEAFAAVS

SEQ ID NO: 9601 - protein, 84 aa, Xenorhabdus bovienii
  Peptide sequence Name=Xb4151_4152.C442.gene75.pep
LFFCGCNSLQLGCYTLFIVIQADAQVDFFCTGIFFKGFHQRKNRITCISINILEHCVYSLLLGYIYPLSVRLQLCRLQREIYWV

SEQ ID NO: 9602 - protein, 359 aa, Xenorhabdus bovienii
  Peptide sequence Name=Xb4151_4152.C442.gene76.pep
  Gene classification: Gene name=Alr; Function=Alanine racemase; Function class=M Cell envelope biogenesis, outer membrane
  Homolog annotation: Query=1..358bp; Hit=1..359bp; Blast score=509; Percent Identity=68.0; E value=1e-144; Homolog= alr COG0787
MKAATAVIDRRALRHNLQQVRVKAPDSKLVAVVKANAYGHGFLEVAYTMEDADSFGVARIGEALALRNGGIVKPILLLEGFFEAADLPVLVVNHIETVVHSIEQLEALEQANLSHPIKVWMKLDTGMHRLGVRIDEAEEFYQRLSCCHNVEQPVNIVSHFSRADELTVDTTPQQIDRFMAFIADKSGEKSIAASGGILLWPQAHLDWVRPGIMMYGASPIADKTAADFNLIPAMTLKSSLIAVRKHKSDESVGYGGTWISERDTTLGVVAVGYGDGYPRSAPSGTPVLINGRKVPLVGRVSMDMITVDLGPECYDKVGDEVTLWGNILPVEKIAEHTGISAYELITKLTSRVVMEYLDE

SEQ ID NO: 9603 - protein, 469 aa, Xenorhabdus bovienii
  Peptide sequence Name=Xb4151_4152.C442.gene77.pep
  Gene classification: Gene name=DnaB; Function=Replicative DNA helicase; Function class=L DNA replication, recombination and repair
  Homolog annotation: Query=1..469bp; Hit=1..471bp; Blast score=769; Percent Identity=84.0; E value=0; Homolog= dnaB COG0305
MAGKKPTNNSMAGPKDRQVEGLKLPPHSLEAEQSVLGGLMLDNERWDNVSERVSSNDFFSRPHRRIFAEMQRLLERGQPIDLITLSESLEQNGELDSVGGFAYLAELSKNTPSAANINAYADIVRERAVVRDMIAVAHEIADAGYDPQGRTSEDLLDLAESRVFQIAENRANKDEGPKGIEQILEETVERIEQLYQRPHDGVTGVSTGYQDLDKKTAGLQKSDLIIVAARPSMGKTTFAMNLCENAAMMQDKPVLIFSLEMPGNQIMMRMLASLSRVDQTRIRTGQLDDEDWARISSTMGILLEKRNMYIDDSSGLTPTEVRSRARRVFREHGGLSLIMIDYLQLMRVPSLSDNRTLEIAEISRSLKALAKELQVPVVALSQLNRGLEQRADKRPVNSDLRESGSIEQDADLIMFIYRDEVYHDNSELKGVAEIILGKQRNGPIGRIRLTFNGQWSRFDNYVGPSYSDE

SEQ ID NO: 9604 - protein, 161 aa, Xenorhabdus bovienii
  Peptide sequence Name=Xb4151_4152.C442.gene78.pep
  Homolog annotation: Query=1..154bp; Hit=1..191bp; Blast score=191; Percent Identity=53.0; E value=4e-48; Homolog= gi|15801315|ref|NP _287332.1| putative capsid protein of prophage CP-933C [Escherichia coli O157:H7 EDL933] gi|15830844|ref|NP_
MKTLLELRQQKATFTEQMRSLLTKAEDEKHSLTADEAKQFDELRHYILTGETRTLSTGVPSEGGYTVIPELNKQIMQQLADESVMRRICTVKTTRSNEYKQLVSVGGAAVVHGEEGKSRSETATSKMEEVSIKLFPIYAYPKTTQEIIDFSDVDSVLTMFY

SEQ ID NO: 9605 - protein, 131 aa, Xenorhabdus bovienii
  Peptide sequence Name=Xb4151_4152.C442.gene79.pep
  Homolog annotation: Query=1..131bp; Hit=1..131bp; Blast score=135; Percent Identity=64.0; E value=1e-31; Homolog= Pa|Phot5-451c10.q1k _g192| 147172 - 147567 784 131 aa, chain -
MNSKYFQLLGVLILLLLVIFTVIFVIGDAVSLILMKDEITFSGTVVIGVMSSPLLFYALLCSIFFFIFNRQPKFNKVIINFMVWLAILSFIISLPVSFYVNYKLKSDGYLTCDKISWMSPTTYVKDIKLCK

SEQ ID NO: 9606 - protein, 321 aa, Xenorhabdus bovienii
  Peptide sequence Name=Xb4151_4152.C442.gene80.pep
  Homolog annotation: Query=1..321bp; Hit=1..321bp; Blast score=506; Percent Identity=78.0; E value=1e-142; Homolog= Pa|Phot5-451c10.q1k _g193| 147564 - 148529 2798 321 aa, chain -
MTHKKYNPTWDGYMGDVLRGNVGINQLKPQHEFFDAIGLEKVLRDNTQYHFVLTLSEAQSIIEDISSRRPQSPSYGYAFARGMNEKHLSYEEAFSRGTDSGNKIKNPMAHIFSVTDPISTYAGNIYDTHGFSEVCREFKSLGIKATEHVGKNGEKYIHISGHAGLRSRIMGTRYRAKNPQMLGMGIGQQGLNASIIKGVRFCIVFSIGYRLIESIFKDEYTLADFIGNITMDMAKTAIIAASSWVIGSLLTATAFLGGSIIAVALIVLAVGVLAAYILDTLDKKYGISEKLIALLKEEMKRKPRTPEADLQHFFNGLGRFR

SEQ ID NO: 9607 - protein, 72 aa, Xenorhabdus bovienii
  Peptide sequence Name=Xb4151_4152.C442.gene81.pep
MHYLEVSEREINLVANRLNNRPRKIRDYKTPNELFKGIPSHLLRPLRCCAYYVNLSKLFIICRDNFTEKLMR

SEQ ID NO: 9608 - protein, 327 aa, Xenorhabdus bovienii; identical to SEQ ID NO: 5470
  Peptide sequence Name=Xb4151_4152.C442.gene82.pep
  Gene classification: Gene name=Tra8; Function=Transposase, IS30 family; Function class=L DNA replication, recombination and repair
  Homolog annotation: Query=1..312bp; Hit=1..312bp; Blast score=295; Percent Identity=52.0; E value=3e-80; Homolog= NMB0443 COG2826

SEQ ID NO: 9609 - protein, 77 aa, Xenorhabdus bovienii
  Peptide sequence Name=Xb4151_4152.C442.gene83.pep
  Gene classification: Gene name=MarC; Function=Integral membrane proteins of the MarC family; Function class=S Function unknown
  Homolog annotation: Query=1..70bp; Hit=16..85bp; Blast score=95; Percent Identity=77.0; E value=1e-20; Homolog= ychE COG2095
MGFFALVNPIGILPVFISMTNYQTPAGCNKTNLIANLSVAIILCISLLIGDSILHMFGISIDSFRIAGGVFHWHCLL

SEQ ID NO: 9610 - protein, 102 aa, Xenorhabdus bovienii
  Peptide sequence Name=Xb4151_4152.C442.gene84.pep
  Gene classification: Gene name=MarC; Function=Integral membrane proteins of the MarC family; Function class=S Function unknown
  Homolog annotation: Query=1..86bp; Hit=126..211bp; Blast score=88; Percent Identity=54.0; E value=1e-18; Homolog= VC2035 COG2095
MTGSGAISACIVWSARYQGWQNYLGLALTCLLFTFCCWLLFHSAILLVKFFGQTGINVIIHIMGLLLMSLGIEFIVTGTKAVFSGLLGYCTGNDNAGTDLES

SEQ ID NO: 9611 - protein, 40 aa, Xenorhabdus bovienii
  Peptide sequence Name=Xb4151_4152.C442.gene85.pep
MVSFLYHFFKTISYILFLSYRLLLQSHTVIFHTIFFPLFH

SEQ ID NO: 9612 - protein, 547 aa, Xenorhabdus bovienii
  Peptide sequence Name=Xb4151_4152.C442.gene86.pep
  Gene classification: Gene name=OppA; Function=ABC-type dipeptide/oligopeptide/nickel transport systems, periplasmic components; Function class=E Amino acid transport and metabolism
  Homolog annotation: Query=16..544bp; Hit=17..542bp; Blast score=639; Percent Identity=58.0; E value=0; Homolog= oppA COG0747
MRKTPSKLSQLISTIALLSFPVAQGMAAIVPTGVALAEKQEVTVNNGVEVASLDPHKVEGAPETAIIRNLLEGLVTTGPDGETVPGVAEKWENEDYKVWTFYLRDNAKWSDGKPVTAHDFVYSWRRLADPKVGSPYTSYLQYTYVQNAEDILKGKKSPDQLGVKALDNHRFQVTLSHPVPYLVDMLSHTAMKPVRQDVVEAFDKKWTLPENYIGNGAYVLKDWVVNERIVLTRNPQYWNNKETIIEKGTFLPIVSEVSDINRYRSGEIDITNGAITPYLYQKMKRDIPDQLHVSPFLCTFYYEINNKNPLFKDKRVREAIKLSLNRNIIAEKIMGQGQIPAYGFTPTYIGDRGFTTNPEWANWTQEQRNQRAKDLLKEAGFDVRNPLKFTLLYNTSDQNKQQAIAAASMWQKNIGAQVMLQNQEWKTSLESRHQGNYDVARATWCGDYNEPSSFLNTLLSDSSNNTGFYQSAAFDNYLGQALAAKDEAARKVFYQQAEAQLDKDSGLIPVYYRVSVRLIRPTVVGLTGKDPLDYIDLKNLYIRKANN

SEQ ID NO: 9613 - protein, 545 aa, Xenorhabdus bovienii
  Peptide sequence Name=Xb4151_4152.C442.gene87.pep
  Gene classification: Gene name=OppA; Function=ABC-type dipeptide/oligopeptide/nickel transport systems, periplasmic components; Function class=E Amino acid transport and metabolism
  Homolog annotation: Query=1..545bp; Hit=1..543bp; Blast score=785; Percent Identity=69.0; E value=0; Homolog= ZoppA COG0747
MMNTTKKRLAAGITVALGMMTGWQAFAAQVPAGVQLAEKQVLVRNNGSEPQSLDPHKIEGVPESNIARDLFEGIVINGPNGEILPGVATHWENQDFKVWTFHLRKDAKWSNGDPVTAQDFVYSWRRLADPNTASPYASYLQYAHILNVDDVIKGKQKPESLGVKALDDHTFQVTLSEPVPYLVRLLIHSTMSPVHRATVEKYGDRWTQPKNFVGNGAYKLKSWNINERLVFERSPTYWDNKNTIIDQVTFLPISSEVTDVNRYRSGEIDITYSNLPIELFQKLKKEIPDQLRVNPYLCTYFYEINNQKPPFNDPRVRTALKLGMDRDLITNKVKNQGDTPAYGWVPPYIANFKDEKPDWYTKLNQQQRNEEAKKLLAEAGFSKENPLKISLLYNTSDLHKKMAIAAAAIWKKNIGAEVSLENQEWKTFLDTRHQGNYDIARAGWCADYNEPTTFLNVKLSYSSNNTAHYKSEAFDALMKEALKVKSDAERAEIYKQANALIDKDSAVVPLYYYVSTRLVKPYVGGYTGKDPLDNIHTKDFYIIKH

SEQ ID NO: 9614 - protein, 306 aa, Xenorhabdus bovienii
  Peptide sequence Name=Xb4151_4152.C442.gene88.pep
  Gene classification: Gene name=DppB; Function=ABC-type dipeptide/oligopeptide/nickel transport systems, permease components; Function class=E Amino acid transport and metabolism
  Homolog annotation: Query=1..306bp; Hit=1..306bp; Blast score=487; Percent Identity=89.0; E value=1e-138; Homolog= oppB COG0601
MFKFILRRCLEAIPTLLILITISFFMMRLAPGSPFTGERKLPPEVMANIEAKYHLNDPIYKQYFNYLVQLSKGDFGPSFKYKDYSVNDLVAEALPVSAKLGFAAFIMAVVLGVSAGTIAALNQNTKWDYTVMGFAMTGVVIPSFVVAPLLVLIFAIILKWLPGGGWNGGAPKYMILPMVALSLAYIASISRITRGSMIEILHSNFIRTARAKGLPLRAIIFRHALKPALLPVISYMGPAFVGIITGSMVIETIFGLPGLGQLFVNGALNRDYSLVLSLTILVGGLTILFNAIVDVLYAVIDPKIRY

SEQ ID NO: 9615 - protein, 302 aa, Xenorhabdus bovienii
  Peptide sequence Name=Xb4151_4152.C442.gene89.pep
  Gene classification: Gene name=DppC; Function=ABC-type dipeptide/oligopeptide/nickel transport systems, permease components; Function class=E Amino acid transport and metabolism
  Homolog annotation: Query=1..302bp; Hit=1..302bp; Blast score=447; Percent Identity=87.0; E value=1e-126; Homolog= oppC COG1173
MLLNKRNSEALENFSEQLEVEGRSLWQDARRRFIHNKAAITSLCVLLLITLFVIFAPVLSQFTYDDTDWNMMTMPPDSESSHYFGTDSSGRDLLVRVAIGGRISLMVGIAAAFIAVIFGTLYGAMSGYLGGKADMIMMRLLEILNSFPFMFFVILLVTFFGQNILLIFVAIGMVSWLDMARIVRGQTLSLKRKEFIEAALVGGVSTRHIVLRHIVPNVLGVVVVYASLLVPSMILFESFLSFLGLGTQEPLSSWGALLSDGANSMEVAPWLLLFPAGFLVLTLFCFNFIGDGLRDALDPKDR

SEQ ID NO: 9616 - protein, 335 aa, Xenorhabdus bovienii
  Peptide sequence Name=Xb4151_4152.C442.gene90.pep
  Gene classification: Gene name=DppD; Function=ABC-type dipeptide/oligopeptide/nickel transport system, ATPase component; Function class=E Amino acid transport and metabolism
  Homolog annotation: Query=11..335bp; Hit=14..337bp; Blast score=525; Percent Identity=81.0; E value=1e-149; Homolog= ZoppD COG0444
MNSVEAAKNAKSAVPLLTVKDLNVAFSTPDGSVIAVNKLNFDLNAGETLGIVGESGSGKSQTAFALMGLLASNGVVSGSAAFNGREILNLKEKDLNRMRAEEISMIFQDPMTSLNPYMRVGEQLTEVLMLHKRISKSEAVEESIRMLDAVKMPEARKRMKMYPHEFSGGMRQRVMIAMALLCQPKLLIADEPTTALDVTVQAQIMTLLNELKNEFNTAIILITHDLGVVAGICDKVLVMYAGRTMEYGSARDIFYHPTHPYSIGLLDAVPRLDDDEESLTTIQGNPPNLLRLPKGCPFQPRCQFATERCANEEPQLEHFDLGRLRACFKPQGELV

SEQ ID NO: 9617 - protein, 333 aa, Xenorhabdus bovienii
  Peptide sequence Name=Xb4151_4152.C442.gene91.pep
  Gene classification: Gene name=OppF; Function=ABC-type dipeptide/oligopeptide/nickel transport system, ATPase component; Function class=E Amino acid transport and metabolism
  Homolog annotation: Query=1..333bp; Hit=1..334bp; Blast score=593; Percent Identity=84.0; E value=1e-170; Homolog= ZoppF COG1124
MNAAAEKRVLLEVDDLKVYFDIKDGKQWFWQPAKTLKAVDGVTLRLYEGETLGVVGESGCGKSTFARAVIGLVKASGGTVTWLGQNLLDMSDNQWRNIRNDIQMIFQDPLASLNPRMTIGDIIAEPLRTYHPKMKSGEIKEKVKNMMMRVGLLPNLINRYPHEFSGGQCQRIGIARALILEPKLVICDEPVSALDVSIQAQVINLLQELQREMGLSLIFIAHDLSIVKHISDRVLVMYLGNAVELGTYDEVYHNPLHPYTRALMSAVPIPDPDKERNKRIELLEGELPSPIDPPSGCVFRTRCPMADAECAKTRPLLEGSFKHAVSCLKVDPL

SEQ ID NO: 9618 - protein, 58 aa, Xenorhabdus bovienii
  Peptide sequence Name=Xb4151_4152.C442.gene92.pep
MQNVPKHVHCLKAASNMPCLVLRLIRYSFKCLFSVTLSLIYILSPRCGGLIYRQGQLR

SEQ ID NO: 9619 - protein, 117 aa, Xenorhabdus bovienii
  Peptide sequence Name=Xb4151_4152.C442.gene93.pep
  Gene classification: Function=Uncharacterized BCR; Function class=S Function unknown
  Homolog annotation: Query=2..117bp; Hit=20..135bp; Blast score=156; Percent Identity=67.0; E value=3e-39; Homolog= yciU COG3099
MENKPTHSLQLDFNNRMTEDETLEKAYDIFLEQAIANLDPADSLLFNLQFEERGGAELLAPSAIWLEHVDFDLHPDFFAEVIIGLAASDDAEIDDIFARVLICREKSHPISQILWKK

SEQ ID NO: 9620 - protein, 486 aa, Xenorhabdus bovienii
  Peptide sequence Name=Xb4151_4152.C442.gene94.pep
  Gene classification: Gene name=Cls; Function =Phosphatidylserine/phosphatidylglycerophosphate/c ardiolipin synthases and related enzymes; Function class=I Lipid metabolism
  Homolog annotation: Query=1..486bp; Hit=1..486bp; Blast score=724; Percent Identity=70.0; E value=0; Homolog= cls COG1502
MTTFYSVLNWLAIFLYWLIIAGITIRVLMKRRPVTSAMTWVLIIYILPLVGIVAYLSFGELYLGKRRVEQAKQMRSSVTKWLSELKKSPHIFAHENSEVAEPLFQLCERRQRIKGVRGNKMQLMTSYDNSLKSIVNDIEKANHNIEMVFYIWQAGGLVDQVTDALMCAAKRGVKCRIMVDSAGSWQFFRSPYPDIMRKAGIEFVESLKVNIFRLFLRRMDLRQHRKIILIDNHISYTGSMNMVDPRFFKQDAGFGQWVDIMVRMEGPVTTTLGIIYAFDWEMETGQRHLPSPPDSPIMPFEQASGHTAQVIASGPGFPDELIQQSLMTAIFSAREQLILTTPYFVPSDDLMHAICTAAMRGVDVSIILPSQNNSFLVRWASRAFFTELLEAGVKIYQFEDGLLHTKSVLVDGQLSMVGSVNLDMRSLWLNFEITVVIDDKHFGNDLTFVQQGYIARSTLLDNEEWAKRPLWHRILERICYFFSPLL

SEQ ID NO: 9621 - protein, 64 aa, Xenorhabdus bovienii
  Peptide sequence Name=Xb4151_4152.C442.gene95.pep
MEILTNHQLNVVNLAENNQNITNIIPDVVSQVLCNLIQLNHESIIYLLTNDLDSIPHCVKPYIG

SEQ ID NO: 9622 - protein, 65 aa, Xenorhabdus bovienii
  Peptide sequence Name=Xb4151_4152.C442.gene96.pep
MPHIIVREIPCSARTESTCDACHHQSYATNRCVNYDVIAPLTSDDDGGCFGEAFAIDRLHFCYVS

SEQ ID NO: 9623 - protein, 236 aa, Xenorhabdus bovienii
  Peptide sequence Name=Xb4151_4152.C442.gene97.pep
  Gene classification: Gene name=TonB; Function=Periplasmic protein TonB, links inner and outer membranes; Function class=M Cell envelope biogenesis, outer membrane
  Homolog annotation: Query=8..235bp; Hit=5..237bp; Blast score=95; Percent Identity=38.0; E value=4e-20; Homolog= tonB COG0810
MLLIKNSLMRWIHWPVLLSVCLHVSIAAALFHAIEPEKQLEATPISVAMIQLAAEEAPVSEPAMPESIPEPPEPEPEPEPIAKIALPKPEKKPEEKKVVKKEPKPMERKMEKTSEQPVKPVSDDSQMANNRNNQLKPTHPALNDKPKVQNGPKALSRSVPVYPSRAWQLGTEGMVKVKYDIDEDGRVKNIEIIAADPKNVFEREVKQAMRKWRYEKAPATGYVTTIEFKLTGISQS

SEQ ID NO: 9624 - protein, 144 aa, Xenorhabdus bovienii
  Peptide sequence Name=Xb4151_4152.C442.gene98.pep
  Gene classification: Function=Acyl-CoA hydrolase; Function class=I Lipid metabolism
  Homolog annotation: Query=1..130bp; Hit=1..130bp; Blast score=206; Percent Identity=73.0; E value=5e-54; Homolog= ZyciA COG1607
MTQQQCLPNGELVLRTLAMPADTNANGDIFGGWLMSQMDIGGAILAKEIAEGRVVTVSVDGISFLKPVAVGDVVCCYARCLKTGNSSITIHIEVWVKKVASDPVGQRYRATDAVFTYVAVNEDNTSRRLPEGKTQFKLESSDSK

SEQ ID NO: 9625 - protein, 44 aa, Xenorhabdus bovienii
  Peptide sequence Name=Xb4151_4152.C442.gene99.pep
VSLENLLYLVNTTIPADVSAGIHMKVIIFVREADDGRYIPHSTQ

SEQ ID NO: 9626 - protein, 189 aa, Xenorhabdus bovienii
  Peptide sequence Name=Xb4151_4152.C442.gene100.pep
  Gene classification: Function=Intracellular septation protein A; Function class=D Cell division and chromosome partitioning
  Homolog annotation: Query=12..189bp; Hit=1..178bp; Blast score=199; Percent Identity=69.0; E value=2e-51; Homolog= yciB COG2917
MPPSALQWIQFMKQLLDFLPLVVFFIAYKMYDIFYASGALIAATGLAVVITYLIYRKVEKSSLITFIVVAIFGTLTLAFHSDLFIKWKVTVIYTIFALALLISQWFMKKTLIQRMLGKELELPGFIWKKLNIAWAIFFIACALANIYVAFWLPQDVWVNFKVFGLTALTLVFTVLSVVYIYRHLPREQK

SEQ ID NO: 9627 - protein, 570 aa, Xenorhabdus bovienii
  Peptide sequence Name=Xb4151_4152.C442.gene101.pep
  Gene classification: Gene name=SUL1; Function=Sulfate permease and related transporters (MFS superfamily); Function class=P Inorganic ion transport and metabolism
  Homolog annotation: Query=2..555bp; Hit=7..558bp; Blast score=532; Percent Identity=50.0; E value=1e-151; Homolog= VCA0103 COG0659
MLWKRLYRWMPGLENFCYYRKEYFSHDIRSGLSVAAVALPVAIAYAELMGISAIIGLYACILPMFAYSLFGTSRQLIVGPDAATCAVIAAAVAPLALGNEHVRWQLAIIMTLMTGFWCILASHFRLGAFADFLSRPILKGFINGVAITIMADQLAKVFGLSGLPPELIERLIALPHKLLESHWPTVGISVMTLLVLLSVRFLHSGWPAPLIAMIVSTYVSWQFELNQYGIQIVGNMESGLPIVPMPEFQLGVMRDLVVPSINLAVISFVSFMMTARSFASKNGYQVDADLELRALGIANIASSLSLGFAVSAASSRTAVNDTIGGKTQMVSVIAATTILLVLLFMTEFLGYIPLSSLGIVLIFSTWSLLGLKNIWSYRKRNRRAFTLSIFTLVAVLLVGVIDGIGFAVLLGLLQFLRIIFRPSDQLLGVNEQGMIHSINQGNDIASVDGIMMYRFNSPLTYFNVGYFKKRVLQHVERASRHPTWLVVDAAVSFTHDDVSVFAVLDELITELKEKNVTLVLAGRRTELNYWIKQNRLSRSDEDLIVVPDLYFAIRLIQSKQQVEEKKEEYA

SEQ ID NO: 9628 - protein, 2547 aa, Xenorhabdus bovienii
  Peptide sequence Name=Xb4151_4152.C442.gene102.pep
  Gene classification: Function=RTX toxins and related Ca2+-binding proteins; Function class=Q Secondary metabolites biosynthesis, transport and catabolism
  Homolog annotation: Query=942..1119bp; Hit=3452..3632bp; Blast score =125; Percent Identity=39.0; E value=5e-28; Homolog= VC1451 COG2931
MQRASLKNRQRITVMVYMSKDFKKLLNTLIDRQIEVAGRQTEWFNMSADARADYIRQVNERLQEMQQSTLSVLAAQHFQMQDNPVSVGDQLQTLQQKRQQMDGKSDTPAIKAYKQQLDRDIRLYSRQQAAITHFNSSRKKALDMLNPSGSKTLNAMTLREDAAVKQANLDTEIKHLEQQLTIQVTDSTFSPKYVRLFSRLQAYKDVKTRYTALLETPSKDETKEAKAFSKLIEMPLASDDLPVNISLLMMEERPGYIRMNVALVNASPDGRFKDFFLKDGRLVVPKDGVFNFSFGTPARSLAWQQQYRLKSEPPSFRSPTYTPIRSVLVKIEFVEKYFANYLVSESTEREGFKEHFLDNDRKILLISVDRKVPNQIGIKVSGHTHEVPLAGTLSDLINQNADITSFQTIGLEDFRQNSYDPDRDGLFINIHELERTVGFGNRQYLLEMPQGKTPSKNYLSATPFGVMNVDGDKVSSSHLSKAQTAELYQYNAAFFEKLDRLRDDGAKASRLFEGSSERKVFEQQLVRLLERNHITPAGVLESEYTNDRVRDIKGNNLNKVLWEQAFATSVWENTNNDPLLFKLANRLNNLVFSSTAVDKILKNSYVQSDIAQVKGLLAQQYEQWRIRATEEETQRINRANAEQHPNNPKVQVFNQTEVESSLDRKLLALLLVGSENFGRADEQLYPAVKAALLSNEGRSLCKQVLFHVLRPIADSFSKPAVPVNPHAELMSERGDNKVIINNRLNQPDPYLILNTRPEEQVYHDGSYLIKDDKYRSYNQFRPDPKNKATLYMNDLDTPFVGGISGTTQTVSNVLPELFGDTLSVKEYWNFQMVNAAFMIRNGYHSFFETFYVAARYEPEGADSIGKDMLQMFDEYRAEGREKALKGELYDGVMARILPIINQGLPEAKKFYSPRFMPTLLDQEEGRYRHEPEGIAPFDEKPVSNWEKPVVEAHHEGEVSRFDGQLIIQLENDPVVREAAAKLVGKHLNSVLVQLDARGQYQVVHGDLTILKDKEKIRWQLVGHSRDSGDKPNHQTLAKRTPEALASQLRQFYTDSGVQTSPEHISMVSCSLAGENQQESYALKFARALDQRIRPLSVKAYTTQITVSPEGRKQLMENGNKATLVFNPEDSLWAITVTPGKSVPAEGMVNPPLGNKTAPVPDNVQIDIRLLEMLNRAEDFQQATEQLYSKNALPAEEWLPVLGSLREGESRYSLQFINMARSELPPQTFTTDDRRIIDFIHSYDKDLETVSKTHEYTKGKLTLRTGIPEAEAVHGLNSAFMVKTLIPWFADRKRTTVASEKVPNTLETALRVHTYVNLAQMAHGMLEDGAKLASLYRVVASEGRGVTSSLFSSLSHVSTGVGAGLNIFSVALDGIELAHAQNESQKAVYGTQLAFDSAGLVTTGVGIGAGIFGAPIVAGFASSLAVPLAGLGIGFTALAEAFGRVASDAQAVGNYFADLEAAYQQGGYRQTEKVAADGSRYTVMEPIPGAVTRQLDLRHGHLTFDSQYLYRNDPTYSWGSGKSNYFFWWPGRAADTDKKHAINIREGIGHKQAQINFHFRPRSSDILILPVTMKSYINYEYMILPFVTARNDRGFDVLRRLEEDGRFDFDFYAFPGERVVRRIKPEFVATPIDIILDDEDRDIVIQQLPEKDHGILSYQLTGGKGKYRISLQEGVSLSLQGDTGTHWILDARHIGSNVNTSLSKKDNRQLLHIGSIKITLPEKTDNISLINNAGIFSVKQNKENQWQITESVTNAMQFNSLQALHDHLRQLSNSEHHNRPYLVVEHYQYSPQSRPVGRAFYETGRDRMIYTNVPDAADFLSYAELAKVEGNKAWCYRDTTLWQVDIVSGEVLRQYLPIKFPGSDQGKISSHVMQSNDQLWFVVEQQLDEGCISYTYQVAEEALKLVAVDGNTVMLAGLDKISEKNFVALPVPLDSSDGEFNGLLAPLAANQWFTGDLCAPEHQVKGSPAEVISLSGRVAGVDRHYWLQTDGKQLQNVVRMNRINPDQEDAGILTELKKKNSDLLTLTADFTRVFTTTGDKPGYYFYSHQRHSLYFQQDNGLSGTPASKVAVDDIRSVSIANKQLVALSSRGMLWLADDQGSIRLIGVTADWLQQPHQKGLTAALNQLAQDNPDRFSTLLLLGLQDSNGKPISAWYDSTAGRVVQGGVGLITEHTLTYLGLAEDGSQAWIFDTDNHQLYRQPLSVEADLKLGEKQVLSEKPVAAEPWLRASHQYRSAVRQGNTLRLETPDGAVLLLSVDAKMTDRPVLIAWHVQDRADSQIASAIAALRNEAELPQAVRLFSERSYPAWYLPEEGKMLRSGIVNSDHVLHYLGQVAGQEASYVHDRTTGELWQVSEEQSTLEGNYCFVNRTPESLVLQVGQVPLGEKIRLPQLAGTDRLAITGRSKELYYWLSSPEALTHYRHITIDDRGQGSAIRFSDTCIANLSLWRSDQNLVLLHQASEDTSLFLVNIEQAAQRYMRFESTGTSPLKKMKIIHLLRKMDKLTVLNPDVSCFELVSEEGELRVKPAECTEKLESFSSIPEYSVLIPL

SEQ ID NO: 9629 - protein, 252 aa, Xenorhabdus bovienii
  Peptide sequence Name=Xb4151_4152.C442.gene103.pep
  Homolog annotation: Query=1..243bp; Hit=1..250bp; Blast score=196; Percent Identity=55.0; E value=3e-49; Homolog= Pa|Phot3-136c07.q1k _g14| 21016 - 21780 362 254 aa, chain +
MPITANILYRDSFNFFKNQLLNIFILSILAALVAVLLEHLLMPDGEQLKLLVEIQNAFKESGNTGVKNFVAQLTPEEQFMFLRTAFGILFSNIFGSTLLTANVLLLINAISNGHQTNALHASKSSIGSLPKMFLLMFICTLLIQLGYALMFIPGILLSIAFAFAPVFLLEKGKGVFSSMQESWKLAFANLRLLAPAILLWFAIKLIIALGFARMPDIVLSILNNLLSSILLIYLFRLYMLTKSQNKSANGMQ

SEQ ID NO: 9630 - protein, 51 aa, Xenorhabdus bovienii
  Peptide sequence Name=Xb4151_4152.C442.gene104.pep
  Homolog annotation: Query=1..36bp; Hit=165..200bp; Blast score=62; Percent Identity=80.0; E value=1e-09; Homolog= Pa|Phot2-74c09.q1k _g4| 1777 - 2502 295 241 aa, chain -
MKAKALSLWNKLMLRKRFLIETAGDQLKNISQIEHSNTVVSSVFYWKLSLA

SEQ ID NO: 9631 - protein, 287 aa, Xenorhabdus bovienii
  Peptide sequence Name=Xb4151_4152.C442.gene105.pep
  Gene classification: Function=Uncharacterized BCR; Function class=S Function unknown
  Homolog annotation: Query=1..286bp; Hit=1..285bp; Blast score=368; Percent Identity=59.0; E value=1e-102; Homolog= yniA COG3001
MWQAVNRLLSEHFGDADIHNKTELAGGDIHRSWCVDYGEEHIFIKSNLKEMLPVFKTEAEQLELLARSKTIHVPHVYGVGYDRDHSFLLLEYLPIKPFTAYSAYYFGQQLAKLHQWSEQPKFGFDFDNMLATTIQPNGWQKRWNQFYAEKRIGWQLQLAADRGMVFGNIELIVQIISDKLQSHQPQPSLLHGDLWPTNCASLNSNSAVAFDPACYWGDRECDLAMLPLYPELPLQIFDGYQSIWPLPQGFIERQPLYQLYYLLNRCNLFGGENFIVVQNMIDNILSE

SEQ ID NO: 9632 - protein, 291 aa, Xenorhabdus bovienii
  Peptide sequence Name=Xb4151_4152.C442.gene106.pep
  Gene classification: Gene name=ZnuB; Function=ABC-type Mn2+/Zn2+ transport systems, permease components; Function class=P Inorganic ion transport and metabolism
  Homolog annotation: Query=4..273bp; Hit=1..270bp; Blast score=303; Percent Identity=62.0; E value=2e-82; Homolog= HI0359 COG1108
MSTLIEFITEPFMHDFMQRAIFASVIVGAVCAVLSCYLVLKGWSLMGDAISHAVLPGIVLAFVAGIPLAIGAFLSGIFCAFATGYLKEHSRIKEDTVMGIVFSGMFALGLVLFTRIDTDQHLTHILFGSILGITQHELIQTLCIAGVTLAIVLLKRKDFMLYCFDPNQARVVGLPVKLIHYGLLSLLALTIVASLQAVGIILVIAMLISPGIIAFMLCRSFDRMLIVAMIASVSSSVLGTIISFHIDGETGPCIVIIQAIFFITALIYDQIKLARKKMSKKRTRDIPSPLS

SEQ ID NO: 9633 - protein, 291 aa, Xenorhabdus bovienii
  Peptide sequence Name=Xb4151_4152.C442.gene107.pep
  Gene classification: Gene name=ZnuB; Function=ABC-type Mn2+/Zn2+ transport systems, permease components; Function class=P Inorganic ion transport and metabolism
  Homolog annotation: Query=1..272bp; Hit=1..272bp; Blast score=327; Percent Identity=75.0; E value=1e-89; Homolog= PM0398 COG1108
MMELLLQPFNYNYMVKAMWVSAIVGAVCAFLSAYLMLKGWSLMGDALSHSVVPGVAGAYALGLPYAGGAFFTGMLAALSMTLVRHITRLREDAVIGFIFSTFFAVGLLIVSLNPTSVNVQTIILGNILGISDEDVLQVEIIIAVSFIILMLLWKDLLVVFFDETHARSIGLSPLRLKIIFFTLLSACTVAALQTVGAILVIAMVVTPGATAYLLTDRFKHLLIIAVTIGSLTSAIGAYLSYFLNGATGGVIVTLQTVIFLLAFFFAPKHGMLASRRRAKKESLELTQGGRS

SEQ ID NO: 9634 - protein, 303 aa, Xenorhabdus bovienii
  Peptide sequence Name=Xb4151_4152.C442.gene108.pep
  Gene classification: Gene name=ZnuC; Function=ABC-type Mn/Zn transport systems, ATPase component; Function class=P Inorganic ion transport and metabolism
  Homolog annotation: Query=19..302bp; Hit=11..294bp; Blast score=390; Percent Identity=65.0; E value=1e-108; Homolog= PM0399 COG1121
MSHSSLNHQSLFEHPHLIVDDATVTYNNGHTAIYDASFDITGGTICALVGMNGSGKSTLFKTIMGLVTPSHGKVTLNAQTIKTALKQNIIAYVPQTEDVDWNFPVLVSDVVMMGRYGKMGFLRRPSKRDHQIVDKALERVGLNELRNRQIGELSGGQKKRTFLARALAQEGKVLLLDEPFTGVDVKTENAIVDLLRDLRDEGHLVLVSTHNLGSVPEFCDHVILINRTVLASGPTETTFTQKNLETTFGGVLRHINLSGSELHDDDDLRSLTVITDDERAAVFYGYDRHVPPRQSQKQKENQP

SEQ ID NO: 9635 - protein, 304 aa, Xenorhabdus bovienii
  Peptide sequence Name=Xb4151_4152.C442.gene109.pep
  Gene classification: Gene name=ZnuA; Function=ABC-type Mn/Zn transport system, periplasmic Mn/Zn-binding (lipo)protein (surface adhesin A); Function class=P Inorganic ion transport and metabolism
  Homolog annotation: Query=14..304bp; Hit=5..293bp; Blast score=438; Percent Identity=72.0; E value=1e-123; Homolog= PM0400 COG0803
MNKRRSISAFPIFSMIIALFTLTLFSQQAYADKKFRVVTTFTIIQDMAQNIAGDTAIVESITKPGAEIHDYQPTPKDIIKAQRADLILWNGLNLERWFERFFENMKDIPTAVITEGITPLPIREGPYNKNPNPHAWMSPKNALIYIENIRKSFVKYDPANAEVYNRNAKIYAEKMVKLDAPLRERLSRIPENQRWLVTSEGAFSYLTQDYGFKEVYLWPINAEEQGSPQQVRRVIDTIRTQKIPVVFSESTVSDKPAKQVSKETGAHYGGILYVDSLSTPKGPVPTYIDLLNTTVDTIAKGFNQ

SEQ ID NO: 9636 - protein, 216 aa, Xenorhabdus bovienii
  Peptide sequence Name=Xb4151_4152.C442.gene110.pep
  Gene classification: Gene name=MltE; Function=Soluble lytic murein transglycosylase and related regulatory proteins (some contain LysM/invasin domains); Function class=M Cell envelope biogenesis, outer membrane
  Homolog annotation: Query=52..207bp; Hit=82..237bp; Blast score=186; Percent Identity=57.0; E value=1e-47; Homolog= mltE COG0741
MLLTGCADQEIHQSGVGKQLTAKRLLGNNNVVSSSRKFMARSESTPFDRFIEQAARRYGVDETLIKAIIRVESGFRPEIVSKSNAVGLMQIKASTAGRDAYRIKGKSGQPTMRELKDPETNIDLGTAYISILKKQHLEGITNPETMYYAMIVAYVNGAGALLRTFDSNRTLAINKINRMTPNEFYQYVQNNHPAPQAPRYLWKVKKAYRDLDIINN

SEQ ID NO: 9637 - protein, 94 aa, Xenorhabdus bovienii
  Peptide sequence Name=Xb4151_4152.C442.gene111.pep
MLSTYYNFDKFPADNYLKEKQEIVEWWERKLLSLQGRNLPLRWDITPCGNRGDFLYIRGKYFTFFDGIHHINHFPDFSWIGQRAWTDCHRFLAS

SEQ ID NO: 9638 - protein, 385 aa, Xenorhabdus bovienii
  Peptide sequence Name=Xb4151_4152.C442.gene112.pep
  Gene classification: Gene name=Rnd; Function=Ribonuclease D; Function class=J Translation, ribosomal structure and biogenesis
  Homolog annotation: Query=12..384bp; Hit=2..374bp; Blast score=485; Percent Identity=64.0; E value=1e-137; Homolog= rnd COG0349
MYLNNILSSGYNYQLITSDAQLQSICERAKKHATIALDTEFVRTRTYYPQLGLIQLFDGEQLSLIDPLDISEWQPFRELLTDRDVLKFIHAGSEDLEVFWNSFQCLPTPMIDTQVLAAFIGHPMSCGFATLVAQYLHVELDKSESRTDWLARPLSEKQCEYAAADVYYLLPLADILMAATEQAGYMGAAQDESYLIAQRRKEILMPECAYKDIGNAWQLRPKQLACLKKLAGWRLNQARERDLAINFVIREENLWQVARYMPTSLGELDALGLSGQEIRCHGRRLLAMVAESRDIPDEACPALITNLIDYPGYRTAFKEIKSLVTQISESHQFSVELLASRRQINQLLSSHWKLKSPDYQPELLRGWRGELLAEPVAEILANYPA

SEQ ID NO: 9639 - protein, 50 aa, Xenorhabdus bovienii
  Peptide sequence Name=Xb4151_4152.C442.gene113.pep
  Homolog annotation: Query=2..47bp; Hit=1430..1475bp; Blast score=76; Percent Identity=69.0; E value=1e-13; Homolog= gi|37524951|ref|NP _928295.1| Insecticidal toxin complex protein TcdB1 [Photorhabdus luminescens subsp. laumondii TTO1] gi|36
MYTNTHYYDPIGREILVINAKGWLSRVQYYPWFSISEDKNDTAAEVMTQS

SEQ ID NO: 9640 - protein, 55 aa, Xenorhabdus bovienii
  Peptide sequence Name=Xb4151_4152.C442.gene114.pep
  Gene classification: Function=Putative transposase; Function class=L DNA replication, recombination and repair
  Homolog annotation: Query=3..40bp; Hit=23..60bp; Blast score=60; Percent Identity=76.0; E value=5e-10; Homolog= XF2303 COG3316
MSLIRKAFKRLHYPVDIIAQCVRWYLAYALSLRNLEEMMAPSVALRLTTRHCTAG

SEQ ID NO: 9641 - protein, 146 aa, Xenorhabdus bovienii
  Peptide sequence Name=Xb4151_4152.C442.gene115.pep
  Gene classification: Function=Putative transposase; Function class=L DNA replication, recombination and repair
  Homolog annotation: Query=1..80bp; Hit=106..185bp; Blast score=127; Percent Identity=75.0; E value=4e-30; Homolog= XF2303 COG3316
VKGQWKYLYRAVDTTGQTIDFLLTAKRDAPAALRFFHKAIRHHGEPEVVTIDKSGANTAALDKLNADKPEEEMITIRQNKYLNNLVEQDHRNIKRRTGSMLGFNSFRRAQTLLAGIEVVSMLRKGQYIQPKDNTLSPTEMFYRLVA

SEQ ID NO: 9642 - protein, 193 aa, Xenorhabdus bovienii
  Peptide sequence Name=Xb4151_4152.C442.gene116.pep
  Gene classification: Gene name=AcrR; Function=Transcriptional regulator; Function class=K Transcription
  Homolog annotation: Query=2..182bp; Hit=11..192bp; Blast score=82; Percent Identity=28.0; E value=4e-16; Homolog= mll1598 COG1309
MRIKEFDTDKIVDAAMQVFWLRGYAGTSIQDLVEGTGLSRSSLYNTFENKYGLYQKALEHYSTITSANVELIAGEGTAKELIRKLLSSIAEDELSDSLMRGCMVANASLELAGHDTTIAELVLYNLKRLQKALEKRIQAGQLAGEISKEKNASALAYFFVNTIQGIRIMGKGCPVQERQRCLHDVINIALETL

SEQ ID NO: 9643 - protein, 287 aa, Xenorhabdus bovienii
  Peptide sequence Name=Xb4151_4152.C442.gene117.pep
  Gene classification: Gene name=MmsB; Function=3-hydroxyisobutyrate dehydrogenase and related proteins; Function class=I Lipid metabolism
  Homolog annotation: Query=7..285bp; Hit=1..277bp; Blast score=134; Percent Identity=30.0; E value=1e-31; Homolog= jhp0585 COG2084
MTTQKQLKIAVLGTGLMGAPIARNLQKKGFLVHAWNRTITKALPLQAEGIQIFNTPADAVRDADIIITVLKEGMNVQQVLEEAVSAIRKGAILLQLSTIGVEAAISLDALAEKIGLIYYDAPVQGTKQPAELAQLVILASGPMDKRTEVQPVFDAIGKKTIWVSEQKGSSSCLKLALNSWVFSLTHGIAESLTLAKGLGIDPQLVVDVIKGGPMDSVFFQSKAAAMLSDDYTVSFSIENAVKDAQLVVDAAKQFNLQIDGANVSLTRFEHALKTGHGDKDMAATYII

SEQ ID NO: 9644 - protein, 305 aa, Xenorhabdus bovienii
  Peptide sequence Name=Xb4151_4152.C442.gene118.pep
  Gene classification: Gene name=AraJ; Function=Arabinose efflux permease; Function class=G Carbohydrate transport and metabolism
  Homolog annotation: Query=20..298bp; Hit=65..343bp; Blast score=233; Percent Identity=50.0; E value=3e-61; Homolog= XF1728 COG2814
MSNLNQVNTAFEYDVNPNRLPIWKLLAFTMAGFLTILTETIPAGLLPQISEGLNVSEIQAGQLVTFYALGSVLAAIPVVAVTRNLNRRFLFLFAISGLLVFNSITAISTDYVLTLVARFIAGMAAGVIWGLFAGYARRLVPHRLQGRALAIAGVGQPIALCIGVPLGTMLGTLFDWRGVFWIMSVIALLLLIWIRLAIPDFAGQSSQQRLSIRRVILLPGVRSVLVILFAWILAHNILYTYIAPYLTAFGLSSSIDVVLLVFGIACIIGIWLTGLFVDSGVRILTLLSLILSVIASLLLILSVMY

SEQ ID NO: 9645 - protein, 96 aa, Xenorhabdus bovienii; identical to SEQ ID NO: 5468
  Peptide sequence Name=Xb4151_4152.C442.gene119.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 9646 - protein, 92 aa, Xenorhabdus bovienii; identical to SEQ ID NO: 6203
  Peptide sequence Name=Xb4151_4152.C442.gene120.pep

SEQ ID NO: 9647 - protein, 243 aa, Xenorhabdus bovienii
  Peptide sequence Name=Xb4151_4152.C442.gene121.pep
  Gene classification: Function=Predicted transposase; Function class=L DNA replication, recombination and repair
  Homolog annotation: Query=1..156bp; Hit=1..158bp; Blast score=64; Percent Identity=29.0; E value=9e-11; Homolog= sll0808 COG3335
MGYSLDFRKRVLAYKDKHSLTFEQTSAHFEISIRTLFRWCSKIEPCMTRDKPATKIPDEVLIADVQNFSDDYQWERAKRLGVSQSAIHYALKRLRITPKKTLQHPRADPQARQAFIERISDDEQTGRPIVYLDESGFAQSMPRKQGYSEKGLRCFGTHDWHAKGSCIKWLVAVICFRLFKDEVWPKLMSIAVIATNQNRSKDMGKEMADILVIAVIAAVRSFSWRIPIRPANPALKNRLSISR

SEQ ID NO: 9648 - protein, 30 aa, Xenorhabdus bovienii; identical to SEQ ID NO: 6724
  Peptide sequence Name=Xb4151_4152.C442.gene122.pep

SEQ ID NO: 9649 - protein, 36 aa, Xenorhabdus bovienii
  Peptide sequence Name=Xb4151_4152.C442.gene123.pep
  Homolog annotation: Query=1..36bp; Hit=1..36bp; Blast score=67; Percent Identity=88.0; E value=7e-11; Homolog= gi|18957984|gb|AAL79619.1| xylanase-like protein [Xenorhabdus nematophila]
MKPLICAFENPPISVAVDLLNATEPNFHVTEKHVEL

SEQ ID NO: 9650 - protein, 51 aa, Xenorhabdus bovienii
  Peptide sequence Name=Xb4151_4152.C442.gene124.pep
VIFFLSVQLPQFEVSKITNELALTHPSLLIMFNCSISAQLDFGQKLPAIAQ

SEQ ID NO: 9651 - protein, 161 aa, Xenorhabdus bovienii
  Peptide sequence Name=Xb4151_4152.C442.gene125.pep
  Homolog annotation: Query=3..160bp; Hit=7..166bp; Blast score=194; Percent Identity=56.0; E value=3e-49; Homolog= gi|15964967|ref|NP _385320.1| PUTATIVE AUXIN-BINDING PROTEIN [Sinorhizobium meliloti] gi|15074146|emb|CAC45793.1| PUTATIVE AUXI
MNPVINLKNLTLKPWKQGERYEGSDISFGQQLDLKHLGISYNEVPKGKSSCPFHNHHSVDELFFILEGNGTYRFGSDEFLVKKGDVVGAPAGGQETAHQIINTGSVPLRYLAMSANVSADVIEYPDSGKFQSVLKQQDGKLFHFVGRLSSEVDYWDGEPGA

SEQ ID NO: 9652 - protein, 90 aa, Xenorhabdus bovienii
  Peptide sequence Name=Xb4151_4152.C442.gene126.pep
VLLSALGLGVARAFNPFPKIDKLEAPLVATVGVSLLIPHLTKLPISGYLNFINELLLPCELNPEKGFVLPVIPEISPCGLSEPFAQVVGQ

SEQ ID NO: 9653 - protein, 185 aa, Xenorhabdus bovienii
  Peptide sequence Name=Xb4151_4152.C442.gene127.pep
  Homolog annotation: Query=12..163bp; Hit=103..286bp; Blast score=62; Percent Identity=28.0; E value=5e-09; Homolog= gi|27550095|gb|AAO18078.1| putative type III secreted effector LopT [Photorhabdus luminescens]
MGIYLKMSLLDADEFEGNWVFRFNQTLNFPLKFSSTMQNGVCSSLVMAWVKMHKLGKSHLFLGNIRLPSYIKIVENLKAKSMDGLLFLNENGLSYRHVSCYGGGSIVENLATIHKGYDVLAYGDHAIGLAVTANGIDFFDPNFGCVHFPTGHNFRTWFKEKYWPNRDGIGAIARPCDKIIVHSIA

SEQ ID NO: 9654 - protein, 60 aa, Xenorhabdus bovienii
  Peptide sequence Name=Xb4151_4152.C442.gene128.pep
LPDNLRERLPPYLAVVRKYYLLANGINWTNLSCRVKAGSRLWSIQPAGAKLRYYGQYKAL

SEQ ID NO: 9655 - protein, 141 aa, Xenorhabdus bovienii
  Peptide sequence Name=Xb4151_4152.C442.gene129.pep
  Homolog annotation: Query=1..127bp; Hit=1..127bp; Blast score=185; Percent Identity=68.0; E value=1e-46; Homolog= gi|37528280|ref|NP _931625.1| hypothetical protein [Photorhabdus luminescens subsp. laumondii TTO1] gi|36787717|emb|CAE16831.1|
MYRDMQKILSHWGRWVAQGRVNIGWKSVSAGFENAVTYTCSDKLSCSDEDGMVIDGYVAKLRNVGMSQECDFIEDHYVKGISKRAIGRKFKLSESEVRKRMLVAESFILGCLEVIDEPLEIDLIYGFHGNYAEKRSSALRV

SEQ ID NO: 9656 - protein, 63 aa, Xenorhabdus bovienii
  Peptide sequence Name=Xb4151_4152.C442.gene130.pep
MWPRVDSQYFDHDTNQGVGCMPLFRTIMILKDFFNFGESTELSLIKKLPGSFSVMRYDRVFAS

SEQ ID NO: 9657 - protein, 67 aa, Xenorhabdus bovienii
  Peptide sequence Name=Xb4151_4152.C442.gene131.pep
MHKQTRQYRQLTPEQRYQLQALYTYFGFILTGEGVRNFSHTFCSCEIFTTENFFAVDAFVHTGFSLM

SEQ ID NO: 9658 - protein, 53 aa, Xenorhabdus bovienii
  Peptide sequence Name=Xb4151_4152.C442.gene132.pep
  Homolog annotation: Query=Organism:..Bacillusbp; Hit=halodurans..bp; Blast score=; Percent Identity=; E value=; Homolog= Pa|Phot4 -264a06.p1k_g1| 503 - 1030 256 175 aa, chain +
VNEQVRNNVYFPDTKTFRETLRYFFHVTLPEKAKELTTRLTDNFQILKPASSS

SEQ ID NO: 9659 - protein, 69 aa, Xenorhabdus bovienii
  Peptide sequence Name=Xb4151_4152.C442.gene133.pep
LFRTCSFTYFHNLYMNASHSQDKNHVDTGGRLQLYIRPYYSRRAVGLDVIRWLVPHSINDLYDHAIIQV

SEQ ID NO: 9660 - protein, 40 aa, Xenorhabdus bovienii
  Peptide sequence Name=Xb4151_4152.C442.gene134.pep
MITRLFRFSKSRSYLSLSSLLFDSAIFLHSSLSLNVKVDQ

SEQ ID NO: 9661 - protein, 163 aa, Xenorhabdus bovienii
  Peptide sequence Name=Xb4151_4152.C442.gene135.pep
  Homolog annotation: Query=61..157bp; Hit=286..385bp; Blast score=87; Percent Identity=46.0; E value=1e-16; Homolog= gi|29826660|ref|NP _821294.1| putative transposase InsA homolog [Streptomyces avermitilis MA-4680] gi|29603756|dbj|BAC67829.1
VPRPFEPAYWPFLQRLRKPDVVFLSSVTQGDGVFVSKVAVLAPWIPLWRLQLSEKEREYGHYLLVRRSRDEKQERAYYIVYARRDQAALKTLVQVAGCRWEIESGFEETKGECGLDHYEVRRWQSWHRHITLSLLAHAVLAVLRVQEKKNTGRPGSAQCSGTP

SEQ ID NO: 9662 - protein, 77 aa, Xenorhabdus bovienii
  Peptide sequence Name=Xb4151_4152.C442.gene136.pep
MQSSRFCGYRRKKTPVGRVPLSVAELRKLLSKLMEKAGKTIEQIFHWSDWRRRHQYRAQQCHYRRRANHRLTEQLRL

SEQ ID NO: 9663 - protein, 295 aa, Xenorhabdus bovienii
  Peptide sequence Name=Xb4151_4152.C442.gene137.pep
  Homolog annotation: Query=5..295bp; Hit=1..291bp; Blast score=393; Percent Identity=64.0; E value=1e-108; Homolog= gi|24372594|ref|NP _716636.1| transposase, putative [Shewanella oneidensis MR-1] gi|24346617|gb|AAN54081.1|AE015545_3 transpos
MHNLVDLFCHVDDFCKLFMPQWQKYLIESGQRQRLRPTRMTTSEIMTIIIAFHMSHQRDFKHFYIGFMTVYHKKDFPSLLSYTRFLEAMPTVLAPLSSFFTHLKGQPTGLEFIDSTRIKVCHNLRIPRHQVFKGAAARGKGTMGWFYGFKLHIIVNHLGEIVAAKLTSANVDDRTPVKAFSKGLLDKLYADKGYISKALTEELEMEGITLVTGQRKNMKPKLLAAWDRAMLAKRFIIETINDQLKNITQIEHSRHRSLHGFMLNLLGSLIAYCLKPKKPSLNLSNTEKTGLQVMA

SEQ ID NO: 9664 - protein, 443 aa, Xenorhabdus bovienii
  Peptide sequence Name=Xb4151_4152.C442.gene138.pep
  Gene classification: Gene name=MltE; Function=Soluble lytic murein transglycosylase and related regulatory proteins (some contain LysM/invasin domains); Function class=M Cell envelope biogenesis, outer membrane
  Homolog annotation: Query=1..441bp; Hit=1..443bp; Blast score=421; Percent Identity=50.0; E value=1e-118; Homolog= ZdniR COG0741
MKTKAILFASVLLAGCQSGLQLKTPSQQNTQKMSSTNQQTDGIAEPKDTANWKESPTTQQDLWGHIRDELKMEIPDNNRVREQQNYYLKHKSHLQNVMLRAEPYMYWIVDQLDQRHMPMEVVFLPIVESAFNPHATSYAKAAGLWQIIPSTGHHYGLTQNKWYDARRDVAASTTAALEMLEYLNARFNRDWLLTIAAYNSGEGRVIRAIRDNQAKGKPTDFWSLSLPRETMQYVPKIVALSNIIRHNDKFSLKLPRPNNQQALAKVEVGQQITLSQAAELSGLSLTSIRAYNSGYKQGITSPDGPHYIMLPKRNVKQFKNLLTDEKVLKDIRLAVAQNTRQLLQQSQYTVRSGDTLSAIAKRFKTSHRELQRLNSLKTVDRLKIGQVLKINSSGPITYQVRKGDSFFSIAKHHGVNLNDLMSWNKSIRIKDIKPGINLTLYPN

SEQ ID NO: 9665 - protein, 265 aa, Xenorhabdus bovienii
  Peptide sequence Name=Xb4151_4152.C442.gene139.pep
  Gene classification: Gene name=GloB; Function=Zn-dependent hydrolases, including glyoxylases; Function class=R General function prediction only
  Homolog annotation: Query=15..265bp; Hit=1..251bp; Blast score=266; Percent Identity=52.0; E value=1e-71; Homolog= gloB COG0491
MSSSFQPTINMRHIMELIRIPALSDNYIWLLCDEDKHCVIVDPSESQPVIDILAANQLIPAAILLTHHHHDHVGGVAGLLKQYADLPVYGPEETRSKGTTHIVHEHDTIETGHYCFHIMELPGHTLGHIAFYQAPYLFCGDTLFSGGCGRLFEGTAEQMFSSLEKIMSLPDETLICCAHEYTAANMKFARAVLPENETIHDYYNKIISIRENNKPTVPTTLQIEKKVNVFLNCHNIDLQKNIGIKPNSKPLSSVFQQLRIYKDRF

SEQ ID NO: 9666 - protein, 238 aa, Xenorhabdus bovienii
  Peptide sequence Name=Xb4151_4152.C442.gene140.pep
  Gene classification: Gene name=SmtA; Function=SAM-dependent methyltransferases; Function class=Q Secondary metabolites biosynthesis, transport and catabolism
  Homolog annotation: Query=1..238bp; Hit=7..245bp; Blast score=255; Percent Identity=51.0; E value=2e-68; Homolog= ZyafS COG0500
MQSARSIKQITSPASWAELPWGEYYRVALERQLELWWPKIFGLHLAKLGNLSAEIDSRTCPISHQFNIGLMEGSMDVIADPYCLPFEAKSVDACLLAHMLTYSADPHWLLREVDRIITDDGWLIISGFNPISLLGLRKVLLPIHRRQAYEAQMFSMLRQVDWLSLLNYEIVHHVSFHVLPWQSGKSFCNRSASMFGCMNMIIARKRTIPLTLNPMWATSLKPKFRNVLGAAKDLHRRQ

SEQ ID NO: 9667 - protein, 156 aa, Xenorhabdus bovienii
  Peptide sequence Name=Xb4151_4152.C442.gene141.pep
  Gene classification: Gene name=RnhA; Function=Ribonuclease HI; Function class=L DNA replication, recombination and repair
  Homolog annotation: Query=1..151bp; Hit=1..151bp; Blast score=242; Percent Identity=76.0; E value=1e-64; Homolog= rnhA COG0328
MSKKVEIFTDGSCLGNPGPGGYGVVLRYQQHEKTLSKGYFRTTNNRMELMAAIAGLESLTCPCNVILTTDSQYVRQGITQWIHNWKKRGWKKADKSPVINVDLWQRLDQAIADHDIDWRWVKGHAGHRENEQCDELARTAANSPTLPDNGYTESAN

SEQ ID NO: 9668 - protein, 249 aa, Xenorhabdus bovienii
  Peptide sequence Name=Xb4151_4152.C442.gene142.pep
  Gene classification: Gene name=DnaQ; Function=DNA polymerase III epsilon subunit and related 3'-5' exonucleases; Function class=L DNA replication, recombination and repair
  Homolog annotation: Query=1..242bp; Hit=1..242bp; Blast score=379; Percent Identity=72.0; E value=1e-105; Homolog= dnaQ COG0847
MSTAITRQIVLDTETTGMNKLGVHYEGHNIIEIGAVEVINRRLTGRHFHLYIKPERLVDPEAFEVHGISDEFLQDKPTFADIADEFIEFIRGAELIIHNATFDIGFMDYEFRKLNRDIPPTADFCTITDSLVLARQLFPGKRNNLNALCDRYQIDNSKRTLHGALLDAEILSDVYLTMTGGQTSLTFSMEGEISGGAQMAEIQKITRPQTGLKVIYASDEELLQHESRLDLVEKKGGSCLWRPKPEQLQ

SEQ ID NO: 9669 - protein, 104 aa, Xenorhabdus bovienii
  Peptide sequence Name=Xb4151_4152.C442.gene143.pep
MAGLQSLTTLIMVSERFCLASLYVKTFIMTIQFQLFEGVNSFTRIICTMYCTFKIQSTLEHNDISTSACMVVISHQERAILLAVAESNRKKKKPRVKNSGLIDS

SEQ ID NO: 9670 - protein, 87 aa, Xenorhabdus bovienii
  Peptide sequence Name=Xb4151_4152.C442.gene144.pep
  Gene classification: Function=Uncharacterized ACR; Function class=S Function unknown
  Homolog annotation: Query=4..84bp; Hit=10..90bp; Blast score=96; Percent Identity=61.0; E value=5e-21; Homolog= yefM COG2161
MVIMKVLTYSEARQNLSETMISVVNDCSPAIITRKNGESCVLMSLSDYESLQETAYLMRSPNNVNRLMDSIAELRAGKGKAKELDLD

SEQ ID NO: 9671 - protein, 84 aa, Xenorhabdus bovienii
  Peptide sequence Name=Xb4151_4152.C442.gene145.pep
  Homolog annotation: Query=1..84bp; Hit=1..84bp; Blast score=129; Percent Identity=72.0; E value=1e-29; Homolog= gi|24113399|ref|NP _707909.1| orf, conserved hypothetical protein [Shigella flexneri 2a str. 301] gi|33347611|ref|NP_877527.1| hy
MKITFSDSAWEDYLYWQQTDKAILKRINQLIKDIRRQPFEGIGKPEPLKHNLSGFWSRRITEEHRLIYAIEEDQIMIAACRYLY

SEQ ID NO: 9672 - protein, 181 aa, Xenorhabdus bovienii
  Peptide sequence Name=Xb4151_4152.C442.gene146.pep
  Gene classification: Gene name=WecD; Function=Histone acetyltransferase HPA2 and related acetyltransferases; Function class=K Transcription
  Homolog annotation: Query=20..179bp; Hit=12..171bp; Blast score=126; Percent Identity=43.0; E value=1e-29; Homolog= PA1885 COG0454
MSKFNLTSDSTSIPAIILLDSIHAKRDELINLLHDCVESDASIGFIAPLDVNEAEQYWQNVEADMVSGSRVLLIALEGEELAGSVQLSFCQKKNSLHRAEVEKLIVHTAYRQRGIGRMLVNALERLARQYQRRLLVLDTRTGDPASALYRKCGFIEAGQIPQFALNSSGEFAGTTFFYKLI

SEQ ID NO: 9673 - protein, 74 aa, Xenorhabdus bovienii
  Peptide sequence Name=Xb4151_4152.C442.gene147.pep
MKLSPICANAPSVVQIDLKICHNNGINQRIYARGKLRLFPLSGINDCGLYAALRKLVLMYINAFIRLGVKNDHS

SEQ ID NO: 9674 - protein, 664 aa, Xenorhabdus bovienii
  Peptide sequence Name=Xb4151_4152.C442.gene148.pep
  Gene classification: Gene name=TktA; Function=Transketolase; Function class=G Carbohydrate transport and metabolism
  Homolog annotation: Query=1..663bp; Hit=1..663bp; Blast score=1112; Percent Identity=80.0; E value=0; Homolog= tktA COG0021
MTTRKTLANAVRFLSMDAVQKAKSGHPGAPMGMADIAEVLWRDYLNHNPVNPNWADRDRFVLSNGHGSMLIYSLLHLTGYDVSIDDLKNFRQLHSKTPGHPEYGYTAGVETTTGPLGQGVANAVGFAIAERTLAAQFNRPGHDIVDHHTYVFMGDGCMMEGISHEVCSLAGTLKLGKLIAFYDDNGISIDGEVEGWFTDDTAARFDAYGWHVIRGVDGHDSDAIKAAIEEAQKETGKPSLLMCKTIIGFGSPNKAGKEECHGSPLGDAEIEATRKALGWEHPAFDVPQDIYAGWDAKAAGKAKEATWEEKFAAYAKAHPELAAEFNRRTRGELPANWEAESKAFIENLQQNPASIASRKASQNALEAFGKVLPEFMGGSADLAPSNLTMWSGSKPLNEVQDGNYIHYGVREFGMSAIMNGIALHGGFVPYGATFLMFVEYARNAVRMAALMKIRSIFVYTHDSIGLGEDGPTHQPVEQIASLRVTPNMSTWRPCDQVESAVAWKYAIERQNGPTALIFSRQNLAQQARTAEQLANIEKGAYILKDCAGQPELLLIATGSEVELAVKAADQLSAAGRQVRVVSMPSTDAFDKQDAAYREAVLPAAVSARVAIEAGIADYWFKYVGLNGAIVGMETFGESAPADLLFKEFGFTVENVVAKATSLLK

SEQ ID NO: 9675 - protein, 38 aa, Xenorhabdus bovienii
  Peptide sequence Name=Xb4151_4152.C442.gene149.pep
MQPLRITEQLPIVRMIHHKINQIVTDKTFYAPKLKRFS

SEQ ID NO: 9676 - protein, 339 aa, Xenorhabdus bovienii
  Peptide sequence Name=Xb4151_4152.C442.gene150.pep
  Gene classification: Gene name=GapA; Function=Glyceraldehyde-3 -phosphate dehydrogenase/erythrose-4-phosphate dehydrogenase; Function class=G Carbohydrate transport and metabolism
  Homolog annotation: Query=1..339bp; Hit=1..339bp; Blast score=540; Percent Identity=76.0; E value=1e-153; Homolog= epd COG0057
MTIRIAINGFGRIGRSILRALYESGRQTEISVIAINELADAEGIAHLLKYDSSHGRFAWDVRLNNNLLLVGDDSIRLFHQPDISALPWKELGIDIVLDCTGKYGDRADGEAHIASGAKKVLFSHPGGNDLDATVVYGVNHHELVAEDCIVSNASCTTNCIIPIIKLLDDAFNIESGTVTTIHASMNDQPVIDAYHSDLRRTRAASQSIIPVDTKLSAGITRIFPKFSDRFEAISVRVPTINVTAIDLSVTVSAAVDVGDVNQLLQESAGSSFRGIVDYTDLPLVSTDFNHDPHSAIVDGTQTRVSGNHLIKTLVWCDNEWGFANRMLDTTLVMAATGFK

SEQ ID NO: 9677 - protein, 388 aa, Xenorhabdus bovienii
  Peptide sequence Name=Xb4151_4152.C442.gene151.pep
  Gene classification: Gene name=Pgk; Function=3-phosphoglycerate kinase; Function class=G Carbohydrate transport and metabolism
  Homolog annotation: Query=1..385bp; Hit=1..385bp; Blast score=639; Percent Identity=86.0; E value=0; Homolog= pgk COG0126
MSVIKMTDLDLAGKRVLIRADLNVPVKDGKVTSDARIRASLPTIVSALNQGAKVMVTSHLGRPTEGEYNEEFSLQPVVDYLKEKLSSPVRLEKNYLDGVEVAEGELVVLENVRFNKGEKKDDETLSKHYAALCDVYVMDAFGTAHRAQASTHGVAKFAAIACAGPLLSGELEALGKALYNPARPMVAIVGGSKVSTKLTVLDSLSKIADQLIVGGGIANTFVAAEGHNVGRSLYEDDLIPEAKKLLESCDIPVPTDVRVATEFSETAEATLKSTSEIKDEEQILDLGDASAERLVEILKDAKTILWNGPVGVFEFPNFRKGTEIIARAIAESDAFSIAGGGDTLAAIDLFGIADKISYISTGGGAFLEFVEGKKLPAVVMLEERANSN

SEQ ID NO: 9678 - protein, 358 aa, Xenorhabdus bovienii
  Peptide sequence Name=Xb4151_4152.C442.gene152.pep
  Gene classification: Gene name=Fba; Function=Fructose/tagatose bisphosphate aldolase; Function class=G Carbohydrate transport and metabolism
  Homolog annotation: Query=1..358bp; Hit=26..384bp; Blast score=650; Percent Identity=84.0; E value=0; Homolog= Zfba COG0191
MSKIFDFVKPGVITGDDVQKVFAVAKENNFALPAVNCVGTDSINAVLETAAKVRAPVIIQFSNGGAAFVAGKGLKAEGQQAAILGSISGAHHVHQMAEYYGVPVILHTDHCARKLLPWIDGLLDAGEKHYVQTGKPLFSSHMIDLSEESLEENIEICGQYLARMAKIDMTLEIELGCTGGEEDGVDNSHLDSSSLYTQPEDVAYAYEKLNAISPRFTIAASFGNVHGVYKPGNVKLTPKILRNSQDYVSEKFNLPHNSLDFVFHGGSGSTAEEIQEAVSYGVVKMNIDTDTQWATWEGILNYYKKNEGYLQGQLGNPEGADKPNKKFYDPRVWLRAAQVSMIVRLEQAFKELNAVDVL

SEQ ID NO: 9679 - protein, 901 aa, Xenorhabdus bovienii
  Peptide sequence Name=Xb4151_4152.C442.gene153.pep
  Homolog annotation: Query=1..671bp; Hit=1..692bp; Blast score=878; Percent Identity=65.0; E value=0; Homolog= gi|3265044|gb|AAC38630.1| insecticidal toxin complex protein TccC [Photorhabdus luminescens] gi|16416915|gb|AAL18473.1| toxin comp
MSRFNPALYNKTPGVSVLDNRGLNVRDMGYHRAEVGSATDTRITRHQYNTQGYLSQSIDPRLHASQQNDSTIKPNFIWQYDLNGQILHTDSVDAGRTVTLNDIEGRPIMAVTATEVTQKWQYEAPSLPGRLLSVSEQAVNVSPRITERLFWSDNNQQAKDNNLVGQCVKHYDPAGLSQLQSGSLTGAMLRQSRQFILDDQKVNWTDNNLGALDNTLHTTQSTVDATSALLTQTDTKGNLQRLDYDIAGQLKGSWLTLKDQNEQIILKSLTYSAAGQKLQEVHGNGVITDYTYEPETQRLISITTHRPSDAKVLQDLRYDYDPVGNVLNIRNDTEATRFWRNQKVVPENSYSYDSLYQLINATGREMANIGQQSNKLPPPVSPIDSSTYTNYTRNYSYDNAGNLLQIRHSSPATNNNYTLNITVSNRNNHAVSQDLAEKPEQVDAQFDAGGHQMNLIPGQSLKWNSRGELHQVNKTGSSDNLEEYRYDSSGKRVLKIGEQQRVTYLTGLELRTTKNGNSITEDLQVISVGEAGRAQVRVLHWESGKPEDIDNNQLRYSYDNLLSSSQLELNGTGQIITEEEYYPYGGTSVWATRNETEAHYKTIRYSGKERDATGLYYYGFRYYQPRVGRWLSADPAGTIDGLNLYRMVRNNPITFKDDKGLAPEPPQETETQLLIHEFKEGDILYGLDNPRTTALSDLEKVGFKRMSKSTANSGNVFSRLRQSFRKKNNTKRNILIQNDITNATWDASKPREYATDKSIKKEVHDYQRVIGFRAFLSEHPKYNVKNDNELITALINNPSITTSVPLWQKTSKAGLGYQFFERKAPVHFLVDTIGDDINTVISKQGHGASITSSELRWLYRHKDTKEVKENLKFWRDGKAVPHSEVFSEAKWSSYQPKHRYS

SEQ ID NO: 9680 - protein, 59 aa, Xenorhabdus bovienii
  Peptide sequence Name=Xb4151_4152.C442.gene154.pep
VTLTPRQGEKSSQLSSARCKATVSIIVIKQPKIYIFRTDATNIYPIDFKLKDEGYIFFA

SEQ ID NO: 9681 - protein, 352 aa, Xenorhabdus bovienii
  Peptide sequence Name=Xb4151_4152.C442.gene155.pep
  Gene classification: Gene name=AmpC; Function=Beta-lactamase class C and other penicillin binding proteins; Function class=M Cell envelope biogenesis, outer membrane
  Homolog annotation: Query=35..317bp; Hit=36..320bp; Blast score=85; Percent Identity=27.0; E value=8e-17; Homolog= BS_pbpE COG1680
MIDTVALQRALDNWLLFSPCLGVNVTLSDSLGNNWHSASGFEQFENKTEMKALQQCYIYSITKTFTAIRILQLVEQEKLALDSRLTEILGHCGLDPAITIRQLLNHTAGVPNYTEFDGYDAATKASPGTPWSYDYTLALSGEKGMKFSPGEGWDYSNTGYMLLVKVIKVVTGESFQKNINDGIILPLELTKTYVASDIDRGTVIPGFSRWLNNNDVMENITGIYHPHWCKTELMVSTTKEICQVYQALFQGKILSPALLAEMCKPISIGRSAGLFYRKPSYGMGLMIDPEWGHGGLFGHGGEGPGFNTWALYLPDYQGRALAICIFCNTSMAGQPVYLVKDFLRVLGAPFAE

SEQ ID NO: 9682 - protein, 40 aa, Xenorhabdus bovienii
  Peptide sequence Name=Xb4151_4152.C442.gene156.pep
MQEEAKKEDRRKARVFVGIVITREFKKVEKDWLELLSWLN

SEQ ID NO: 9683 - protein, 459 aa, Xenorhabdus bovienii
  Peptide sequence Name=Xb4151_4152.C442.gene157.pep
  Gene classification: Gene name=UhpC; Function=Sugar phosphate permease; Function class=G Carbohydrate transport and metabolism
  Homolog annotation: Query=1..459bp; Hit=1..459bp; Blast score=685; Percent Identity=80.0; E value=0; Homolog= PM1341 COG2271
MFKILDQIRKPTLDLPVEERRKMWFKPFIQSYLVVFIGYMAMYLVRKNFNIAQNDMISTYGLSMTELGLIGLGFSITYGVGKTVVSYYADSKNTKQFLPFMLILSGLAMIGFSMSMGSSNISVFLMVACYALSGFFQSIGGPASYSTITKWTPRNKRGTYLGLWNMSHNVGGAGAAGVALFGANYLFDGHVIGMFVFPSIIALIIGFIGLRYGSDSPESYGLGKVEELFDEAVSEEDIAAEENQMTKREIFVEYVLKNKVIWLLCFANIFLYVVRIGIDQWSTVYAYQELGHSKETAISGFTLFEVGALVGTLMWGYLSDLANGRRALVACVSLGLIIVCLEFYQHATSEFMYLSSLFVLGFLVFGPQLLIGVAAVGFVPKKAISVADGVKGTFAYLIGDSFAKLGLGMIADGVPIFGLTGWKGTFVALDASAFICIGLLAFVVIAEEKKIRKAKKSSR

SEQ ID NO: 9684 - protein, 209 aa, Xenorhabdus bovienii
  Peptide sequence Name=Xb4151_4152.C442.gene158.pep
  Gene classification: Gene name=CitB; Function=Response regulator containing a CheY-like receiver domain and an HTH DNA-binding domain; Function class=T Signal transduction mechanisms
  Homolog annotation: Query=1..193bp; Hit=1..188bp; Blast score=250; Percent Identity=67.0; E value=7e-67; Homolog= uhpA COG2197
MIKVALVDDHVVVRSGFAQLMSLESDIEIVGEFSSCAEARHGLPGSGATVCILDISMPDESGLSLLQDLPSGIHCIMLSVHDSVTMVENALKAGARGYLSKRCSPDELLQAVRTTANNGCYLTPDIALKLASSKNSQTSLDHLTKRERQVGEMLARGMDVKVVAAELGLSHKTVHVHRANVMSKLGVTNNVGLVNYFTTSDLDPVHHFV

SEQ ID NO: 9685 - protein, 122 aa, Xenorhabdus bovienii
  Peptide sequence Name=Xb4151_4152.C442.gene159.pep
  Gene classification: Function=Predicted transposase; Function class=L DNA replication, recombination and repair
  Homolog annotation: Query=38..120bp; Hit=106..188bp; Blast score=137; Percent Identity=80.0; E value=2e-33; Homolog= Z2082 COG3328
MEKAGKTIEQILHWSDWRRRHQYRAQQCHCRGRGNDRLTELKNRGLNDILIACVDGLKGFPDAINAVYSETRIQLSIVHMLRNNLRFVAGKDNKAVTRDLKTIYQVPTEDAALQALDAFSET

SEQ ID NO: 9686 - protein, 78 aa, Xenorhabdus bovienii
  Peptide sequence Name=Xb4151_4152.C442.gene160.pep
MLSNRAARRLLGMPHKLSNSKRKVIISLLNLTSSDSKHQIPEQLRHSSFVCMKKDAYSGKITYHPGNTFYPEHLNTSR

SEQ ID NO: 9687 - protein, 460 aa, Xenorhabdus bovienii
  Peptide sequence Name=Xb4151_4152.C442.gene161.pep
  Gene classification: Gene name=CysS; Function=Cysteinyl-tRNA synthetase; Function class=J Translation, ribosomal structure and biogenesis
  Homolog annotation: Query=1..460bp; Hit=1..461bp; Blast score=768; Percent Identity=80.0; E value=0; Homolog= ZcysS COG0215
MLKIFNTLSRQKEEFKPIHEGKVGMYVCGITIYDLCHIGHGRTFVAFDVIARYLRYLGYDLTYVRNVTDVDDKIIKRATENNESCDALTTRMLSEMHSDFDALNIQRPDSEPRATQHISEIIQITEELINRGHAYVADNGDVMFSIDTNPDYGLLSRQDLEQLQAGARVEIADVKRNPMDFVLWKMSKPGEPSWESPWGVGRPGWHIECSAMNGKQLGQHFDIHGGGSDLMFPHHENEIAQSTCAHGGPYVNYWMHSGMVMVDKEKMSKSLSNFFTIRDVLGYYDAETVRYFLLSGHYRSQLNYTEENLKQARTALERLYTALRGTDKSAQPTGSEAFEARFTEAMNDDFNTPEAYSVLFDIAREINCLKTENLAAANGLAAELRKLAGILGLLEQEPEQFLQGGAHVDDDVAQIEALIKQRNDARTNKEWALADAARDQLNAMRIELEDGPQGTTWRRK

SEQ ID NO: 9688 - protein, 164 aa, Xenorhabdus bovienii
  Peptide sequence Name=Xb4151_4152.C442.gene162.pep
  Gene classification: Gene name=PpiB; Function=Peptidyl-prolyl cis -trans isomerase (rotamase) - cyclophilin family; Function class=O Posttranslational modification, protein turnover, chaperones
  Homolog annotation: Query=1..164bp; Hit=1..164bp; Blast score=282; Percent Identity=85.0; E value=1e-76; Homolog= ZppiB COG0652
MVTFHTNFGDVVINTFTDKAPVTVENFLNYCREGFYDNTIFHRVINGFMIQGGGFEPGMKQKTVKSPIQNEANNGLKNTRGTLAMARTNDPHSATAQFFINVVDNDFLNFRSERPDGWGYCVFAEVVEGMDVVDKIKGVSTGRSGMHQDVPNEDVIVERVTISE

SEQ ID NO: 9689 - protein, 240 aa, Xenorhabdus bovienii
  Peptide sequence Name=Xb4151_4152.C442.gene163.pep
  Gene classification: Function=Uncharacterized BCR; Function class=S Function unknown
  Homolog annotation: Query=1..240bp; Hit=1..240bp; Blast score=336; Percent Identity=65.0; E value=1e-92; Homolog= ybbF COG2908
MCTLFIADLHLNEQEPAITAGFLRFLREDVIYAESLYILGDFFDYWIGDDDPNSLHSEIAQALNELKQKGISCYFIHGNRDFLLGSRFARESGLILLPQEKVLELYGKRILILHGDTLCTDDTGYQQYRKRVHTPWIQRLFLLLPLFIRLKIAAKMRAGSQYANSQKSESIMDVNQQAVIEHFEKYQVDWMIHGHTHRPAIHDIQITDKTVHRGVLGAWHHQGSMFKVTKTSIELMFFPF

SEQ ID NO: 9690 - protein, 83 aa, Xenorhabdus bovienii
  Peptide sequence Name=Xb4151_4152.C442.gene164.pep
MAILAWCCIEVAEIAVAGSGRAVITQMLLYWVSSRTNIYEEADHIMRMVQGKRLRCLIYRFLQKFSTGIRRGKTSVQSTFSSL

SEQ ID NO: 9691 - protein, 181 aa, Xenorhabdus bovienii
  Peptide sequence Name=Xb4151_4152.C442.gene165.pep
  Gene classification: Gene name=PurE; Function =Phosphoribosylcarboxyaminoimidazole (NCAIR) mutase; Function class=F Nucleotide transport and metabolism
  Homolog annotation: Query=14..178bp; Hit=2..166bp; Blast score=213; Percent Identity=80.0; E value=9e-56; Homolog= purE COG0041
MTARPDPATAISATSMQHHAKIAIVMGSKSDWATMQHAADILTSLDIPFHVEIVSAHRTPDKLFHFAEKAKENGYDVIIAGAGGAAHLPGMLAAKTLVPVFGVPVQSAALSGVDSLYSIVQMPKGIPVGTLAIGKAGAANAALLAAQVLALHDGMLFQRLSDWRSAQTQDVLNNPDPREDA

SEQ ID NO: 9692 - protein, 355 aa, Xenorhabdus bovienii
  Peptide sequence Name=Xb4151_4152.C442.gene166.pep
  Gene classification: Gene name=PurK; Function =Phosphoribosylaminoimidazole carboxylase (NCAIR synthetase); Function class=F Nucleotide transport and metabolism
  Homolog annotation: Query=1..353bp; Hit=1..353bp; Blast score=516; Percent Identity=73.0; E value=1e-146; Homolog= ZpurK COG0026
MKPVCVLGNGQLGRMLRQAGEPLGIAVYPIGLDAEPESVPYQSSVITAEIERWPETALTRELAHHKAFINRDIFPLLADRLPQKQLMDSLGLATAPWRLLSDPSQWPQLFAELGDFVIVKRRTGGYDGRGQWRIRPGDEAELPAEIYGECIVEQGIPFSGEVSLVGARNVQGQSVFYTLTHNLHQEGILRTSVALPNAGNQLQQQAEKMLSALMDHLNYVGVMAMECFIVGDNLLINELAPRVHNSGHWTQNGASISQFELHLRAILDLPMPQPEIMALSVMVNLIGTELNPEWLGLPLVHLHWYEKEVRPVRKVGHLNLTHADKHALQTTLQALILLLPAEYQSGLEWAKIKLN

SEQ ID NO: 9693 - protein, 83 aa, Xenorhabdus bovienii
  Peptide sequence Name=Xb4151_4152.C442.gene167.pep
  Gene classification: Gene name=RibC; Function=Riboflavin synthase alpha chain; Function class=H Coenzyme metabolism
  Homolog annotation: Query=12..83bp; Hit=148..217bp; Blast score=64; Percent Identity=47.0; E value=2e-11; Homolog= NMA1416 COG0307
MRLTIFINYIKYFFLKGFIGLDGCSLTINGIDEENKTVALNLIPETLRMTNFNKIKAGDLLNNEIDQMTRTTVDTLSRTLLKK

SEQ ID NO: 9694 - protein, 62 aa, Xenorhabdus bovienii
  Peptide sequence Name=Xb4151_4152.C442.gene168.pep
MLPQKMGRSGVFFACWTVTEKRYLYSNFIVKETTLFNIDWFLLINGIGLTRQKTNNLMGETL

SEQ ID NO: 9695 - protein, 346 aa, Xenorhabdus bovienii
  Peptide sequence Name=Xb4151_4152.C442.gene169.pep
  Gene classification: Gene name=Tdh; Function=Threonine dehydrogenase and related Zn-dependent dehydrogenases; Function class=E Amino acid transport and metabolism
  Homolog annotation: Query=1..343bp; Hit=1..344bp; Blast score=405; Percent Identity=58.0; E value=1e-113; Homolog= SPy1111 COG1063
MKALVYHGTGKKQWETKSPPQLIESTDAIVRIIKTTICGTDLHILKGDVPTVDAGRTLGHEGIGIVESVGESVRNIKVGDKVIISCITVCGRCRYCKRQLYSHCEDGGWILGHKIDGTQSEKVRIPHADNSLHRLPEGIDEEAALMLSDILPTGLEIGVINGKVQPGNTIALIGAGPVGLSALLASQFYSPAHIIMIDTDDNRLHVAQQFGADTVINPTHQNVVEVIQKLTDGIGVDVAIECVGIPATFKICQDIITAGGYIANVGVHGKSVELHLEDLWIKNITITTGLVNTSSTPMLLKSLQSGKISPEKLVTHRYSLSEIKTAYEVFGNAEKEKALKIVLTAE

SEQ ID NO: 9696 - protein, 77 aa, Xenorhabdus bovienii
  Peptide sequence Name=Xb4151_4152.C442.gene170.pep
  Homolog annotation: Query=12..62bp; Hit=50..100bp; Blast score=94; Percent Identity=78.0; E value=4e-19; Homolog= gi|13096080|gb|AAK09056.1| CS12 fimbria downstream hypothetical protein [Escherichia coli]
MTCSSLNATEPDDHLHQFHIYGKNYGISYSGGIAFPYNPYKITPDDFEFDVGDRFTYEYNFYVQIALYLIIPLFTLR

SEQ ID NO: 9697 - protein, 35 aa, Xenorhabdus bovienii
  Peptide sequence Name=Xb4151_4152.C442.gene171.pep
MILLNKIIEVFALPSSLRDCPGSKYKRGTREYTEQ

SEQ ID NO: 9698 - protein, 107 aa, Xenorhabdus bovienii
  Peptide sequence Name=Xb4151_4152.C442.gene172.pep
  Homolog annotation: Query=63..107bp; Hit=114..158bp; Blast score=74; Percent Identity=75.0; E value=3e-13; Homolog= gi|21233682|ref|NP _639980.1| transposase [Proteus vulgaris] gi|21202866|dbj|BAB93582.1| transposase [Proteus vulgaris]
MLGFIKKGECLLCERTAVRCGFIKEQAEPFPIHQLCRFMPGRQNPFGYFLMNNENDTERQPRYLKTPEGWSYLAIVMDLYSRRLVGWDMSTETDTTLISQALMKAYH

SEQ ID NO: 9699 - protein, 83 aa, Xenorhabdus bovienii
  Peptide sequence Name=Xb4151_4152.C442.gene173.pep
MDRNKWKKVVGWFREKIQNNFWAKWGYIPIIMFYPNSLKFWFREYAPEFLPNFVTDIIFSIPIVFAVIYIPLLLIDYLEKTRK

SEQ ID NO: 9700 - protein, 74 aa, Xenorhabdus bovienii
  Peptide sequence Name=Xb4151_4152.C442.gene174.pep
MEARAAAPRTTEEIWDSIIKSVDEIDVLTQLMIGLKKDIKDDNGRSCCMSDIALYSTKQRAGNRILGSGGVTTR

SEQ ID NO: 9701 - protein, 120 aa, Xenorhabdus bovienii
  Peptide sequence Name=Xb4151_4152.C442.gene175.pep
MEDLSLKQQQELIAVCAANPAVCKEKYGDIPANGILVRQAIDRVLGDDVPSRMKNDMSSLLAQQIEAEGVVSRPRRGSVNGVTIICGGHMNSRQRYKLRWKLGLLLPERPRKSGTQSLNQ

SEQ ID NO: 9702 - protein, 65 aa, Xenorhabdus bovienii
  Peptide sequence Name=Xb4151_4152.C442.gene176.pep
LQTAGFAAQTAISSCCCLRLRSSISFTICLQSPRASHSLAFAAKSSICFAVKKLFSTASQLAFKG

SEQ ID NO: 9703 - protein, 121 aa, Xenorhabdus bovienii
  Peptide sequence Name=Xb4151_4152.C442.gene177.pep
  Homolog annotation: Query=1..120bp; Hit=1..122bp; Blast score=127; Percent Identity=54.0; E value=5e-29; Homolog= gi|37524242|ref|NP _927586.1| hypothetical protein [Photorhabdus luminescens subsp. laumondii TTO1] gi|36783665|emb|CAE12517.1|
MKKELFSQFDMGLGLDLIIVSYFERMYEDGKFLDAIELLSKKWTLSVDGAYCNFPDMDSYDETEHFEGVEFAIGYPPTEEERVIVTEETCYHYVRLACEKYLQLHPEDKDKLSILLDQLPC

SEQ ID NO: 9704 - protein, 103 aa, Xenorhabdus bovienii
  Peptide sequence Name=Xb4151_4152.C442.gene178.pep
  Gene classification: Gene name=FhaB; Function=Putative hemagglutinin/hemolysin; Function class=M Cell envelope biogenesis, outer membrane
  Homolog annotation: Query=2..102bp; Hit=536..649bp; Blast score=88; Percent Identity=39.0; E value=1e-18; Homolog= NMB0502 COG3210
VKILSEAPTKVPGITEIKYQVPTKDRAGNLTGEYKPAIQTKTVYDPKVFTDQKILELGQQASTKGYKDAMASSNGQATAVVDGVSFRIYVDKTTGRVKNFHPN

SEQ ID NO: 9705 - protein, 190 aa, Xenorhabdus bovienii
  Peptide sequence Name=Xb4151_4152.C442.gene179.pep
  Gene classification: Function=Transposase; Function class=L DNA replication, recombination and repair
  Homolog annotation: Query=138..189bp; Hit=485..536bp; Blast score=78; Percent Identity=63.0; E value=4e-15; Homolog= Z1161 COG3436
MTSDKLESQLYPARTNPVMTDIPEPVLAGEPVVRKRSRRPNFPLAFKISLAEKSLQPGANVAQLAREHGINDNLLFNWRNLYKRGLLSSRNDSSWLLPVTLAEITVPVEQPVPAMQQPAAKEPCCELALPSGILRIRGERAAILYSLIGSCRLNGVEPEAWLRYTISHIADWPSNKVHELLPWKFSLTNI

SEQ ID NO: 9706 - protein, 282 aa, Xenorhabdus bovienii
  Peptide sequence Name=Xb4151_4152.C442.gene180.pep
  Homolog annotation: Query=12..271bp; Hit=7..265bp; Blast score=349; Percent Identity=68.0; E value=3e-95; Homolog= gi|1073741|pir||S46408 hypothetical protein - Aeromonas salmonicida gi|451856|gb|AAA72049.1| [Aeromonas salmonicida gene, com
MANQQVEYTPPMTLIEHLSVVKETRSDINRQYDLVDVIFLVVSAIMAGAEGWQDIETYGRAKIKWLREYRTFLHGIPRRHTIARILQAIELDSLLEALLNWVNEQREQDGKSVIAFDGKVLRRAYRNEKKNAVQLVTAYDTERGLVLSQKATATKNGEISVVRQMLDILNLKGSIVTLDALHCQRETLQKISEKKAHVVVQVKKNQPRLWDAVQSQFQFQCVFDAGKEKIITEIKQEAHGRREERYVFQLKPQFTPDIAERWPTISLFASEGRELAGRCLII

SEQ ID NO: 9707 - protein, 121 aa, Xenorhabdus bovienii; identical to SEQ ID NO: 6713
  Peptide sequence Name=Xb4151_4152.C442.gene181.pep
  Gene classification: Gene name=InsB; Function=Insertion element IS1 protein InsB, putative transposase; Function class=L DNA replication, recombination and repair
  Homolog annotation: Query=4..120bp; Hit=49..166bp; Blast score=112; Percent Identity=50.0; E value=5e-26; Homolog= insB_g4 COG1662

SEQ ID NO: 9708 - protein, 91 aa, Xenorhabdus bovienii
  Peptide sequence Name=Xb4151_4152.C442.gene182.pep
  Gene classification: Function=Transposase; Function class=L DNA replication, recombination and repair
  Homolog annotation: Query=1..87bp; Hit=1..87bp; Blast score=80; Percent Identity=45.0; E value=4e-16; Homolog= insA_g5 COG3677
MALVEVKCRFCGQTTPVKKHGKGEGGHQRYYCQSCRRTFQLEYTYRACHSGMKEQIVELAMNNAGIRDTARALHVSINAVVRTLKNSRCDV

SEQ ID NO: 9709 - protein, 345 aa, Xenorhabdus bovienii; identical to SEQ ID NO: 8506
  Peptide sequence Name=Xb4151_4152.C442.gene183.pep
  Gene classification: Function=Predicted transposase; Function class=L DNA replication, recombination and repair
  Homolog annotation: Query=179..332bp; Hit=34..184bp; Blast score=70; Percent Identity=29.0; E value=3e-12; Homolog= BH2520 COG3335

SEQ ID NO: 9710 - protein, 100 aa, Xenorhabdus bovienii
  Peptide sequence Name=Xb4151_4152.C442.gene184.pep
  Gene classification: Gene name=RtcB; Function=Uncharacterized ACR; Function class=S Function unknown
  Homolog annotation: Query=1..97bp; Hit=279..375bp; Blast score=138; Percent Identity=67.0; E value=9e-34; Homolog= PA5471 COG1690
LVQPLASDRSLFSLAHGAGRKWMRGECKARLTGRYNAEQLSRTAFGSRVICLDKQLIFQEAPEAYKPIGGVMDAMLQSGLVKLIARLKPVLTYKTRGNKE

SEQ ID NO: 9711 - protein, 205 aa, Xenorhabdus bovienii
  Peptide sequence Name=Xb4151_4152.C442.gene185.pep
  Gene classification: Gene name=PrfB; Function=Protein chain release factor B; Function class=J Translation, ribosomal structure and biogenesis
  Homolog annotation: Query=39..201bp; Hit=1..163bp; Blast score=198; Percent Identity=61.0; E value=3e-51; Homolog= prfH COG1186
MILLQISAAQGPDECALAVRKALERLIDEADELGIMVNILEKESGRRSRTLRSVMVAIQGENEQQFFERWDGTIKWICASPWRKGDGRKNWFIGVAQFKPLQQIMESEIRFETLRASGPGGQHVNKTESAIRAVHIASGISVKVQSERSQHANRRLACLLLEHRLQQQQDMHQAQLKAERRLFHNQIERGNPVRTFAGMQFSPQI

SEQ ID NO: 9712 - protein, 123 aa, Xenorhabdus bovienii
  Peptide sequence Name=Xb4151_4152.C442.gene186.pep
MKRLLLPLFLVPFFSYAAHMNADKTAETYCDLFGKASVEAFKTNASPDAIAQKTFNELNKKGFDLKEIHSNKDELISSVKQTVIEVRKNKQVFPSHKHFDESLDKSVKTCKAQIKDTLSQSTQ

SEQ ID NO: 9713 - protein, 160 aa, Xenorhabdus bovienii
  Peptide sequence Name=Xb4151_4152.C442.gene187.pep
  Homolog annotation: Query=24..150bp; Hit=22..148bp; Blast score=145; Percent Identity=56.0; E value=3e-34; Homolog= gi|16123838|ref|NP _407151.1| putative exported protein [Yersinia pestis] gi|22124084|ref|NP_667507.1| hypothetical [Yersinia
MYLCKILKIAVIPALLVLSLSTPALAKDAALINLPDKRFAVISVSDLESRSIGSYSIAVFKDRDLTEFETGAVFSRDGSVFEDNNKPRVTFADINGDGVKELIVYKLTAGSGNYLEVDALKITDKNVRFLARINTDSKHDPIQLLRILCKKGQCTGQLHH

SEQ ID NO: 9714 - protein, 47 aa, Xenorhabdus bovienii
  Peptide sequence Name=Xb4151_4152.C442.gene188.pep
MKLIESQKINGSGNSRFINLNIYQTLRAVFFNFFYNLVVFFPNNGYW

SEQ ID NO: 9715 - protein, 63 aa, Xenorhabdus bovienii
  Peptide sequence Name=Xb4151_4152.C442.gene189.pep
MLERKRKNPADNILPKRVYRGKSKYEYHPATGGSISICCLSSPVSVVWKEYNKVVEKIEKNST

SEQ ID NO: 9716 - protein, 474 aa, Xenorhabdus bovienii
  Peptide sequence Name=Xb4151_4152.C442.gene190.pep
  Gene classification: Gene name=AlsT (BS); Function=Na+/alanine symporter; Function class=E Amino acid transport and metabolism
  Homolog annotation: Query=1..463bp; Hit=11..472bp; Blast score=602; Percent Identity=71.0; E value=1e-172; Homolog= VC2356 COG1115
MLWDYVLLYLLLGVGLYFTLRTGLIQLRHFGHMFSVLKNSNKSDDSGISSFQALCTSLAARVGTGNLAGVAIAITAGGPGAIFWMWVVAFIGMATSFVESTLAQLYKTKDDQGNYRGGPAYYMEKGLKKRWMGVLFSVFLIIAFGLVFNSVQANSIAEAAAFAFHVKPIYVGIVLVIISGAIIFGGLRSIARVAELIVPFMAGAYLLLAFWVIGHNIERIPEVFALIIKSAFGLQEAIAGTLGYGISQAMIQGVQRGLFSNEAGMGSAPNAAASASPYPPHPASQGYVQMLGVFMDTIVICSATAVIILSSGILNENVTAISGIELTQRALSSAVGHWGTTFIAIAIFCFAFTSIIANYAYAESNMIFLERNHTAGLFILRLATLGMVMFGSLAEVPLVWNMANLSMACMAIVNLIAILLLSGIAIKLAKDYNQQRKAGQLPTFDINMYPELQKEVEEGIWDNKLSQDSQKCSH

SEQ ID NO: 9717 - protein, 42 aa, Xenorhabdus bovienii
  Peptide sequence Name=Xb4151_4152.C442.gene191.pep
MYTLTFQIVALFVAFTHPRNIASYIPGDSLRSFTTALQHAIY

SEQ ID NO: 9718 - protein, 290 aa, Xenorhabdus bovienii
  Peptide sequence Name=Xb4151_4152.C442.gene192.pep
  Gene classification: Gene name=AmpD; Function=Negative regulator of beta-lactamase expression; Function class=M Cell envelope biogenesis, outer membrane
  Homolog annotation: Query=14..289bp; Hit=1..273bp; Blast score=235; Percent Identity=47.0; E value=5e-62; Homolog= Z1100 COG3023
MMILFFLHNHSSKMIRRLRLGACITLLIGCSHQPQREVRNDYIVDHSYSYSTKQGIDSARFLVLHYTALNDQNSLQILTGGNVSAHYLIPSRPEYENKEPVIFQLVSENEKAWHAGTSGWRGYKSLNSNSIGIEIVNCGFKQHFIKKEWCLYHPSQIDALIRLVKDIIQRYQIEAVNVVGHSDIAPLRKKDPGPVFPWQALYQQGIGAWPDLITVNKYLANRVPSMPVPVIGIQKALALYGYSIPQTGHLDEDTHKIIQAFQMHFRPSDISGVPDAETEAIVLALVEKYK

SEQ ID NO: 9719 - protein, 128 aa, Xenorhabdus bovienii
  Peptide sequence Name=Xb4151_4152.C442.gene193.pep
  Gene classification: Gene name=AraC; Function=AraC-type DNA-binding domain-containing proteins; Function class=K Transcription
  Homolog annotation: Query=5..107bp; Hit=2..104bp; Blast score=89; Percent Identity=41.0; E value=6e-19; Homolog= soxS COG2207
MPQDNHLALVCALSKWIENHLGRVIHLEELAAYSGYSLWHMQKIFKEVTEISLGKYIRQRRLAGAVHLLRNSSLSIFDIALDFGFGSQSHFTYMFRKEYGITPYDFRQSTDIELEVKLPLHLTYNCQL

SEQ ID NO: 9720 - protein, 53 aa, Xenorhabdus bovienii
  Peptide sequence Name=Xb4151_4152.C442.gene194.pep
MLINIKTDTLLLNIALKKFFLCSIESPYNNFIVVSFIIKYYREFLCGKIKFHV

SEQ ID NO: 9721 - protein, 47 aa, Xenorhabdus bovienii
  Peptide sequence Name=Xb4151_4152.C442.gene195.pep
MKGLSWGSVQLLDTCLFDIHLNHPLATICANIRLQYSFLGNDVLIFI

SEQ ID NO: 9722 - protein, 64 aa, Xenorhabdus bovienii
  Peptide sequence Name=Xb4151_4152.C442.gene196.pep
LNLNRARNSLISPNFCAICRAQTTLTIVAIGLSSDFSATFKLTPLSYLIYHFEPRLCSYESNSF

SEQ ID NO: 9723 - protein, 456 aa, Xenorhabdus bovienii
  Peptide sequence Name=Xb4151_4152.C442.gene197.pep
  Gene classification: Gene name=AnsP; Function=Gamma-aminobutyrate permease and related permeases; Function class=E Amino acid transport and metabolism
  Homolog annotation: Query=3..440bp; Hit=4..450bp; Blast score=565; Percent Identity=69.0; E value=1e-161; Homolog= PA3000 COG1113
MVEQAEQSTLKRGLKNRHIQLIALGGAVGTGLFLGIAQTIKMAGPSVLLGYAIGGFIAFLIMRQLGEMVVEEPVAGSFSHFAYKYWGNFAGFLSGWNYWAMFILVGMAELTAVGMYIHYWWPEIPTWISAAIFFVLINAINLINVRLYGETEFWFSIIKVTAIIGMIIFGAYLLISGTGGPQASVTNLWQYGGFMPNGVSGLIMAMAVIMFSFGGLEMVGITAAEAEDPEKNIPKATNQVVYRILLFYIGSLSILLSLYPWMNVVEGGSPFVLIFDHLDNFWVSNILNVVVLTAALSVYNSGVYCNSRMLYGLAKQGNAPRILTKVNQRSVPVLSIGLSALATSIGVLVNYIMPGKAFELLMALVVTTLVINWIMICLAHLKFRTAKNAEGIKTKFQAFWYPFGNYLCLIFLAFILVIILMTPEIRISVILMPFWIGMLWGGYLFSKAKKAKVRVI

SEQ ID NO: 9724 - protein, 46 aa, Xenorhabdus bovienii
  Peptide sequence Name=Xb4151_4152.C442.gene198.pep
MCTTQSNFSVQLSCITIASVASQKAYSCYCRSRKYKLTKMTACYIR

SEQ ID NO: 9725 - protein, 34 aa, Xenorhabdus bovienii
  Peptide sequence Name=Xb4151_4152.C442.gene199.pep
MCALGSAPEKNGLRLYKEYVIKHMGKRSIGSVNE

SEQ ID NO: 9726 - protein, 69 aa, Xenorhabdus bovienii
  Peptide sequence Name=Xb4151_4152.C442.gene200.pep
  Gene classification: Gene name=CspC; Function=Cold shock proteins; Function class=K Transcription
  Homolog annotation: Query=1..69bp; Hit=1..69bp; Blast score=106; Percent Identity=84.0; E value=4e-24; Homolog= cspC COG1278
MAKITGIVKWFNESKGFGFITPADGSKDVFVHFSAIMNDGFKTLSEGQQVEFEIQNGPKGPAAANVTAL

SEQ ID NO: 9727 - protein, 51 aa, Xenorhabdus bovienii
  Peptide sequence Name=Xb4151_4152.C442.gene201.pep
MMVTPSTSQRKASIRIGDTMTSLRWHYPDQVIRVLLSSIKNAPSQNKKSLY

SEQ ID NO: 9728 - protein, 284 aa, Xenorhabdus bovienii
  Peptide sequence Name=Xb4151_4152.C442.gene202.pep
  Gene classification: Gene name=ThiD; Function =Hydroxymethylpyrimidine/phosphomethylpyrimidinekinase; Function class=H Coenzyme metabolism
  Homolog annotation: Query=21..284bp; Hit=3..266bp; Blast score=382; Percent Identity=72.0; E value=1e-106; Homolog= thiD COG0351
MVSPILILAFLWLVLGVTIMRINSLTIAGTDPSGGAGIQADLKTFSALGAYGTTVITALVAQNTMGVQSVYDIDPRFVAEQLESVLSDVRMDSIKIGMLSNVANVNVVAEALNRYPVPHIVLDTVMVAKSGDPLLSPEAITTMVEQLLPNVSLITPNLPEAAAILKCNIAETEGEMLQQGRELFSMGCQAVLLKGGHLVNEESPDWLFTVEGEWRFTAPRINTRHTHGTGCTLSAALAALRPRYPDWKNTLPAAKTYLQNALAQADTLDVGKGIGPVHHFHQWW

SEQ ID NO: 9729 - protein, 458 aa, Xenorhabdus bovienii
  Peptide sequence Name=Xb4151_4152.C442.gene203.pep
  Gene classification: Function=Collagenase and related proteases; Function class=O Posttranslational modification, protein turnover, chaperones
  Homolog annotation: Query=1..453bp; Hit=1..453bp; Blast score=780; Percent Identity=83.0; E value=0; Homolog= ZyegQ COG0826
MFTPELLSPAGSLKNMRYAFAYGADAIYAGQPRYSLRVRNNEFNHETLAQGIKEAHELGKRFYVVVNIAPHNAKLKTFIRDLKPVVEMEPDALIMSDPGLIMMVREAFPEIDIHLSVQANAVNWATVKFWKQMGLTRVILSRELSLEEITEIRQQVPDMELEVFVHGALCMAYSGRCLLSGYINKRDPNQGTCTNACRWEYNVQEGKEDNVGNIVHMHDPIPVKKMEPTLGQGTPTDKVFMIEEAKRPGEYMSAFEDEHGTYIMNSKDLRAIEHVEKLASIGVHSLKIEGRTKSFYYCARTAQMYRRAIDDAAAGKPFDSTLMTTLEGLAHRGYTEGFLRRHTHDAYQTYEYGYSMSDTQQFVGEFTGNRVNGLAEVTVKNKFLVGDQLELMTPSGNINFTLESMANKKGQAIEVAPGDGHIVYLPIPEEIILNYTLLIRNLKGTNTRTPQPKEIQEK

SEQ ID NO: 9730 - protein, 40 aa, Xenorhabdus bovienii
  Peptide sequence Name=Xb4151_4152.C442.gene204.pep
MFFKEPAGDSNSGVNIINNVLDLSSNQALSLKARLREQEF

SEQ ID NO: 9731 - protein, 53 aa, Xenorhabdus bovienii
  Peptide sequence Name=Xb4151_4152.C442.gene205.pep
MAQIYCGNRFVLTVDGKGKNLAFVIIAGRVMKSHFGLEIINSGILGIFSGADR

SEQ ID NO: 9732 - protein, 235 aa, Xenorhabdus bovienii
  Peptide sequence Name=Xb4151_4152.C442.gene206.pep
  Gene classification: Gene name=OmpR; Function=Response regulators consisting of a CheY-like receiver domain and a winged-helix DNA -binding domain; Function class=T Signal transduction mechanisms
  Homolog annotation: Query=10..235bp; Hit=13..240bp; Blast score=305; Percent Identity=68.0; E value=3e-83; Homolog= baeR COG0745
MSTHSIQYTILIVEDEPKLGQLLIDYLQAADYQTQWLIRGDEVIAHVQKRQPDIILLDIMLPGLDGISICREIRRFSDVPIVMMTARTEEIDRLLGLEIGADDYICKPYSPREMVARVKTILRRCYRPQDIISEHGSLTIDENHFQARYLDRVLELTPVEFRLLKIMSSQPGRVFSRDQLLNNLYDDHRIVNDRTIDSHIKNLRRKLEQLDEDKSFIRSIYGLGYRWEAEICRLV

SEQ ID NO: 9733 - protein, 481 aa, Xenorhabdus bovienii
  Peptide sequence Name=Xb4151_4152.C442.gene207.pep
  Gene classification: Gene name=BaeS; Function=Signal transduction histidine kinase; Function class=T Signal transduction mechanisms
  Homolog annotation: Query=21..472bp; Hit=5..459bp; Blast score=495; Percent Identity=56.0; E value=1e-140; Homolog= ZbaeS COG0642
MAPPPYDKISGGKIIMRHMIRTSVSGKLFLAIFATCMLVLVTMHWGIRLSFQHSFIGYIKQNSQIRANKMAEALTEQYQKYGNWDFLLQNDRMIFQLIRAIEQNSDSHQNPSSRGWRSQFWVVDNKMLRLVGHSGKIPTDTYRKPVIYQNNIVGWVIVSTSDKITRQADISFDHQQQLTSWIIAGFSTLLALIATFLLSRGFLKPVKRLVEGTHKLAAGDFSVRVKPSSTDEIGQLASDFNRLASTLEKNEQMRRDYMVDISHELRTPLSVLRGELEALQDGVRQSTPETIHSLLTEITTLTKLVDDLHLLSLCDRGSLAYRQELTNANDLLQITLASYRGRFADKQITLELNLTENAILFADPGRLTQLFQNLLENSLRYTAAPGNIIIRTHLTPQKWILDWQDSAPGLTVEQCQQIFKRFYRCESSRNRASGGSGLGLAICYNIVEAHDGIIYAERSPLGGLKIHVELPLVELPEYKAQ

SEQ ID NO: 9734 - protein, 988 aa, Xenorhabdus bovienii
  Peptide sequence Name=Xb4151_4152.C442.gene208.pep
  Gene classification: Gene name=AcrB; Function=Cation/multidrug efflux pump; Function class=Q Secondary metabolites biosynthesis, transport and catabolism
  Homolog annotation: Query=1..977bp; Hit=40..1018bp; Blast score=1270; Percent Identity=68.0; E value=0; Homolog= yegO COG0841
MDYPFISVSAYMPGASPETMASSVATPLERSLGKIAGVKEMSSNSSLGNTNITLEFELSRDINGAARDVQAAINAAESLLPSGMPSRPRYYKANLSDSPIMILTLTSTNHSVGQLYDIASTYLAQKLSQVEGVSNVSVGGGSLPAVRIELNPNALFNQGVSLNDVSQAINSANAQRPTGHVDSAQQNWQVHTNDELKNADSYRSIIVHYRNGSPVRLQDVANIKDSVENTRVAGMSGGEPAIVLVIRRESGANIIATIDRIRAELPVLRESIPANIQFNIAQERSPTIRASLQEVKQSLAIAVALVILVVFLFLRSGRATLIPAIAVPVSLIGTFTAMYLCGFSLNNLSLMALTIATGFVVDDAIVVLENISRHLEAGLKPAQAALKGVREVGFTVLAMSVSLVAVFIPLVLIDELLGRMFRDFAVTLATAIGISLLISLTLTPMMCAHLLKSSPQKSQKRIRGFSKVLLKIQQGYGRSLKWVLNHTRWVLLTLIGIVVLNVWLYINIPKTLFPQQDTGRILGFVIADENSSFQSMRDKMKHFMQVINADPTVENVEGFTESSSGFMFIALKPLKERTESIEKVIIRLKGKLSNEAGAQLYLLPIQELKLGGRGGAKSIYQFALLSDDLGELRKWEPIIRKALAKLPQLTDVNSDYENKGSEIAIIYDRDLMARLGISVNEANALLSNAFGQQSISTIYLPRNQYKVVMEVAPEYTQDASSLEKMFVINAKGERIPLSYFARWQPANAPSGVYHQGLSASSTIAFNVAENYTLSDAISAIERTMTELSVPSAVRSSFAGIAQDFQKTQSSQLWVILAAIVTVYLVLGVLYESYIHPLTILSTLPSAGVGALLALELFNTPFSLIAMVGIMLLIGIVKKNAIIMVDFALEAQKSGKLSAQEAILQASLLRFRPIMMTTLSALFGALPLVLNSGDGAELRQPLGITIVGGLVMSQLLTLYTTPVVYLFFDRLRKKWHHRRTIKSQVVKSS

SEQ ID NO: 9735 - protein, 1056 aa, Xenorhabdus bovienii
  Peptide sequence Name=Xb4151_4152.C442.gene209.pep
  Gene classification: Gene name=AcrB; Function=Cation/multidrug efflux pump; Function class=Q Secondary metabolites biosynthesis, transport and catabolism
  Homolog annotation: Query=6..1032bp; Hit=6..1032bp; Blast score=1399; Percent Identity=75.0; E value=0; Homolog= ZyegN COG0841
MHSDSPMTGGGPSRLFILRPVATTLFMIAILLAGIIGYRMLPVSALPQVDYPTIQVVTLYPGASPDIMTSVVTAPLERQFGKISGLKQMTSQSSGGASVITLVFQLSLPLDVAEQDVQAAINAATNLLPNDLPYPPIYSKVNPADPPILTLAVTSDALPMIQVQDMVETRIAQRISQVGGVGLVTLAGGQRPAVRVKFNAQAIAAHGLNSETIRTTIMNANVSSAKGSFDGPTRSVTLTTNDQMKSIDEYRNLIVAYKNGAPIRLRDVATIERGAENTKLGAWANEKPAIVINVQRQPGANVIDTTDNIRAMLPELINSLPKSVNMDILTDRTVTIRASVQDVQFELLLAIALVVMVIYVFLRNATATLIPSIAVPLSLVGTFAVMYFCGFSVNNLTLMALTIAAGFVVDDAIVVIENISRYIERGEKPMAAALKGAGEIGFTIISLTFSLIAVLIPLLFMGDIVGRLFREFAITLAVAILISAVVSLTLTPMMCARMLKAEAEIKHNRFEQASEHFFERIIAIYGGWLKRVLNHPWITLGVAFSTLAFTALLYLTIPKGFFPLQDNGLIQGTLEAPQSISFNAMSDKQREVTALLLQDPDVENVTTFIGVDGSNSTLNSGRLQITLKPLNQRDIRVDEIIPRLQARVANVPDVKLYLQPTQDLTIDTQVARTQYQFTLQGTVSNDLNIWVPKLQEALKQRPELVDVGTDWQNRGLVAYINVNRDMASRLGISMTAIDNALYNAFGQRLISTIYTQANQYRVILEQDTQNEAGMNAFNNVHLIGTDNKVVPLSTIATVEQQLGYLSINHLQQFPAVTFSFNVAQEASLEAAVNAVKETERSIGMPKNINTQFQGATLAFQDALGNTLWLILAAVISMYIVLGILYESFIHPVTILSTLPTAGVGALLALMVGGYELDIIAIIGIILLIGIVKKNAIMMIDFALAAEREKGMSPYDAIFQACLLRFRPILMTTMAALLGALPLMLSTGIGAELRRPLGICMVGGLIMSQILTLFTTPVIYLLFDRLANYFKNKRQNRLQSQNQRELDHSPVNHQEPL

SEQ ID NO: 9736 - protein, 413 aa, Xenorhabdus bovienii
  Peptide sequence Name=Xb4151_4152.C442.gene210.pep
  Gene classification: Gene name=AcrA; Function=Membrane-fusion protein; Function class=Q Secondary metabolites biosynthesis, transport and catabolism
  Homolog annotation: Query=7..404bp; Hit=53..455bp; Blast score=385; Percent Identity=53.0; E value=1e-107; Homolog= yegM COG0845
MKNKRRTYFFQFAVLAVVIATAYFAWNYFKASTISEEKSAQASKSLQDLKYLLQPPVQVATAKIQSVPHYLGGLGTVQAANTVTVTSLVAGQLTALHFDEGQFVKQGDLLAEIDPRSFQIQLAKVQGQYAKDQATLANSRQDLVRYQQLAKNKSISQQDLDKQISTVRQYEALLKADQSSIDDARLQLTYSRITAPISGRVGLKKIDVGNYISAGGGTPLVIITQVDPIDVLFALPENDISAVLKAQKNNKDVVVTAWDRNNQQQLAQGKLLSIDNLIDVTTGTIKMKARFDNQNNVLFPNQFVNIQIKVNTLENAIVIPNAALQMSSEGHYVWKVDKENKVNKRKVTIGLQNAQLVVISKGLATGDRVVTDGTDALTEGTGITIVKPLKSESANTYDQMDKSKPSNSKVENT

SEQ ID NO: 9737 - protein, 53 aa, Xenorhabdus bovienii
  Peptide sequence Name=Xb4151_4152.C442.gene211.pep
MEFNKNNVVADIKKSAFFIVVLLKNSLTIFTPAQNRELKDHLSITYPLSLVEG

SEQ ID NO: 9738 - protein, 660 aa, Xenorhabdus bovienii
  Peptide sequence Name=Xb4151_4152.C442.gene212.pep
  Gene classification: Function=Phospholipase/lecithinase/hemolysin; Function class=I Lipid metabolism
  Homolog annotation: Query=8..448bp; Hit=3..473bp; Blast score=133; Percent Identity=28.0; E value=8e-31; Homolog= PM0076_1 COG3240
MKKALFLISATTLFLLNSITNAHAYDNVYVFGDSLSDGGNIGRFTTDGENSELYNEYITRELTGKKLIPSRRGGTNYAQGGATANGSLNPSHFLFNPTTKKQIDSYLKAHSGKADSNGLYIHWVGGNNIDEALDNVAKGDKYTAQKIINDSSASAASQVNNLIKAGAGLVIVPNVPDIGTTPKIMEEVLQGALGKSKVSAKEIKQILKKAHQAINQYPTPNIATRHQIIEGVFKKIAEDAAPKNPSKAKEIYNQLLDAYNQSSKIASQFSDEYNQKEEDQLGNGNILRADINHLLREVIENPTIYGISNTLGYGCTQGGLAAFCSSSDPDFDKSQSYLFSDSFHPTPYVHLMISQYIMSIYNAPLQVMTLNHINRVPVISVLNSLDGHLQQFRNGRNAQGKIGIFGGYTGNHNSTLTLGSDYQLTNDLLLGATVSRYRDEQSSASNFNYAATGHVVTAYALWNYYNHGWLSGDLHYSRTNYDNLSRSIQLGQATRRETGSTTGKQWGWRITAGWNIPITHYLTTSPIIQYAWDKGNVDGYRESGNNSTSMHFEDQHYNSKVGSVGWRVDTQLGRFNPYASILFSHQFDDESYILRSAINSTKTSFIQREEKQDRNRFQYTVGVNANLTNNFRAFAAISHEKSDKTSNHNYGFNLGFNISF

SEQ ID NO: 9739 - protein, 32 aa, Xenorhabdus bovienii
  Peptide sequence Name=Xb4151_4152.C442.gene213.pep
MLGFKNFRGAQVLFAVIDTNKVILFIHGDGLL

SEQ ID NO: 9740 - protein, 1169 aa, Xenorhabdus bovienii
  Peptide sequence Name=Xb4151_4152.C442.gene214.pep
  Homolog annotation: Query=35..945bp; Hit=125..976bp; Blast score=383; Percent Identity=31.0; E value=1e-104; Homolog= Pa|Phot2-7h01.p1k _g13| 14750 - 20632 4013 1960 aa, chain -
MPSFAKKIIGTFIFIYALLIPSTITFALAKDAIRHETSHPHSKETQNTPEFDAQNFIVNNLQTMSQVLSSSPSELKTQATSYALGKLNSTILSETQKWLSQFGTVSINFGLDRDWKLKNHSLDLLLPLYDNKADWLFFSQLGYRNKDSRNTINIGLGGRYFYQNWMYGLNTFYDYDITGKNRRIGLGSEIWGDYIKLSANAYYRLSDWQNSRNFDYYYERPANGYDINSEFYLPFYPNLGAKLSYEKYFGDSVTLFNRDTKQKNPSLAKMGLTYTPIPLFTIGVDYRQGESGRSETQLLVNLNYRFGIPISTQLDHNNVASMRTLAGSRYDLVERNNNIVLEHKKIEEIELLAVEPILGYGHQEIKISVPVRTHKNIKQASWKVADKAFEQYNGKLSSDLGKDITVTLPSYQEAHKQDYILDISIMDNQERIKNTHMPIKILPFLIDGKVKVIPPKSLESTDEEKNGYKFTDLVITYQGVIKGEIVKNGKIDNVRWIVESSLGDESELSFAWNNRPAQTNEKGELIDENRKPISNILVSKNKNQNDKVKVYIQLDGATKQEIGEVNFDPVKPVPDKPENIEVKCQAQGETPVLVNESYICKAIVTGAKGKSDYIIGKKVNWKVEGHNKLQPIPVIEQTNADGEATATLTSSTELSGLVVIASVDDGQPTYKSNKINFSWPEITLDPLSKSTTDGDEVEHYTVRATILREKGGKVYTGNTENKGKDIKFVWKDLKLENGNNASGVTSKPSPGTPQSVDSQGKLETHISGNKANNEQVKACINIEGRDSASDICSELINFVQDFKIDSIEVINFDPASPLLGDGNSKYQYRAKIVDYKDNTKIIAGRKFEPKDISWIHDHNKIESAKLPSPELYSPTNKDVYTTDDKGYLYATLKSSVGVKKVNMTLKVSGAKNTNEELTTTAGVEFTPVAKVALLYVYNRNDKKIYKYFDNKDNLNRPSNVFESLRGELRDPKNPKSFYDDPDVSEVIYSMKFNKDEAPYGGITLTFGDKEHGPIQFRAMGIVEIYSNVTMQSGEIKLYKYKIDIKSVSSVNNQKGYVSVNGSNIDCGVNLKGGRQDLYSDKEASDPTNPYSIHNEWGETERGERYSLYDWGLFDEVNNHNAEKATIIVKSTSSASSKRFRIYDSKNNTFDQQSEGVIFCYDHWLKSGKN

SEQ ID NO: 9741 - protein, 658 aa, Xenorhabdus bovienii
  Peptide sequence Name=Xb4151_4152.C442.gene215.pep
MAAITSTKISPLANELEVGQKVTFSVKLTSNKPIDNNKYIIVESGYVQNIKFDNLKVLLVDKNESGLFTATAEFDFTVLDKIGGVGANVNNNDSISFTINTDAKSDATVFPNMPHTYNSKIKVKPVNSNKIDITINKNADLVIGQKVSFFVELNSDNPILPAGNITIEKISSNIKFDQDTTKTIPIYSQVGNKVSAKLSFTVLDGVSGGASAQDGDAITFVIHTDALTSEGNFGSVPFNGTANEIDMDSLALFVENPFLQMSSESDQQHPTAIYTYLKNRNTQKPLVGTPVFITSQKRNQIEEFKFKDGDGNNPIILEEKDNTKGLIIASKDDGLVKFYLYPQTALVSVVNLWSYIISYTTDIRREAKQVIYAVNYIKPTFFNSIGMPDISGYSTAGIRADSILPYFMVSVSGDPRISKGDTVLFFVNKLNSTKAPKFTGYTELIDDPKTQLDRYSMKLPYTIFEQSISSELSYTVVKPDGSALYSDTLPVTYLGGTPYVPDQEAKRSYELCIVHPSTGVDPDVFIPADNDIGYENIKKYPHHKYDGLFIEIVRLKSNDAASKLNPVPLNIKDITLNMYINSDNKNFTKPYTKQINLADISGPGNKDSIFFHIPYDDIVGVKWRGNISFDYQFFKDEVIQYSAVWNGYIGTEPLDGSN

SEQ ID NO: 9742 - protein, 500 aa, Xenorhabdus bovienii
  Peptide sequence Name=Xb4151_4152.C442.gene216.pep
MSNVMTFSQPETGNLIIGQTFLFTVILSSDEVIDGSSIISFFNTKNISVPIGDVSVNLESDNKKATATVTLTVSNLIAENEEIHFSVKTSLSGIQQKKLQYLAKEIYPESLRLSVDNAFLSVPTSYDHSQIGTVSTKVHTIIKDKDGNPLSGIPIFIKSRAFNQLEEVYIYANDVRNKINVQNLSLYSGFSINSGDKGQVEFYISPIKPLALVIDLSSTIRIPSDYAISHSTVFIIFDNKKYNRQEPEAVTAIDGDLTSKGESKFWLDTTPCTAYDVDDFLLFNINGEYKYYVRGFDVIEDNQCLIKLPYFILEKNKLSNLSYLVIRGNGDIIAKSYPVDVTYRGRTNKPWTDVDRIYEPCKVYTSFNDVIEQDGDINNQKISNHAKNPDDAGLFVTITGTNDNSDNTKVKLGSKVTLNLYINSKNKTVTLPFNCIMPYHPDNKDGKTAVLRFNIRYKLLNGHFAFPFHDGMIYFDYQVGDDNDRDVTYGGIWSGHIVTD

SEQ ID NO: 9743 - protein, 458 aa, Xenorhabdus bovienii
  Peptide sequence Name=Xb4151_4152.C442.gene217.pep
MNIKNNIVLSKPEFPQSDSNNVINILEVKTMGIKYLVMKVNKYDGVELLDSIDGELYLKDNSKIKIKSITYCVTPDVLDNDYDYYSVIFNVNDFHTYGLYEAVYTVTSLNDNKNTSPISSVNIIEDPSMNASDNEITFTDIKNRKLYLSSISRERGIRIRTNFKGFTAGDTITITLKILDEENSPINTLKSDKVLLQDQVNQDYADYTISTGEGGINFVEAKSILAGFYSADINITSSLSQISIYNDLDNVNVKVQLTQNIGTSSESPDVKPFLTAVVYTGSNSNAIIAQVSNAYFSDGSNRTPLGEINNNGVGYLNIYSKDIAKNSVLTLNYLDPVNAYKVCLNFSVWLLSSSEEIKYTYSSYGVADGTCQCFLFIEPLITGIETINVKFDTPDIIIDDVVKSSIPINNPVSNKTLSYKITSNKAFRANFSINASGKGIYMEQINNTIVFVDPLTFE

SEQ ID NO: 9744 - protein, 520 aa, Xenorhabdus bovienii
  Peptide sequence Name=Xb4151_4152.C442.gene218.pep
MAITINFTPSYEVFQDRSAVNINILAYEYSESLPGLEIVFECSVGSFVVNGEDTGKKRLFGKIGGTGETSVLVVGPMTGGNGQLTVSLRENNKQIGILPYDLITTDYQLNFSVTGDYAMADGKQSNKVNAILTGMGTVFDLKNRQLDLIVTGSASFEQNKVTQTTSINTDPLGNVSFELYDANNSGETVTLAGQLSGNKISHNTEQIHFQPNLDCDAHPPSNEIYIRTIFTYSINNDQYLLRQRQCDHLVTVHKLLAGGKQGEQTSTGQKWVNYYDLMFPFVIENEQYVFGLAKDFINAPQNTDKSFWMIAKLDENGQKEIIDSGYFDVSYDVGFAYNIGGRQFILLHGKGNGWPIICYEIFTKVKMNRKPICQQNWDNFYGVVFFISMEGNQYIYCHTKTTKNIYTFEFNKDGTLGKLAYSDTWSYYYYPQFPYFIKGKYYYTGQRFYDNYWFISYIYSKGVPEHVNEHAEPWDTSYQYLIPFSIGENQYFLRQNQSKNHWYITEIIADTKMGEDRDSR

SEQ ID NO: 9745 - protein, 106 aa, Xenorhabdus bovienii
  Peptide sequence Name=Xb4151_4152.C442.gene219.pep
MRQNRFLASSLAKVCHCFSFILSPVLVDKLNILKTGNDTNLETGSKTPISFINRRFSHEAQIKNSVANPKKIKNPPVSVIAVIITLEPMAGSRPSFIINKWNQYSH

SEQ ID NO: 9746 - protein, 135 aa, Xenorhabdus bovienii; identical to SEQ ID NO: 6015
  Peptide sequence Name=Xb4151_4152.C442.gene220.pep
  Gene classification: Function=Predicted transposase; Function class=L DNA replication, recombination and repair
  Homolog annotation: Query=11..88bp; Hit=11..83bp; Blast score=58; Percent Identity=39.0; E value=2e-09; Homolog= sll1791 COG3293

SEQ ID NO: 9747 - protein, 133 aa, Xenorhabdus bovienii; identical to SEQ ID NO: 6016
  Peptide sequence Name=Xb4151_4152.C442.gene221.pep
  Homolog annotation: Query=1..127bp; Hit=94..223bp; Blast score=115; Percent Identity=46.0; E value=1e-25; Homolog= gi|21228333|ref|NP _634255.1| Transposase [Methanosarcina mazei Goe1] gi|20906799|gb|AAM31927.1| Transposase [Methanosarcina m

SEQ ID NO: 9748 - protein, 92 aa, Xenorhabdus bovienii; identical to SEQ ID NO: 6203
  Peptide sequence Name=Xb4151_4152.C442.gene222.pep

SEQ ID NO: 9749 - protein, 96 aa, Xenorhabdus bovienii; identical to SEQ ID NO: 5468
  Peptide sequence Name=Xb4151_4152.C442.gene223.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 9750 - protein, 242 aa, Xenorhabdus bovienii
  Peptide sequence Name=Xb4151_4152.C442.gene224.pep
  Gene classification: Function=Transposase; Function class=L DNA replication, recombination and repair
  Homolog annotation: Query=4..240bp; Hit=223..465bp; Blast score=140; Percent Identity=32.0; E value=8e-34; Homolog= Z4340 COG3436
VGTDTPEPAALTPNIVLYDHQASRSGTCAADYLAGFQGYLQVDGYQGYEQTGARLVGCMAHARRKFMEAKQAQGKNKTGKADIALSLIQSLYRVEHQVKGLSPAEKYRIRQEKALPIWDKLSAWLVKTRSQVIPKSKLGEAVTYLSNQWAKLIRYREDGRLSIDNNRAERAIKPFVIGRKAWLFSHTSRGAQASAILYSVIETAKANGLIPFDYVMTCLDELCQPTPDLEKLLPWKKVISKV

SEQ ID NO: 9751 - protein, 112 aa, Xenorhabdus bovienii
  Peptide sequence Name=Xb4151_4152.C442.gene225.pep
  Homolog annotation: Query=Organism:..Bacillusbp; Hit=halodurans..bp; Blast score=; Percent Identity=; E value=; Homolog= Pa|Phot4 -264g05.p1k_g40| 51047 - 53815 2179 922 aa, chain -
VIFRLSFLRAAHSLPLVAFVVAKTRTRRDHMKYLTLIQSIALLHQYQREIKTAEHRGKTLEYIEVTKDDIRLAVSVNCKRQLNYTLLITFFQGSSFSRSGVGWHNSSRQVMT

SEQ ID NO: 9752 - protein, 150 aa, Xenorhabdus bovienii
  Peptide sequence Name=Xb4151_4152.C442.gene226.pep
MITIFIMNSKLEEKMLLARAKRYINNIQGIEKISISLSNNDKEFQWHKEIINSILKGKEIPECKLELPVSEEDIYSYLQSKIHIGECNSYYMFFEGMVKFSFNIIDLKRFLSSCYALKKTFDLYVLLLNPMKVIAISEEEYELSFYNKTM

SEQ ID NO: 9753 - protein, 1525 aa, Xenorhabdus bovienii
  Peptide sequence Name=Xb4151_4152.C442.gene227.pep
  Gene classification: Gene name=RhsA; Function=Rhs family protein; Function class=M Cell envelope biogenesis, outer membrane
  Homolog annotation: Query=184..1401bp; Hit=252..1491bp; Blast score =365; Percent Identity=28.0; E value=1e-100; Homolog= Z0705 COG3209
MSVSQNVMMGAAAAQRPSPPPATNRRPSPAQGDRRVPAPPRTEKSTSDKTLEFLQSETFENATLATSGTFAVATGAAVPFAVGLAAGAAGAAAGAYVGDKIGHAIAAGMGMSTVATEGENPAREGDAIAHQNKNAGLWGALGGILLGAVAAIAVAALVIATGGAALVVVAAAAAAGGFVGGACAGIGAAIGQYGSNTGTIVAGSPDVFFEGKPVARVGDPVACSDHPPGVIAEGAKTVFANGQGIARLGHRTTCDANINSAAGSISITQATDGKYPIMEESNKGLQWAVVIAGLLPLPRNKKGVTKSDKPKESTQKNSKKPKEEDCCGDPVDMATGDFLQQWPLLSLPGTLPLSLTRTYRSTADFAGLFGAKWADDWSQHLVLDGEATRFTDADGVVYTFHTPEEKVFSVNLHAGHYLLFGELRGSLHLFDRQTQLTLSFEQRDGKRRLLSAISDRYDNRITFHYDDLNDEGIPQLAQVTHSDGYRLLLDYHQHRLVTVEYLTDELRQRLVTCQYDEQGYLSECATFQHSHLWHEYDTHGHMTRWHDADATDVSMGYDTRGRVVSVSTPQGYWQDRFLYDEVNRVTTYRDAEGGCTRYWYNGDGQITRKLDPLERETVLEWDLSHKLSETDPLGRKTTFEYSPYGELTQLTLPAGEVFIYDYDEYGQLVQATLPAGKSWGFHYSEQGALDAVTDPQGRREEYRYNLHGELLRRVLPDGTQWRYEYEQHRLHQVLQPNGYTTRYDQDGLGRLRGVTDALGQQTRYQHSAFHASPAGSVTEIELPDGVKQHIDYDSERRVTAVTDGEGNTTRYAYGAFDLLTRMTRPDGTTLHFEYDRLIRLNRVTMATGETYRYERDLAGQIIRETDFTGRTVEYIYDRAGRRTLTRYPNGQLIRFCYTAEDLLSRQEHWLAGASSCELQVATEYTYDVHRRLTRAVSPDAVVEFDYDEAGNLTGERLNGREISREWNELTGLPAVETLDGHTLHFDYNRMGALTGFRFDRHSPLTLSHDPLGRETARESGEGFILASRYTATGMLAHQSAGRVTAMFRETLQQNDPHFPPQATAVNRSWQYDRAYNLRVIDDGRWGQTRYRYNSNNQITETLYQGARPYEEQFRYDANGNLSQHIPVDAQGAVTQITQHQQAGRVIRRGDVSYRYDDSGRLVEKTAQRDGFRPQVWRYRWDALNQLTQCETPDGSRWYYQYDAFGRRIRKLKVHDGKLAAANLQRWLDGKPDLTPKPRTMMGQDYLWSGDQLIEETPLYADGTPAEDQRIRWLYEPGKLTPSARYERGKLHYIVSDHQGTPREMLNEEGGLVWAQRLTTWGRAEKSQVLASNDADYHVSCNLRFVGQYEDEESGLYYNRFRYYDRETGQYLTPDPIGLLGGLNPYGYVHNPTNFIDPLGLAGENCGKPKPNRRQALNKAKDLAGIPRSQKPDRQWTVGNDPKRRGQTNYQYSEDLGSHGRYYEYKDAHGHKKVVLEHTADPRATHPHAHAGQAKTGADPRTYDFKENRYQKITDPKTDDHHIYYE

SEQ ID NO: 9754 - protein, 151 aa, Xenorhabdus bovienii
  Peptide sequence Name=Xb4151_4152.C442.gene228.pep
  Homolog annotation: Query=1..148bp; Hit=1..148bp; Blast score=188; Percent Identity=59.0; E value=2e-47; Homolog= Pa|Phot5-465c10.p1k _g13| 16270 - 16719 284 149 aa, chain +
MSDPLDLSPFHFNAGTIKLPASWQDSSILVLNSPDDKNGTSFTISRDSLPWGLAFNQFAEREMTAIGKQLKDYEVLAHEAGELNGHETETFEFRWRAPSGPVHQLMMMLNAPGQVLIFTGTCQGEMTPAQKAQMQAMMATFQLRSEQKGSE

SEQ ID NO: 9755 - protein, 65 aa, Xenorhabdus bovienii
  Peptide sequence Name=Xb4151_4152.C442.gene229.pep
MLESCQLAGNLIVPALKWKGERSSGSLMVNPFYCLPFQNKNRYVINAGQDIRRTELRLAGLQVFS

SEQ ID NO: 9756 - protein, 121 aa, Xenorhabdus bovienii
  Peptide sequence Name=Xb4151_4152.C442.gene230.pep
MVKKSLLSFLGVMLLACSSMLFAAYTDVFETKTYHITINVLCPEGNVSCDNVIYTGVRKKDNASITLKGTTLNKDCNTGTCDFYGYEFKNKDVTYTIYQYGSLEISKKGEVIFSEDRISKE

SEQ ID NO: 9757 - protein, 1023 aa, Xenorhabdus bovienii
  Peptide sequence Name=Xb4151_4152.C442.gene231.pep
  Gene classification: Gene name=VgrG; Function=Uncharacterized BCR; Function class=S Function unknown
  Homolog annotation: Query=122..733bp; Hit=3..633bp; Blast score=530; Percent Identity=45.0; E value=1e-150; Homolog= Z0707 COG3501
MSMKKNMAKLKKGRALIQQGQQAAQLAKHVTGKLGGGLGGAAAGTAGLIPGGGFGGGIGGGSAGTGAAGLIPGGGFGGGLGGAGGGAGQGLAARAASGQSGAAKALQKAGQLLGGGGGMAPSGLQFTLTAGGLPPETFVVTDFALTEGFSRPFSLHVGLASADPAIDFPAVLDRSATLTILQEGVEQRSITGIVARFEQGNTGLHQTTYQMSLYPDLWRTTLRQNSRIFQQLDIAAILTTLLKEHGIRDVVFSLRHPHPAREFCVQYQESDFAFLQRLTAEEGIFYFFECGNGRNTLVFADDAGSVPPGIVLAYQPGEGSTTGTPSVGSFTCSAQVRPAQVQLKDYTFKNPAWPAEFSQQMKEDTLQQMYYEHYDYPGRFKDEAHGQAFTRYRLEALRSDAVTGQASGQAIAVQPGKLFTLFNHPREDLNQPWQVVGASHTGSQPQARETASSDSGTTLHSQFSFIRHNQHWRPAPLPKPTIDGPQIAKVVGPAGEEIFCDQYGRIRLQFPWDRYGKSDDQSSCWIRVSQPWAGQGWGMLAIPRIGQEVVVDFLHGDPDQPIVTGRTYHASNIPPGALPGSKTQMAFRSKTHKGEGYNELLFEDAKGSERLALHAQKDMHTTVKDNQSLVVEAGDRTLTVQTGDEHKTVKQGNLTETICQTRSTEANVIQVKAKAGKAGLGTQLYQAEDNITLQVGKGSIEMTPEHIRVAFGSSVILLNSSGVFVDGPAIGLNNGSAGAGLPPAAADGGDSASESGSLLPAAVMAAGLGPMGMAALGSMGLISSASAATPASAPRPMPTPADGAGRQAAPADSQATPASAPRSMPVPVNGAGRQAVPAGSQVAAPSAPPVSATNLTTSTKKTMGQDGLDLLKGIESLRLKPYDDQTGKTVTKWTKGATIGYGKLIEKKDWDTYKDGITEDEAEELFKKTLAPFEKTVNDGITKEINQNQFDALTMFAYNIGAKGFNDSSVLKLVNDENAKTDYDTLDDAWKAWNKSQGKVNQGVINRRAAELKIYNEGVYERW

SEQ ID NO: 9758 - protein, 463 aa, Xenorhabdus bovienii
  Peptide sequence Name=Xb4151_4152.C442.gene232.pep
  Homolog annotation: Query=1..445bp; Hit=1..441bp; Blast score=533; Percent Identity=64.0; E value=1e-150; Homolog= Pa|Phot2-74c01.p1k _g104| 65768 - 67114 3509 448 aa, chain +
MSEHPENLIIRAGGSPQNLPEFAVIRDEINKISHPAQPEVNWVLVESLSLTLFRRNGVDLQTAIYYTLARMQLNGLAGFTEGCELLAGVIVSEWDALWPPQPAVRTDLLEWFHTRTGSQLRQMDFGTGDLRMIYRAERALQLIIDRLQQSDLKRLPRVENLLWFFQNAAKKLEKPRPAAKPVQSPVQMPPLVYLSQSDTEPEIPPPSAPPRPDRPPEADSPRVRVQFPEPPRGWNAWQGFGLGAVLGLLVLVGGWLLFYKPLQQQLSAITASPAGARLAWLTEPALAGYQGQLDRLAETPLLATWDAARTLTGTAAQQWPDSAEQKNATHQWTQAMTARIDSIPLKGSWHTTRDQLQQLADKILLQERTRGSFTLSYLKTAVYDLQRSHGSEVPLEELLRQLNGRVVNGEPVPPVLLKGIDDRFNALLGRYDRLRQAAENPAEKQAGKQTTHHESTVIPDGGH

SEQ ID NO: 9759 - protein, 1189 aa, Xenorhabdus bovienii
  Peptide sequence Name=Xb4151_4152.C442.gene233.pep
  Gene classification: Gene name=IcmF; Function=Uncharacterized BCR; Function class=S Function unknown
  Homolog annotation: Query=38..1189bp; Hit=2..1144bp; Blast score =1214; Percent Identity=54.0; E value=0; Homolog= Z0250 COG3523
MKWPSLSSLAPLKSALPALSKFKSLPRLKATMALALALIPCLLLIAVWVWGPEWKLRNDTPLDSLAARWLATALIILMVLLWIGIKAWRRLRQLEKLNLDVELKGVDPVRVDIEHQARYLDHWKAQLQRHLDSYNYLYQRPWYMMVGSQQSGKTTLIKEGYKLSDIAAPEYLRQDGDIALRLRCWLGEKAVIIDPDGGLIDQPVPVNSDKPQINSRLWESLLNWLTENRQRQPLNGIILTVDTLRLLTDNREQRDRYVREIHQRLQNLRLTFHSQLPLYLVMTKIDLLHGFEAMYPSLDRRQRDQILGVTFSLNNRDEKAWHSELAQFWQQWMANLNGAMPDMMLNGVDAGQRSALFSFTRQVQGLHSYIAQMLEDILYNDEHHRPMLRGVYLTSARQVGQMDDLFTQSASAQYHLGSQAFPTWPAGDTLPYFTQSLFEEVLLAEPNLAAENRLWLSRNRRQLYTFATISALVIAAMWGGWHYFYQKNYRAGEEVLAQAKNFLSVPPPDGDDRYGNLQLPLLNPIRDATLAYGNYHEKKSFLTDMALYQGDGVGPYVEGTYLKLLEQRFLPSLMQGLLDDLNRAPAGSEEKLEILRVMRMMEDGSKRNNGLVGQYMRARWSKAFHGQRDLQAQLLTHLDYALAHTDWKGQRDKDNQDALARFAPFIKPMKQAQQELSALTINQRVYQNLRLKAQDTLSAPVNLRDQIGPSFDSVFIAGNESRLVIPQFLTRHGLTDYFVRQDKELVELTEMDSWVLNLPLKTNKYSDTDQGNIQREITELYVGDYTATWRAAMNNLEVRDFEDLPQAISAIEQVISGEQPIKRALQILSDNTRPPELVSGLSDKEKQALLAQSDYRLLNRISRDFAPETGVLVEHGDKGSALQSVYQKLMALHRYLLAIQNSPVPGKAALQAVQLRLDQNNSDAIFEVQQMAKNLPEPLNRWVGDLAEQAWRVVMMEAVRSLEVEWNESVVKQYKTYLAGRYPFNPAATEDVPLSEFDRFFRPDGTLDTFYKQSLKPFVENNLTTGTDGRELIRADVLKQLAMADRIRTTFFTPQNGLGTAFAIEPVSLTGNKRRGLLNLDGQLVDYAHGRSNVAHLVWPNSMRAGTESRLTLMPDRSNAAPRSLSFTGPWAQLRLINSGKLTNVQPGAFDVRFAVDGGEITYRIYVDESDNPFAGGLFSQFRLPDTLY

SEQ ID NO: 9760 - protein, 478 aa, Xenorhabdus bovienii
  Peptide sequence Name=Xb4151_4152.C442.gene234.pep
  Gene classification: Function=Uncharacterized BCR; Function class=S Function unknown
  Homolog annotation: Query=208..462bp; Hit=6..259bp; Blast score=235; Percent Identity=51.0; E value=8e-62; Homolog= Z0251 COG3515
MDIRTQFDWFGALLAPLSDEQTGKALSESDPAWEFIDGEMVKFGSLSHGTLEVDALQRQALQLFSEHSKDFRLMVHLLRTLQHAGHPAELILAIELLTEYVKNYWEKAWPVKPVLKRRLAQQVIKRFESAQSSFTDQASKSQRDEAQGALAHLAQCWHASEPDLAKDVDQLRTRYNRQPEARTAPTQTAPTTPEAASVAPSPQSPEQAPMPEVAVNSSSDKAWKQTLMTVADLLCERYPESPIGYSLRRHAVWHTITTAPMANATGKTPLAPASADRTADYLARLPTADNKLLAQIEQSLALAPYWLDGHAIAAQAAEQRGYSRVAQAMRDELKAFLARLPVLKTLSFSDLSPFISPDTLDWLTPEPDTSGSPGAASADQEAIWHCFQQQGLEAALQMLEEHQQSLTEPRDQFYGQLFTAQLLEEAGMTALAHQHYRNLLHTGQHMLLTEWEPSLLTLLAEKIPSPAKDTASHRSVNT

SEQ ID NO: 9761 - protein, 221 aa, Xenorhabdus bovienii
  Peptide sequence Name=Xb4151_4152.C442.gene235.pep
  Homolog annotation: Query=1..221bp; Hit=1..215bp; Blast score=251; Percent Identity=61.0; E value=9e-66; Homolog= gi|37524372|ref|NP _927716.1| hypothetical protein [Photorhabdus luminescens subsp. laumondii TTO1] gi|36783796|emb|CAE12656.1|
MNIVLIISSLLASLTGDPKLANLVEPKEVVAPKEEYTDEMQKCRFEPSPLVRLACYDRTVNNLKFNALQIPMENMGLVWRQAMEQEMKRTDYSTGFIVTQGENGEAPVILTTPAVGVPPPRPVLMLSCIDRITRLQVALPKPMGSGTVTVTTDKTQFKTEWFLREHGYLWESSRGLPGIEEIKRLMNSDQMTITARTGSPITFNISQLEQAAKPLRDACRW

SEQ ID NO: 9762 - protein, 264 aa, Xenorhabdus bovienii
  Peptide sequence Name=Xb4151_4152.C442.gene236.pep
  Homolog annotation: Query=1..264bp; Hit=1..266bp; Blast score=350; Percent Identity=69.0; E value=1e-95; Homolog= Pa|Phot2-74c01.p1k _g100| 59296 - 60096 1688 266 aa, chain +
MKQRLKSALALLDDDTIEQLVDHFLLVSQSSRFDALLVFLLNTNENRLECYNLPELHQASSRRLNVDIDDVNNPLIQVLRKGTPTVWDSLNHGARIDDVHFRTFVAELPHNCGLYAIPLFDCNGQACGVIAIFAEHVSHFINNENMFGLYCHVMQHRLKKLQELEQLRGQLRQIRQVFQVQQQKEKQLDELLASLSGSKPAGVSRISVDYSHIDNLPKAIEEFESAVLVQRQRQYGNDTRLIAQSLGIATRTLVYKLAKYGCRL

SEQ ID NO: 9763 - protein, 904 aa, Xenorhabdus bovienii
  Peptide sequence Name=Xb4151_4152.C442.gene237.pep
  Gene classification: Gene name=ClpA; Function=ATPases with chaperone activity, ATP-binding subunit; Function class=O Posttranslational modification, protein turnover, chaperones
  Homolog annotation: Query=1..904bp; Hit=1..911bp; Blast score=1126; Percent Identity=68.0; E value=0; Homolog= Z0254 COG0542
MIQIDLPTLVNRLNPMTRHALEAAAASCVSQQQPEITVAQLLFQMIDTPLSDVRLILNKADIDKDLLKEQLDQMMPHHQAIVQTYPNFSPMLVEWLQDSWLLASTEMQHTELRGGVMLIALLFSPMRYLTPQPARMLAGINRELLRQNFTEWTNGSAEQPFSGDDKNGQGVHPANSDSLLARFTQNMTEQARQGKLDPVLCRDNEIDLMIDILCRRRKNNPIVVGEAGVGKSALIEGLALRIINDRVPDKLRHSELMTLDLGALQAGAAVKGEFEKRFKGIMAEISQSSKPIILFIDEAHTLIGAGNQAGGLDISNLLKPALARGELKTIAATTWSEYKKYFEKDAALSRRFQLVKVSEPSAEEATVIMRGLRAIYEQAHGVLIDDEALKASAVLSDRYLSGRQLPDKAIDVLDTACARVAINLTSPPRQISSLTTELHQMQMEIDVLKREQRMGLNEHADRLEELQNQQVEIQEELVTLEKNWRQQQELVTQIIELRGQLLADSDESVAAETTDKTIENAVEETAQDAKEQEAIAQDEPEAAADEQSLIEKLALLNAQLTELQQKQTLVSPHVDKTQIASVIAEWTGVPLNRLSQSELSIVTELPTHLGQSIKGQDVAIQNLHKHLLTARADLRRPGRPLGAFLLVGPSGVGKTETVLQIAELMFGGRQYLTTINMSEFQEKHTVSRLIGSPPGYVGYGEGGVLTEAIRQKPYSVVLLDEVEKAHPDVLNLFYQAFDKGELADGEGRIIDCKNVVFFLTSNLGYQTIVDHAEQPDQLNDLLYPELAAFFKPALLARMEVIPYLPLGHETLKTIIQSKLARLDSLLSQRFNAEVTISDDVSEEILQRATRAENGARMLESIIDGALLPPVSLLLLQKMAAGTAISAIRLTVAEHEFHAEVEEAE

SEQ ID NO: 9764 - protein, 255 aa, Xenorhabdus bovienii
  Peptide sequence Name=Xb4151_4152.C442.gene238.pep
  Gene classification: Function=Uncharacterized BCR; Function class=S Function unknown
  Homolog annotation: Query=22..255bp; Hit=20..253bp; Blast score=278; Percent Identity=61.0; E value=4e-75; Homolog= Z0255 COG3455
MSDINVGSPSLEKSETLKTFQRQYQLPLRGESLNPMIDAATPLLGMVLRLQDMSDQALPDKLYQQVVTDIRAIEQFLQTKGYEPGAIVSFRYVLCTFIDETALGHGWNSQNGWLKQSLLVHFHNETWGGEKVFVLLERLMGETQRYQHLLEFIYLCLCLGYRGRYKVSTQKSDDFDRLFRRLQQQLHSLRGEAPPTTLYVDINERDERYRLSRRWTIKHLFWISVGLLAAIYSFYAIRLGDQTQDILKQLSNLLR

SEQ ID NO: 9765 - protein, 450 aa, Xenorhabdus bovienii
  Peptide sequence Name=Xb4151_4152.C442.gene239.pep
  Gene classification: Function=Uncharacterized BCR; Function class=S Function unknown
  Homolog annotation: Query=4..447bp; Hit=5..443bp; Blast score=456; Percent Identity=50.0; E value=1e-128; Homolog= Z0256 COG3522
MPGKNRVIWHEGLFIKPQHFQQQQKHNDYLAHSLVSVLAAYGHGFSSLSINQDLLNLGRIGITEASGIMQDGTIFSAPSQDLLPKPLDIESVNDLKSKDIYLALPMSSDTIREIADKEAEMQSAVRYRELPSDVRDLHTKGGDSFALNLAQLTPVLMQGSEDMSAYTAIPLCRIKEKQKDGTIVLDSEFIPTCLSIFVADKLRRFMVEIDGLLTERSRTLAKRIGSPGQQGVADVAEFMMLQLLNRVQPLFNHYAKQTVLHPLHLYTQLLQTCGELRTFTDASRLPGNVLAYDHNNLTDTFQDAMHAIRDALNVVLTPRATSIVLKQNEGGIRVATLHDNDLLRKAEFVLAISASTPQEQLRRQFVQQTKVTSMEKIRDLVSVQLPGVPLIALSAAPRQLPYHSGYTYFRLDQKSPAWKEIQQGNSIAFHVSGDFPDLDMQLWAIRGGKE

SEQ ID NO: 9766 - protein, 184 aa, Xenorhabdus bovienii
  Peptide sequence Name=Xb4151_4152.C442.gene240.pep
  Gene classification: Function=Uncharacterized BCR; Function class=S Function unknown
  Homolog annotation: Query=16..184bp; Hit=10..174bp; Blast score=159; Percent Identity=45.0; E value=1e-39; Homolog= Z0257 COG3521
MKRSASHRVWAVGILLLSAMLLNGCSGAWNATKKVGQVIWDPSTPVGKPDEQASVANITLLAEPNINPNESGEAAPVEMNLVYLSEDSRFLAADYDQLESDKLEKALGKNYIDHQDYTLLPGQYKPLSTLILEKNNRYIGVIVHYADANQSEWKKIIRVKDIGRHYNILVHVRNNDVELRKEEE

SEQ ID NO: 9767 - protein, 431 aa, Xenorhabdus bovienii
  Peptide sequence Name=Xb4151_4152.C442.gene241.pep
  Gene classification: Function=FHA-domain-containing protein; Function class=T Signal transduction mechanisms
  Homolog annotation: Query=2..420bp; Hit=10..426bp; Blast score=329; Percent Identity=45.0; E value=3e-90; Homolog= Z0258 COG3456
MEKQQPTLSLRVLNSEQLESGRSASCLFSAQGGTVGSSESHLWSVQDQQGNIHPSQFSVQWRDGAFCLQVLAEPVQINNAALTPQSSLIRLQQGDQIKAGNLSIKIHISFSDADRVDPSTVSPESLVSSYSNPLDAMMEGAVVQKAVFADDNSIAPTIQHSFSDDPLRVLDSESLTTLKQQVEADDTEQLLPPDHFQSPPFANPISDNRGSVMDQEFLDLPGITSERQYADMDVDHVAITPLMRGLDAQLPLHDSQQANDFLQEMGKTMKAAIEGLLALQREQHGLRDKQLRPIEDNPLRLNMDYDTTMQVMFSDQKSPVHLSAPAAVSESLHNLQLHYQANREAISAALDTMLEAFSPDQLLRRFSHYRRSNEVRNKDAAWAWEMYTNYYRELASSRQQGFEKLFREVYEQAYDRALRQGLEDSSNETFR

SEQ ID NO: 9768 - protein, 350 aa, Xenorhabdus bovienii
  Peptide sequence Name=Xb4151_4152.C442.gene242.pep
  Gene classification: Function=Uncharacterized BCR; Function class=S Function unknown
  Homolog annotation: Query=15..348bp; Hit=23..358bp; Blast score=354; Percent Identity=53.0; E value=9e-98; Homolog= Z0259 COG3520
MAGTDRSTLIDVITEQDPATPLALDISQYNFYQLVELLNQLAVAWEKTGETDRPDRESVRFRASASLAFPTRDVISLSQTRRGYFELEVSFMGLHGSQSPMPGYYLDSLAWEEAQNENRLTDFLNLFNHRLITLLHQIWRKYRYYVCFKKGGEDHFSQRMFSLVGLGSDVNRRMLNINHSKMLAYAGLLASPGRSPEVICSLVSHCFDLQDVTLHGWQFRKVTIPLDQQNRLGSERKGQVIGDSKLSMLGQNFTIGSWVGDYSGKFLLSINNLTRDRFLSFLPDGKNYAPLVMFISFVMRSQFAWELRLGLAENQVSGMVLGAQQNNHLGWTSFLGEPEKKPFVTISVME

SEQ ID NO: 9769 - protein, 610 aa, Xenorhabdus bovienii
  Peptide sequence Name=Xb4151_4152.C442.gene243.pep
  Gene classification: Function=Uncharacterized BCR; Function class=S Function unknown
  Homolog annotation: Query=4..610bp; Hit=5..616bp; Blast score=606; Percent Identity=50.0; E value=1e-173; Homolog= Z0260 COG3519
MSFEKYFRDELNYLRQLGKEAAVERPHLAAFLSEQGSDPDVERLLEGFAFLTGNLRAKIDDQFPELTHGLLNMLWPNYLRPTPSMTIIEYTPDESVVTKATPVKRGTQIMSNTLSTHDDIYSNEKSGGKRDEQGRCTFTLCRDVWLFPLSIQDISVNNSNEQGIIGLNFASKTELSLHELELDKLRFYLSGDDYTTSQLYFWLCYYFRKAELVVGDKVIPLPDFDFVPVGFEREDALLPYPKNAYMGYRILQEYFCFAESFLFFDVKGFPTLPEDLKTKDFKLNLHFSQALPPEAKIRHDTFRLHCTPAINLFPMDSEAIELNGSQAEYPLKASYSLPDNYDIFSVDGVESWLAGENGERSRARIGERVYTPFESFNHQIDDEDERSMRYYRLRVKESPFRRGLEHFISFVRGDESDLLRLKLKENVSISLTCTNRELPLQLRVGDINYPSIGSPTFATFRNITRPSVPLYPLLDGGLHWSLLSNMSLNYMSLLDKDALKQVLRTYDFPSIHNRQSKRSSQKRLDAIEKIETEPTDRLFRGQPVRGLRSTLYIRQQAFSSEGELYLFSTILSRFFSLYASVNAFHMLKVINLDNQECYEWPVQIGQHSLM

SEQ ID NO: 9770 - protein, 146 aa, Xenorhabdus bovienii
  Peptide sequence Name=Xb4151_4152.C442.gene244.pep
  Gene classification: Function=Uncharacterized BCR; Function class=S Function unknown
  Homolog annotation: Query=16..140bp; Hit=16..142bp; Blast score=97; Percent Identity=40.0; E value=3e-21; Homolog= VCA0109 COG3518
MAALYSWNRGSSASLFERIQGKGSGSSRQSRMRSLLDSIKKHLKEVLNSRPGACQSAIDLGVIDLNDATATSVDFKQSIEWAIEECIRNYEPRISAVSVSAINDDSDPLLLSFHISAEILLDDINDIVEFSIQLDNNRRYCLERTQ

SEQ ID NO: 9771 - protein, 492 aa, Xenorhabdus bovienii
  Peptide sequence Name=Xb4151_4152.C442.gene245.pep
  Gene classification: Function=Uncharacterized BCR; Function class=S Function unknown
  Homolog annotation: Query=15..491bp; Hit=15..491bp; Blast score=783; Percent Identity=75.0; E value=0; Homolog= VCA0108 COG3517
MAQHEENSTALASGATTSLLDEIMSQARITPENDGYYIAKQGIAAFISSILDTGANEEPINKLVVDKMIVELDKKLSEQMDEIMHAKPFQELESSWRSLKILVDRTDFRENIKINIIHATKDEMLEDFEFSPEIIQSGFYKHVYSTGYGQFGGEPVAAVIGNYAFTNSSPDIKLMQYVSAVGAMAHSPFLSSVSPEFFGVNSFTDLPAIKDLKSVFEGPSHTKWRALRESEDSRYLGLTAPRFLLRLPYSSVENPIKNFNYQENVSRDHEHFLWGNTAYLMASCLTDSFAKYRWCPNIIGPQSGGTVSDLPVHLYEAMGQVQAKIPTEVLITDRREFELAEEGFITLTMRKGSDNAAFFSANSVQKPKVFPNTREGKIAETNYKLGTQLPYMFIINRLAHYIKVLQREQIGSWKERQDLERELNMWLKQYIADQENPPTDVRSRRPLRAAEIKVLDVEGDPGWYQVAMQVRPHFKYMGASFELSLVGRLDKE

SEQ ID NO: 9772 - protein, 165 aa, Xenorhabdus bovienii
  Peptide sequence Name=Xb4151_4152.C442.gene246.pep
  Gene classification: Function=Uncharacterized BCR; Function class=S Function unknown
  Homolog annotation: Query=1..165bp; Hit=1..166bp; Blast score=185; Percent Identity=64.0; E value=2e-47; Homolog= Z0264 COG3516
MSKNSPGSVAPKERINIKYVPNTGDQTAEVELPLNLLVVGDLKGKKEDTPIEERQTVSVNKNNFNAVMNEANINLTFNVPNRLDEKNEEDMPVNLEIKSLSDFSPDNIAKKVPELNKLLELREALVALKGPLGNIPAFRTRLQSLLDDESVREQLLKELEIVNKK

SEQ ID NO: 9773 - protein, 51 aa, Xenorhabdus bovienii
  Peptide sequence Name=Xb4151_4152.C442.gene247.pep
MIIKFLFVIELELALQFANYFALHDFSFIIRSECSAATVLFNYRMKLSLTE

SEQ ID NO: 9774 - protein, 172 aa, Xenorhabdus bovienii
  Peptide sequence Name=Xb4151_4152.C442.gene248.pep
  Gene classification: Gene name=Hcp; Function=Hemolysin-coregulated protein (uncharacterized); Function class=R General function prediction only
  Homolog annotation: Query=1..172bp; Hit=1..172bp; Blast score=296; Percent Identity=80.0; E value=7e-81; Homolog= Z0266 COG3157
MPTPCYISINGKTQGNITAGAFTAESVGNIFVQGHEDEMLVQEFDHIVTVPTDPQSGQPSGQRAHKPFRFTVALNKAVPLLYNALASGEMLPTVELKWYRTSIEGKQEHFFTTKLEDATIVDIDCKMPHCQDPSKAEFTQLIRVSLSYRKINWEHTTAGTSGSDDWRAPIVA

SEQ ID NO: 9775 - protein, 44 aa, Xenorhabdus bovienii
  Peptide sequence Name=Xb4151_4152.C442.gene249.pep
MRFWCDCSINHHAKVGAGVKQYQQDSISQIGYVRNHVFMHLCLA

SEQ ID NO: 9776 - protein, 52 aa, Xenorhabdus bovienii
  Peptide sequence Name=Xb4151_4152.C442.gene250.pep
MLWEGVDISLCSMNSAWILEKFEVRMLYAVLVRLFNKSSCKSGCWRKAVSTR

SEQ ID NO: 9777 - protein, 556 aa, Xenorhabdus bovienii
  Peptide sequence Name=Xb4151_4152.C442.gene251.pep
  Gene classification: Gene name=FhaC; Function=Hemolysin activation/secretion protein; Function class=N Cell motility and secretion
  Homolog annotation: Query=8..475bp; Hit=8..475bp; Blast score=182; Percent Identity=29.0; E value=6e-46; Homolog= PA0040 COG2831
MIKKTAIFILLCTALQVKASPEELNVILPTDETRRTLQDSSREIDQLIEQRRHQGLVNRSGALSPQTVSPVLVEAPVCLDIRGVYLQGITLLTLTDLNTLSTLPDNCITSNDINKLSAEITNLYIAKGYITARVQFIPPSHHGELGINVVEGFIEAIEGGDRWINSRMLFPHLTNKPLNLSQLDQGLDQANRLQSNKATLDILPGKVNGGSVIRLSNQHSTPWRISTITDNYGQKSTGKWISRLNASMDSPLGLSDFISLSGISTVDNPDTQYNRAATLFYSLPYGAATFSGFTSYSRYISHPKLQHNVHKLYGNSQQSGMRMDWVFHRNQSQISTLNTQLVYKNFNNYFDSAKLSHSSQTLTVFSLGISHLQIIANGLITFDAGIEQGTPWFSAQTSTDNLNKQFTKGKLSVNLQQRFRLFDMSYRLNNQFYTQYSPNGLPGVEWLNITDRNAVRGFSKNTLSGDNGWYLRNTLSHSIPILKGSLDLRAGVDIGRVKGYLSQNGWQSSAGLSTGLTWRYQRLLADIEVSRGKLLSHQNRDKDESMQLLTRVSYTF

SEQ ID NO: 9778 - protein, 39 aa, Xenorhabdus bovienii
  Peptide sequence Name=Xb4151_4152.C442.gene252.pep
MDTASFPVGDNLNFFSCILLPLFTFFYCHVQPPENKTPS

SEQ ID NO: 9779 - protein, 1482 aa, Xenorhabdus bovienii
  Peptide sequence Name=Xb4151_4152.C442.gene253.pep
  Gene classification: Gene name=FhaB; Function=Putative hemagglutinin/hemolysin; Function class=M Cell envelope biogenesis, outer membrane
  Homolog annotation: Query=14..340bp; Hit=11..343bp; Blast score=137; Percent Identity=33.0; E value=8e-32; Homolog= PA0041 COG3210
MQEKKFKLSPTGKLAVSMAIILTTCSVSFANGITPGGDAGHRPDVTLADTGATVVNIVAPSDSGLSHNQYEDFNVNQMGAVLNNSLIDGSSELAGQLSANSNLNGQAASVILNEVISRNPSLLLGQQEIFGIAADYVLANPNGITCNGCGFINTNQASLVVGNPLVENGVLQGFNTFNNQNALSIKNNGLSHTDVLNLIAPKIDSHGREITAKIINITTGNNQISADGKILASQQADVGVLDSYYLGSMQAGRIRLLNTAEGSGVNLQGKMTANDSIDIKSYGDVNLQAANLKGGDITLQGNNVLSQGRLNQSSSDKDGSDNHQGSFSGLYAQQKQISESIARTQLEGKNITLVAKQNNRVMATDIVGDNVTLTGADLKLDGQQLHQLTSNTKNEWKLSWQYDVTEESEKYHHEGNTIKAHENVHLTASEGNAEVLGSKISAGNKLSVSARKDVKLAGLLESEVTAEKGYKKNHTVGLQTGNWNKNHTAQRSIGSELSAGGDLGINAGANAEIIGSQVNSGKNLIVSAGQQAKITAQSLVDNQSIAKNKKYWGGIAGGSNKDNLNKEETHHISDINANGHLLLSGMNGVTITGSKVRAQQGAYVEANDGQLIIDNVVNNSYKKVNERTGTIFNITKNSNQEHNTQQTTSNSQLVSDTDLKLLSNKDINIIGSLVKSAGELQMNTSGNINVLAYGEQNSHHQEKTDLNWQYYAHEAEDKQYRVGIGLEHTRDGQKTDVTTQRPSELNGGNLTLNASENVTVTGSKLVTTQGDAKVTGNNINLLSGENRTSTENSQVKGRGGLFLTGGMDRLGGGIEGGYASHGQSQNQTTAVVSKTQVTGNLELNATGELKQQGTQHQINGVYQANAGSIKNLATENTESNSTNQLQVDSEISGSADYSATTRPAEKTAKAASEKKLDTSIAKIGLPNAGLELAAKGNSHYTGNSQSNAVVTSIQAGNVKVTTNGDVYDQGTQYQANTGDVSLTAGSHTSEAAYNRKDSHSSDTTGNARLRVYTSTGSDISVNGKGDGSYQATSNSSANAVTSGVQAQNGIDIQVTRDARYQGTSMNAGSGSTNINAKENIQFDQATNRNEQNRTGHNGEISLTVGTNPDGKNFSASAGGGYNTDQQTSTTAQTSTLTAGQGVNLNAGNNLALKGSDVSGKQVDLTAQRGKIELTSAQDTINNNGWNVGLKGKGGMSSKARNNESGDSAGSVNAATDNSTGSSEAGNKIIDNKYNIGGEVKFGVNRLDTMTYHNGHVSGGNVTLTSGGDTSLKGTNVTADRVTGNVGGNLNVESLKDSTHSLNVGLDAGLGYSKTVKGDDKATLPVPTANSSSSETAPETAAADGKKEVPGLKDQLTAAFKGYSGKLKGNYDTLDREATGEQSTLTGTHGVNLDVAGKTYLVGGKIDSAQGTVSVNTQQIGHQPVTGYDKGRNLGVNLPDSMVGLAGAAQKDIFSGKIPFVKNESHDTATPATHSGIKGHQLD

SEQ ID NO: 9780 - protein, 51 aa, Xenorhabdus bovienii
  Peptide sequence Name=Xb4151_4152.C442.gene254.pep
MGNKWNKISWHYIPLILVLPSVLIMLALCAKWVCGKRVTGKTEKATNTVAA

SEQ ID NO: 9781 - protein, 285 aa, Xenorhabdus bovienii
  Peptide sequence Name=Xb4151_4152.C442.gene255.pep
  Gene classification: Gene name=Rbn; Function=Predicted multitransmembrane protein; Function class=R General function prediction only
  Homolog annotation: Query=7..282bp; Hit=49..324bp; Blast score=380; Percent Identity=70.0; E value=1e-106; Homolog= ZyhjD COG1295
MPRDFVPFIAHLIRAAQRFNDRMGSQFGAAITYFSFLSLIPILMLSFAIAGFVLASNPDLLTRLINGIANSISDPSLANTLKNSVDTAVNQRTTVGLTGLAIALYSGVNWVGNLREAILAQSRDVWERHHAEKEKIYSQYIRDFFSLFGLLFALVITLSLTSIAGSAQATLVHAFGLEGIEWLRPAWTLIGMTISISANYLLFLWILWILPRHQPERKALFQGTLMAAIGFEIIKYIMTIMLPKLASSPSGAAFGSVIGLMAFFYFFARLTLFCAAWIATAEKTS

SEQ ID NO: 9782 - protein, 68 aa, Xenorhabdus bovienii
  Peptide sequence Name=Xb4151_4152.C442.gene256.pep
  Gene classification: Function=Uncharacterized protein, 4 -oxalocrotonate tautomerase homolog; Function class=R General function prediction only
  Homolog annotation: Query=1..64bp; Hit=1..64bp; Blast score=79; Percent Identity=60.0; E value=8e-16; Homolog= CC2975 COG1942
MPFVNIRITREGATAEQKKQLIEGATQLLVDVLGKNPATTFVIIDEVETDNWGIGGKSVTEVRAAAKK

SEQ ID NO: 9783 - protein, 134 aa, Xenorhabdus bovienii
  Peptide sequence Name=Xb4151_4152.C442.gene257.pep
  Homolog annotation: Query=1..132bp; Hit=1..124bp; Blast score=64; Percent Identity=31.0; E value=2e-10; Homolog= gi|16766216|ref|NP _461831.1| putative cytoplasmic protein [Salmonella typhimurium LT2] gi|16421458|gb|AAL21790.1| putative cyto
MNNQKELIAHQSIMELHQWIEDVFTNDQQKGAVSLEKLLSCFSPEFSMITTRGHIAFFVQVSELFHQNIGYKPSLKIEIDSIKTLVNTGDTVVCQYRETHCMNGINQSRWSVVIIEFKEGNALWRYLHETSIVV

SEQ ID NO: 9784 - protein, 449 aa, Xenorhabdus bovienii
  Peptide sequence Name=Xb4151_4152.C442.gene258.pep
  Gene classification: Gene name=ProP; Function=77 Permeases of the major facilitator superfamily; Function class=G Carbohydrate transport and metabolism
  Homolog annotation: Query=6..442bp; Hit=6..441bp; Blast score=235; Percent Identity=37.0; E value=6e-62; Homolog= PA1313 COG0477
MTYRYRIAIIFLVGFFIDCINIFMSAIALPDIARNLSVSESTVTWVANSYLLGLTLIIPISNWLASRFGTRQIMTASMLVFSIAAFFAGMATHFFSLALFRFIQGLGGGLLIPVGQALTLSLFKKQERAKISTIIMAVALIAPAVSPGVGGIIVDHFSWHWVFFSNIPFSLIAALLSFLWIKTEKTTAPKPDLSGLFLVSLSLASLLLGLSLYAEASTKLVPYILVITGVLFALLYVRHYRRINNPVLDLNILTNIRMRFSIWVYYAVPGVFTGVNLLNIFYLQQELNWSAEKAGLLMLFYAAGSFCAILICGRIYNQLGSVRLFFAGLVLHAAGIAILVTVNTPQDQPLLIMAYLLMGIGGGIGANTAQTTAMLDFEGENLSRASTIWNLNRQICFSIGATIFAMIFNVLQHQTTPATAYHLTFIIAAISGLLPLLKLRQLAKSRETV

SEQ ID NO: 9785 - protein, 296 aa, Xenorhabdus bovienii
  Peptide sequence Name=Xb4151_4152.C442.gene259.pep
  Gene classification: Gene name=LysR; Function=Transcriptional regulator; Function class=K Transcription
  Homolog annotation: Query=6..294bp; Hit=4..297bp; Blast score=181; Percent Identity=34.0; E value=1e-45; Homolog= PA1312 COG0583
MMNNQLNRIQTFIAVVDCGSFTRAAERLLISKAMTSIHVKRLEESLNIPLLIRNSRGVALTEAGQFLYNEFSEIFINIQSSLDNVAEQYLSLSGTLHITSTIEFGDRFLLPLIGEFCKIHPQLNVSYDAGSALNDLISDRLDLAIRLGVLRDSSLKSRKIADFKIYMVASPDWLEKNKLETVNDLKDVDWIANSNLQTPTHWELSHSTLPSIDIRAKARFNANSSTSIKTMAIAGFGVTVLPEWMIETELQSGNLVRLFPEYSLPKQPVTIVYPNGHQIQRKCRVFIDYLIDKLKL

SEQ ID NO: 9786 - protein, 494 aa, Xenorhabdus bovienii
  Peptide sequence Name=Xb4151_4152.C442.gene260.pep
  Gene classification: Gene name=PqqL; Function=Predicted Zn-dependent peptidases; Function class=R General function prediction only
  Homolog annotation: Query=1..472bp; Hit=1..473bp; Blast score=482; Percent Identity=52.0; E value=1e-136; Homolog= ZyhjJ COG0612
MQGKKIGYLIGGAILATSYLAQAEILQPDPAWQQGKLENGFSWQALQTPQRPNDRIQLRLIVKTGSLAEKTQQHGYTYLIPKVVLFSSKDLSSQKLENLWRNAIDSKNPLPPAIVSYDFTLYSLSLPNNRPDLLKDALVWLSDIAGGAVFTPETLAQAMKATDHSVATLPADIQDPVWRMRLQGSTLLDHDPGASVSMPVDVKKIEAFYRQWYTPDAMTLYVAGHVDSRVLSERINQVFSPLKGKRQTPVAVATLLPLKSETLGVVSDKAQQDRLSLVWNLNWQPINDSQTLLQYWLNDLAREALYRYLQLGREEKQADMKLDLDCRILYQRANCFLNMDTSSDKLTESTLYLASELASLRENGLPQEQFDELYAQKRLQLQQLFAVYARTNTDLLINQRLISQQNNVVDIAPEQFQRLRQTFLSSLTPPLLNKKLKEMLSQDISFILVQPKDETAVNVNQLRNGFNQIMRPGPVPETPAIDTKQDADIKKGAE

SEQ ID NO: 9787 - protein, 66 aa, Xenorhabdus bovienii
  Peptide sequence Name=Xb4151_4152.C442.gene261.pep
MAPPIRYPIFLPCILTYPYLFSFILVIPGFTCHSLTIHAKPLMPTTNQQGFILIAVSAYQSDDYSL

SEQ ID NO: 9788 - protein, 235 aa, Xenorhabdus bovienii
  Peptide sequence Name=Xb4151_4152.C442.gene262.pep
  Homolog annotation: Query=1..232bp; Hit=1..232bp; Blast score=347; Percent Identity=78.0; E value=9e-95; Homolog= Pa|Phot2-74c01.p1k _g164| 109015 - 109749 1334 244 aa, chain -
MKLRVKRSLTIKQMAAVTGVALITIAIFITIQLSHLLQQRKDDYISQLNNAAAQVQVPLAEALLNSDLNKAKTLLIGLKTSGILGRADVVSPNNARVMSLDFATYRPIPELAKQIFGIPVEVQIPLHIYGITPQTEASQGYLILQVDSNRVYRFALNTLALMLTTYLLLALILTVAISWCVNRIIIHPLRDVARALNEEQPTAPILCPKNHQDDELGLLVKGYNRQIDKQKLRLK

SEQ ID NO: 9789 - protein, 36 aa, Xenorhabdus bovienii
  Peptide sequence Name=Xb4151_4152.C442.gene263.pep
MSSKQKNDRNITFMFNNVCIIHIISTLYHGQRRLSG

SEQ ID NO: 9790 - protein, 343 aa, Xenorhabdus bovienii
  Peptide sequence Name=Xb4151_4152.C442.gene264.pep
  Gene classification: Gene name=OppF; Function=ABC-type dipeptide/oligopeptide/nickel transport system, ATPase component; Function class=E Amino acid transport and metabolism
  Homolog annotation: Query=13..343bp; Hit=4..334bp; Blast score=546; Percent Identity=83.0; E value=1e-155; Homolog= ZdppF COG1124
MSEQNIRNQNRREQEKATAPLLKATELKKYYPVKTGMFAPERMVKALDGVSFELEKGKTLAVVGESGCGKSTLGRLLTMIEKPTEGELYYQGQDLLVPDKQAEKLRRQKIQIVFQNPYASLNPRKKVGQILEEPLLINTSLAAAERKEQVLKMMEKVGLKPEYYQRYPHMFSGGQRQRIAIARGLMLNPDVLIADEPVSALDVSVRAQVLNLMMDLQQDLGLSYVFISHDLSVVEHIADEVMVMYLGRCVEKGSKDQIFNNPRHPYTQALLSATPRLNPALRRERIKLTGELPSPMNPPPGCAFAARCRRAFGHCTQFQPKLRKYDEQLVACFAIEQDENSSR

SEQ ID NO: 9791 - protein, 343 aa, Xenorhabdus bovienii
  Peptide sequence Name=Xb4151_4152.C442.gene265.pep
  Gene classification: Gene name=DppD; Function=ABC-type dipeptide/oligopeptide/nickel transport system, ATPase component; Function class=E Amino acid transport and metabolism
  Homolog annotation: Query=18..343bp; Hit=1..327bp; Blast score=557; Percent Identity=85.0; E value=1e-159; Homolog= dppD COG0444
MGCVTHSILSSSSRGIEMALLNVDQLSVHFGEENAPFRAVDRISYSVEQGQVVGVVGESGSGKSVSSLAIMGLVDYPGRVMAEKLEFNGRDLTKISEKERRQLVGAEVAMIFQDPMTSLNPCYTVGFQIIEALKVHQGGSRKTRYQRAVDLLTLVGIPDPASRLDVYPHQLSGGMSQRVMIAMAIACRPKLLIADEPTTALDVTIQAQIIELLLELQQQENMALVLITHDLALVAEAAHHIIVMYGGQVVEAGKATEIFRAPRHPYTQALLRALPEFSTDKSRLASLPGVVPGKYDRPTGCLLNPRCPYANEHCRQVEPALKTVGESQVKCHMPLDDEGRPTV

SEQ ID NO: 9792 - protein, 316 aa, Xenorhabdus bovienii
  Peptide sequence Name=Xb4151_4152.C442.gene266.pep
  Gene classification: Gene name=DppC; Function=ABC-type dipeptide/oligopeptide/nickel transport systems, permease components; Function class=E Amino acid transport and metabolism
  Homolog annotation: Query=17..316bp; Hit=1..300bp; Blast score=409; Percent Identity=84.0; E value=1e-114; Homolog= dppC COG1173
MASSTHVSVIRNKEHVMTQTTEPAVSGAPKLMTPIQEFWHYFKRNKGAVVGFAYIVLMLLVALLANVLAPHGPAEQFRDSLLVPPIWQDGGSWQFILGTDDVGRDILSRLMYGARLSLLVGCLVVVMSLVMGIILGVLAGYFGGLVDTIIMRIVDIMLALPSLLLALVLVAIFGPSIVNASLALTFVALPHYIRLTRAAVLVEVNRDYVMASQVAGAGAIRQMFINILPNCLAPLIVQASLGFSNAILDMAALGFLGMGAQPPTPEWGTMLADVLQFAQSAWWVVTFPGLAILLTVLAFNLMGDGLRDALDPKLKQ

SEQ ID NO: 9793 - protein, 339 aa, Xenorhabdus bovienii
  Peptide sequence Name=Xb4151_4152.C442.gene267.pep
  Gene classification: Gene name=DppB; Function=ABC-type dipeptide/oligopeptide/nickel transport systems, permease components; Function class=E Amino acid transport and metabolism
  Homolog annotation: Query=1..339bp; Hit=1..339bp; Blast score=539; Percent Identity=87.0; E value=1e-153; Homolog= dppB COG0601
MLQFILRRLGMVIPTFIGITLLTFAFVHMIPGDPVLIMAGERGVSAERHAELMAAMGLDKPLWEQYFHYINGIFHGDLGISLKSRIPVWDEFVPRFKATLELGVCAMLLAISVGIPVGVLAAVKRGSVFDHTAVGVSLTGYSMPIFWWGIMLIMLVSVQWNLTPVSGRISDSVFLDDSYPLTGFMLIDTLFWGEEGDFIDAVMHMLLPAVVLGTIPLAVIVRMTRSAMLEVLGEDYIRTARAKGLSRMRVIIIHALRNALLPVVTVIGLQVGIMLAGAILTETIFSWPGLGRWLIDALQRRDYPVVQGGVLLVATMIILVNLVVDLLYGVVNPRIRHKK

SEQ ID NO: 9794 - protein, 68 aa, Xenorhabdus bovienii
  Peptide sequence Name=Xb4151_4152.C442.gene268.pep
MCTKAKVSSVIPINVGITIPKRRRINCSISWVLFLITSYSSQAVWCNTRVNLPVREAKPSPQNNLGDG

SEQ ID NO: 9795 - protein, 536 aa, Xenorhabdus bovienii
  Peptide sequence Name=Xb4151_4152.C442.gene269.pep
  Gene classification: Gene name=OppA; Function=ABC-type dipeptide/oligopeptide/nickel transport systems, periplasmic components; Function class=E Amino acid transport and metabolism
  Homolog annotation: Query=5..536bp; Hit=4..535bp; Blast score=872; Percent Identity=78.0; E value=0; Homolog= dppA COG0747
MATSSKKKFSLLKLGIGLVALAVTASVQAKTLVYCSEGSPEGFNPQLFTSGTTYDATSRQIYNRLVDFKAGTTNVIPSLAERWDVSDDGKAYTFYLRKGVKWHSTKEFKPTRDFNADDVIFTFMRQKDKNHPYHKVSGGSYEYFIGMDLDNIISKIEKVDDYTIRFVLSRPEAPFLADLAMDFASVLSKEYADVMMKAGTPEKVDLDPIGTGPFQLQQYQKDSRILYKAFKDYWEGPAKIDRLVFSITPDASVRYAKLQKNECQVMPYPNPADISRMKQDKNIVLKEQAGMNVGYLSFNVDKKPMDNLKVRQALAMAVNKDAIIDAVYQGAGQKAKNLIPPTMWSYDDDIKDYAYDPAKAKELLKEAGFPNGFETDLWAMPVQRPYNPNARRMAEMIQADWAKIGIKAKIVSYEWGEYLKRAKDGEPQTVMMGWTGDNGDPDNFFGTLFSCAAKEKGSNYSKWCYKPFEDVIKPARETADNAKRTALYKQAQVVMHEQVPALIVAHSTVYEPIRKEVKGYLVDPLGRHLFYNVTLD

SEQ ID NO: 9796 - protein, 51 aa, Xenorhabdus bovienii
  Peptide sequence Name=Xb4151_4152.C442.gene270.pep
MNKEKDNELSNQGNSVPERITDSFRDEIQIDEQFYQTDRDITSMFKIGIKE

SEQ ID NO: 9797 - protein, 37 aa, Xenorhabdus bovienii
  Peptide sequence Name=Xb4151_4152.C442.gene271.pep
MLVGERGFEPPTHWSQTSCATKLRYSPKTKRILLPAP

SEQ ID NO: 9798 - protein, 182 aa, Xenorhabdus bovienii
  Peptide sequence Name=Xb4151_4152.C443.gene1.pep
  Gene classification: Gene name=FldA; Function=Flavodoxins; Function class=C Energy production and conversion
  Homolog annotation: Query=1..168bp; Hit=1..168bp; Blast score=201; Percent Identity=55.0; E value=4e-52; Homolog= hemG COG0716
MNCLLLYSTQDGQTKKIITYIAENLRRAGAECDLRDLATIKHINLKPYHKVMIGASIRYGHFNSVLHKFAIRHQKQLNQMPTAFFGVNLTARKLEKRTPETNAYLRKFLMKSPWKPNLCDVFAGALLYPRYRWLDRIMIQFIMRMTGGETDTTKEIEYTDWEQVDLFSGRFLQISCEKVPQK

SEQ ID NO: 9799 - protein, 483 aa, Xenorhabdus bovienii
  Peptide sequence Name=Xb4151_4152.C443.gene2.pep
  Gene classification: Gene name=TrkG; Function=Trk-type K+ transport systems, membrane components; Function class=P Inorganic ion transport and metabolism
  Homolog annotation: Query=1..483bp; Hit=1..483bp; Blast score=694; Percent Identity=84.0; E value=0; Homolog= ZtrkH COG0168
MHFRAITRIVGLLVILFSVTMIIPGLVALIYRDGAGRAFSQTFIFALVIGLMLWVPNRNQKHDLKPKEGFLIVVLFWTVLGSVGALPFIFSEKPNLSVTDAFFESFSGLTTTGATTLIGLDSLPKAILFYRQMLQWLGGMGIIVLAVAILPLLGVGGMQLYRAEMPGPLKDNKMRPRIAETAKTLWLIYVLLTIACAIALWAAGMSIFDAISHSFSTIAIGGFSTHDASIGFFNSPAINTIIAIFLLISGCNFGLHFAVLSGRSLKVYWRDPEFRMFITIQLALLVICVLILWQQSIYESGLDALNHAFFQVVSMATTAGFTTVSFADWPLFLPFLLLCSAFIGGCAGSTGGGLKVIRILLLFLQGSRELKRLVHPNAVYTIKLGQRALPERIIEAVWGFFSAYVLVFLISMLLLIATGVDEFSAFSAIAATLNNLGPGLGAVSDNFTTMNPAAKWILVVTMLFGRLEVFTLLVLFTPTFWRE

SEQ ID NO: 9800 - protein, 203 aa, Xenorhabdus bovienii
  Peptide sequence Name=Xb4151_4152.C443.gene3.pep
  Gene classification: Function=Uncharacterized ACR; Function class=S Function unknown
  Homolog annotation: Query=1..199bp; Hit=2..200bp; Blast score=233; Percent Identity=63.0; E value=1e-61; Homolog= ZyigZ COG1739
MKPYLIPAASVNFTEEIKKSRFITLLEHTSGVNEAKLFIQSIKEQYPDARHHCWAFVAGAPDDSQQLGFSDDGEPTGTAGKPMIAQLIGSGMGEITAVSVRYFGGIKLGTGGLVKAYGNGVQQALKLLETEYKVPQKLYQLQCEYAYISMVEQLLQKFSGQVIASEYAENVTLQVSLPATLAGEIGDKLRDLSRGALFLTPKS

SEQ ID NO: 9801 - protein, 444 aa, Xenorhabdus bovienii
  Peptide sequence Name=Xb4151_4152.C443.gene4.pep
  Gene classification: Gene name=PepP; Function=Xaa-Pro aminopeptidase; Function class=E Amino acid transport and metabolism
  Homolog annotation: Query=1..444bp; Hit=1..443bp; Blast score=646; Percent Identity=69.0; E value=0; Homolog= pepQ COG0006
MEKLASLYHEHIKILQRRAREILARNQLDALLIHSGESLRVFLDDCDYPFKVNAHFKAWVPVTKVPNCWLWVDGVNKPKLWFYSPVDYWHSVEALPNSHWTEEVELIHLAKADDIKAELSGLSKQNTAYIGEQTERAKNLGILEHNINPKMVLDYLSYHRSYKTDYELVCMREAQKTAVNGHLAAYDAFTSGVSEFEINMFYLMATGHRDTDVPYNNIIALNENAAVLHYTKLQQTLPSEIRSFLIDAGAEYNGYVADITRTYAAKHNNDFASLIKDLNGEQQAIIGSIKAGIRYTDYHINMHRRIAKLLKKHGIINGITEETMVEKGLTTPFFPHGLGHSLGLQVHDAAGFMQDDTGTHLAAPTLHPYLRCTRILEPRMVLTIEPGIYFIETLLAPWRENEYSKHFDWKKIDMFKLYGGIRIEDNIVIHDGKIENMTRDLQLS

SEQ ID NO: 9802 - protein, 728 aa, Xenorhabdus bovienii
  Peptide sequence Name=Xb4151_4152.C443.gene5.pep
  Gene classification: Gene name=FadB; Function=3-Hydroxyacyl-CoA dehydrogenase; Function class=I Lipid metabolism
  Homolog annotation: Query=308..715bp; Hit=2..409bp; Blast score=615; Percent Identity=72.0; E value=1e-176; Homolog= fadB_2 COG1250
MLYLSDTIQVNWLKDGIAELIFNAPAAINKLDTKTVASLDKAVAVLEQQTKLKGLLLRSEKQAFIVGADITEFLSLFDAPKEKLQEWLKFANDIFSRIEDLPVPTISAINGYALGGGCEVVLSTDFRVASPDLRIGLPETKLGIIPGFGGSVRLPRLIGPDNALEIITAGKDIGAEEALKNGLIDAVVPTEKLVDAAVSILELAIKGDLDWQAARQPKLSPLNLNDVERTMSFTVAKGMVMKVAGPHYPAPITAVKTIEKAATLGRDEALKLEAESFVPLAHTTVARALVGIFLNDQYVKGLAKKHLKEVTVPQHATILGAGIMGGGIAYQSARKGVPVLMKDINQKALDLGVNEAAKLLHKQFERGRLDAMKMAKILSSIQPTLSYAGIEQSQIVVEAVVENPKIKAAVLAETESHINDDCILASNTSTIPITELAKSLKRPENFCGMHFFNPVHRMPLVEIIRGEKTSDKTISTVVAYASKMGKTPIVVNDCPGFFVNRVLFPYLAGFGMLLRDGGDFRQIDKIMEKEFGWPMGPAYLIDVVGIDTAHHAQAVMAQGFPERMTRDYHDAIDVLFENQRYGQKNDVGFYKYTQDKKGKPKKEQDETVDQLLAGISHPKQIFSGEDIIARTMIPMINEVVRCLEEGVIASPAEADMALVYGLGFPPFHGGVFRYLDTMGTAAYVKLAERYAHLGAMYHVPAGLKAKSESNESYYPAAAKIAVNPGEKA

SEQ ID NO: 9803 - protein, 387 aa, Xenorhabdus bovienii
  Peptide sequence Name=Xb4151_4152.C443.gene6.pep
  Gene classification: Gene name=PaaJ; Function=Acetyl-CoA acetyltransferases; Function class=I Lipid metabolism
  Homolog annotation: Query=1..387bp; Hit=1..387bp; Blast score=591; Percent Identity=77.0; E value=1e-169; Homolog= ZfadA COG0183
MENVVIIDGIRTPMGRSKGGVFRQVRAEDLSAHLMKSILKRNPSVQPEHIDDISWGCVQQTLEQGFNIARNSALLAGIPHSVPAVTVNRLCGSSMQSLHDGARMIMTGDASIAMIGGVEHMGHIPMTHGVDFHSKLNRNVAKAAGVMGLTAEMLAKMHGISREMQDEFALRSHLRAAQATESKAFSNEIAPIHGHDADGNLKFIDFDEVIRPDTNLKNLAGLRPVFDPVTGSVTAGNSSALSDGASAMLIMSESKAKELGLKARARIRSMAVVGCDPSIMGYGPVPATQMALKKAGLSLADIGLIELNEAFAAQSLACMKGLNLLDSMDDRINLNGGAIALGHPLGCSGARITTTLLNLMERKDVQFGLATMCIGLGQGIATIIERV

SEQ ID NO: 9804 - protein, 233 aa, Xenorhabdus bovienii
  Peptide sequence Name=Xb4151_4152.C443.gene7.pep
  Gene classification: Gene name=UbiB; Function=2-polyprenylphenol hydroxylase and related flavodoxin oxidoreductases; Function class=H Coenzyme metabolism
  Homolog annotation: Query=1..233bp; Hit=1..233bp; Blast score=362; Percent Identity=75.0; E value=1e-100; Homolog= ubiB COG0543
MTTLSCKVTSVDSITDTVYRVHLLPDSPFSFRAGQYLMVVMDERDKRPFSMASPPSEKQTIELHIGASELNLYAMAVMDRILDQRVIDIDIPHGQAWFREDSENPMLLIAGGTGFSYTRSILLSALEKNPNRDISIYWGGRELHHLYDLGELQGLSECYPNLAVVPVVEQVDEYWQGRTGTVLSAVLEDFGSLANHDIYIAGRFEMAKIARERFCSERDASIDRMYGDAFEFI

SEQ ID NO: 9805 - protein, 490 aa, Xenorhabdus bovienii
  Peptide sequence Name=Xb4151_4152.C443.gene8.pep
  Gene classification: Gene name=UbiD; Function=3-polyprenyl-4 -hydroxybenzoate decarboxylase and related decarboxylases; Function class=H Coenzyme metabolism
  Homolog annotation: Query=1..487bp; Hit=4..490bp; Blast score=905; Percent Identity=87.0; E value=0; Homolog= ZyigC COG0043
MKYRDLRDFLSLLEQSGELKRIRMEVDPYLEMTEIADRTLRAGGPALLFENPKGYSMPVLCNLFGTPKRVAMGMGQDDVKALHDVGKLLAFLKEPEPPKGFRDLVDKLPKFKQVLNMPTKRLNSAPCQEQVWTGDEVDLTRIPVMHCWPEDAAPLITWGLTVTRGPNKERQNLGIYRQQVLGKNKLIMRWLSHRGGALDFQEWCQAHPGERFPVSVALGADPATILGAVTPIPDTLSEYAFAGLLRGHKTEVVKCLSNDLEVPASAEIILEGYIEPDEMAPEGPYGDHTGYYNEVDMFPVFTITHITQRRDAIYHSTYTGRPPDEPAVLGVALNEVLVPILQKQFPEIVDFYLPPEGCSYRLAVVTMKKQYAGHAKRVMMGVWSYLRQFMYTKFIIVCDDDINARDWNDVIWAITTRMDPQRDTVLMENTPIDYLDFASPVSGLGSKMGLDATNKWPGETQREWGRPIVMSDEIRARVDEIWDKLEILKR

SEQ ID NO: 9806 - protein, 41 aa, Xenorhabdus bovienii
  Peptide sequence Name=Xb4151_4152.C443.gene9.pep
MSYCSRNLPAFTVQKIPASHNIPTPLHNMSSITKPRLQDHQ

SEQ ID NO: 9807 - protein, 162 aa, Xenorhabdus bovienii
  Peptide sequence Name=Xb4151_4152.C443.gene10.pep
  Gene classification: Gene name=NusG; Function=Transcription antiterminator; Function class=K Transcription
  Homolog annotation: Query=1..162bp; Hit=1..162bp; Blast score=215; Percent Identity=62.0; E value=1e-56; Homolog= rfaH COG0250
MGSWYLLYCKRGQISRAIGHLERQDVICLTPTAKIEKIVRGKRTTVTEPLFPNYLFVNFDPEIIHTTTINSTRGVNHFIRFSTYPAVVPQTLIDELMSATEQEYIAPETPITGDTVLITEGIFEGIQAIYNEPDGETRSILLLNILNKEVSKILDNKQFIKI

SEQ ID NO: 9808 - protein, 338 aa, Xenorhabdus bovienii
  Peptide sequence Name=Xb4151_4152.C443.gene11.pep
  Gene classification: Gene name=HemB; Function=Delta-aminolevulinic acid dehydratase; Function class=H Coenzyme metabolism
  Homolog annotation: Query=1..335bp; Hit=1..335bp; Blast score=511; Percent Identity=72.0; E value=1e-145; Homolog= VC0105 COG0113
MSYVFPGTFPGRRMRRVRRHDFSRRLVAENQLTVNDLIYPVFVMEGINQRQEVSSMPGVYRLTIDLLLKEAEEIARLGIPVLSLFPAIEADKKSLDAQESYNPDGLIQRSIRALKNEVPELGLLTDVALDPFTTHGQDGVIDQDGYVINDITKEILVKQALSHAEAGAEIVAPSDMMDGRIGAIRDQLEVDGYINTQIMAYSAKYASCYYGPFRDAIGSSGNLKGGNKMTYQMDPANSDEALQEIAQDLQEGADSVMVKPGMPYLDVIRRVKDTFGVPTFAYQVSGEYAMHVAAIQNGWLKEQPAIMESLLCFKRAGADGVLTYFAKRVAQWLNEQKY

SEQ ID NO: 9809 - protein, 259 aa, Xenorhabdus bovienii
  Peptide sequence Name=Xb4151_4152.C443.gene12.pep
  Gene classification: Gene name=TatC; Function=Sec-independent protein secretion pathway component TatC; Function class=N Cell motility and secretion
  Homolog annotation: Query=1..258bp; Hit=1..258bp; Blast score=348; Percent Identity=73.0; E value=2e-96; Homolog= tatC COG0805
MSVDDTQPLIGHLIELRKRILNSLITVLVIFLALVYFSNDIYRLIAAPLMEQLPKGANMIATDVASPFFTPIKLTIMVSIVVSAPMILYQVWAFIAPALYKHERRLIMPLLFSSSVLFYLGMAFAYFVVFPIAFGFFVKTVPAGVVISTDISNYLSFVMALFMAFGVSFEVPVAIILLCWSGVVTPESLKRKRPYILVGAFVVGMLLTPPDVFSQTLLAIPMYLLFEVGILLSQFYVGGRKSGRAENESEYDEGNNPEK

SEQ ID NO: 9810 - protein, 130 aa, Xenorhabdus bovienii
  Peptide sequence Name=Xb4151_4152.C443.gene13.pep
  Gene classification: Gene name=TatA; Function=Sec-independent protein secretion pathway components; Function class=N Cell motility and secretion
  Homolog annotation: Query=15..125bp; Hit=1..114bp; Blast score=84; Percent Identity=54.0; E value=3e-17; Homolog= tatB COG1826
MVIGLVVLGPERLPIAVKTVAGWIRVLRSLAANVQNELAQELKVQELQDSLKKMEEKVDLQSLSPELKASMDELREAAESLKKSYQLTPEEAKALEEDETHFHSSVSHSVPESASKQNKNQSPEKANSEH

SEQ ID NO: 9811 - protein, 82 aa, Xenorhabdus bovienii
  Peptide sequence Name=Xb4151_4152.C443.gene14.pep
  Gene classification: Gene name=TatA; Function=Sec-independent protein secretion pathway components; Function class=N Cell motility and secretion
  Homolog annotation: Query=2..80bp; Hit=18..94bp; Blast score=83; Percent Identity=63.0; E value=4e-17; Homolog= tatA COG1826
MISIPQLLIIAVIVVLLFGTNKLRSLGSDLGASIKGFKKAISDDEKSDQAEKNSHDADFDTKSIAEKSTVAEKSESKNKEQV

SEQ ID NO: 9812 - protein, 562 aa, Xenorhabdus bovienii
  Peptide sequence Name=Xb4151_4152.C443.gene15.pep
  Gene classification: Gene name=AarF; Function=Predicted unusual protein kinase; Function class=R General function prediction only
  Homolog annotation: Query=21..562bp; Hit=1..546bp; Blast score=840; Percent Identity=76.0; E value=0; Homolog= aarF COG0661
MQLPMICLIWKNGWRHWRENMTPSEIKRLYFIVRVFLSYGLDELIPNIRLTWPLRFGRYFLFWLPNRHKDKPLGERLRLALQELGPVWIKFGQMLSTRRDLFPPAIADQLSMLQDRVVSFDGAVARKSIEIALGGPLETWFDDFDSQPLASASIAQVHTARLKENGKEVVLKVIRPDILPVIKADVRLMYRMAHLVPLLPDGYRLRPREVVREYEKTLLDELNLLREAANAIQLRRNFEDSSMLYVPEIYPDYCRENVLVMERIYGIPVSDIAMLEARNTDMKLLAERGVQVFFTQVFRDSFFHADMHPGNIFVSYERPEDPTYIGIDYGIVGSLNKDDKRYLAENFIAFFNRDYRRVAELHVDSGWVPADINVEDFEFAIRTVCEPIFEKPLAEISFGHVLLNLFNTARRFNMAVQPQLVLLQKTLLYIEGLGRQLYPQLDLWKTAKPFLEDWLHDQVGIPAIVRAFKEKAPYWAEKLPEFPELVYGALQQHKRLQTSIDQISQQLQKQQVSQKKSLYLLGIGATLFICGSLFFMTDKIHLSWWLMGAAVISWIFGWRRLK

SEQ ID NO: 9813 - protein, 216 aa, Xenorhabdus bovienii
  Peptide sequence Name=Xb4151_4152.C443.gene16.pep
  Gene classification: Function=Uncharacterized BCR; Function class=S Function unknown
  Homolog annotation: Query=17..213bp; Hit=5..201bp; Blast score=208; Percent Identity=50.0; E value=3e-54; Homolog= yigP COG3165
METPELSDNLNSTVLFPVLTAFLETTLNHLLYRETVLKSSRMRLAGKVLSIELKEIKTPLVLIFSEKQVDVLSQWSESADCSMKTTFTALLKLRDRHCLSSLINSGEIVIEGDMQVMQQWSALLDMSEWDPAHYLSPYVGDIVAEGLSRVMKGSIKLASNAITRQKTYLTESLTEEWRVAPNPLEVAYFSEEVNAVANDMSHMEKRLAALEGKYDS

SEQ ID NO: 9814 - protein, 251 aa, Xenorhabdus bovienii
  Peptide sequence Name=Xb4151_4152.C443.gene17.pep
  Gene classification: Gene name=UbiE; Function=Methylase involved in ubiquinone/menaquinone biosynthesis; Function class=H Coenzyme metabolism
  Homolog annotation: Query=1..251bp; Hit=1..251bp; Blast score=414; Percent Identity=78.0; E value=1e-116; Homolog= ZubiE COG2226
MADQSKKTTDFGFRTVEKDEKQNMVAEVFHSVASKYDLMNDLMSFGIHRIWKRFTIDASGIRRGHKVLDLAGGTGDLTAKFSRIVGEKGEVVLADINESMLKVGREKLRDIGIVGNVNYVQANAEELPFSDNYFDCITISFGLRNVTDKEKALRSMCRVLKPGGRLLVLEFSKPMLAPLSKVYDAYSFHVLPRIGQMIVKDADSYRYLTESIRMHPDQETLKSLMEEAGFDQVSYTNMTGGIVALHKGFKF

SEQ ID NO: 9815 - protein, 444 aa, Xenorhabdus bovienii
  Peptide sequence Name=Xb4151_4152.C443.gene18.pep
  Gene classification: Function=Uncharacterized BCR; Function class=S Function unknown
  Homolog annotation: Query=1..436bp; Hit=5..443bp; Blast score=499; Percent Identity=62.0; E value=1e-141; Homolog= yigN COG1322
MLIGSLSGLLGGGIFVWLSVHQRIQQKELELRELHSQLAISHEKLEQSHYWRTECDQLNQELLAQREINSVQEVELRELSTRLEESRLAAEEKQRLLINSEQRLNTQFENLANRIFEQNRRRTDEYSRQSLNDLLMPFREQLDGFRSQVQDSFGQEARERHTLTHEIRNLQQLNAQMAKEAINLTKALKGDNKMQGDWGEMVLARVLESSGLREGYEFHTQVNIKTENGERFQPDVIVHLPQEKDVIIDAKMSLIAYERYFNSDDDTQQAQALQEHINSIKGHIRGLSRKDYQQLPGLRSLDYVLMFIPIEPAYLVALNQAPELLDEALKHNIMLVSPSTLLVAVRTINNLWRYEYQSQNARLIADKATRMYDKMRLFVDDMQGLGHSLNKAQESYHLAMKKLAEGRGNLISQAEGFRDLGVDVKRPIDSQLIDKSFQSLQVNE

SEQ ID NO: 9816 - protein, 176 aa, Xenorhabdus bovienii
  Peptide sequence Name=Xb4151_4152.C443.gene19.pep
  Gene classification: Gene name=DedA; Function=Uncharacterized membrane-associated protein; Function class=S Function unknown
  Homolog annotation: Query=13..164bp; Hit=11..162bp; Blast score=125; Percent Identity=46.0; E value=3e-29; Homolog= mll0121 COG0586
LSLHEIIELVTDFVKAHEYWAIPIVFLLAFGESLAFISLLLPATIILLGLGALIGESGLNFWPIWIAAAAGAFFGDWVSYLFGAHYKDNVGKMWPLSRHPQMLVRGHRFFERWGVWGVFIGRFFGPLRAVIPLVAGICAMPKRHFQLANFASALIWAFGILAPGAFGLRWLAEWMG

SEQ ID NO: 9817 - protein, 260 aa, Xenorhabdus bovienii
  Peptide sequence Name=Xb4151_4152.C443.gene20.pep
  Gene classification: Function=Protein tyrosine/serine phosphatase; Function class=T Signal transduction mechanisms
  Homolog annotation: Query=11..259bp; Hit=4..256bp; Blast score=100; Percent Identity=31.0; E value=1e-21; Homolog= CC2955 COG2365
MTTTLLSHPSLLPLHGGINFRDFGNKTLHNGAKIKSGLLFRSGSLDMLTENDQTFLMSKNLFQIIDYRDSSEIEDKPDRVWRGANYHHAPANPLSKEVDANLEKLGQERLEQFDERAFMLRLYELLPISNPAYKKLANLLVQPEKGGILQHCAVGKDRTGVGSALVLFALGADLDTVMEDYLVTNVTLAPYREYLLNEHAKVMSDRVIEKFAYVYSVQEEFLLTALNSINQHYGSVDIWLEKDIGLDMTAREKLQSYFLE

SEQ ID NO: 9818 - protein, 251 aa, Xenorhabdus bovienii
  Peptide sequence Name=Xb4151_4152.C443.gene21.pep
  Gene classification: Gene name=Udp; Function=Uridine phosphorylase; Function class=F Nucleotide transport and metabolism
  Homolog annotation: Query=2..251bp; Hit=4..253bp; Blast score=434; Percent Identity=86.0; E value=1e-122; Homolog= udp COG2820
MSDVFHLGITKSDLQGATLAIVPGDPNRVEKIAKLMDNPVHLASHREFTTWRAEIDGKPVVVCSTGIGGPSTSIAVEELAQLGVSTFLRIGTTGAIQPHINVGDVLVTTAAVRLDGASLHFAPMEFPAVADFECTNALYAAAKASGSATHVGITASSDTFYPGQERYDTYSGRVVRRFQGSMQEWQQMGVMNYEMESATLLTMCASQGLRAGMVAGVIVNRTQQEIPDVELLKKTESNALGIVVDAARRLL

SEQ ID NO: 9819 - protein, 32 aa, Xenorhabdus bovienii
  Peptide sequence Name=Xb4151_4152.C443.gene22.pep
MIYWFDHIKHLLRCINKHKAIVMLLNKDRCNM

SEQ ID NO: 9820 - protein, 45 aa, Xenorhabdus bovienii
  Peptide sequence Name=Xb4151_4152.C443.gene23.pep
VAGEKIISPISPEPIHEWIVLPTQHIDDLIKKAHRNSLLVDDLLV

SEQ ID NO: 9821 - protein, 764 aa, Xenorhabdus bovienii
  Peptide sequence Name=Xb4151_4152.C443.gene24.pep
  Gene classification: Gene name=MetE; Function=Methionine synthase II (cobalamin-independent); Function class=E Amino acid transport and metabolism
  Homolog annotation: Query=1..754bp; Hit=1..751bp; Blast score=1245; Percent Identity=79.0; E value=0; Homolog= metE COG0620
MTVLNHTLGFPRIGLKRELKKAQENYWAGKISQQELLETGRELRARHWQQQKEAGVDLVPVGDFAWYDQVLTTNLLLGNVPPRHQNEDGSIDLDTLFRIGRGRAPTGTPAAASEMTKWFNTNYHYIVPEFQQGQEFKLTWTQLLDEVDEALALGHKVKPVLLGPVTYLWLGKVKGKAFDRLSLLTDILPVYQQVLAELAKRGIEWVQIDEPALVLELPKEWLEAFSTAYQALQGQAKLLLTTYFDSISHNLATIKSLPVQGLHVDLVAGKDSLDELNKSLPETWLLSLGVINGRNVWRADLSAKYQLVASLAGKRDIWIGTSCSLLHSPIDLNDETGLDEEVKSWFAFALQKCAELSLLAQALNAPEGSKQAELDAYSAPIRARRSSTRVNNPTVTERITAIKPQDSERNLVYPERAKLQRERYNLPLWPTTTIGSFPQTTEIRSLRLDFKKGRVDNTHYRTNISEHIKQAINEQENLGLDVLVHGEAERNDMVEYFGEHFDGYVFTQNGWVQSYGSRCVKPPVIIGDISRPEAITVNWATYAQSLTDKPVKGMLTGPVTILCWSFPREDISRETIAKQIALALRDEVDDLQKAGIGIIQIDEPALREGLPLRREEWQEYLEWAVDAFKLSAAIAEDDTQIHTHMCYCEFNDIMLSIAALDADVITIETSRSDMELLDSFEDFSYPNEIGPGVYDIHSPNVPSVEWIEALLRKAADRIPVERLWVNPDCGLKTRGWTETRQALANMVEAAKRLRASVNNTSVNN

SEQ ID NO: 9822 - protein, 318 aa, Xenorhabdus bovienii
  Peptide sequence Name=Xb4151_4152.C443.gene25.pep
  Gene classification: Gene name=LysR; Function=Transcriptional regulator; Function class=K Transcription
  Homolog annotation: Query=1..307bp; Hit=1..307bp; Blast score=459; Percent Identity=74.0; E value=1e-129; Homolog= metR COG0583
MIEIKHLKTLQALSHCGSLAAAANHLHQTQSALSHQFSELEHRLGFKLFIRKSQPLRLTPQGEVLLKLAGKVLPLVTASLRECSEPEEINLRIAIECHSCIQWLTPALKRFSESWPQVSVDFKSGVTFDPQPALQQRELDIVLTSDIIADSKLNYTSLFDYEVKLVLAPDHPLANKRDIYPQDLAPETLLIYPVQRQRFDIWRRFLQPAGVTPTLKSVDNTLLLIQMVAARLGIAALPHWAVETFERQGLVVTKTLGEGLWSRLYAACREGEQHQPAINTFIRSARQHAVDNLPFVKRVSISNGDAPKEMQQSGCFLW

SEQ ID NO: 9823 - protein, 299 aa, Xenorhabdus bovienii
  Peptide sequence Name=Xb4151_4152.C443.gene26.pep
  Gene classification: Gene name=RhaT; Function=7 Permeases of the drug/metabolite transporter (DMT) superfamily; Function class=G Carbohydrate transport and metabolism
  Homolog annotation: Query=1..299bp; Hit=1..299bp; Blast score=337; Percent Identity=65.0; E value=1e-92; Homolog= yigM COG0697
MWLLTITTFLWAASFSLIGAYLAGQVDSWFSVFIRVVLAALVFLPFLRWRGLSLKVISLYMVVGACQLGVMYLFVFHAYHYLTVAEFLLFTVMTPLYVTLIYDVMGRQRLRWGYAMSSLLAVAGAAIIRYDRLSESFWIGLILVQLANIFFAIGQVGYKRLMEVYPIPQRVAFSWFYLGACVVATIGWLLFGDPYKLPTTQLQWGVLIWLGAGASGIGYFMWNYGATQVDTGTLAIMNNMLVPAGLLVNFLIWQQHPDWLGFTIGSSLIVASLWVHHRWILKPVLQTANCPPRAGAQNE

SEQ ID NO: 9824 - protein, 549 aa, Xenorhabdus bovienii
  Peptide sequence Name=Xb4151_4152.C443.gene27.pep
  Gene classification: Gene name=NhaP; Function=NhaP-type Na+/H+ and K+/H+ antiporters; Function class=P Inorganic ion transport and metabolism
  Homolog annotation: Query=1..549bp; Hit=1..549bp; Blast score=706; Percent Identity=70.0; E value=0; Homolog= yjcE COG0025
MEIFFTILILILVVSVSGVLTKMIPFRIPLPIVQIAMGALLAWPHFGLHVTFDPELFLVLLIPPLLFVDGWKTPTREFFQHGREIVILVLFLVLVTVVGIGYLIYWLLPGIPLIAAFALAAVLSPTDAVALSSIVGKGRIPKNMMSVLEGEALMNDASGLVALKFAVAIAMGTMVFTVTGATIEFFKVAIGGLLSGIAITWLYSKSLRLMSRWSGDDPATQIMFMMLLPFASYMIAEHIGVSGILAAVAAGMTISKSGVIRNAPLAMRLRADNVWGMLAFVFNGLVFVMLGLQLPGIWETSVEQAELDPQVETWMLFAAVGIIYVALVLLRFCWLWLMKNASKVLMKKKPLEFASYTMRELCLASLAGVRGAITLAGALSVPLFLPDGDPFPARYQLIFIAAGVILFSLFVGVVVLPLLLRGMKVGDKQADINEIRMAKAAMAEVAIVSMNKMEERLSASTEEKLDAEVVSEIASRVTGYLRRRTVGKDEIEHNLLVEELERRFRLTALRAERGELYHLRATRKISNETLQTLLHDLDLLEALLVVKDQ

SEQ ID NO: 9825 - protein, 448 aa, Xenorhabdus bovienii
  Peptide sequence Name=Xb4151_4152.C443.gene28.pep
  Gene classification: Function=Permeases; Function class=R General function prediction only
  Homolog annotation: Query=9..448bp; Hit=15..455bp; Blast score=556; Percent Identity=81.0; E value=1e-158; Homolog= Z4223 COG2252
MSGMQAPTQCKLDKYFKITERGTTVRQEILAGLTTFLAMVYSVIVVPGMLGQAGFPHTAVFISVCLVTGIGSLLMGLWVNLPMAIGCAISLTAFTAFSLVLGQQVSIPVALGAVFLMGCLFTVISVTGIRSWILRNMPMGIAHGTGIGIGLFLLLIAANGVGMVIKNPHAGLPVAFGSLTAFPVIMTLLGLAGIIGLERKKVPGGILLVIIVISIIGLIFDPAVKYQGFFKLPTLGEDGLSLMFSMDIVGALQPVVLPSVLALVMTAIFDATGTIRAVAGQANLLDKGGQIINGGKALTADSVSSIFAGAMGSSPAAVYIESAAGTAAGGKTGLTAAVVGILFLLILFLSPLSYLVPAYATAPALMYVGLLMLSNVRKLNFDDSVEAMSGLLCAVFIVLTCNIVTGIMLGFSALVVGRVFSGEWRKLNIGTVIIAIVLVIFYAGNWAI

SEQ ID NO: 9826 - protein, 89 aa, Xenorhabdus bovienii
  Peptide sequence Name=Xb4151_4152.C443.gene29.pep
MPRVLIKSPCTNFSRFKWHIFSIHVARYIHNLMNRLKQVDLFSVFSVHTEITHNKFYDYLLILIPYSLDNHSPQILSPFFYLKSQTIAY

SEQ ID NO: 9827 - protein, 33 aa, Xenorhabdus bovienii
  Peptide sequence Name=Xb4151_4152.C443.gene30.pep
MVILSKHVAYLDSFVVGKNHFFFNQVGIILQES

SEQ ID NO: 9828 - protein, 44 aa, Xenorhabdus bovienii
  Peptide sequence Name=Xb4151_4152.C443.gene31.pep
MLLFFFTSCTFTLSVHSDFFNAPQLRCFFSQLSCKIIPTWLKKK

SEQ ID NO: 9829 - protein, 60 aa, Xenorhabdus bovienii
  Peptide sequence Name=Xb4151_4152.C443.gene32.pep
MLQSLVYQTTCKHNITTTKPKASMYHYRVTFRSGLGSCAHYRDLLVYHQWTNYNDSDYKN

SEQ ID NO: 9830 - protein, 306 aa, Xenorhabdus bovienii
  Peptide sequence Name=Xb4151_4152.C443.gene33.pep
  Gene classification: Gene name=LysR; Function=Transcriptional regulator; Function class=K Transcription
  Homolog annotation: Query=1..302bp; Hit=1..301bp; Blast score=515; Percent Identity=84.0; E value=1e-146; Homolog= gcvA COG0583
MSKRLPPLNALRVFDAAARHLSFTKAAEELFVTQAAVSHQMKSLEDFLGLKLFRRRNRSLLLTEDGQSYYLDIKEIFTAINDATRKLQARSAKGALTVSLSPSFAIQWLVPRLSGFNQSFPGIDVRIQAVDREEDKLADDVDVAIFYGRGNWPGMRTDRLYPEYLLPVCSPSLLMGERPLKIPADLAKHTLLHDSSRRDWQAYIRQLDMQQQINVQQGPIFSHSSMVIQAAVHGQGVALANNVMAQNEIDAGRLVCPFNDVLVSKNAFYLVCHDNQAELGKIAAFRKWILMQAASEQARLGFITNE

SEQ ID NO: 9831 - protein, 147 aa, Xenorhabdus bovienii
  Peptide sequence Name=Xb4151_4152.C443.gene34.pep
  Gene classification: Function=Uncharacterized small membrane protein; Function class=S Function unknown
  Homolog annotation: Query=17..147bp; Hit=1..131bp; Blast score=120; Percent Identity=52.0; E value=4e-28; Homolog= ygdD COG2363
MCEGVSRHISRNRSGAMSSRFMLIFVGISGFLYVALGAMGAHMLAPVLTSRQMEWIHTGLQYQGLHTLVMMVLAALLMRQPTKPFGWAGIFFAAGIVLFSGSLYCLAFLPLKFLVYLTPIGGFSFLIGWLCILIGALRLRKSAPSHE

SEQ ID NO: 9832 - protein, 365 aa, Xenorhabdus bovienii
  Peptide sequence Name=Xb4151_4152.C443.gene35.pep
  Gene classification: Function=Predicted SAM-dependent methyltransferase; Function class=R General function prediction only
  Homolog annotation: Query=1..364bp; Hit=1..364bp; Blast score=579; Percent Identity=74.0; E value=1e-165; Homolog= ygdE COG2933
MNKVALYCRPGFEKECAAEITDKAGKKGIYGFARVKENSGYVLFECYQHDDADRLIREIPFGELIFARQMVVVGELLKNLPQEDRITPILGMLTGVIERAGELRVEVPDNDESKELMTFCRKFTVPLRHAMRQEKFLLAKESANRPVIHVLFIAPGCCYVGYSYSNNNSRFYMGIPRLKFPSDAPSRSTLKLEEAFHVFIPHDEWEERLGSGLYAVDLGACPGGWTYQLVKRGMIVHAVDNGLMADSLMDTGQVKHHRVDGFKFEPTVKNVYWLVCDMVEQPAKVAHLMTDWLVKSWCREAIFNLKLPMKKRYEEVAQILQKIEQQLKENGVNAQIQAKHLYHDREEVTVHVRRIWSAYAMTRDF

SEQ ID NO: 9833 - protein, 476 aa, Xenorhabdus bovienii
  Peptide sequence Name=Xb4151_4152.C443.gene36.pep
  Gene classification: Function=RTX toxins and related Ca2+-binding proteins; Function class=Q Secondary metabolites biosynthesis, transport and catabolism
  Homolog annotation: Query=3..476bp; Hit=2..479bp; Blast score=381; Percent Identity=50.0; E value=1e-105; Homolog= PA1249 COG2931
MTSKNKYTYVGLSDSKSVQDVNALLTAYVPNSDPGIRVAHTPLGNKAPDELVRTNYHWTNKVGSSGAVELSYHFLESAPSVMPRFGIAGFSSFNDEQKEAALLSLQSWSDVANVKFNEVSSLSKANITFGFFDYSITDDYAFATLPKGQNTTYSWYSAESRTFIDNDIGVNGYGRQTFTHEIGHTLGLDHPAEYDASDAVRPTYISVGEYFEDSRAYTVMSYFSEKYTGQDYKGAFSSAPLLNDISAIQQLYGANTETRTGDTVYGFNSNTDRDFMTATNAKSKLVFSVWDADGNDTFDFSGFTQNQRINLNEGAFSDVGGLKGNVSIARGVTIENAIGGSGDDILVGNSADNVLKGGDGDDIIYGGLGGDDLWGGAGKDTFVYLNGKESLKGNPDWIHDFISGEDKIDLSDFNFGGKGDIKFVDSFSGRAGEVLLTYDKVTDITDMSISLGGDLASHDFLVKIIGQPVAEADFIV

SEQ ID NO: 9834 - protein, 119 aa, Xenorhabdus bovienii
  Peptide sequence Name=Xb4151_4152.C443.gene37.pep
  Homolog annotation: Query=6..109bp; Hit=20..124bp; Blast score=136; Percent Identity=61.0; E value=5e-32; Homolog= Pa|Phot2-13g06.p1k _g97| 78146 - 78541 1318 131 aa, chain -
MFSLFLIGGCMASSLRLPEPAELKGLWQLSDGNQVCSIELTDTRLPEGSIWALKGDSCLTELMGNPVEGWRPTPDGITLTDDDGNSLAFFGHESEQWVAYLVDGRELVMTFSGTHSVTK

SEQ ID NO: 9835 - protein, 541 aa, Xenorhabdus bovienii
  Peptide sequence Name=Xb4151_4152.C443.gene38.pep
  Gene classification: Gene name=MdlB; Function=ABC-type multidrug/protein/lipid transport system, ATPase component; Function class=Q Secondary metabolites biosynthesis, transport and catabolism
  Homolog annotation: Query=1..535bp; Hit=37..562bp; Blast score=577; Percent Identity=59.0; E value=1e-164; Homolog= PA1246 COG1132
MLVPSIYMLQVYDRVLPSSNEMTLLMLTLITLGMFAIMGGLEYIRSMVVIRIGSQFDMCLNQRVYTASYESNLKNGSTDAGQMLNDLATIRQFLTGNALFAFFDVPWFPIYLWVIFLFSPYLGLLALVGAIILITLAVLNQWLSQSPLSEASHLSLRSANLASTNLRNAEVIEALGMLPALRQRWFSLHERFLNFQRIASERAASITALTKTVRMALQSLILGLGGWLAIEGNITPGMMITGSILMGRALSPIEQLIQAWKSWSAARLSWQRLDKLLKAQPERKSGMSLPAPKGILLLEKVAAIPPSKTQARQTAGNHKQVLQDISFSLNAGDVLGVIGPSASGKSTLARLLVGIWPSQEGVVRLDDADIYQWNKDELGASIGYLPQDIELFGGTIAENIARFNDVDPEKVIEAAKKAGVHELVLNLEQGYDTVIGTGGMGLSGGQKQRIGLARALYGNPSLLVLDEPNSNLDDIGEKALSQAITQLREQGKTVVVITHRPSLLSQTNKILLLVQGKMKMFGPSQQVMAALSQSKTVERAS

SEQ ID NO: 9836 - protein, 445 aa, Xenorhabdus bovienii
  Peptide sequence Name=Xb4151_4152.C443.gene39.pep
  Gene classification: Gene name=AcrA; Function=Membrane-fusion protein; Function class=Q Secondary metabolites biosynthesis, transport and catabolism
  Homolog annotation: Query=18..445bp; Hit=17..443bp; Blast score=369; Percent Identity=49.0; E value=1e-102; Homolog= PA3405 COG0845
MSYQTNAKSAKNDESGLLPLDANRYLRLGWLVIGIGLLGFFVWAAFAPLDKGVASSGIVVVDGNRKTVQSPANGIIRQILASEGEQVKAGQVLVQLSQVQVNAQIDSLKQQLHTTLATEARLLAEQQGLEVISFPATLWDQQSEPRIKDILVLQKQLFLSRREMLRSDLAGMQQAEEGLSFQLKGLRNALTNKQQQQVSLKEQVTNLRPLTEEGYFPRNRYLELQRSQSELSGSMAEMAGRIGQLEKQCQETRQRIIQRQADYQREVRSQLSDVQVQANELKNKLETTQFDLSHTSITAPVSGSVMGLTVFTQGGVVASGEKLMEILPAQSALEVEARLMVHLIDKVAMGQDVDLMFTAFNQNQTPKVTGKVTVISADRLVDGVTREPYYQMRVRVTPEGMAQLAGLHIKPGMPVEVFVKTGSRSLLSYLFKPLMDRASTSLIEE

SEQ ID NO: 9837 - protein, 460 aa, Xenorhabdus bovienii
  Peptide sequence Name=Xb4151_4152.C443.gene40.pep
  Gene classification: Gene name=TolC; Function=Outer membrane protein; Function class=M Cell envelope biogenesis, outer membrane
  Homolog annotation: Query=7..459bp; Hit=1..444bp; Blast score=317; Percent Identity=42.0; E value=2e-86; Homolog= PA1248 COG1538
MFRSYSVTGRVLFLPLFLLMLFSGTVQALSLTEAYALALQHDPTFQAAIKAQEAGQEEKNLGRAELLPKLAFNYQYVPQNWQKMESSSSASGQRGNMITESRNRQYHSYSGSLVLTQPLVDFEAWARYKTRQAYVLMSDARFRVDTQQLAVRVVNSYVDVAYAQDRQAQVAQQRRAYEEQLERNQKLFASGEGTRTDVAETQAHYSQVVADELTVKDELDAAIRDLQLLVGIPLPDDLPVNRLSPVQNFKIIKLAFAHYADWEQIALSQNPQLAEARQKVAVAAQDIERNRAGYLPKLELYASHTENKSSSDNIVDQKYRTDSIGLRVSMNLYNGGGTSAAVRQSAANYSKAKYEMDAEAGETLNALRRNYNACMNGEKRIRAYESAVEAAELQVKATQKSVALGQRVNVDILNAEQQLYIARRDLSQAKYQYMKSWIGLLSEAGQLNGEHIQLASGYFE

SEQ ID NO: 9838 - protein, 37 aa, Xenorhabdus bovienii
  Peptide sequence Name=Xb4151_4152.C443.gene41.pep
MKFKAIKPACTCFPSLCDAFKYAMTGNTEVMTNSNLG

SEQ ID NO: 9839 - protein, 195 aa, Xenorhabdus bovienii
  Peptide sequence Name=Xb4151_4152.C443.gene42.pep
  Homolog annotation: Query=16..195bp; Hit=5..182bp; Blast score=158; Percent Identity=50.0; E value=5e-38; Homolog= gi|15833104|ref|NP _311877.1| putative virulence-related membrane protein [Escherichia coli O157:H7] gi|25301824|pir||B98110 p
MVIKKALLATLAVSGVMYGSLAYADSHTVTVGYAQSKVQNFKDIRGVNLHYRYEWDSPVSIIGSFTHMKGDRDYKFSFKHNGKNYTGEDSLDMKYYSLMAGPAYRINDYLSVYGLLGFAHSKADATEGAYHLRNTVEVEASKMNRKSTNFAYGAGVEVNPIQSLSLYAGYEGASVKYNDNREEINGFNLGVGYRF

SEQ ID NO: 9840 - protein, 39 aa, Xenorhabdus bovienii
  Peptide sequence Name=Xb4151_4152.C443.gene43.pep
MMSSDSEKRQTAFPRYLIKRSHCISVDKIATTFDWQLLT

SEQ ID NO: 9841 - protein, 424 aa, Xenorhabdus bovienii
  Peptide sequence Name=Xb4151_4152.C443.gene44.pep
  Gene classification: Gene name=ET17; Function=O-acetylhomoserine sulfhydrylase; Function class=E Amino acid transport and metabolism
  Homolog annotation: Query=1..412bp; Hit=1..412bp; Blast score=659; Percent Identity=75.0; E value=0; Homolog= PA5025 COG2873
MKLETLSIHAGYSPDPATKAVAVPIYQTTSYAFDDTQHGADLFDLKVEGNIYSRMMNPTNDVLEKRIAALEGGIGALSVASGMAAVTYAIQAIAQAGDNIISVAKLYGGTYNVMAHTFPSIGIETRFVDHNDIAAIEALIDEKTKAVYCESITNPGGHIIDIQAMADVAHKYGIPLIVDNTVATPYLCRPFEHGADIVIHSLTKYIGGHGTTIGGIIVDSGKFPWAEHQDRFAILSTPDASYHGIIYTEHFGAAAYIARCRVGPLRSTGATLSAFSAFLILQGLETLALRMERHTENTLKVAQYLNEHPQVSWVKYAGLPEHPEHELAVRYMGGKPSSVLSFGIKGEEEAGTRFIDALELIVRLVNIGDAKSLACHPASTTHRQLNDAEMVKAGVSRDLIRLSIGIEHSDDIIADLSQALDAAK

SEQ ID NO: 9842 - protein, 324 aa, Xenorhabdus bovienii
  Peptide sequence Name=Xb4151_4152.C443.gene45.pep
  Gene classification: Gene name=IlvA; Function=Threonine dehydratase; Function class=E Amino acid transport and metabolism
  Homolog annotation: Query=4..319bp; Hit=3..318bp; Blast score=425; Percent Identity=67.0; E value=1e-119; Homolog= YKL218c COG1171
MNFIPDYHDVVEAHSRIKKYINKTPVFTSRTVNQLFNAEVYFKCENYQRMGAFKFRGAMNALYQFSDEQKKAGVVTFSSGNHAQAISLAANLLNIPATIVMPQDAPKAKIAATKGYGGKVVIYDRYTEDCEEITRNLANQYGLTFIPPYDHPHIIAGQGTSTKELFEEVGELDALFIPLGGGGLLSGSALSAVHFSPKCRIFGVEPVAGNDGQQSFKKGEIVHIATPKTIADGAQTQHLGKYTFPIIRHLVEDILVTSDDELIDAMYFLAERMKTVVEPTGCLGFSAARKMREELKGQRIGIILSGGNIDMERYSNFLSNIGKI

SEQ ID NO: 9843 - protein, 233 aa, Xenorhabdus bovienii
  Peptide sequence Name=Xb4151_4152.C443.gene46.pep
  Gene classification: Function=Predicted metal-dependent hydrolases related to alanyl-tRNA synthetase HxxxH domain; Function class=R General function prediction only
  Homolog annotation: Query=38..210bp; Hit=30..200bp; Blast score=68; Percent Identity=29.0; E value=6e-12; Homolog= PH0108 COG2872
MRENVLMTQIQCYLNNTYCFLSTGEVIANGSDEWGQWIALNNNIFHPQGGGQPADIGWVNNIPVKVRKQATGQVVVYPESALHAPPGAQLNSKLSEEARICHAALHTAGHLLNWEMRQYGWMAIKGHHFPGESRVEFSPMGSSAIPSDQLSLQNIETTINTRLRDGGQVTTWYEADTRLCLIEGTEPMPCAGTHVDNLNKINEFTIKSVKFKKETLRISYDASHIILRTDNVS

SEQ ID NO: 9844 - protein, 305 aa, Xenorhabdus bovienii
  Peptide sequence Name=Xb4151_4152.C443.gene47.pep
  Gene classification: Gene name=RhaT; Function=7 Permeases of the drug/metabolite transporter (DMT) superfamily; Function class=G Carbohydrate transport and metabolism
  Homolog annotation: Query=11..295bp; Hit=39..303bp; Blast score=74; Percent Identity=29.0; E value=1e-13; Homolog= AF0788 COG0697
MSHDALPLSRRRLYLLDLGLLAVALSWGASYSLMQLIIQAGVTIPLFLMLRFALAVPFMFFGTRIRLHNIKPGEIINGLIFGCLLYAILTFETLGVKYTTASNAGFLIALSVVIVPFFERILGKRKQSKFIYFTCFISLVGGGILSFSNTDNFGFNNGDWLILLAALIRGFQIFMFGKQTSGKSYSLVNITLIELVTVSVLGLAFVLMTDSASLLLIPTITFNVWGYILFLSLLATAFAFLMQLYAANITSPTRVGLILSLEPGFAALFAVTIMGETIGILQGFGGAIIVCAALLGRIVEGKRYE

SEQ ID NO: 9845 - protein, 153 aa, Xenorhabdus bovienii
  Peptide sequence Name=Xb4151_4152.C443.gene48.pep
  Gene classification: Gene name=HipB; Function=Predicted transcriptional regulators; Function class=K Transcription
  Homolog annotation: Query=2..134bp; Hit=30..159bp; Blast score=58; Percent Identity=32.0; E value=2e-09; Homolog= ZydcN COG1396
LSGVSKAALSQLESGNSNPRIDTLDAIAIALRLPLGDLFGSNNERYPYLEKKIPMKDTYSQVMKFRIGLGSVAEIWHLQMNPGVIISSPAHTVGTHEHIMIHDGVLMLRLSNDESVILNPGDFYAFSGDVIHSYICIDVAVSATVVMSYSIQS

SEQ ID NO: 9846 - protein, 135 aa, Xenorhabdus bovienii; identical to SEQ ID NO: 6015
  Peptide sequence Name=Xb4151_4152.C443.gene49.pep
  Gene classification: Function=Predicted transposase; Function class=L DNA replication, recombination and repair
  Homolog annotation: Query=11..88bp; Hit=11..83bp; Blast score=58; Percent Identity=39.0; E value=2e-09; Homolog= sll1791 COG3293

SEQ ID NO: 9847 - protein, 133 aa, Xenorhabdus bovienii
  Peptide sequence Name=Xb4151_4152.C443.gene50.pep
  Homolog annotation: Query=1..127bp; Hit=94..223bp; Blast score=114; Percent Identity=46.0; E value=2e-25; Homolog= gi|21228333|ref|NP _634255.1| Transposase [Methanosarcina mazei Goe1] gi|20906799|gb|AAM31927.1| Transposase [Methanosarcina m
LLTDGQGLPLAIAVAPANIHDIRLVIATLDGLQTGRRGYGTKLHRDKAYEAEWLEKELKTRGYVPCIQSRKEEQDALAEQEDFKVNRWVVERTHSWLNRFRRILVRWEKRVENYEAMLHLACSLIVWNIILLG

SEQ ID NO: 9848 - protein, 41 aa, Xenorhabdus bovienii
  Peptide sequence Name=Xb4151_4152.C443.gene51.pep
MNNTQQQDRVKKNCIDIGNKVKRLRLARNISLNELSKSLSQ

SEQ ID NO: 9849 - protein, 466 aa, Xenorhabdus bovienii
  Peptide sequence Name=Xb4151_4152.C443.gene52.pep
  Gene classification: Gene name=RtcB; Function=Uncharacterized ACR; Function class=S Function unknown
  Homolog annotation: Query=43..460bp; Hit=35..468bp; Blast score=186; Percent Identity=32.0; E value=5e-47; Homolog= TM1357 COG1690
MSTFTRLQKRLSRQGIETQYENNIYRFNKEQIEAEVLLPESLPLEEKAVQQLLDLASVHVPGSDAKVCRTRATPDFHPGAVAPVGCIVATTEDLVIPAAIGTDINCGMRLLTTGLSYAEANSQKEALIQQLKNTLLMDQRDVPVTPTSFSALFDEGLAAWLQELPQQGVWQQADFKRMHTELNAILSTQAVQAHSRYAPEAFFEHREIIRPASLGTVGSGNHFVELQIVDTILDRHAAYAAGLHEGEVLMMIHTGSRDVGFYIGQRWVDKARALWPVTAKYPSSGLFGLTDEHAQEYFLAMGCAARYAWANRIVLTELVRAAWKQIFGQDKSKLIVDLSHNIIFPEQGMNLHRKGATPARAGELALIPGSMGDYSYLVLGKGNEDWLWSCSHGAGRSIRRQAMRNKVPDLQKNSRLPWQCITLKSDRLREEAPEAYKPITPVIEIQEQAGLIQPVARVRPWITFKA

SEQ ID NO: 9850 - protein, 69 aa, Xenorhabdus bovienii
  Peptide sequence Name=Xb4151_4152.C443.gene53.pep
MGKKCCFSCSSSIQEDFSGVTLSMNSEIVKAFLIPTKNHRNPPKLCISFNKVNYHQNDSSRQIHILFNG

SEQ ID NO: 9851 - protein, 474 aa, Xenorhabdus bovienii
  Peptide sequence Name=Xb4151_4152.C443.gene54.pep
MKRFFLVFVLTLFLSGCGDADEGYYLIKNIDVIFDEDEGLEDFKELIAKKIKGEKDYMYFFLTPDEASYFTGVKPEKTAIKDNRLEIGHDMLTLKNTFSGVKLVGDKKRICGFYNCIITFELDKVKQNDKRLLDIQNKFKESEIKKQKLYAAQKEKLAELVFKDFFGQLTYLDDFSIKLEPIESGSLNEINSGIYFRNMGGLRIDLESEDNTIYNFKNQNSQLIGELFIIKSLKDKFDYSSWLEIQDEILYQDKQGAIYYNMHGELEAVYYQYDEKSQHYFIGLANAPKLETIKKSYIMLRTMDEQYRGEIANIQDVSLSQTDFENKYGIKISDSFDSQEIHKVLIKKMNDKLAETKDFSKDKDWFNSILVRFPSESFSSKIYFYFHPKPMKKVISEFKNKYPRGKWIENVFVYNISPSSESGYSYFINHNGMVYEIFVATDIHSTVERMAFLSVLRHLDPTKLQGYSPSKLRP

SEQ ID NO: 9852 - protein, 51 aa, Xenorhabdus bovienii
  Peptide sequence Name=Xb4151_4152.C443.gene55.pep
MLNTLPSPRFASMIAIPLPVSQKAHMLTIKKLQTAISSLSVWRKGGSTCAT

SEQ ID NO: 9853 - protein, 91 aa, Xenorhabdus bovienii
  Peptide sequence Name=Xb4151_4152.C443.gene56.pep
MAQGGINVRHISHYYCCMYFLNTKKSMGDCLTTGKKSTSHYWSYSTILGQSAKTIIQPCHSGGYAAMGSGSCRIPNAAHPKKAIKNHQSAS

SEQ ID NO: 9854 - protein, 161 aa, Xenorhabdus bovienii
  Peptide sequence Name=Xb4151_4152.C443.gene57.pep
  Gene classification: Function=Predicted restriction endonuclease; Function class=L DNA replication, recombination and repair
  Homolog annotation: Query=1..44bp; Hit=85..128bp; Blast score=66; Percent Identity=59.0; E value=1e-11; Homolog= Z5892 COG3440
MPFWRLRGDGFWELQNTERCTPQKGNKEPPKRELIEYGVIGGFDMGSIGLDDSMKLIVSKGINGGQMVEQLFWNFADQPILLPQQKEYYPLEEFVIWHRSQVFKQQSAQIKKGSHPLLCYSDCCRLLTRFQFLEIVFVQDIGVANIALPFPFLDNGFIRIQ

SEQ ID NO: 9855 - protein, 350 aa, Xenorhabdus bovienii
  Peptide sequence Name=Xb4151_4152.C443.gene58.pep
  Gene classification: Gene name=PotD; Function=Spermidine/putrescine -binding periplasmic protein; Function class=E Amino acid transport and metabolism
  Homolog annotation: Query=1..350bp; Hit=1..348bp; Blast score=525; Percent Identity=73.0; E value=1e-149; Homolog= potD COG0687
MKKWFYLLAAGMMAFSIGSVNAAAADDGKTLYFYNWTEYVPPGLLNQFTNETGIKVIYSTYESNESMYTKLKTYKDGAYDLVVPSTYFVSKMSKEGMLQKIDTSKLSNFKNLDPNLLHKSFDQNNEYSIPYIWGATVIGVNSDNIDPKTISSWADFWKPQYQSGLVLTDDAREVFQMALLKLGYSGNTTNPKEIEAAYQELQKLMPNVLAFNSDNPANPFMEGEVDLGMVWTGSAYVARQSGTPVDIIWPKEGGIFWMDSLAIPANAKNVDGAMKLINFLLRPEIAAQVAQKIGYPTPNLAAKKLLPAEITGDPSLYPDEAIIQKGEWQSDVGNANILYENYFQKLKAGQ

SEQ ID NO: 9856 - protein, 46 aa, Xenorhabdus bovienii
  Peptide sequence Name=Xb4151_4152.C443.gene59.pep
MKCRFYNSRFSKDRFTLGLYMTNAPTVRETLHEKVVLSASRWDDGI

SEQ ID NO: 9857 - protein, 259 aa, Xenorhabdus bovienii
  Peptide sequence Name=Xb4151_4152.C443.gene60.pep
  Gene classification: Gene name=PotC; Function=ABC-type spermidine/putrescine transport system, permease component II; Function class=E Amino acid transport and metabolism
  Homolog annotation: Query=1..256bp; Hit=1..256bp; Blast score=353; Percent Identity=88.0; E value=8e-98; Homolog= potC COG1177
MIGRLLRGGFMTLVYAYLYIPIVILIVSSFNQSRFGISWQGFTTEWYNLLFNNDSLLQAAGHSLTMAVTSATFATLIGSLTAVALYRYSFRGKKFVSGMLFVVMMSPDIVMAISLLVLFMLLGVSLGFWSLLFSHITFCLPFVVVTVYSRLKDFDVKMLEAARDLGAGELTILRKIILPLAMPAVMAGWLLSFTLSMDDVVVSSFVTGPSYEILPLKIYSMVKVGVSPEVNALATILLVMSLILVLFSQFIMRDRTGKA

SEQ ID NO: 9858 - protein, 276 aa, Xenorhabdus bovienii
  Peptide sequence Name=Xb4151_4152.C443.gene61.pep
  Gene classification: Gene name=PotB; Function=ABC-type spermidine/putrescine transport system, permease component I; Function class=E Amino acid transport and metabolism
  Homolog annotation: Query=1..272bp; Hit=1..271bp; Blast score=374; Percent Identity=82.0; E value=1e-104; Homolog= ZpotB COG1176
MKKTRKLFQNIVITGMVSWLMLFVFMPNLMIIGTSFLTRDDANLVQMVFSLDNYSRLFDPLYAEVLLHSLNMAIVATLCCLVIGYPFAFFLARMPEKLRPLMLFLLIVPFWTNSLIRIYGLKMFLSTRGYLNDFLLWLGIVDKPLRIMYTSEAVVLGLVYILLPFMVMPLYSSIEKLDKPCLEAARDLGAGKLQTFIRIIIPLTMPGIIAGCLLVLLPAMGLFYVADLMGGAKNLLIGNVIKSQFLNIRDWPFGAVTSICLTLVMGLMLLVYLSCA

SEQ ID NO: 9859 - protein, 371 aa, Xenorhabdus bovienii
  Peptide sequence Name=Xb4151_4152.C443.gene62.pep
  Gene classification: Function=ABC-type spermidine/putrescine transport systems, ATPase components; Function class=E Amino acid transport and metabolism
  Homolog annotation: Query=5..369bp; Hit=12..376bp; Blast score=583; Percent Identity=80.0; E value=1e-167; Homolog= ZpotA COG3842
MTENTSLTPLVELNTLSKGFDGKQVISQLDLIINDGEFLTILGPSGCGKTTVLRLIAGLEDADSGKILLEGQDITDIPAEHRHVNTVFQSYALFPHMTVFENVAFGLRMQKTPAKEIAPRVEEALRMVQLEEFAQRRPAQLSGGQQQRVAIARAVVNKPKVLLLDESLSALDYKLRKQMQNELKALQRKLGITFIFVTHDQEEALVMSDRIVVMRDGYIEQDGTPREIYEEPKNLFVARFIGEINIFDAKVQHRIDEQRIRADVEGHECDIFTSLPVTAGQILKVLLRPEDLRVEEINHGEQVSGLVGYVRERNYKGMTLDSVVEMENGKMVMVSEFFNEDDPDVDHSLNQKIAVTWVESWEVVLVDEEDA

SEQ ID NO: 9860 - protein, 54 aa, Xenorhabdus bovienii
  Peptide sequence Name=Xb4151_4152.C443.gene63.pep
MECDVIIYEMITKNDILLLFRLSISAYCVYYARFVISTGATGLSFSGETIFPAG

SEQ ID NO: 9861 - protein, 83 aa, Xenorhabdus bovienii
  Peptide sequence Name=Xb4151_4152.C443.gene64.pep
MITSHSMLYPVYTPGNNFLSGILQSLLIFFTFNKILQTRKPALPSIKTHLKTPFMLLCHTSGVIQALLSFLSPSTKTRHPILF

SEQ ID NO: 9862 - protein, 58 aa, Xenorhabdus bovienii
  Peptide sequence Name=Xb4151_4152.C443.gene65.pep
MFIVLCCTALSGAELPMIITSSALFTSVTKEGPCWWRWSSILQRVAVVPCGMAMPLPR

SEQ ID NO: 9863 - protein, 73 aa, Xenorhabdus bovienii
  Peptide sequence Name=Xb4151_4152.C443.gene66.pep
  Gene classification: Gene name=DnaC; Function=DNA replication protein; Function class=L DNA replication, recombination and repair
  Homolog annotation: Query=1..73bp; Hit=173..245bp; Blast score=113; Percent Identity=78.0; E value=4e-26; Homolog= dnaC COG1484
MQIESRYEKVTINQIVDRRSSSKRPTGMLSNLDMNGMNTLLGERVMDRMRLGDSLWVIFNWGSYRSRIKGNEY

SEQ ID NO: 9864 - protein, 537 aa, Xenorhabdus bovienii
  Peptide sequence Name=Xb4151_4152.C443.gene67.pep
VCNSIIEFLDENEITEHPDYYISKAILARENREYITERQSVLHLLFFIEKKPILISELLNKIDDMNLTDKTQFLLGINKSTSILHPYIRTIITFILSGTKQQINSYFNCFLGRSPKYGEIPPFPAVDTLSIDILLNFYEATHRFLVNTSSGLAILEKMTKLIYAVAKEKSSQSVLFFMSYFNTDINPRYAIDIANTFFDADNISLENSVYTQSLAYNTALTATKIGDISEAEHWLDYIDDDDKKNRIISIVTEIDKKQNARKKHPLNPKNIKIKNINEIETLDLISICSFLDGCGDDWGFKELYRSGSYIFPSKILTTEMFKSLAVKGIITLTQQDFDNIENKLLNDFDHIVNNFKFHLNVIGIIDNRKISIKIFLEEIDRRKDKFDASFEMWKEISTGYFHDAMEYYLGNIRDSWSNEFMLNEKTIERLSTTCLSAKDLSYIASSSVRYSAGQHAIKYTQSNRHTCNTLISSINKNIDWVESDKFLGKAYPRGKKQPVLSSERIIEHITNINPDDLYNNVPKLTEPVIKDETESDK

SEQ ID NO: 9865 - protein, 45 aa, Xenorhabdus bovienii
  Peptide sequence Name=Xb4151_4152.C443.gene68.pep
MDKWILFFCIFPFFVSHRLSLCFMLIYDYINHRLFICVFYLFSVN

SEQ ID NO: 9866 - protein, 61 aa, Xenorhabdus bovienii
  Peptide sequence Name=Xb4151_4152.C443.gene69.pep
  Gene classification: Gene name=Tra5; Function=Putative transposase; Function class=L DNA replication, recombination and repair
  Homolog annotation: Query=8..60bp; Hit=231..283bp; Blast score=62; Percent Identity=62.0; E value=1e-10; Homolog= tra5_g4 COG2801
MIIHVRAESFFHSLEVEFIHGESFAIRMVMCQTVFDYIEGDYNRRCYHNANSGLSRESFEK

SEQ ID NO: 9867 - protein, 56 aa, Xenorhabdus bovienii
  Peptide sequence Name=Xb4151_4152.C443.gene70.pep
MKVQLACDALIMCFGYINAKVCDCVRWQRKSILVGGLLGIIDKRYDLHCSMSAKAC

SEQ ID NO: 9868 - protein, 51 aa, Xenorhabdus bovienii
  Peptide sequence Name=Xb4151_4152.C443.gene71.pep
MNDLTHLASCLLIVDKIVILEQPLSHEEVIETAEKVKATFLKLVVETISRF

SEQ ID NO: 9869 - protein, 79 aa, Xenorhabdus bovienii
  Peptide sequence Name=Xb4151_4152.C443.gene72.pep
LILHHLCFLLVLRWPYLPPELAILPRELADHYECHTLWLILIVIIGFSLLTRRVAHCTKGDNRVSFGRLRDSAIALIVD

SEQ ID NO: 9870 - protein, 106 aa, Xenorhabdus bovienii
  Peptide sequence Name=Xb4151_4152.C443.gene73.pep
  Gene classification: Function=Uncharacterized ACR; Function class=S Function unknown
  Homolog annotation: Query=1..104bp; Hit=1..104bp; Blast score=151; Percent Identity=77.0; E value=1e-37; Homolog= ybjQ COG0393
MKNTTTPTLEGHTITEYLGVVTGETILGVNIIKDFFAGVRDIIGGRSGAYEKELKNAREIAFAEMNAQAQALGANAVVGIDIDYETVGKNGGMLMVTVSGTAVKIV

SEQ ID NO: 9871 - protein, 58 aa, Xenorhabdus bovienii
  Peptide sequence Name=Xb4151_4152.C443.gene74.pep
MWHPNILSNNYYISFSCALTVPCHRQSITAKAETNGRSRADRNGRVRCVISVLLIING

SEQ ID NO: 9872 - protein, 92 aa, Xenorhabdus bovienii; identical to SEQ ID NO: 6203
  Peptide sequence Name=Xb4151_4152.C443.gene75.pep

SEQ ID NO: 9873 - protein, 96 aa, Xenorhabdus bovienii
  Peptide sequence Name=Xb4151_4152.C443.gene76.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=85; Percent Identity=45.0; E value=8e-18; Homolog= insB_g3 COG1662
VAHVFGDRSRKTLDKLLTLLSSFTIRFYCTDDYVVYDPLPEEEHLTGKAFIQRIERTNLTHRTRIKRLNRKTIGYSKSEEMHDKVIGTFIEREHYF

SEQ ID NO: 9874 - protein, 59 aa, Xenorhabdus bovienii
  Peptide sequence Name=Xb4151_4152.C443.gene77.pep
MMVWGNGFFAKTMIPEHHAVQILLIKRQQPLVTSRFMGDRLQRKDLLLLVEIIRVIFLS

SEQ ID NO: 9875 - protein, 175 aa, Xenorhabdus bovienii
  Peptide sequence Name=Xb4151_4152.C443.gene78.pep
  Gene classification: Function=Predicted transposase; Function class=L DNA replication, recombination and repair
  Homolog annotation: Query=1..171bp; Hit=1..171bp; Blast score=103; Percent Identity=32.0; E value=6e-23; Homolog= mll8100 COG3293
MPRTMLSKPLWNKLAVLMQQSGYVYHKEEHYLTFERILYRMRTGCPWRDAPTEFGKWNTIFKRFNDGSKKAIFNLLFKLLSENTDTEWLFIDGSIVRAHQHSSGAASVEDEAIGKSRGGLSTKIHLAVDSYGLPVHFELSGGQVHDIVHAESLVEQSPPSDFVIADKGYDSGHSL

SEQ ID NO: 9876 - protein, 39 aa, Xenorhabdus bovienii
  Peptide sequence Name=Xb4151_4152.C443.gene79.pep
MAPPEGLVHSTSWSSPALKKFILCKTKNDGSQTGFYSHS

SEQ ID NO: 9877 - protein, 171 aa, Xenorhabdus bovienii
  Peptide sequence Name=Xb4151_4152.C443.gene80.pep
  Homolog annotation: Query=5..171bp; Hit=3..188bp; Blast score=170; Percent Identity=47.0; E value=1e-41; Homolog= gi|23954264|emb|CAD42062.1| hypothetical protein [Escherichia coli]
MQNKKRWEPDWFLQSLLNNHIDKLVEHYSCLRAFRTDLFYQDHTAKFFLRDYRQLEAVVGFFWVIEWTEDHHYHAHVVFWLDGSKTQNTYPWAQQAGLQWSDITDRDGWYHRCEFKEHYEADINIPVRYSDPGSIANIRQVLAYMTKIQQKHGLLLYGCNEVPGRPRRIDF

SEQ ID NO: 9878 - protein, 408 aa, Xenorhabdus bovienii
  Peptide sequence Name=Xb4151_4152.C443.gene81.pep
  Homolog annotation: Query=3..400bp; Hit=2..391bp; Blast score=244; Percent Identity=38.0; E value=3e-63; Homolog= gi|22964175|ref|ZP _00011781.1| hypothetical protein [Rhodopseudomonas palustris]
MASALGWLDHDADTQAKTLNILALFQQKESRDELGIGSIRDSFAEQLFPGTSTIQTRLRYMLFVPWIYLRLENKRIPAANFGTQADRDERALIITLSRLEDSAGTFGKNSREKLKRLPSSVYWSGLRRWGIRETMWSQEEYHRRVDELYRERTEISEREYLEKNRGDMGDTSAYKPAQSWHSSLPAPPPNFPNDATFALTRQEASFLRDRIQLSCKGSLLAWLTLHSEPADVSSPWEHPDYARFPDELKELLTHARLFSYTMHGAALLYNYLLAKERSDNDLLSQHNNNFVDWFTALPRKEIATWSLGRMWELTAEPGYSISLKTRRFVEQWIALIQQSPVTLLTSKEACDLIRAREITLKGPRSRFKNRRSLEQWSGYAGTLRLVYRWHNVQIVLKDLAHGLRREEC

SEQ ID NO: 9879 - protein, 598 aa, Xenorhabdus bovienii
  Peptide sequence Name=Xb4151_4152.C443.gene82.pep
  Homolog annotation: Query=1..592bp; Hit=32..637bp; Blast score=289; Percent Identity=35.0; E value=1e-76; Homolog= gi|22984030|ref|ZP _00029191.1| hypothetical protein [Burkholderia fungorum]
MLNPNNRSLYTSALTSPPGMVFDEAIATSFSLDPAFLLQAPVYLAFTATDSNRAQDPLSIFEAIRRYSERITVYVQKGRIQVPTKLKPNPLFGLLEDMIVESKAKGRGVFHPKIWAIRFINPETDEVMYRLVVLSRNLTTDSSWDLSLQLDGYPVKRKQSANKALVHLFSVLPKRATGKMAKHRRKQAQRFADELLYIEWECPAGFDKVAFFLPGEGYEWKPPEADRAVVISPFCTDEALRHIVEHCQQADALISRPDTLLALSKKTLNLFTRQLHLDDAAEGQMHDESSPDEIIASGLHAKAYLFENGRDSELVLGSANATSAALLGKTNCEILVSLKGKKKHTGTIDDLLSSDGMGSYLQDFDPAQPFEPDALRVKAECHLEQARTLLAEATLSLHGHPGQNDQSWALWLIGEIPKLPGVVQATAWPITVSEVLSCNLQDPNKENKRELGEFSVQAITGLTAFSLKTSHPDVSLRFVLNLPIDSLPPDHNAMILQSSMRNQDFLRYLLMLIGETGHQSFFAENTFGDGHFFTGLANGEEFSVLEELTRIYSREPERLNDIAALVENMRKGKNDMIPQDFLALWAVFESAMGGRYGR

SEQ ID NO: 9880 - protein, 1049 aa, Xenorhabdus bovienii
  Peptide sequence Name=Xb4151_4152.C443.gene83.pep
  Homolog annotation: Query=1..1046bp; Hit=27..1068bp; Blast score=799; Percent Identity=44.0; E value=0; Homolog= gi|22964174|ref|ZP _00011780.1| hypothetical protein [Rhodopseudomonas palustris]
MADKHPSIIAPLTGLKDFQQRTVNYVFQQFYGDRQQNRFLVADEVGLGKTMVARGIIAKTIEHLQDKVDRIDIIYICSNAAIATQNIKRLNVSNETQFSHSTRLTFLPKQVRSLRKNRINFISLTPNTALDHTRSRGGHKEERAILYRILYDLPLAKGERRERLRMGMLNLLQATASRHGWCSAVDQLSVDDIDRELAKDFRRKVLDDAELYDLLKEGCEYFADDDEDSETHNSELRYALIGKLRSKLASVCLSALEPDLVILDEFQRFKALLDGDDEAALLAKALFEQPDVRVLLLSATPYKMFTLDQESEEDNHYADFIRTLQFLYNDDSQIKDIQQHLLDHRTALHTSENAAETKNALEHALLQVMCRTERVTMTQKLDAMTKEVLQPAIITPTDLYHAAAVDGVAMEVQARDILEYWKSMPYLFNFLKHYELRTLIDKALKSPSDTLRKLVKSAKPHLLTKKKREHYQPLDAANPRMRMLFEDTLDKGMWQLLWMPPSLPYTTPNGVYANKESLTKTLVFSAWSAVPNAIATVCSYEAERRMVGAAPLILHSQFKKKVKSLLNFAKSSKDGRLTGMPVIAWMLPSPTLARHIDPLEIARQNPGEPLSVKAVRAIATVKCEALLETLPNGGPGSRADERWYWAAPALLDARTETPDWWLGEHGWYTGPSQNDPAENFQEHIDQFAEVANGKISLGPRPDDLAEVLCDFALASPGTCALRALSRIDTGLATDSAEILSAAAQIASGFRSLYNQAESISLLRGSGDDTYWRLTLRYGIDGNIQAMLDEYVHTLLESMGLQHEPAEAQLAAIAPRIQAVVSLRTTQLNVDELKTKGGNYTWSDLYTRCRFALRYGQLRDDTDQAVAHAESVKDAFNSPFHPFVLASTSIGQEGLDFHTWCHAVMHWNLPSNPVDMEQREGRVHRYKGHAVRKNIAEHYGLSALHSLAESADPWTQLFALAASQRKAGQSDLIPYWIFEEGTSRVERRVPILPYSKESIKFKRLKRELALYRIVFGQPRQEDLLFGLKHIGDESLTDLAQWLISLEPPKV

SEQ ID NO: 9881 - protein, 320 aa, Xenorhabdus bovienii
  Peptide sequence Name=Xb4151_4152.C443.gene84.pep
  Gene classification: Gene name=XerC; Function=Integrase; Function class=L DNA replication, recombination and repair
  Homolog annotation: Query=8..257bp; Hit=72..321bp; Blast score=388; Percent Identity=77.0; E value=1e-108; Homolog= intB COG0582
MRVQLRVTFEVVARDWHASNQKWSASHSARVLKSLEDNIFAAIGKRNIAELKTRDLLVPIKAVESSGRLEVAARLQQRTTAIMRFAVQSGLIDYNPAQEIAGAVATAKRQHRAALELNRIPELLHHIDHYSGRPLTRLAVELTLLVFIRSSELRFARWSEVDFEKAMWTIPGEREPLEGVKHSQRGSKMRTPHLVPLSQQALAILEKIKSMNGNRELIFVGDHDPRKPMSENTVNKALRVMGYDTKTEVCGHDFITLQSAGNTDLDNLERNIQGKIQHTDNPRELVATELALNLLTEQIASSDVLSGSHLWWFKRNEPLC

SEQ ID NO: 9882 - protein, 66 aa, Xenorhabdus bovienii
  Peptide sequence Name=Xb4151_4152.C443.gene85.pep
MVPKAGLEPAHPKAVDFESTASTDFATSALKYSRSTRKTEVIIPVRSPFATLILSILFKCRKKKHI

SEQ ID NO: 9883 - protein, 52 aa, Xenorhabdus bovienii
  Peptide sequence Name=Xb4151_4152.C443.gene86.pep
LLFLFLKQRDDSANNDTHKDTYKNIADNRHDCLPQSGMLLWNYIRCLKVVYW

SEQ ID NO: 9884 - protein, 405 aa, Xenorhabdus bovienii
  Peptide sequence Name=Xb4151_4152.C443.gene87.pep
  Gene classification: Gene name=AmpC; Function=Beta-lactamase class C and other penicillin binding proteins; Function class=M Cell envelope biogenesis, outer membrane
  Homolog annotation: Query=53..401bp; Hit=29..377bp; Blast score=407; Percent Identity=58.0; E value=1e-114; Homolog= ampH COG1680
MNKQLYKLFAVSALSWALSACAAPDNAHQNNFPQSGKKTTKWQVFEGNDNTKKMASSLVDQYAQSIFDEGNPLGMAMVIIDNNQVVHRSFGETYPGSGARPRQDSVIRLASITKLMTSEVMIKLAQKERLKITDPLQKYTYHGVRVPDYAITQPIRLYHLASHTSGLPREQPGGKWGRPVFIWPTQSNRWAWLKTAGMNAAPGTTASYSNLAYDLLADALSKATGEPYTRLLQEEITRPYRMKDTTLTPSRSQCARLMEGVKPSPCLSTIAAAGSGGIYSTPVDMQRWMQQFLSSHNQLRKKTASREQGIYFKRENLTSITGMDVAGQADGIGLGWVYMDAKKGVPGIYQKTGGGGGFNTYMAMIPEQNIGVFVVMTRKEQSKFSRVTNGVNELVAALSRNHGKL

SEQ ID NO: 9885 - protein, 358 aa, Xenorhabdus bovienii
  Peptide sequence Name=Xb4151_4152.C443.gene88.pep
  Gene classification: Function=Predicted permeases; Function class=R General function prediction only
  Homolog annotation: Query=2..357bp; Hit=5..360bp; Blast score=472; Percent Identity=72.0; E value=1e-133; Homolog= yjgQ COG0795
MFGVLDRYIGRTILQTILMTLFTLVSLSGIIKFVDQLRKVGQGEYSAFAAGIYTLLSVPKDIQIFFPMAALLGGLLGLGALATRSELVVMQASGFTRLQVAGSVMKTAIPLVFLTMVIGEWVAPQGEQIARNYRSQKMFGGSLMSTAKGMWAKDGNDFVYIKSVDKDNALRDVSIYHFDDNKKLLSVKYAATAVYDQNNRQWKLSQVEESDLRQIGRITGSQRISAEWKSLLTPEKLGVVALDPDALSIRGLQQYITYLKQGQQDAGRYQLNMWKKVFAPLSVAVMMLMALSFIFGPLRSVAMGVRVIAGISTGFIFYVLNEIFGPLSLVYSMPPLLGALLPSLLFFVVSVYFLLHRK

SEQ ID NO: 9886 - protein, 366 aa, Xenorhabdus bovienii
  Peptide sequence Name=Xb4151_4152.C443.gene89.pep
  Gene classification: Function=Predicted permeases; Function class=R General function prediction only
  Homolog annotation: Query=1..365bp; Hit=1..365bp; Blast score=436; Percent Identity=66.0; E value=1e-122; Homolog= yjgP COG0795
VIIIRYLVRETLKSQIAILFILLLIFFSQKLVEVLGAAVEGSVPANLVLSLLGLGVPEMAQLILPLSLFLGVLMTFSKLYTESEITVMHACGLGKGVLVKSALILALFTSMLAAANVLWFTPWSSKYQEQVLADAKANPSLAAIMEGQFKPSRDGNMVLYIGDVKGNNFENVFLAQLRPVNNQRPSVVIADGGHMEERPNGNQVAVLHQGVRYEGTALMRDFRITDFKNYQAVIGHKAADIDSDKVEQKTFSQLWHKGDEDSRAELHWRLTLIVSVLVMALLVVPLSAVNPRQGRVLSMLPAMLLYLIFFLLQSSLRSNGGRGKLDPAFWMWLVNGAYFALALALNMWDTVPMRKLRSRFKNQGAA

SEQ ID NO: 9887 - protein, 53 aa, Xenorhabdus bovienii
  Peptide sequence Name=Xb4151_4152.C443.gene90.pep
MKSIAIWLFRVSRTRYLMMITLITPVKTCLFAGKSLTSSYIYHLYASVWLPHC

SEQ ID NO: 9888 - protein, 502 aa, Xenorhabdus bovienii
  Peptide sequence Name=Xb4151_4152.C443.gene91.pep
  Gene classification: Gene name=PepB; Function=Leucyl aminopeptidase; Function class=E Amino acid transport and metabolism
  Homolog annotation: Query=1..502bp; Hit=1..503bp; Blast score=899; Percent Identity=87.0; E value=0; Homolog= pepA COG0260
MEFSVKSGSPEKQRSACIIVGVFEPRRLSPIAEQLDKISNGYISALLRRGELEGKVGQSLLLHHVPNVLSERILLVGCGKERELDERQYKQIIQKTISTLNETGSMEAVCFLTELHVKGRNNYWKVRQAVETAKESLYVFDQLKSSKNELRRPLRKIVFNVPTRRELTSGERAIQHGLAIASGIKASKDLANMPPNICNAAYLASQARQLADTADNLNTKVIGEEQMKELGMNSYLAVGQGSQNESLMSVIEYKGSKDANAKPIVLVGKGLTFDAGGISLKPGEGMDEMKYDMCGAASVYGVMRVIAELQLPLNVIGVLAGCENMPGGRAFRPGDILTTMSGQTVEVLNTDAEGRLVLCDVLTYVERFDPELVIDVATLTGACVIALGSHYTGLMSNHNPLAHELLNASEQAGDRAWRLPMADEYFEQLDSNFADMANIGGRAGGTITAGCFLSRFTTKYNWAHLDIAGTAWRSGKAKGATGRPVALLAQFLLNRAGLNADD

SEQ ID NO: 9889 - protein, 98 aa, Xenorhabdus bovienii
  Peptide sequence Name=Xb4151_4152.C443.gene92.pep
MITENGLQKNDGKSDTKGYCSRNTLNSVDSLDTSRLHLLCRTIRRQKGGRGINHPHSDLHDLTGIVLRAQPDDLLLLWLYLNAMLCLQYPDAPNCIWS

SEQ ID NO: 9890 - protein, 154 aa, Xenorhabdus bovienii
  Peptide sequence Name=Xb4151_4152.C443.gene93.pep
  Gene classification: Gene name=HolC; Function=DNA polymerase III chi subunit; Function class=L DNA replication, recombination and repair
  Homolog annotation: Query=1..150bp; Hit=1..145bp; Blast score=192; Percent Identity=64.0; E value=1e-49; Homolog= ZholC COG2927
MKNATFYLLEKLSQEQLSSSDELQPHEWLACQLAADQWRAGKRVLIACESQQQAEKLDEALWQREPSQFVPHNLAGEGPRYGAPVELCWPQKRSNAPRDILVTLLPHFADFATAFHEVIDFVPIDENLKQLARERYKVYRSVSFNLTMATPPTY

SEQ ID NO: 9891 - protein, 965 aa, Xenorhabdus bovienii
  Peptide sequence Name=Xb4151_4152.C443.gene94.pep
  Gene classification: Gene name=ValS; Function=Valyl-tRNA synthetase; Function class=J Translation, ribosomal structure and biogenesis
  Homolog annotation: Query=15..965bp; Hit=1..951bp; Blast score=1650; Percent Identity=83.0; E value=0; Homolog= ZvalS COG0525
MEKTPANQTQSEPSLDKTYNPTEIEQPLYNHWEKNGYFKPNGDTSRESFCIVIPPPNVTGSLHMGHAFQQTIMDTMVRYQRMQGKNTLWQAGTDHAGIATQMVVERKIAAEEGKTRHDYGRDAFIDKIWQWKAESGGNITNQMRRLGNSVDWERERFTMDEGLSKAVKEAFVRLYQEDLIYRGKRLVNWDPKLRTAISDLEVENREVKGSMWHLRYPLADGAKTAEGKDYLIVATTRPETLLGDTGVAVNPEDPRYKDLIGKEIILPLMNRRIPILGDEHADMEKGTGCVKITPAHDFNDYEVGKRHSLPMINILTFDGDIRDEAEIFDTNGESSDVYSADIPAEYRGMERFAARKAIVAEFEKQGLLVETKPHDLTVPYGDRGGVVIEPMLTDQWYVRTAPLAKVALEAVENGDIQFVPKQYENMYYSWMRDIQDWCISRQLWWGHRIPAWYDAQGNVYVGRDEEEVRRENNLSADITLTQDEDVLDTWFSSGLWTFSTLGWPEQTEALKTFHPTNVLVSGFDIIFFWIARMIMMTMHFIKDENGKPQVPFKTVYMTGLIRDDEGQKMSKSKGNVIDPLDMIDGISLENLLEKRTGNMMQPQLAEKIGKRTEKQFPEGIEAHGTDALRFTLAALASTGRDINWDMKRLQGYRNFCNKLWNASRFVLMNTEGQDCGQNGGEMSLSLADRWILAEFNQTVKTYREALDTYRFDIAANILYEFTWNQFCDWYLELSKPAINKGSEAEVRAARHTLIEVLEGLLRLAHPIIPFITEIIWQRVKVVKGINADTIMLQPFPEFDQTKVDELALNDLEWIKEAIIAVRNIRAEMNIAPSKPLEVLLRDANADAQRRVAENLNFIQSMGRLTSVTVLAAGEEAPVSVTKLINGTEILIPMAGLIDKDVELARLDKEIEKLDKEINAIEAKLANDGFVSRAPEAVVAKERERLAINHAAKEKLLAQKETIAAL

SEQ ID NO: 9892 - protein, 84 aa, Xenorhabdus bovienii
  Peptide sequence Name=Xb4151_4152.C443.gene95.pep
  Gene classification: Gene name=PinR; Function=Site-specific recombinases, DNA invertase Pin homologs; Function class=L DNA replication, recombination and repair
  Homolog annotation: Query=30..78bp; Hit=84..132bp; Blast score=72; Percent Identity=73.0; E value=1e-13; Homolog= XF2028 COG1961
MPSQRLCSFYILNNKPNVSTLSIHYSLLSGVRFKSLTDAIDTGMSSDRSFFHVMAGLAEMERELTVESIRAGRETVKKHKIKFI

SEQ ID NO: 9893 - protein, 81 aa, Xenorhabdus bovienii
  Peptide sequence Name=Xb4151_4152.C443.gene96.pep
  Gene classification: Gene name=MazE; Function=Growth regulator; Function class=T Signal transduction mechanisms
  Homolog annotation: Query=6..80bp; Hit=6..81bp; Blast score=78; Percent Identity=48.0; E value=1e-15; Homolog= chpR COG2336
MSQVIVKKWGNSPSVRLPVSIMKAASLNVDDTVEITVEDGRIVIVPVRAKEYTLDALLSGVTNENIHEEISFGKPTGKELL

SEQ ID NO: 9894 - protein, 112 aa, Xenorhabdus bovienii
  Peptide sequence Name=Xb4151_4152.C443.gene97.pep
  Gene classification: Gene name=MazF; Function=Growth inhibitor; Function class=T Signal transduction mechanisms
  Homolog annotation: Query=1..112bp; Hit=1..111bp; Blast score=133; Percent Identity=57.0; E value=2e-32; Homolog= chpA COG2337
MKSKYVPEAGDIVWLDFDPQAGHEQAGHRPALVLSPAIYNGRIGLMLCCPMTTKIKGYPFEVKVEGEGEGDSAVLADQVKSLDWRERNAKIKGKVSASVLSEVKAKAKALIG

SEQ ID NO: 9895 - protein, 44 aa, Xenorhabdus bovienii
  Peptide sequence Name=Xb4151_4152.C443.gene98.pep
LAYSEYNSTWLLYVKWPIRYVDYHCENRIFPDKGLPQGMEFKAL

SEQ ID NO: 9896 - protein, 37 aa, Xenorhabdus bovienii
  Peptide sequence Name=Xb4151_4152.C443.gene99.pep
MWSCTLNKPTSLMNFIQVKPLHLILQWLGCINATANE

SEQ ID NO: 9897 - protein, 109 aa, Xenorhabdus bovienii
  Peptide sequence Name=Xb4151_4152.C443.gene100.pep
MLLIIVMGLISFLLRVTPFLMNNNKSFKADSLFITSLDYAICFIIGTIIVNISLNNLSLSELINQFNINYFISLVTIVLAYFISKYMCSILKILFFSLVFFIVIHWLLR

SEQ ID NO: 9898 - protein, 226 aa, Xenorhabdus bovienii
  Peptide sequence Name=Xb4151_4152.C443.gene101.pep
MVDSLPVCISFFLIFASIGALYQRHGIPLMETLVGSLLIYAAPLQVAAVGYLADGAVLSVIILALLINFRFFLMAMVMSQYFQGIPKRNILLAMLGFSASTYTVAHSHISAENIKGGKSQFTFYLGIAIPCFVITFCATLLGYVSAEYLNYESLSLFLMMLVPIHFASLTAKRAGKDMSVMATVMGGLCAPLLNEVNMKLVDLVIPILCGVFIALFERKTRKDRSS

SEQ ID NO: 9899 - protein, 48 aa, Xenorhabdus bovienii
  Peptide sequence Name=Xb4151_4152.C443.gene102.pep
MSFYSKTFMAISFIFQVAAAMQPEIYRVYIADIKFVDYSTNLNIGAKC

SEQ ID NO: 9900 - protein, 257 aa, Xenorhabdus bovienii
  Peptide sequence Name=Xb4151_4152.C443.gene103.pep
  Gene classification: Gene name=ArtI; Function=ABC-type amino acid transport system, periplasmic component; Function class=E Amino acid transport and metabolism
  Homolog annotation: Query=7..257bp; Hit=18..267bp; Blast score=282; Percent Identity=56.0; E value=2e-76; Homolog= mll3861 COG0834
MNIILNILLATIIQLGITQLAYAKSTLDNIQSTGVFRIGTEGAYAPFSYHDASGKLTGFDVEIGREIALRMKVKPEFIEGKWDGLIGGLDAGRSDAVMNQIAITPEREKKYSFSLPYVISEAVLITRKDNNDIKTFRDLKGRTSSHTLTNNFAQIARHYGAEIIGTNGFSQEVELVSTGRADATINDKLSYLDYKKHRPDAPVKIVAADTNAAQTAVLLRKSDPELKAAVDKAITEIKNDGTYQQIWDNYFGGEVAE

SEQ ID NO: 9901 - protein, 327 aa, Xenorhabdus bovienii
  Peptide sequence Name=Xb4151_4152.C443.gene104.pep
  Gene classification: Gene name=Tra8; Function=Transposase, IS30 family; Function class=L DNA replication, recombination and repair
  Homolog annotation: Query=1..312bp; Hit=1..312bp; Blast score=298; Percent Identity=53.0; E value=5e-81; Homolog= NMB0443 COG2826
MAYKQLTETERYQIFSLKEAGFSQREISKSLNRNPSTISRELRRNREAKKYTPEQAQLKAVARRQCATKAVKMKPEIEMWIKQLIWQDLSPEQTVGYLKRENIISLHHETVYRLIYKDKINGGNLWQHLRIAKKPYRKRYGSYERRGKIKNRVSIDKRPKLVDKKQRIGDWEGDTIVGKNHKSALLTLVERKSLFTIIIKLENKTAEGVAKAATRHLSLIKHKIKTMTFDNGLEFAEHELISKNLETKIYFAHPYSPWERGINENTNGLIRDYFPKGTDFNKVSEREINLVANRLNNRPRKTRDYKTPNELFKGISSHLLRPLRCCA

SEQ ID NO: 9902 - protein, 45 aa, Xenorhabdus bovienii
  Peptide sequence Name=Xb4151_4152.C443.gene105.pep
MMGSYILPVYRVDRHIYTTYQSLSDQNSGFSYRDRLLFKKSLFFA

SEQ ID NO: 9903 - protein, 250 aa, Xenorhabdus bovienii
  Peptide sequence Name=Xb4151_4152.C443.gene106.pep
  Gene classification: Gene name=ArtM; Function=ABC-type amino acid transport system, permease component; Function class=E Amino acid transport and metabolism
  Homolog annotation: Query=18..233bp; Hit=2..217bp; Blast score=270; Percent Identity=71.0; E value=1e-72; Homolog= mll3859 COG0765
MLYKYVYPPYKQEEYMTPSWLSLALDSLWPMLYAGLTFTIPLTLITFALGISLGFIVALIRLYGSKPLVAVVRFYVWLIRGTPLLVQLFLIFYALPSVGITLEAFTSAVIGFTLNVGAYTSEVIRAALISVPKGQWEASHSIGMSWWQSLRRIVLPQAARVSIPPLSNTFISLVKDTSLASVITVPEMFLAAQRIAAVTYQPLILYTEAAILYLLLSSVLSALQVRLEKKFSQQFSQHRSSKEAKNDSAL

SEQ ID NO: 9904 - protein, 254 aa, Xenorhabdus bovienii
  Peptide sequence Name=Xb4151_4152.C443.gene107.pep
  Gene classification: Gene name=GlnQ; Function=ABC-type polar amino acid transport system, ATPase component; Function class=E Amino acid transport and metabolism
  Homolog annotation: Query=1..247bp; Hit=1..247bp; Blast score=320; Percent Identity=65.0; E value=9e-88; Homolog= mll3858 COG1126
MIQLSNIEKSFDGQKVLKNISLTIKEGSLTALIGPSGSGKSTLLRCINLLEIPQAGTLEIGKEQITFTGKERLPHREIQRFSLQTGMVFQNFQLFPHLTVIENIIEGLIYVQKWPLERARERAQELLKKVGMSHKADVWPNTLSGGQQQRVAIARAMAPSPKVLLCDEPTSALDPELSKEVVSVLKHLAEEGTTMVMATHDLRLAANLAHNVIFLESGEIVESGTAQTMFTRPNKQRTGEFISTLTETLPDWEI

SEQ ID NO: 9905 - protein, 257 aa, Xenorhabdus bovienii
  Peptide sequence Name=Xb4151_4152.C443.gene108.pep
  Gene classification: Gene name=ArtI; Function=ABC-type amino acid transport system, periplasmic component; Function class=E Amino acid transport and metabolism
  Homolog annotation: Query=1..257bp; Hit=11..267bp; Blast score=308; Percent Identity=63.0; E value=4e-84; Homolog= mll3861 COG0834
MKAFLSLLLAGATALTISAPSYAGKDLDAIKASGVFKVGTEGTYPPFTYHDQANKLTGFDVDIAREVARRLNVKPEFMEVKWDGLIAGLDAKRFDAVINQVGVTPEREAKYSFSIPYTASQVVLITRDNNSDIKTFADIKGKRSAQSLTSNYGQLATSNGAHLVSTDGFNQAIDLVATGRADATLNDRLSFLDFKKQRPDAPVKIVAQQADASKSAVLLRKGDPELIAVINKALQDMKDDGTYARISEKYFGTDISK

SEQ ID NO: 9906 - protein, 55 aa, Xenorhabdus bovienii
  Peptide sequence Name=Xb4151_4152.C443.gene109.pep
MTGLMPVFPKNTSALIFPNNLPLNSSISGVFITPLINKFSEFILFTYLFFQLISS

SEQ ID NO: 9907 - protein, 167 aa, Xenorhabdus bovienii
  Peptide sequence Name=Xb4151_4152.C443.gene110.pep
  Gene classification: Gene name=WecD; Function=Histone acetyltransferase HPA2 and related acetyltransferases; Function class=K Transcription
  Homolog annotation: Query=11..167bp; Hit=5..160bp; Blast score=127; Percent Identity=41.0; E value=6e-30; Homolog= VC1217 COG0454
MTATTTQNYVIRPITPQDNTGIAAVIRQVSAEHGLTADRGFAVADPILDTLYEVYNQPRSAYWVIEMDGEVVGGGGVAPLAGGDDDTCELQKMYLSSVLRGKGIARQIVKQSLEFGIEQGFKRCYLETTEILQTAIKLYEKLGFSHLGEPLGNTGHCDCEIRMIKVL

SEQ ID NO: 9908 - protein, 143 aa, Xenorhabdus bovienii
  Peptide sequence Name=Xb4151_4152.C443.gene111.pep
  Gene classification: Function=Uncharacterized BCR; Function class=S Function unknown
  Homolog annotation: Query=1..120bp; Hit=1..120bp; Blast score=146; Percent Identity=75.0; E value=6e-36; Homolog= yjgD COG3076
MADPHALEEQREETRLIIEELLEDGSDPDALYIIEHHFSAENFDLLEKAAVEAFKLGYEVTDAEELETEDRVVLMCCDIISESRLDAELINTQVEQLMNLVEKLGVNYDGWGTYFEDPNAPDDEDEDEDEAEDFPEQDERKLH

SEQ ID NO: 9909 - protein, 43 aa, Xenorhabdus bovienii
  Peptide sequence Name=Xb4151_4152.C443.gene112.pep
MPIPSVIWLSCCAFSHLFPAKDIAIQFRQKGNTDRELWHDKLF

SEQ ID NO: 9910 - protein, 337 aa, Xenorhabdus bovienii
  Peptide sequence Name=Xb4151_4152.C443.gene113.pep
  Gene classification: Gene name=ArgF; Function=Ornithine carbamoyltransferase; Function class=E Amino acid transport and metabolism
  Homolog annotation: Query=1..333bp; Hit=1..334bp; Blast score=528; Percent Identity=75.0; E value=1e-150; Homolog= ZargI COG0078
MNPFYRRNLLRLHDYTPSEINVFLTLSSELKSNKKSGKESPLLSGKNIALIFEKDSTRTRCAFEVAAHDQGASVTYLSSNGSQIGHKESIKDTARVLGRLYDGIQYRGYGQEVVETLAKYAGVPVWNGLTNEFHPTQLLADLLTMQEHSQKPLTEIKLAYLGDARNNMGNTMLEAAALTGMELRLVAPKTCWPDAALIAECQTLAEKTGGRIALTEDIATGVKDADFLYTDVWVSMGEPKTVWQERIALLKPYQVNMDVIQLTENPEVKFLHCLPAFHDEETTLGKQLAEEFNLYGGLEVTSEVFESKHSIVFDQAENRMHTIKAVMVATLAKELSF

SEQ ID NO: 9911 - protein, 357 aa, Xenorhabdus bovienii
  Peptide sequence Name=Xb4151_4152.C443.gene114.pep
  Gene classification: Gene name=RbsK; Function=Sugar kinases, ribokinase family; Function class=G Carbohydrate transport and metabolism
  Homolog annotation: Query=61..347bp; Hit=6..292bp; Blast score=303; Percent Identity=51.0; E value=2e-82; Homolog= ZyeiC COG0524
MPSRENQILRLIKQDPFIQQQEIADILGVSRSCVAGHIMNMNKKGHIKGKGYIFPSPNNAYAVTIGAANMDFTSYASEKLVYEDSNPGKIISTPGGVGRNIAQNIAALKSESHFISVVGNDYNGKVLFEQTKLAGVNIRYFHKLDEEKTSICNSIIDENGKCIVSVNDMDIMEKLTPTLLSQSEELIRRASVLVIDCNLTEGALEWLFNHAGNVPIFIDTVSTFKATKIRHWLSYIHTLKPNRSEAEILSGIEIETQKDAAIAASWFHQQGVQRLILSMGAEGVYYSELDNKSGYSRAITTSVLNASGAGDAMMAGLAHCWLQSMSLEDSIRYAQRCSALTLSSEDTWILPNKSSIP

SEQ ID NO: 9912 - protein, 42 aa, Xenorhabdus bovienii
  Peptide sequence Name=Xb4151_4152.C443.gene115.pep
MCTVFAEQNSFSCFSNKCHEDGLLPQFKKIPHFWCKKHSFIR

SEQ ID NO: 9913 - protein, 89 aa, Xenorhabdus bovienii
  Peptide sequence Name=Xb4151_4152.C443.gene116.pep
  Homolog annotation: Query=1..72bp; Hit=1..83bp; Blast score=119; Percent Identity=83.0; E value=1e-26; Homolog= gi|37524271|ref|NP _927615.1| hypothetical protein [Photorhabdus luminescens subsp. laumondii TTO1] gi|36783694|emb|CAE12547.1| u
MEIIPAQLAKNQFGDLLMKVQRVAVVISPEEYDQFTQLKLQNLKAVLAESIAQADRGELHSIDDVFAPFTVEFPRREPHYLLPGSFDWY

SEQ ID NO: 9914 - protein, 88 aa, Xenorhabdus bovienii
  Peptide sequence Name=Xb4151_4152.C443.gene117.pep
MSAFTAPLLLKLPPPKIGSDICSTTPAIECKPTPDISCNRVLKMTLNIWSSSLWVRSSRATRPVSWLFCVLVALYTFSYNSYLSHFRR

SEQ ID NO: 9915 - protein, 84 aa, Xenorhabdus bovienii
  Peptide sequence Name=Xb4151_4152.C443.gene118.pep
MSGVGLHSIAGVVEQISDPILGGGSFRSNGAVKALIELDVILQGPKIGRNHSYRLNPQFGWKGMVNNHKETLTNGLSVIQGGRA

SEQ ID NO: 9916 - protein, 154 aa, Xenorhabdus bovienii
  Peptide sequence Name=Xb4151_4152.C443.gene119.pep
  Gene classification: Gene name=WecD; Function=Histone acetyltransferase HPA2 and related acetyltransferases; Function class=K Transcription
  Homolog annotation: Query=4..153bp; Hit=5..156bp; Blast score=57; Percent Identity=25.0; E value=4e-09; Homolog= BS_ydgE COG0454
MIELREMTTAEFELFRLLFINEYALDLASTRGYPADVSLKKASQLIDVTQSQATEKVINKFWCIVKSDHELPVIGYLWIELKEKAAWVCDFSLLPEWRHKGLGKATLDKMKSNLISMGITEVGLRVAPNNPVAKALYEKSGFHITGFNMSKTLS

SEQ ID NO: 9917 - protein, 207 aa, Xenorhabdus bovienii
  Peptide sequence Name=Xb4151_4152.C443.gene120.pep
  Gene classification: Gene name=RhtB; Function=Putative threonine efflux protein; Function class=E Amino acid transport and metabolism
  Homolog annotation: Query=1..207bp; Hit=1..208bp; Blast score=182; Percent Identity=50.0; E value=2e-46; Homolog= CC0456 COG1280
MLVTDALLAFIVAATLLTSTPGLDTALVLRTAAVEGGKKALHAALGINAGCFIWGAMVAFGLGTLIAVSEQAFNILKWCGALYLCWLGIQMIVRPSQSLAGETASSPVKTQNWFIRGMLGNVLNPKIGVFYVSFLPQFIPQGHSPVLWIFGLVSIHILLGTIWSLLLIYATRPLSHLLRRENVIKWMNRATGGLFLFFAFKLVLSRR

SEQ ID NO: 9918 - protein, 181 aa, Xenorhabdus bovienii
  Peptide sequence Name=Xb4151_4152.C443.gene121.pep
  Gene classification: Gene name=KptA; Function=RNA; Function class=J Translation, ribosomal structure and biogenesis
  Homolog annotation: Query=9..180bp; Hit=47..218bp; Blast score=224; Percent Identity=62.0; E value=5e-59; Homolog= kptA COG1859
MAQVDTKISKFLSYVLRHQPESIGLTLDNEGWADIGELIKCAEKHGKHLNYALIATIVETNDKKRFAISDDQKRIRAVQGHSNQKVNISYQAQVPPTVLYHGTAIRFLDSIFQQGLVAGSRHYVHLSADEATAIKVGQRHGKPDILKINAQLMHEQGFKFHQADNGVWLTKSVPVKYISFN

SEQ ID NO: 9919 - protein, 268 aa, Xenorhabdus bovienii
  Peptide sequence Name=Xb4151_4152.C443.gene122.pep
  Gene classification: Function=Predicted nucleotidyltransferase; Function class=R General function prediction only
  Homolog annotation: Query=13..260bp; Hit=11..258bp; Blast score=259; Percent Identity=54.0; E value=1e-69; Homolog= PA4584 COG3541
MEVMEKKTTAVSSVMRTRIKQELAGIEKRYGVQILYACESGSRGWGFASPDSDYDVRFIYVHPVDWYLIVEAGRDVIELPISDELDICGWELRKTLKLLKQANPTLMEWLDSPIIYQADPAATNGLKTMVPHFFSGIKARYHYLSMAKKNFRGYLQGEEVRLKKYFYVLRPLLAVRWIEMGKGVPPIDFETLVAGTVDDPQLKAEISDLLRSKRLANESEYGLRKLRVHAFIESELDETLSRCELKDKRERSYALLDDYLRRWVMKRV

SEQ ID NO: 9920 - protein, 413 aa, Xenorhabdus bovienii
  Peptide sequence Name=Xb4151_4152.C443.gene123.pep
  Gene classification: Gene name=RtcB; Function=Uncharacterized ACR; Function class=S Function unknown
  Homolog annotation: Query=12..413bp; Hit=5..404bp; Blast score=646; Percent Identity=76.0; E value=0; Homolog= PA4583 COG1690
MTTIEMKTNAYNLLTQENGAQIKMWTNGVPVDPKAITQLQNTAKMPFVFKHLAVMPDVHVGKGSTIGSVIPTRGAIIPAAVGVDIGCGMIAVRTSLVASDLPDSLLNIRHAIEAAVPHGRTVNRGGRDKGSWHRAPELVDQHWATLADGFKCITDKYPKLLNTNNHQHLGTLGTGNHFIELCLDEADRVWVMLHSGSRGVGNAIGNLFISLAQKDMQQHIANLPDRDLAYFEEGSRYFDDYMEAVGWAQDYARQNREVMMHHVLEALSREIPKPFTTQEEAVNCHHNYVQREQHYGEEVLVTRKGAVSARKGQMGIIPGSMGAKSYIVRGLGNEESFCSCSHGAGRVMSRTEAKKRFTVSDQKRATAHVECRKDSDVIDEIPMAYKDIDAVMEAQSSLVEIVHTLRQVVCVKG

SEQ ID NO: 9921 - protein, 524 aa, Xenorhabdus bovienii
  Peptide sequence Name=Xb4151_4152.C443.gene124.pep
  Gene classification: Gene name=HflC; Function=Membrane protease subunits, stomatin/prohibitin homologs; Function class=O Posttranslational modification, protein turnover, chaperones
  Homolog annotation: Query=156..520bp; Hit=15..379bp; Blast score=377; Percent Identity=57.0; E value=1e-104; Homolog= PA4582 COG0330
MMKKIKLLQGQIGLLAKEGEYQQILTAGKYRFIDWFNKLRLTVFELNSNEIEAKLAEHLRQYHTDWVAQHCDDIQLTEDEIGLLYEHDLLTEILPPATRRLYWKNGDQRRIEVCPTTEQEVSSQLVSLLQPSKIRKRNVKGLESVLITQIPAWHIGVLKSDGIVQQLLQPGLKGYWRFGHDISVELVDTRSWPQVEESLAEYFRHQHIDWVEQYCDEIQIADDEMGLLYEHDVLVEILSPATRYLYWKNGNPRCVEVLKASELEVSSELASVLVSSMVRKHSVKGIDSVLIAQVPAWHVGILKVDGVAQKLLQPGQAGYWQVGHDVTVEIVDTRLQALEVGGQEILTRDKVNLRINLSANWRYHDVLMAYEQLSEPVAYLYRELQFALREMVGTRSLDELLEDKQAIDELINEKVQRITAGFGLEVVSLGVKDIILPGEMKTILSRVVEAEKAAQANVIRRREETAATRSLLNTAKVMENNPIALRLKELETLESIAERINQISVYGGLDQVLNGLVQIKGEQK

SEQ ID NO: 9922 - protein, 168 aa, Xenorhabdus bovienii
  Peptide sequence Name=Xb4151_4152.C443.gene125.pep
MKRYLPAVKICWYSPSFASKPICPCNNLIFFIIVIFLFYIPFTRKTEHQGETKGGTHRYSNSGSSVSCPWLSDISRVFRMVALDGQPQGFTSTFYFVFYRESKRPYPLYGVNLGLEPNVTLCCSRNVFLLTEYMWRNDLMPSPMYRLGLTPCYFSVRTYELLPIACQL

SEQ ID NO: 9923 - protein, 525 aa, Xenorhabdus bovienii
  Peptide sequence Name=Xb4151_4152.C443.gene126.pep
  Gene classification: Gene name=PspF; Function=Transcriptional regulators containing an AAA-type ATPase domain and a DNA-binding domain; Function class=T Signal transduction mechanisms
  Homolog annotation: Query=1..523bp; Hit=1..530bp; Blast score=688; Percent Identity=67.0; E value=0; Homolog= PA4581 COG1221
MKRRVVIGILGTKLDRRGKKANRWTKWRPTIGMCQQAELPIDRLELLYQTNDYGLAQRVKEDIAETSPKTKVVLQELKIEDAWDFEEVYTAQLDFAVRYPFDTENEEYLVHITTGTHVAQICWFLLTEARYLPAQLLQTSPRNGDRESHPEGNYTIIDLNLSRYTTLTSRFLHEQQEQVAFLKSGIATRNANFNRLIDQVERVALRSSAPILLTGPTGAGKSFLARRIYQLRQSRHLIQGRFVEVNCATLRGDNAMSTLFGHVKGAFTGAIQPRTGLLREADGGILFLDEVAELGLDEQAMLLKAIEEKSFLPYGSDKEVHSNFQLIAGTHRDLHTWVVQGKFREDLYARINMWTYQLPGLAQRREDIEPNIEYELARYAQMQQTQVRFDKEARLIYLHFACSEQAQWRGNFRELGASVTRMATFAENGRINQHLVEEEITRLKQNWQDNGLSSLLPNHLPEVDLFDRQQLETVIKICRESASLSEAGRKLFAVSRQQKKQPNDADRLRKYLARFGLGWDSIQND

SEQ ID NO: 9924 - protein, 304 aa, Xenorhabdus bovienii
  Peptide sequence Name=Xb4151_4152.C443.gene127.pep
  Gene classification: Gene name=ElaC; Function=Metal-dependent hydrolases of the beta-lactamase superfamily III; Function class=R General function prediction only
  Homolog annotation: Query=1..304bp; Hit=7..311bp; Blast score=388; Percent Identity=61.0; E value=1e-108; Homolog= elaC COG1234
MELKFLGTSAGVPTKERNVTSLVLDLRGIRNALWMFDCGEGTQHQILNSSIKIPKLEKIFITHLHGDHIFGLPGLLCSRSMGGSTDPVTLYGPKGIRQFVETTLQLSGSFLTYPLDIVEVQSGLLFDDGELKVTAYALNHRVECYGYRIEEHDKPGGLNTQRLNQDNIPRGSWMQTLKQGGTVTLEDGRTVCGKDYLGAPISGKSLAIFGDTTPTPEALKLAANVDVMVHEITLEDALAEKANNNGHSTTKQAATLARDAKAKHFIATHISGRYGIEDCPRLLAECREIFPNTDLAEDFAIFIV

SEQ ID NO: 9925 - protein, 65 aa, Xenorhabdus bovienii
  Peptide sequence Name=Xb4151_4152.C443.gene128.pep
MSGNIPQYRFGRRLCDIYSLIKHQFAHLILLSRSNVFTRQRYKAFLRSSLRIIFKIVVSYFNIFH

SEQ ID NO: 9926 - protein, 406 aa, Xenorhabdus bovienii
  Peptide sequence Name=Xb4151_4152.C443.gene129.pep
  Homolog annotation: Query=22..240bp; Hit=22..240bp; Blast score=211; Percent Identity=46.0; E value=2e-53; Homolog= gi|37526105|ref|NP _929449.1| hypothetical protein [Photorhabdus luminescens subsp. laumondii TTO1] gi|36785535|emb|CAE14484.
MNSIIKTDIKESMYNIFTENTDNIWSDWLDEKELKKLTDHPVLQSFNDSTASEEMLKTFLIQHCYYSRHFTRYLIALISKLDVFEDIKDLLHNLLEEMGLEDENKITHAELFQRTLKTVGADINSQKPFENTTAMVDAMFSFCLSDDPLEGLSAMCLGAEAIVPLIYKPVLNRLMTLNYNKDATEFFTLHIEEDEDHAIKMFEIIDRLTRQDESLRLKAINIGSEMIRKRVKMLDSVWESEIVRKNNVEKADLNNQKNDLSFNSSDFWRVNHKSTPSIPEKLIHKNVINSHSHGENKFSEERKHKVNIVNLPTKTISMTLGHLEPGQSTNLHRHNYETVIYIIEGDGVSKIGNNDVAWSAGDAIYIPSWVEHKHSSVNQNQCLYIACENAPLLQNIGNIALREELE

SEQ ID NO: 9927 - protein, 536 aa, Xenorhabdus bovienii
  Peptide sequence Name=Xb4151_4152.C443.gene130.pep
  Gene classification: Gene name=CaiC; Function=Acyl-CoA synthetases (AMP-forming)/AMP-acid ligases II; Function class=I Lipid metabolism
  Homolog annotation: Query=43..515bp; Hit=29..503bp; Blast score=281; Percent Identity=35.0; E value=1e-75; Homolog= PA0996 COG0318
MSLATFSTFEAIASTTKSINLAQRFVMENSSLDKDCFIGPDGSLSYSQLAFFVQKSASAMSLKKIEKNTAVILCLNDSRELAIIFFASLAIGALPVVINPKLPANTLDYILGEFDTPFIFLDEDNQISIAAEAKENTIRIKRSADLSAFCDWMPENTNDKWHDFLEKTHFEPAFIQYTSGSTGKPKGVIHSVTSILSSCEHFSKHQLGLTTTDIIYSTPKTFFGYGMGNTLFFPLFIGATAIIDSLWPSITRVTDNIKQFQPTVLLAGPMIFRLLLEDDEFKQNCHLRLVVSSGSMLPAPLKESWFQRLNIVIHDAFGATETCHAFATTYGHPSRSGSIGKFIAGCTGKIVDKDGKTVPAGETGVLMLSSESLALGYWNNHQDTKIKFSNGWYRTGDLFSQDDEGFLYYHGREDEQFKVLGRWLVPVEIEKLVHSAFPEIGDAFMIPWMDSIQECRPVLCLKTSSSEFEAISQQIANFISHQVESYKHPYVYLNLEQFPLNGNGKIDRKSMIEIARQKITDQNMSSHPRRINYAQS

SEQ ID NO: 9928 - protein, 500 aa, Xenorhabdus bovienii
  Peptide sequence Name=Xb4151_4152.C443.gene131.pep
  Gene classification: Gene name=TrpE; Function=Anthranilate/para -aminobenzoate synthases component I; Function class=E Amino acid transport and metabolism
  Homolog annotation: Query=2..497bp; Hit=1..489bp; Blast score=379; Percent Identity=40.0; E value=1e-105; Homolog= PA0609 COG0147
MLNLNEFLAYGEEGYNLVPVWKNIKKTQISPISIYETLANKSYSYLFELSEKYEDKYRATYSIVGLPCHQRIEIKDYSIKVFDENNAQTHITDIPPLDALRQILTSYRVPKIDQLPNYAGGLFGYFGFETTRLIEPKLQANTRKKTLVDLPDILQIVSQELIVVDHINDLIYVIVHAKPTKSQNFTDANLRINQIISELEKIPYQQQANFSPSTTTDRTTWFKDMESHFPQHDFQMAVNKIKEYIKAGDAMQVVLSQAMSRPLKANAIQLYQALTSMTNTPYCYLMNVEDSHIVGASPEMMVSLHQNKLISHPMAGTRHRGMNQQEDDALKAELLADNKEIAEHIMLVDLARNDIGRVAKTGSVTVNNLLSVEYFSHVMHIVSEVSGEKMDGIDEIDVISSTFPAGTLSGAPKIRALEIIHELEPYGRGVYGGCLGYITWNGDINLSITIRTGLLHQGQLYVQAGAGIIDASRAEREWQETIEKNSMMMHAAYQAEQFSL

SEQ ID NO: 9929 - protein, 198 aa, Xenorhabdus bovienii
  Peptide sequence Name=Xb4151_4152.C443.gene132.pep
  Gene classification: Gene name=PabA; Function=Anthranilate/para -aminobenzoate synthases component II; Function class=E Amino acid transport and metabolism
  Homolog annotation: Query=1..186bp; Hit=1..186bp; Blast score=228; Percent Identity=58.0; E value=3e-60; Homolog= BS_pabA COG0512
MYFIIDNYDSFTYNIAQYLGMLGIEVLVKKNDRITLEYIEQHNPTGLIISPGPCTPNEAGISTLAIQHFAGKIPILGICLGHQCIAQEFGGKVLRANKVYHGHTSTITHNDKNLFANLPQDIKVGCYHSLVVDDLPECLTVTARSCDEYNDIMALKHNDFPIYGVQFHPESILSDFGLDMLKNFIKITQEWKPMNRIQ

SEQ ID NO: 9930 - protein, 46 aa, Xenorhabdus bovienii
  Peptide sequence Name=Xb4151_4152.C443.gene133.pep
MNKVTGTNIFRTNNFFYFFWRNHWSIFPLRSMYKMIYYIMIICKTI

SEQ ID NO: 9931 - protein, 538 aa, Xenorhabdus bovienii
  Peptide sequence Name=Xb4151_4152.C443.gene134.pep
  Gene classification: Gene name=CaiC; Function=Acyl-CoA synthetases (AMP-forming)/AMP-acid ligases II; Function class=I Lipid metabolism
  Homolog annotation: Query=54..445bp; Hit=31..426bp; Blast score=106; Percent Identity=24.0; E value=7e-23; Homolog= AF1932 COG0318
MITPEEIKKIISSENIGAGNFIHHLNNYFSEREMSPKITCDVPTYDNPEEEKSQFEINDLVKISDQLSGAYIALGVQKREPVALYFDDTIDYLIHFIALNNIGSFPIFVNGDLSSHIAMSFMQNSGTKFIISTEERIHSLGDKAAGIQFVTPNELNLLKKPISRYYQHHANDIILLGHTSGTTGLPKPVIFTHESMFHGILKEVAKQRGKQILSMFPHSHGASMTLIMLTLTRGAAIHIQSKKTAFDILDSIEQIKPDTVAAFPKIFVDLCREDLDDWDLNSISHWVSTGDANHEPHIRKLISYGHHFVDGKKARGSFFIDNLGSSEFAFAMFRNIHQPKTDRYDRCIGIPFSWVDAAILDADGNVLPNNQVGMLGVISKSVTTGYWNNHLLTEKNRVNGYWLTGDLVYRTNDGFFYHVDRTSDWIKTPQGPLYSTQCEEWLLKNIDSIFDISIVATSLPNGDQQTTAIVELKAGHEISPATLLQNINACHQEKQWPLIDNIVYQSADNDLGVTGKKLKRKIRDRMPEDNSMVTEEGN

SEQ ID NO: 9932 - protein, 243 aa, Xenorhabdus bovienii
  Peptide sequence Name=Xb4151_4152.C443.gene135.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=2..235bp; Hit=6..235bp; Blast score=136; Percent Identity=36.0; E value=2e-32; Homolog= mll2196 COG1028
MKTCLITGANRGIGFEIAKKLGERGHRVILSGRDIPALEHSVSQLTQMGITADLLHLDVTDPESIKSAANLLLSANTTLDVLINNAGVFLDSIQKPSETSLDDIHKSLTVNLVGPWLVTQAFLPLLNRSEEARLIFISTDLAALSQAADPHSKYNRIEGPAYRASKAALNMLALQWAKEFRDSKISVSVCSPGWCRTGLDSQISSEQAPNSAAEGADTVVWLALDKGREQHGHFYSARQTIDW

SEQ ID NO: 9933 - protein, 459 aa, Xenorhabdus bovienii
  Peptide sequence Name=Xb4151_4152.C443.gene136.pep
  Gene classification: Gene name=PutA; Function=NAD-dependent aldehyde dehydrogenases; Function class=C Energy production and conversion
  Homolog annotation: Query=26..455bp; Hit=9..445bp; Blast score=199; Percent Identity=32.0; E value=4e-51; Homolog= ZadhE_1 COG1012
MYGDNIMTINENIDITVQQTETASYIDNLVVQGKIAQKELEKQSDEDIDNVLHHLAKIFSTHCREWAEKELAVTRIGNADDKEHKLALVVNQVFKGLYGTKTHGRLGGTQRLIEYASPVGLIFAVVPLTNPIPNSLFKIMLSIKTRNAIIFSYPGKTGKLADEFIGLVQQVLTEHGLPVSLVQVCTPPSHDKTHMLMQHPGVDMILATGGRNLVHAAYSSGKPAFGVGPGNVPVYISRSAHIQKAAANIVNGKIYDNGIVCGSESNLIVHPASKNDLISALEANGAAILTSSEVEQAIQTLFNPETQYVSRENIGVCAASLAAKANISRTYPIKLLVIPAEIGRHDFLSNEKMAPVLTLYTADEENGVSLAYSLICNEGAGHTAVIHSEDPEEIHQFSTVMPAGRILVNTSATQGMLGETTELPVSFMQGSGTFGHNHSTDPIIWKHLVNIKRVAHGLH

SEQ ID NO: 9934 - protein, 371 aa, Xenorhabdus bovienii
  Peptide sequence Name=Xb4151_4152.C443.gene137.pep
  Homolog annotation: Query=1..368bp; Hit=1..383bp; Blast score=273; Percent Identity=38.0; E value=4e-72; Homolog= gi|22975647|ref|ZP _00021602.1| COG1902: NADH:flavin oxidoreductases, Old Yellow Enzyme family [Ralstonia metallidurans]
MKIQCIGAGPAGLVFSILAKMQDHNRDVVVYERNLSNVTTGWGLVLSEPMLQQLANIDPSIVEQLRPHISTLNHIDIYIKEKTFRSSGYQFLAISRLEMINTLRKKALDLGIKINYDSSLNAEDLINLPADLTVISDGANSKIRHQLKNEFDTNINEGKNLYLWLGTSHLFNDTFNFIFEQTETGWFWAHCYKFENNHSTFVVECTHETWVKTGFAHMDEKQTIAFLEKVFHRHLCGHPLQINDTCREKAYWRRFVTPVSKHWSHDKKVLLGNAAHSAHFSIGSGTKLAIGDAIALAENLKSSNKLDSACFTDYQHNRQNESSNLHIAAQSSQSWFENVESLIENDPLEFSISLLLRSGRLSRDELTINLL

SEQ ID NO: 9935 - protein, 140 aa, Xenorhabdus bovienii
  Peptide sequence Name=Xb4151_4152.C443.gene138.pep
  Gene classification: Function=Uncharacterized ACR; Function class=S Function unknown
  Homolog annotation: Query=3..136bp; Hit=8..141bp; Blast score=104; Percent Identity=38.0; E value=2e-23; Homolog= Z3974 COG2128
MNYAKISPKIMNPLYKCYDEIQKCELDQSLILLVEMRTSQINGCAYCCRLHAEMGRKLGIEEEKLDKLPGWFNSRIYNQKEVLALEWCEALTIGLRDKDLNDLRERLEELFSEKELVDLTSAISVMNALNRMAISIGDHS

SEQ ID NO: 9936 - protein, 147 aa, Xenorhabdus bovienii
  Peptide sequence Name=Xb4151_4152.C443.gene139.pep
MLNGTQLRYAALIARYSLAIAYLVAVADRFGLCGEYGDPQITWGNFTVFLGVVKHLTPWAPDFMIPIFGWGATILEVALPIFLIIGFKIKETALVSAALLLIFAVTMTTTGLLKSVFDYSVLSAFSCSLLLYCFEKFRVSEDKKQLN

SEQ ID NO: 9937 - protein, 245 aa, Xenorhabdus bovienii
  Peptide sequence Name=Xb4151_4152.C443.gene140.pep
MIFNQKEMNIIQARDFMNEILVSKTTTNILRQMIQKDTVIKSPIGTYVGIESFIALLKIWHRAFPNLVYKENNLYVHNENIIIDWEAEGKHLGEFYSISATGKQVTCQGTTEIVMNDGKIIDYHTKINIQNIISQLIGLPCSPTLDIRNIEIYNLINNILGYQLSCRQIECLSLSTLNTSIKEIARLLSIESNTVKTHLKRAFEIIGISNKKMLMEFIIERQAIEILVRLGLFLRVQIKRNNYFE

SEQ ID NO: 9938 - protein, 42 aa, Xenorhabdus bovienii
  Peptide sequence Name=Xb4151_4152.C443.gene141.pep
MSIDQEFIINFCTTAWYRCYDWHNSVRSVLLVWRLIRTPHLD

SEQ ID NO: 9939 - protein, 248 aa, Xenorhabdus bovienii
  Peptide sequence Name=Xb4151_4152.C443.gene142.pep
  Gene classification: Gene name=Cof; Function=Predicted hydrolases of the HAD superfamily; Function class=R General function prediction only
  Homolog annotation: Query=4..220bp; Hit=3..222bp; Blast score=82; Percent Identity=29.0; E value=3e-16; Homolog= PM0231 COG0561
MKTYIFDLDGTIITNGQPIHNVIAEKIKQLCSSGSVIFASARPIRDMLPLLPHELHNCLMIGCNGGMAWQNGDFLFSHSFNPEHFSRVIAFLKEEKIPYVIDGVWYFSVSEINHDFHNYMRTLSTYEKEEKELLSEKITKILVLDGESRTKIDRFLEREGFKYNINHHKADNLFDITPQSEDKYQSLCKLGVDFNNAIVFGNDENDYAMLDNAKISVFIGAMKDYPNANFYCRTEYIPSILGEVTDSF

SEQ ID NO: 9940 - protein, 56 aa, Xenorhabdus bovienii
  Peptide sequence Name=Xb4151_4152.C443.gene143.pep
MNAIVSIMRDDLLGENMKYCTTHDVTKHQANEKLPAGSLGALFFPLQNRSLKKPLI

SEQ ID NO: 9941 - protein, 313 aa, Xenorhabdus bovienii
  Peptide sequence Name=Xb4151_4152.C443.gene144.pep
  Gene classification: Gene name=PyrB; Function=Aspartate carbamoyltransferase, catalytic chain; Function class=F Nucleotide transport and metabolism
  Homolog annotation: Query=1..311bp; Hit=1..311bp; Blast score=510; Percent Identity=81.0; E value=1e-145; Homolog= pyrB COG0540
MANPLYRKHIISINDLSRTDLELVLQTAAALKANPQTELLKHKAIASCFFEASTRTRLSFETAIQRLGASVVGFADSNNTSLGKKGETLADTISIISQYTDAIVMRHPQEGAARLASEFSGHIPVINAGDGANQHPTQTLLDLFTIQETQHKLDNLKIAMVGDLKYGRTVHSLTQALAKFSGNHFCFIAPDALAMPSYILHMLDEKQVSYSIHHNFEDVMPELDILYMTRVQKERLDPSEYANIKAQFVLHAADLVNVKENLKVLHPLPRIDEITVDVDKTPYAYYFQQAGNGIFARQALLALVLNENVVIEK

SEQ ID NO: 9942 - protein, 772 aa, Xenorhabdus bovienii
  Peptide sequence Name=Xb4151_4152.C443.gene145.pep
  Gene classification: Gene name=BisC; Function=Anaerobic dehydrogenases, typically selenocysteine-containing; Function class =C Energy production and conversion
  Homolog annotation: Query=6..758bp; Hit=9..763bp; Blast score=918; Percent Identity=59.0; E value=0; Homolog= PA5181 COG0243
MKFKSKIEPYHSAAGGWGSLEATTRFVFDSKQALKNMVNLMRMNKAKGFDCPGCAWGDDNKSLFSFCENGAKAMTWEATRRHVDQAFFAAYSVSKLYQQSDYFLEYQGRVVEPMRYNHQTDHYEPISWDDAFTLIAKHIKAMENPNQLELYTSGRASNEASWLYQLFGRVLGTNNFPDCSNMCHEASGYGLLKSLGVGKGTIRLNDFDHADAIFVFGQNPGTNHPRMLHSLRHAAERGARIVTFNTLRERGLERFADPQKPLEVITPKAGAISHRYYQPKLGGDMAVVRGMVKALLETHNAFLAAGKSGIFDLEFISTHTEGVDAYLQEVAVTEWAFIENQSGLTQAQLREAATIYQHADRVICTWAMGITQHKHSLDTVREIANLQLLFGQLGKSGAGLCPVRGHSNVQGNRTMGINEQPTKAFLDSMAEHFGFEPPRAHGHHVVKALSAMLRDEVRVLIALGGNLAAAAPDSPRTEEALRHCDLTVHISTKLNRSHLITGKKEALILPALGRTEQDIQLSGAQFITVEDSFSMVHASEGLNKPLFDTQRSETAIIAGIANAVVGNTATINWLELAGNYNKIRDHIAATIPGFADFNKKCEQPGGFYLGNAAAELRFSTPSKKAQFSDASLPESLFPQLGETDVPFTLQTLRSHDQYNTTIYGLDDRYRGVYGQREVLFMNPEDIALLGYQAGDRVDIETVWNDGIERKVYGFKLVPYAIPCGNLAAYYPETNPLVPMDSIGNGTGTPTSKSVPVKLSLTEIGEAEPQRLV

SEQ ID NO: 9943 - protein, 69 aa, Xenorhabdus bovienii
  Peptide sequence Name=Xb4151_4152.C443.gene146.pep
MIHCDTYSVLRQRKNRSIAIESTMSAPQINHTISIGNFIGNCFITDYEFGMIFVMLTITIETFRPQGVT

SEQ ID NO: 9944 - protein, 405 aa, Xenorhabdus bovienii
  Peptide sequence Name=Xb4151_4152.C443.gene147.pep
  Homolog annotation: Query=3..398bp; Hit=2..388bp; Blast score=357; Percent Identity=51.0; E value=2e-97; Homolog= gi|16078255|ref|NP _389072.1| yjcL [Bacillus subtilis] gi|7475109|pir||D69847 hypothetical protein yjcL - Bacillus subtilis gi|
MNNTLITSDNSLMLWAFIMIAVAVAIMVEQRYRWASKIPGAVIALIIAVFASNLNIIPTEAPVYDAVWGYIVPLAIPLLLFKTNLHSIIKESWRLLILFLISSVATMIGAIVSFRLFKEHIPELDKISGMISASYTGGGVNFAAMAAKLEPSQSMTASTIVADNMMMAGYFIILIALSGWTVARKFWGSPHTDAIDNDPDLDKSQTFAAAYWKPKNIALKDIALSLAWSIFIVALSFQLSTWLKALLGQPNSIYQELLFSLISDKYLILTTVTFTLVSIFKETFSKLNGTQELGTYAIYMFFVVIGIPASIEAIISHAPLLFAFVFVIAMINLLLTFAAGKVFKFSLEENILACNANIGGPTTAAAMAISRGWVNLVGPIMVIGTVGYVIGNYVGTFVYFIVGRM

SEQ ID NO: 9945 - protein, 243 aa, Xenorhabdus bovienii
  Peptide sequence Name=Xb4151_4152.C443.gene148.pep
  Gene classification: Gene name=DdpX; Function=D-alanyl-D-alanine dipeptidase; Function class=M Cell envelope biogenesis, outer membrane
  Homolog annotation: Query=29..238bp; Hit=13..247bp; Blast score=65; Percent Identity=28.0; E value=4e-11; Homolog= slr1679 COG2173
MFLSIAMENNTVDKIAVEKLFDWEVINGMPINECHEPLEIITDTDKLRQQSAYFFAGIKGSIEYCTVRENVARKLVIASQLLPPHLGLLVLDGWRSRETQQALQEQTQIKIADQYRHLSVEEQKALLQQFVAPAPTEQHQISPHLTGGSVDVTLFDVASGKPLFLGTEFDEVTELSYTAALEKEPEKNMPAILYRRLLYNAMIQVGFTNLPTEWWHYDYGNSLWAFYKNDIAIYGAVDGTRNR

SEQ ID NO: 9946 - protein, 45 aa, Xenorhabdus bovienii
  Peptide sequence Name=Xb4151_4152.C443.gene149.pep
MNTVQVFLLRILGDQGHVPILSHKIWHFTLHKSVFDASSDTLFEL

SEQ ID NO: 9947 - protein, 154 aa, Xenorhabdus bovienii
  Peptide sequence Name=Xb4151_4152.C443.gene150.pep
  Gene classification: Gene name=PyrI; Function=Aspartate carbamoyltransferase regulatory subunit; Function class=F Nucleotide transport and metabolism
  Homolog annotation: Query=1..153bp; Hit=1..153bp; Blast score=221; Percent Identity=73.0; E value=3e-58; Homolog= pyrI COG1781
MTQDHQLQVEAIKCGTVIDHIPAHIGFKLLSLFKLTETEQRITIGLNLPSNQLGRKDLIKIENTFLTEQQANQLAMYAPHATVNNIENYEVVKKIPINLPKQIDNVLVCPNSNCISHNEPVESSFYVIPTADDVIVRCKYCEKEFDRQAVINND

SEQ ID NO: 9948 - protein, 128 aa, Xenorhabdus bovienii
  Peptide sequence Name=Xb4151_4152.C443.gene151.pep
  Gene classification: Gene name=TdcF; Function=Putative translation initiation inhibitor; Function class=J Translation, ribosomal structure and biogenesis
  Homolog annotation: Query=1..127bp; Hit=14..140bp; Blast score=205; Percent Identity=83.0; E value=9e-54; Homolog= yjgF COG0251
MSRSIHTENAPAAIGPYVQGVDLGSMVITSGQIPVDPKTGDIPEDITAQTRQSLENVKAIIEQSGLKVADIVKTTVFVKDLNDFTTVNAAYETFFTEHNAPFPARSCVEVARLPKDVKIEIEAIAVRS

SEQ ID NO: 9949 - protein, 143 aa, Xenorhabdus bovienii
  Peptide sequence Name=Xb4151_4152.C443.gene152.pep
  Gene classification: Function=Uncharacterized BCR; Function class=S Function unknown
  Homolog annotation: Query=5..143bp; Hit=2..140bp; Blast score=152; Percent Identity=53.0; E value=1e-37; Homolog= yhbP COG3787
MELNENFLTIRRYLAKQHVFTLCTSSSQDLWCASCFYAFDADSMAFWFMTEPDTRHGQMMQQNPVVAGTVAGQTRNIAQIKGIQFRGEITPLTGEAETLARARYCRRFPVALAAKSPIWRLSLSEIKMVDNTLGFGKKLHWQR

SEQ ID NO: 9950 - protein, 83 aa, Xenorhabdus bovienii
  Peptide sequence Name=Xb4151_4152.C443.gene153.pep
  Homolog annotation: Query=1..82bp; Hit=1..82bp; Blast score=92; Percent Identity=78.0; E value=2e-18; Homolog= Pa|Phot3-239h02.q1k _g17| 15916 - 16167 263 83 aa, chain -
MKSVKYIVCILALSAISFGSMAATEVQYAKGEKVGVVSVTGAETLDSLTAELSKKADKAGASYFRVISANGQNKLSGVAEIYK

SEQ ID NO: 9951 - protein, 133 aa, Xenorhabdus bovienii
  Peptide sequence Name=Xb4151_4152.C443.gene154.pep
  Gene classification: Function=Predicted endonuclease containing a URI domain; Function class=L DNA replication, recombination and repair
  Homolog annotation: Query=23..119bp; Hit=2..97bp; Blast score=112; Percent Identity=58.0; E value=1e-25; Homolog= yhbQ COG2827
MNEFHRIIKACKLFKINNDMKSTHWYLYLIRTRNNSLYTGITTDIARRFMQHVSGKGAKALKGKGPLTLVYHSLVEDQGMALKLEYRVKKLSKKQKERLITLQPVCIATYLSEMLVPKIAQSVITHDQNGRNT

SEQ ID NO: 9952 - protein, 167 aa, Xenorhabdus bovienii
  Peptide sequence Name=Xb4151_4152.C443.gene155.pep
  Gene classification: Function=Predicted acetyltransferase; Function class=R General function prediction only
  Homolog annotation: Query=1..165bp; Hit=1..165bp; Blast score=217; Percent Identity=66.0; E value=4e-57; Homolog= yhbS COG3153
MLIRVEIPVDAMGIDRLLRQSFETSAEAELVYRLREDGLLTLGIVATDDEGYVIGYVGFTSVDVNGQDHQWVGLAPLAVAEPYRRQGIGEKLVYEGLDSLNEFGYGAVVVLGEPAYYRRFGFRLAKEYQLHCQWPECEDHFQIYTLADVSLEDCHGLITYSDHFDHE

SEQ ID NO: 9953 - protein, 126 aa, Xenorhabdus bovienii
  Peptide sequence Name=Xb4151_4152.C443.gene156.pep
  Gene classification: Function=Putative lipid carrier protein; Function class=I Lipid metabolism
  Homolog annotation: Query=1..113bp; Hit=1..160bp; Blast score=110; Percent Identity=42.0; E value=3e-25; Homolog= yhbT COG3154
VLGKIHSHLVSQEPTLLRLSLKVTPFALPHQVLEQLLGWQFHGVLAEGELAFLESRREDPDTLFFQHRLRIEGNTELGLHVKNLVDAIRLGSMPSILRLGLLCLAEFIKAGQKEGVDQHDRALSSC

SEQ ID NO: 9954 - protein, 390 aa, Xenorhabdus bovienii
  Peptide sequence Name=Xb4151_4152.C443.gene157.pep
  Homolog annotation: Query=51..388bp; Hit=1..338bp; Blast score=293; Percent Identity=48.0; E value=3e-78; Homolog= gi|28629103|gb|AAO49467.1|AF487831_1 Qsc4 [Serratia proteamaculans]
MIPILISALTSGVSMAVFFTAISWFVEGSFHSTTLVSVVLSSGYILTFFILPKIGFFIDSNSAKKALNNIYILGLLNSVVFLFLTNINLNEIVLIATVIILTSIFTFIRSSDQVIRATYIKRVVSSEELYNANKNLELIRQGITFLSGGVAFFILEDKSISNVCIVSIFCFSISIFINVCVKKDNTDKFDRVIENNSRIKNTYKIGYDFFNGEVKRHVVLLSIFPYICVVSLNSIYPALFNVINSQIQYYALLVVPYGVGAIMGSLIGSKRSYLSLKNNYIIFGTISIIGLFLPVFFNHLYSVYLCLFLIALSHSRIRVIRNTIIMNEAGNQILGRLLSFNEMIFITLSVGLSVLLGVLSDFLGFWVAWFMVIFLNVTVLFFILLSKDKK

SEQ ID NO: 9955 - protein, 329 aa, Xenorhabdus bovienii
  Peptide sequence Name=Xb4151_4152.C443.gene158.pep
MASKNYLETPKFIHNLWTQNEDDEYYLRFTKGLYEVDKNDARDFMTIRGYCTGNNTITDIHEKTGMPKDRIVDIISSLHEIGMLRNEEIVSEENFFDKIIIACEMWAEQIEETHLFNKFLYGDVSYNVLLGFMLENYHYIKLFPETISSAIKNTTNESVKNILEEYRLQEAGHEIFMLRCLLKMGMRKEEVETSIPLVSTSNLINMMKYLFGKYPESVFLVAKVIESHDYDENEVKIAIDNINKTYNLKQGTLEPFFEHSKIDYELGHSQLLEKAKSLINFNDVDKVSYVLNAIHDIKHAIDLQCLEIEEYYTKQGNYIPRQRVDYFGV

SEQ ID NO: 9956 - protein, 62 aa, Xenorhabdus bovienii
  Peptide sequence Name=Xb4151_4152.C443.gene159.pep
MRNCVIFHFVSGIFSNEIYKIKSLFVFIIYLNDFTNSDYYIFNSDAVFNISITFVCDLYLKF

SEQ ID NO: 9957 - protein, 391 aa, Xenorhabdus bovienii
  Peptide sequence Name=Xb4151_4152.C443.gene160.pep
  Gene classification: Gene name=AraJ; Function=Arabinose efflux permease; Function class=G Carbohydrate transport and metabolism
  Homolog annotation: Query=5..390bp; Hit=12..394bp; Blast score=211; Percent Identity=37.0; E value=9e-55; Homolog= BS_ytbD COG2814
MPFVIYVFSLCAFAIGFTEFITIGLISVMSANLDADVTSIGLTVTAYALGVVIGAPILTALASNWSRKRLLLTAMLVFTIGNLIAAASANLALLLAARLLSGLAHGVFFAVASGVATRLVPSERAGTALALVFGGVTIAMSLGVPAGTWLGSILDWRVIFLIISACGLLGTLGIGFKMPKDAGEQIVKTSASWRHLTILFDRRLLAGASVPMLSYTASFALYTFITPILLSITGVSVETASGVLLAYGIGAAVGTVWGGRLTDRQGMDLASLILLVGIAVVLAAMSFSLTHSLLMIGLTALLGLATYGAIPPLQSRILMLAKRHTPYAMDIASGMNIAAFNAGVVLGSVIGGATVREWGLETLTWIGAVTGVLAIVSLVWQMVIPSMREQR

SEQ ID NO: 9958 - protein, 45 aa, Xenorhabdus bovienii
  Peptide sequence Name=Xb4151_4152.C443.gene161.pep
MNSVNPIANAQSENTYITNGIKNSPYTLKTRQPEFKVSHQYQASI

SEQ ID NO: 9959 - protein, 302 aa, Xenorhabdus bovienii
  Peptide sequence Name=Xb4151_4152.C443.gene162.pep
  Gene classification: Gene name=LysR; Function=Transcriptional regulator; Function class=K Transcription
  Homolog annotation: Query=7..273bp; Hit=5..272bp; Blast score=198; Percent Identity=38.0; E value=7e-51; Homolog= PA3565 COG0583
VVLRNLEDLSVFIRIIDTGSFTATAQALGLSPTTVSKQIARLEKNLGVVLFVRSTRSLRITPEGKAIAEKVRAALTLVEEATEIAKDGSESLTGLIRLTAPVPLGRTYVAAAIAEFRKKYPSVGFILHLTDKIVDLYKVEMDLAIRVANLTDSGLIARRLTDNKRILVASPDYLRLHGELQHPEELINHHCLLFSASGNKSTIWSLHDRKGTKAISLSSDLIANNGDVLRTWCTAGLGIALRETWDVVDLIRAKKLIQILPEWQEETSPINLVRAGKRPVPQRIKSFIEFLTEEWRIPPWEK

SEQ ID NO: 9960 - protein, 261 aa, Xenorhabdus bovienii
  Peptide sequence Name=Xb4151_4152.C443.gene163.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=1..260bp; Hit=1..263bp; Blast score=254; Percent Identity=53.0; E value=7e-68; Homolog= PA1344 COG1028
MNINLKGKIALVTGSTAGIGLAIAQGMHKAGASVILNGRSEERLIQAVNKFNCLDRVFTVAADVGTKEGCELINKNFPDIDILVNNAGIFSPKPIFEISDDEWINYFNINVLSGIRLARSYIPLMIGKRWGRVVFISSESALQIPVEMPHYGLTKTAQVAAARGFAQAATGTGVTVNSVLPGPTESEGVERFVRELITDPTLSMEEAGKRFIETARPASLLGRLATAEEVANAVLFLASPLASAITGTALRVDGGVIQSIL

SEQ ID NO: 9961 - protein, 262 aa, Xenorhabdus bovienii
  Peptide sequence Name=Xb4151_4152.C443.gene164.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=5..258bp; Hit=3..244bp; Blast score=145; Percent Identity=35.0; E value=6e-35; Homolog= TM1724 COG1028
MERSLAGKAVIITGAGSGIGLAATTEFLNAGAYVIGADINLEKLYELQRGEYLFPYQFNVRDPSDIDGLINTAISQFGKIDILINNAALVEPRKSFLDVTDDDWNSTIETNLLGYIRMARGVLPYMCNQKKGILLHIASEAALMPNLILPDYSILKSSVLTLSKVISREFGKYGIRSNVISPAFIHTSIYDKPEGLITQLEQKYKVGREEALQRYIEEVDIAVGRLGQPEEVAVLLLFLASESAAFITGANYLVDGGVTPFI

SEQ ID NO: 9962 - protein, 77 aa, Xenorhabdus bovienii
  Peptide sequence Name=Xb4151_4152.C443.gene165.pep
MRKDEHFDPILISTGQHDEMLYFTLSVAAADFNQDGKFDFATIAYSVPNYFVAKQARIVVHINQIKRDVAVGDTDGA

SEQ ID NO: 9963 - protein, 43 aa, Xenorhabdus bovienii
  Peptide sequence Name=Xb4151_4152.C443.gene166.pep
MVTFLRFEVSYKLFFKKIDHLKGTSSSFTGYSVIQNHSTDRKL

SEQ ID NO: 9964 - protein, 197 aa, Xenorhabdus bovienii
  Peptide sequence Name=Xb4151_4152.C443.gene167.pep
  Gene classification: Gene name=XerC; Function=Integrase; Function class=L DNA replication, recombination and repair
  Homolog annotation: Query=2..183bp; Hit=10..190bp; Blast score=185; Percent Identity=51.0; E value=2e-47; Homolog= fimB COG0582
MRKYITQDEWNRVFSVLNNGTNKERDQCLLYLTYIHGLRVSELTSLKVSDIDIAGKTIYIKRLKNGFSTTHPISKTEKELILKWLKIRNNNSVYCASLWLFPSRKGGKLSRQWVHVLMGRYGEQAGLSIRLHPHKLRHSCGFELANQGLDTRLIQDYLGHRNIRHTMHYTASNPERFQKAWQQNQQLKIDSGKYPAP

SEQ ID NO: 9965 - protein, 72 aa, Xenorhabdus bovienii
  Peptide sequence Name=Xb4151_4152.C443.gene168.pep
LFSFTNGRQPNFVYELFYLTHRLKLFFISHDQTTSIALFLRLKNRHKIILLIYYVSLTTLFIAFYNYLLCFL

SEQ ID NO: 9966 - protein, 995 aa, Xenorhabdus bovienii
  Peptide sequence Name=Xb4151_4152.C443.gene169.pep
  Homolog annotation: Query=17..559bp; Hit=35..583bp; Blast score=456; Percent Identity=43.0; E value=1e-126; Homolog= gi|16124072|ref|NP _407385.1| putative invasin [Yersinia pestis] gi|22127755|ref|NP _671178.1| hypothetical [Yersinia pestis
MHRKFDKSWPQNQYPLLKRMAWANIIIQLAFPVAGTFTPIIAAAKTHTTSHDQQLTALPIKPYILKSGETIDLIAKRYSLTVDDLKKINQLRTFSKPFSTLGIGDEIDVPRPRLNKFLPCNYSPLDESDSKDETNSRLSNAAIRVGDVLKSNDISNSAKIQLNGLAVSEVNQQIQNWLGHYGTARVQINISDRGRLDGSQLDMLLPLYDTKNQLTFTQFGLRRLDKRNTINLGVGQRRFFDGGMLGYNAFFDYDFTGENTRIGLGAEYARDYLKLGANGYFRLSNWKESPLLTDYDERPANGFDLRIQGYVPALPQLGGKLMYEHYFGDEVGLLNQNHRQKDPSAFTVGINYTPIPLLTFGIDRKQNTSGGGETLFNIELNYEIGTPWEKQIDPDATDFKRTLQGSRYDLVDRNNQIVLEYRKREVIHLTMDRLITGHAGDIKPLHLTVVSKYGLKNIQWEAVNLFADGGEIERQGGSHYLLTLPEYHHQGNNTYILSAVAYDEHGNASQRVETQVQVLPAAVRDNKSTFTAKDNELLADDRATTMLKLTLEDKEGKPIRDVADDIKWVTNQLGGEGSDPTIGKIKETQPGVYEAILTAGKKIGILKITPEVDGVHIKPLKITFVHPDAPFVKNLTIVGKLEIGQKLSATYTFNPNGGEKVDKSRYVWGDKGNIDITNSHTIVESGKLPNYTLELSDAGRVKAVAVQAQNGLGLIGNTMIVNTSMSQESGNRTHGGSEGGKVRGIADDIAATVNTDNTKKSNTITLTVQTFNHGQPVRNVAVEVQATQAINRQNKPQTITVLIGGKPALYQGVTDEQGVLSIPITDPNGNGVKTSFKITAYGSAKPKTQELIFTVPTSPDTPLANFWGHMSESVMGANGAVFMRPQLQVELKGKMKGLATFFESGEIWPRRVYKGAEWYCGKIHANLPTQEDLQSLYRAYSANEMHDLHGWPQHRSYRSSTPAEGNKVHIAVNIDNGFAHPIEDNIVSDYVICRQ

SEQ ID NO: 9967 - protein, 565 aa, Xenorhabdus bovienii
  Peptide sequence Name=Xb4151_4152.C443.gene170.pep
  Gene classification: Function=Putative regulator of cell autolysis; Function class=T Signal transduction mechanisms
  Homolog annotation: Query=1..560bp; Hit=1..560bp; Blast score=799; Percent Identity=73.0; E value=0; Homolog= yehU COG3275
MHEFNLVLLLLQQMCVYLVIAWLLSKTPLFIPLLQVSVRLPHKLMCYVIFSIFCIMGTYFGLSVNDSIANTRAIGAVLGGFLGGPAVGAMVGFTGGLHRYSLGGMTAFSCMVSTIVEGILGGLVHSYLMKRGQINKLLNPWTAAIVTFLAECIQMSIILLLANPFSDALKLVKNIAAPMIIANSIGAAMFIRILLDRRAIFEKYTSAFSAQALKIAVCTEGILRKGFNEDNSMRVAKVIYQELEIGAVAITDRDKLLAFIGIGSDHHLSGTPIVSEQSHRAIENNEVVYADGNETPYRCSLSPICKLGSALVIPLRGENQQVIGTIKLYEAKNCLFSSINRTLGEGIASLLSAQILAGQYERNKQSLLQSEVKLLHAQVNPHFLFNALNTLQAVIRRDSQQAGQLVQYLSTFFRKNLKRPEEIATLENEIEHVNAYLQIEKARFRERLQIAIAIPESLRCAKLPAFSLQPMVENAIKHGTSQLLDTGRVTIRAHQKANLLLVEIEDNAGLYCLKKIGDGLGMSLVDKRLRLRYGERYGMRVDCQPEKFTRVILCLPLEKETDKAV

SEQ ID NO: 9968 - protein, 239 aa, Xenorhabdus bovienii
  Peptide sequence Name=Xb4151_4152.C443.gene171.pep
  Gene classification: Gene name=LytT; Function=Response regulator of the LytR/AlgR family; Function class=K Transcription
  Homolog annotation: Query=1..238bp; Hit=7..244bp; Blast score=335; Percent Identity=69.0; E value=3e-92; Homolog= yehT COG3279
MNVLIVDDEPLARENLRYLLEEETDIQIIGECANAVEAIGAIHRLKPDVVFLDIQMPRITGLEMVGLLDPEHRPYIVFLTAFDEYAVQAFEEHAFDYLLKPPEKERLSKTLQRLRSGYQKQNLADLQQEDEPLKYIPCTGHNRIWLMQLDEVLYVTSRLSGVYVMSANKQEGFTELTLRTLETRTSLTRCHRQYLVNMTHLREIIFGENGQAELVLRNNEHIPVSRRYLKPLKEVLGLN

SEQ ID NO: 9969 - protein, 662 aa, Xenorhabdus bovienii
  Peptide sequence Name=Xb4151_4152.C443.gene172.pep
  Gene classification: Gene name=SrmB; Function=3 Superfamily II DNA and RNA helicases; Function class=L DNA replication, recombination and repair
  Homolog annotation: Query=4..577bp; Hit=20..582bp; Blast score=882; Percent Identity=84.0; E value=0; Homolog= deaD COG0513
MTTETEISFADLGLSAPILAALGDMGYEKPSPIQQQCIPHLLNGRDVLGMAQTGSGKTAAFSLPLLHNIDAELKAPQILVLAPTRELAVQVAEACSEFSKQMRSVNVVALYGGQRYDVQLRALRQGPQVVVGTPGRLLDHLKRGTLDLSNLKGLVLDEADEMLRMGFIEDVENIMSQIPAEHQTALFSATMPEAIRRITRRFMNDPQEVRIQSSVTTRPDISQSYWSVHGVRKNEALVRFLETEDFDATIIFVRTKNATLEVAETLERHGYNSAALNGDMNQALREQTLERLKDGRLDILIATDVAARGLDVERISLVVNYDIPMDAESYVHRIGRTGRAGRAGRALLFVENRERRLLRNVERTMKLTIPEVELPNAELLSQRRLEKFAAKVQQQLESSDLDQYRALLSKLSTNDELDMETLAASLLKMAQGERPLILPPDPVRRPRREFNDRDDRRRDGFSSRERNDRGDRNDRGDRADRGDKGDRPRRERRDVGDMELYRIEIGRDDGVEVRHIVGAIANEGDISSRYIGNIKLFATHSTIELPKGMPGDLLSHFTRTRILNKPLNMQLMGDAQPFERRERRGGGSGRTGNGSNASNGGNGSTGGNGSNGGNAPRRDREGFGNGGRRFSTERRGDRVNSRGRSGDESNSAPRRRQNSGNA

SEQ ID NO: 9970 - protein, 294 aa, Xenorhabdus bovienii
  Peptide sequence Name=Xb4151_4152.C443.gene173.pep
  Gene classification: Gene name=NrfG; Function=TPR-repeat-containing proteins; Function class=R General function prediction only
  Homolog annotation: Query=1..294bp; Hit=1..294bp; Blast score=461; Percent Identity=78.0; E value=1e-130; Homolog= nlpI COG0457
MNSFLRWCYVAVIFLLVGCGSTGWRKNEMIAIPLQPTLQQEVILARMEQILASRSLTEDEYAQLLYERGVLYDSLGLRALAQNDFSVALSIRPDIPEIFNYLGIYFTQAGNFDAAYEAFDSVLELDPTYNYARMNRGITLYYGGRYRLAQDDLQAFYQDDPNDPFRSLWLYLVEDKIDPKVAMTNLSRHFDKANRGLWGWNIVEFYLGKISEKTLMDRLKENSSDNTSLAEHLSETDFYLGKHYLSLGDEDNAVALFKLTVANNVHNFVEHRYALLELALLGQRQDDLSESNQQ

SEQ ID NO: 9971 - protein, 716 aa, Xenorhabdus bovienii
  Peptide sequence Name=Xb4151_4152.C443.gene174.pep
  Gene classification: Gene name=Pnp; Function=Polyribonucleotide nucleotidyltransferase (polynucleotide phosphorylase); Function class=J Translation, ribosomal structure and biogenesis
  Homolog annotation: Query=3..698bp; Hit=24..715bp; Blast score=1155; Percent Identity=86.0; E value=0; Homolog= Zpnp COG1185
MILLNPIVRKFQYGQHTVTIETGMMARQATAAVMVNMDDTAVFVTVVGQKKMKAGQDFFPLTVNYQERTYAAGRIPGSFFRREGRPGEGETLVARLIDRPLRPLFPEGFLNEVQIIATVVSVNPLVNPDIVAMIGASAALALSGIPFNGPIGAARVGYINDQYVLNPTSDELKNSRLDLVVAGTAGAVLMVESEAELLTEEQMLGAVVFGHEQQQIVIDHINALVAETGKEKWDWAPESINQPLHDRVAELAESRLGDAYRITEKQERYAQVNTIKEEVSAIIVAEAVEKGVELEKSEVLDVLSVLEKNVVRGRVLRGEPRIDGREKDMVRALDVRTGVLPRTHGSSLFTRGETQALVAATLGTERDAQVIDELMGERADRFLFHYNFPPYSVGETGMVGSPKRREIGHGRLAKRGVLAVMPTANEFPYTIRVVSEITESNGSSSMASVCGASLALMDAGVPIKAAVAGIAMGLVKEGDNFVVLSDILGDEDHLGDMDFKVAGSRDGISALQMDIKIEGITSEIMQVALNQAKGARLHILGVMEQAIQSPRNDISEFAPRIHTIKINPDKIKDVIGKGGSVIRALTEETGTTIEIEDDGTVKIAATDSDKAHHAIRRIEEITAEVEVGRIYNGKVTRIVDFGAFVAIGGGKEGLVHISQIADKRVEKVTDYLQLAQEVPVKVLEIDRQGRIRLSMKEAVTNITTDEALQSPESSVE

SEQ ID NO: 9972 - protein, 52 aa, Xenorhabdus bovienii
  Peptide sequence Name=Xb4151_4152.C443.gene175.pep
MLTILEFTNNRIQQNHIPWLVLPTLNISNNRHSLFATPSRLMTTLNSLKHSH

SEQ ID NO: 9973 - protein, 89 aa, Xenorhabdus bovienii
  Peptide sequence Name=Xb4151_4152.C443.gene176.pep
  Gene classification: Gene name=RpsO; Function=Ribosomal protein S15P/S13E; Function class=J Translation, ribosomal structure and biogenesis
  Homolog annotation: Query=1..89bp; Hit=1..89bp; Blast score=127; Percent Identity=86.0; E value=1e-30; Homolog= rpsO COG0184
MSLSTEAKAQIVAEFGRGTNDSGSSEVQVALLTAQINHLQGHFSEHKKDHHSRRGLLRMVAQRRKLLNYLKRKDLARYTALIERLGLRR

SEQ ID NO: 9974 - protein, 315 aa, Xenorhabdus bovienii
  Peptide sequence Name=Xb4151_4152.C443.gene177.pep
  Gene classification: Gene name=TruB; Function=Pseudouridine synthase; Function class=J Translation, ribosomal structure and biogenesis
  Homolog annotation: Query=4..311bp; Hit=5..311bp; Blast score=441; Percent Identity=72.0; E value=1e-124; Homolog= truB COG0130
MGRRRRGRAIHGVLLLDKPQDISSNDALQKVRRIFDASKAGHTGALDPLATGMLPICLGEATKFSQFLLDSDKRYRVIARLGQRTDTSDSHGKVICEREVQITQPQLAAALDTFRGDTMQVPSMYSALKHQGKPLYEYARQGIAIEREARPITVYELQFIRWEGDELELEIHCSKGTYIRTIIDDLGELLGCGAHVIYLHRLQVANYPTHRMVTLEQLHELKKQAEEQEVDAGELLDPLLLPMDTAVAHFPVIQLASVVAAYLKQGQPVRSKHSLTSGEWVRVTEGDENKFIGIAVIDDGGLVAPRRLVVEIEQL

SEQ ID NO: 9975 - protein, 136 aa, Xenorhabdus bovienii
  Peptide sequence Name=Xb4151_4152.C443.gene178.pep
  Gene classification: Gene name=RbfA; Function=Ribosome-binding factor A; Function class=J Translation, ribosomal structure and biogenesis
  Homolog annotation: Query=1..135bp; Hit=1..132bp; Blast score=178; Percent Identity=75.0; E value=2e-45; Homolog= rbfA COG0858
MAREFSRTQRVAQEMQKEIAIILQREVKDPRIGMATVSGVEVSRDLAYAKVFVTFLNVLVEGQDSDMVNVGIKALNEASGFIRSLLGKAMRLRVIPELTFSYDSSLVDGMRMSNLVTKVVKNDEQRRVSTDHNEEK

SEQ ID NO: 9976 - protein, 924 aa, Xenorhabdus bovienii
  Peptide sequence Name=Xb4151_4152.C443.gene179.pep
  Gene classification: Gene name=InfB; Function=Translation initiation factor 2 (GTPase); Function class=J Translation, ribosomal structure and biogenesis
  Homolog annotation: Query=1..923bp; Hit=1..889bp; Blast score=1152; Percent Identity=77.0; E value=0; Homolog= infB COG0532
MTEVTVKLLAEEIQTSVERLIQQFADAGIQKTATDSVSQREKESLLAHLNREQGGSGGQPGKLTLQRKTRSTLNVPGTGGKSKSVAIEVRKKRTYVNRDAIEQSPTEEQAKREAEEQARREVEEKARLETEAKKFAEEQAKRDAEEQAKREAAKSAQREAEEKAKREGVDMTQREAAEKEKVTKQHTENKPKSVQTEPAVQSEKARREAEAANLKRKAEEEVRRKVEAEAKRVAEEARRMAEENKDKWSETAEPSENTDDYHVTTSQHARAAEDENDAKVEGDRRTRSRGGKATRQKKNNKHSESKADREEARAVGRNKGKQRKPSTLQQSFTKPVAAVNRDVVIGETITVAELANKMAVKGSQVIKTMMKMGAMATINQVIDQETAQLVAEEMGHKVILRRENELEEALMSDRDTGETLAESRAPVVTIMGHVDHGKTSLLDYIRSTKVASGEAGGITQHIGAYHVQTEKGMITFLDTPGHAAFTSMRARGAKATDIVVLVVAADDGVMPQTVEAIQHAKAANVPVVVAVNKIDKPDADPDRVKNELTQYGIIPEEWGGENQFMSVSAKAGLGIDELLECILLQAELLELNAVRTGMANGVVIESFLDKGRGPVATILVQSGTLNKGDIVLCGFEYGRIRAMRDELGLEVTSAGPSIPVEILGLSSVPSAGDEATVVRDEKKAREVALYRQGKFREVKLARQQKSKLENMFANMEEGKVSELNIVLKTDVQGTCEAICDSLLKLSTDEVKVKIIGSGVGGITETDATLAAASNAIILGFNVRADASARRIIESESVDLRYYSVIYSLIDEIKQAMSGMLAPEYKQQIMGLAEVRDVFKSPKFGAIAGCMVTEGSIKRNNPIRVLRDNVVIYEGELESLRRFKDDVNEVRNGMECGIGVKNYNDVRVGDMIEVFEIIEIKRSIV

SEQ ID NO: 9977 - protein, 502 aa, Xenorhabdus bovienii
  Peptide sequence Name=Xb4151_4152.C443.gene180.pep
  Gene classification: Gene name=NusA; Function=Transcription elongation factor; Function class=K Transcription
  Homolog annotation: Query=1..502bp; Hit=1..495bp; Blast score=777; Percent Identity=85.0; E value=0; Homolog= nusA COG0195
MNKEILAVVEAVSNEKSLPREKIFEALEIALATATKKKYEQEIDVRVCIDRKSGDFDTFRRWVAVEEVTLPTREITLEAAKYEDPEMELGGYIEDQIESVTFDRITTQTAKQVIVQKVREAERAMVVDQFREQQGEIVTAQVKKVNRENITLDLGNNAEAVILREDMLPRENFRPGDRVRGVLYDVRPEARGAQLFITRSRPEMLVELFRIEVPEIGEEIIEIKAAARDPGSRAKIAVKTNDKRIDPVGACVGMRGARVQAVSSELGGERIDIVLWDDNPAQFVINAMAPADVASIVVDEDNCTMDVAVESSNLAQAIGRNGQNVRLAAQLLKKHRGDDKWELNVMTAEELQAKHQAEAHASIDTFTKHLDIDVDFATVLVEEGFSTLEELAYVPINELLAIEGLDEETVEVLRERAKAALTTLELAQKESLGDQQPAEDLLNLSGMDRTLAFNLAAHGICTLEDLAEQGIDDLSDIEGLSDEKAGELIMAARNICWFGDDA

SEQ ID NO: 9978 - protein, 140 aa, Xenorhabdus bovienii
  Peptide sequence Name=Xb4151_4152.C443.gene181.pep
  Gene classification: Function=Uncharacterized BCR; Function class=S Function unknown
  Homolog annotation: Query=1..140bp; Hit=13..152bp; Blast score=243; Percent Identity=85.0; E value=5e-65; Homolog= yhbC COG0779
MISAPVEALGFELVGLEFIRARVSTLRVYIDSEEGITVDNCADVSHQVSAVLDVEDPISVLYNLEISSPGLERPLFKAEHYQRFMGEEVSLVLRMAMQNRRRWQGIIKVVDGEMITVTVDGKDEVFALSNIQKANLVPHF

SEQ ID NO: 9979 - protein, 45 aa, Xenorhabdus bovienii
  Peptide sequence Name=Xb4151_4152.C443.gene182.pep
MLLHPAFENVANLTLIILKTQVSRLWCRGRDLNPYARCLGTTTSR

SEQ ID NO: 9980 - protein, 112 aa, Xenorhabdus bovienii
  Peptide sequence Name=Xb4151_4152.C443.gene183.pep
  Gene classification: Gene name=SecG; Function=Preprotein translocase subunit; Function class=N Cell motility and secretion
  Homolog annotation: Query=1..111bp; Hit=1..109bp; Blast score=141; Percent Identity=70.0; E value=1e-34; Homolog= secG COG1314
MYEALLGVFLLAGLGVIALVLLQQGKGADMGASFGAGASATLFGSSGSSNFMTRMTAIFATLFFVISLILGNMSSNRTGSDSKWENLAEPVKVEKQAEVPASPAKPNSDIPQ

SEQ ID NO: 9981 - protein, 36 aa, Xenorhabdus bovienii
  Peptide sequence Name=Xb4151_4152.C443.gene184.pep
MSYLFPRGDLPQFCSNVILHHPLIIRKINLLSGCEY

SEQ ID NO: 9982 - protein, 445 aa, Xenorhabdus bovienii
  Peptide sequence Name=Xb4151_4152.C443.gene185.pep
  Gene classification: Gene name=CpsG; Function=Phosphomannomutase; Function class=G Carbohydrate transport and metabolism
  Homolog annotation: Query=1..442bp; Hit=1..443bp; Blast score=728; Percent Identity=85.0; E value=0; Homolog= mrsA COG1109
MSSRKYFGTDGIRGKVGDSPITPDFVLKLGWAAGKVLARHGSRKIIIGKDTRISGYMLESALEAGLAAAGLSASFTGPMPTPAVAYLTRTFRAEAGIVISASHNPYYDNGIKFFSIDGTKLPDNVEEAIEAEMEKPLTCVESAELGRANRIVDAAGRYIEFCKGTFPSEQSLNGLKVVLDCANGATYHIAPNVLRELGANVVTIGCEPNGININEECGATDVRLLQKRVQEEQADVGLAFDGDGDRIIMVDHLGQKVDGDQILYIIAREALRQGQLRGGAVGTLMSNIGLELALKQLGIPFERAKVGDRYVLEKLQEKGWRLGAENSGHVILLDKTTTGDGIVAGLQILSAMVRNNMSLHDLCSGMKLLPQILVNVRFAGDNDPLQSESVLEAVKSVEAELNGRGRVLLRKSGTEPLIRVMVEGEDEELVTALAHRIADAVKKTG

SEQ ID NO: 9983 - protein, 285 aa, Xenorhabdus bovienii
  Peptide sequence Name=Xb4151_4152.C443.gene186.pep
  Gene classification: Gene name=FolP; Function=Dihydropteroate synthase and related enzymes; Function class=H Coenzyme metabolism
  Homolog annotation: Query=1..276bp; Hit=16..291bp; Blast score=391; Percent Identity=70.0; E value=1e-109; Homolog= folP COG0294
MKLTARGSVLDLSRPQVMGILNVTPDSFSDGGNHSTFDAALRHAATMIEEGAAIIDVGGESTRPGAVDVSEQEELDRVVPVVEALARRFDAWISIDTSKAIVMQESAKVGAHMINDIRSLQEFGALDAAVKTGLPVCLMHMQGQPSTMQAEPYYEDAVWETKTFLTRQIDRCVAAGIAKNKLILDPGFGFGKNLSHNYQLLAHLEEFHHLGLPILAGMSRKSMIGQLLHVPPQECVTGSIACAVIAAMQGAQIIRVHDVKETVQTMQIVQATLSAKNILAVKNTL

SEQ ID NO: 9984 - protein, 635 aa, Xenorhabdus bovienii
  Peptide sequence Name=Xb4151_4152.C443.gene187.pep
  Gene classification: Gene name=HflB; Function=ATP-dependent Zn proteases; Function class=O Posttranslational modification, protein turnover, chaperones
  Homolog annotation: Query=1..633bp; Hit=1..633bp; Blast score=1082; Percent Identity=85.0; E value=0; Homolog= hflB COG0465
MAKNLILWLVIAVVLMVLFQSFGPGDSSGRRVDYSNFISELSQNQVREVRISGRDIDYSKKDDGKKYSTYMPIQDEKLLDTLLNKQVKVIGEPPEQQGLLATLFISWFPMLLLIGVWIFFMRQMQGGGGKGAMSFGKSKARMLTEDQIKTTFADVAGCDEAKEEVGELVEYLREPGRFQKLGGKIPKGILMVGPPGTGKTLLAKAIAGEAKVPFFTISGSDFVEMFVGVGASRVRDMFEQAKKSAPCIIFIDEIDAVGRQRGAGLGGGHDEREQTLNQMLVEMDGFEGNEGIIVIAATNRPDVLDPALLRPGRFDRQVVVGLPDVRGREQILKVHMRRIPLDTDVDASIIARGTPGFSGADLANLANEAALFAARGNKRVVSMVEFEKAKDKIMMGAERRSMVMTEEQKESTAYHEAGHAIIGRLVPEHDPVHKVTIIPRGRALGVTFFLPEGDQISASRQKLESQLSTLYGGRLAEEIIYGVDSVSTGASNDIKVATSIARNMVTQWGFSEKLGPLLYAEEEGEIFLGRSVAKAKHMSEDTARLIDQEVKAIVDRNYQRARKILMDNLDILHSMKDALMKYETIDVSQIDDLMNRTTVRSPAGWEGDNNNGGNNRHNMSSPQQTVKPADGNPTA

SEQ ID NO: 9985 - protein, 209 aa, Xenorhabdus bovienii
  Peptide sequence Name=Xb4151_4152.C443.gene188.pep
  Gene classification: Gene name=FtsJ; Function=Methyltransferase involved in cell division; Function class=J Translation, ribosomal structure and biogenesis
  Homolog annotation: Query=1..208bp; Hit=1..208bp; Blast score=378; Percent Identity=90.0; E value=1e-105; Homolog= ftsJ COG0293
MANKKRSASSSRWLQEHFSDKYVLQAQKKGLRSRAWFKLDGIQQSDKIFKPGMTVVDLGASPGGWSQYVVNQIGDRGRVIACDLLPMDPIVGVDFLQGDFRDELVLKALLERVGDNKVQVVMSDMAPNMSGTPAVDIPRSMYLIELALGMCRDVLAPGGSFIVKVFQGEGFDEYLREIRSLFTKVKIRKPEASRARSREVYIVATGRKL

SEQ ID NO: 9986 - protein, 97 aa, Xenorhabdus bovienii
  Peptide sequence Name=Xb4151_4152.C443.gene189.pep
  Gene classification: Function=Predicted RNA-binding protein containing KH domain, possibly ribosomal protein; Function class=J Translation, ribosomal structure and biogenesis
  Homolog annotation: Query=1..97bp; Hit=1..97bp; Blast score=133; Percent Identity=77.0; E value=4e-32; Homolog= yhbY COG1534
MTLNKKQVQYLKSLAHSLKPVVMIGNNGLTEGVLAEIEQTLSHHELIKVKVAGEDREIKTLIAEAIVRETGAYNVQIIGKMLVLYRPSKERRISLPK

SEQ ID NO: 9987 - protein, 158 aa, Xenorhabdus bovienii
  Peptide sequence Name=Xb4151_4152.C443.gene190.pep
  Gene classification: Gene name=GreA; Function=Transcription elongation factor; Function class=K Transcription
  Homolog annotation: Query=6..158bp; Hit=1..153bp; Blast score=239; Percent Identity=83.0; E value=6e-64; Homolog= greA COG0782
MKQIPMTVRGADKLREELENLKNVRRPKIITAIADARAHGDLKENAEYHAAREQQGFCEGRIQEIEAKLSNAQVIDITKMINNGRVIFGATVTVLNMGSDEEQTYRIVGDDEANIKENLISVNSPIARGLIGKEVDDVAVISTPGGKVEYEVLNVEYL

SEQ ID NO: 9988 - protein, 512 aa, Xenorhabdus bovienii
  Peptide sequence Name=Xb4151_4152.C443.gene191.pep
  Gene classification: Gene name=DacB; Function=D-alanyl-D-alanine carboxypeptidase (penicillin-binding protein 4); Function class=M Cell envelope biogenesis, outer membrane
  Homolog annotation: Query=51..512bp; Hit=16..477bp; Blast score=676; Percent Identity=67.0; E value=0; Homolog= dacB COG2027
MDHRLLFPEFHLSIIDVNIFRILSPSYARSMALLKITSRIACMLSFSLSIFSANASSIEEDAQYLPAGTDFSFIAQKIGSKTPLLDYNGQQLALPASTQKIVTALAALLQLGKDYRFITTLESNADISDGILRGNLTARFVGDPTLTRSQLRNMVETLKQSGIKQIDGDLIIDSSIFSSHDKAPGWVWNDMTQCFSAPPAAAIVDKNCFSVSLYSSEQPGELAFVRVPSFYPVNIFSEVKTLSKGSPEAKYCELDVTSGELNRFTLTGCLTQRSEPLPLAFAIQNGASYAGAILKNELHIAGIELKGHLRRQSDPEQPEKILALNESAPLHVLLKTMLKKSDNMIADTLFRTLGHRYFNVPGTWRTGSDAIRHILKQKAGIDLGSTIMVDGSGLSRHNLITPATMMEILQFIAQHNDDLDFISMLPKSGYDGTLSYRPGLHEAGVNGKVFAKTGSLQGVYNLAGFITAASGQKIAFVQFISSYSVLPDDQRTRRIPLARFESHLYKSLYQNH

SEQ ID NO: 9989 - protein, 392 aa, Xenorhabdus bovienii
  Peptide sequence Name=Xb4151_4152.C443.gene192.pep
  Gene classification: Gene name=Obg (BS); Function=Predicted GTPase; Function class=R General function prediction only
  Homolog annotation: Query=1..391bp; Hit=1..389bp; Blast score=551; Percent Identity=78.0; E value=1e-157; Homolog= yhbZ COG0536
MKFVDEASILVVAGDGGNGCVSFRREKYIPKGGPDGGDGGDGGDVYLLADENLNTLIDYRFEKSFRAERGQNGQSRGCTGRRGQDITIKVPVGTRVRDIATGEVLADMVRHEQRQMVAKGGFHGLGNTRFKSSVNRAPRQKTMGTPGESRELMLELMLLADVGMLGMPNAGKSTFIRSVSAAKPKVADYPFTTLVPSLGVVRMDNEQSFVVADIPGLIEGASEGVGLGIRFLKHLERCRVLLHLIDLCPLDESDPVENARIIIKELHKYSEKLAEKPRWLVFNKVDLTDPEEAKQRAKAIADELGWEGDYYMISAVNRQGVKELCWDIMEFMKAQPRHMDVEAEAQPEKVEFMWDDYHKEQLQQSSDADVDDDLDDDWDEGDEEGIEFIYKH

SEQ ID NO: 9990 - protein, 98 aa, Xenorhabdus bovienii
  Peptide sequence Name=Xb4151_4152.C443.gene193.pep
MLASSTNFITFLRRITTVKLDGCCTQRWHNSEYKKPRNTHCRASDSIETQKIYSATILINLRFFEPLTSNLIFPSANANRVWSRPQPTLLPAWNLVPR

SEQ ID NO: 9991 - protein, 102 aa, Xenorhabdus bovienii
  Peptide sequence Name=Xb4151_4152.C443.gene194.pep
  Gene classification: Gene name=RplU; Function=Ribosomal protein L21; Function class=J Translation, ribosomal structure and biogenesis
  Homolog annotation: Query=1..102bp; Hit=1..102bp; Blast score=154; Percent Identity=85.0; E value=1e-38; Homolog= rplU COG0261
MYAVFQSGGKQHRVSEGQTIRLEKLDIATGETVEFDQVLMVANGEDIKIGAPVVEGVKVKAEVVAHGRGEKIKIVKFRRRKHSRKQQGHRQWFTDVKITGIA

SEQ ID NO: 9992 - protein, 323 aa, Xenorhabdus bovienii
  Peptide sequence Name=Xb4151_4152.C443.gene195.pep
  Gene classification: Gene name=IspA; Function=Geranylgeranyl pyrophosphate synthase; Function class=H Coenzyme metabolism
  Homolog annotation: Query=1..321bp; Hit=1..321bp; Blast score=488; Percent Identity=76.0; E value=1e-138; Homolog= ispB COG0142
MNLESIIKLTADDMAAVNETILNQLNSDVALINQLGYYIISGGGKRIRPMIAVLAGKALHCEKEKHIKVAALIEFIHTATLLHDDVVDESDMRRGKATANAMYGNAASVLVGDFIYTRSFQMMTDLDSMRVLKLMSDATNVIAEGEVMQLMNCNDPDTSEDDYMRVIYSKTARLFEVAAHSAAILSGATPEQEAALRDYGRYLGTAFQLIDDLLDYDSDDSTLGKNTGDDLNEGKPTLPLLHAMHHGVPEQSALIRSAIEQGNGRHLLDTVLATMKQCGSLKYTRQRAEEEADKAISALQVLDESPYKAALVGLAHVAVQRLS

SEQ ID NO: 9993 - protein, 126 aa, Xenorhabdus bovienii
  Peptide sequence Name=Xb4151_4152.C443.gene196.pep
  Homolog annotation: Query=1..123bp; Hit=1..125bp; Blast score=182; Percent Identity=75.0; E value=6e-46; Homolog= Pa|Phot5-469d04.q1k _g13| 7574 - 7954 2032 126 aa, chain -
MKKDWYSAKELIGLAGLPSSPQGVNLMARREGWEQRRKRGVQGKALEYHVNSLPEEVLNVLAVSESSVEYYRNKRQDPFMIWIEAYYQLTKPERERMVKFILRKGLASLVQYIGIQEVENKDSIPD

SEQ ID NO: 9994 - protein, 115 aa, Xenorhabdus bovienii
  Peptide sequence Name=Xb4151_4152.C443.gene197.pep
  Homolog annotation: Query=1..112bp; Hit=1..112bp; Blast score=172; Percent Identity=76.0; E value=1e-42; Homolog= Pa|Phot5-469d04.q1k _g14| 8031 - 8378 1221 115 aa, chain -
MKKEWYTAMELTGVGELPRSPQGVNARAKREEWLRQKRAGVQGRAIEYHYSCFPESTLSALELHEISPEYQVQKQDPLSIWVSAFNLLSDEEKEAITEVILRDGIRSFLEKIIAT

SEQ ID NO: 9995 - protein, 88 aa, Xenorhabdus bovienii
  Peptide sequence Name=Xb4151_4152.C443.gene198.pep
  Gene classification: Gene name=Nlp; Function=Predicted transcriptional regulator; Function class=K Transcription
  Homolog annotation: Query=7..80bp; Hit=7..80bp; Blast score=101; Percent Identity=71.0; E value=1e-22; Homolog= sfsB COG3423
MISMKSDWHPADIIAALRKRGTTLAAVSREAGLSSSTLANTLSRPWPKGEWIIANYLGLHPAEIWPSRYFDPHTGELLERKIREKKNN

SEQ ID NO: 9996 - protein, 312 aa, Xenorhabdus bovienii
  Peptide sequence Name=Xb4151_4152.C443.gene199.pep
  Gene classification: Gene name=Mdh; Function=Malate/lactate dehydrogenases; Function class=C Energy production and conversion
  Homolog annotation: Query=1..311bp; Hit=1..311bp; Blast score=486; Percent Identity=83.0; E value=1e-137; Homolog= mdh COG0039
MKVAVLGAAGGIGQALALLLKTQLPSGSELSLYDIAPVTPGVAADLSHIPTEVKVTGFAGEDATPALVGADVVLISAGVARKPGMDRSDLFNINAGIIRNLVQQVAKACPKALIGIITNPVNTTVAIAAEVLKKEGVYDRNRLFGITTLDIIRSNTFVAELKGKNSEELEVPVIGGHSGVTILPLLSQIQGVSFTDEEVEALTKRIQNAGTEVVEAKAGGGSATLSMGQAAARLGLSLIRGLQGESNVIECSYVEGDGKYARFFAQPVRLGKNGIEERLDIGKLSDFEQKSLDSMLGVLKKDIELGEKFING

SEQ ID NO: 9997 - protein, 156 aa, Xenorhabdus bovienii
  Peptide sequence Name=Xb4151_4152.C443.gene200.pep
  Gene classification: Gene name=ArgR; Function=Arginine repressor; Function class=E Amino acid transport and metabolism
  Homolog annotation: Query=1..156bp; Hit=1..156bp; Blast score=265; Percent Identity=88.0; E value=2e-71; Homolog= argR COG1438
MRVPSKQEDLVKAFKALLKEEKFSSQGEIVAALQEEGFENINQSKVSRMLTKFGAVRTRNAKMEMVYCLPAELGVPTATSPLKNLVLDVDYNHCVVVIRTSPGAAQLIARLLDSLGKAEGILGSIAGDDTIFTTPAQDFTTKQLYEAILDLFDQEL

SEQ ID NO: 9998 - protein, 456 aa, Xenorhabdus bovienii
  Peptide sequence Name=Xb4151_4152.C443.gene201.pep
  Gene classification: Gene name=MurC; Function=UDP-N-acetylmuramate -alanine ligase; Function class=M Cell envelope biogenesis, outer membrane
  Homolog annotation: Query=1..456bp; Hit=1..456bp; Blast score=769; Percent Identity=78.0; E value=0; Homolog= ZyjfG COG0773
MRIHILGICGTFMGGLAILARSLGHEVTGSDANVYPPMSTLLEKQGIELIQGYDPSQLDPEPDMVIIGNAMTRGNPCVEAVLDRGIPYTSGPQWLHDHVLPERWVLAVAGTHGKTTTAGMLAWILEACGYKPGFLIGGVPGNFDVSAQIGESPFFVIEADEYDCAFFDKRSKFVHYGPRTLIMNNLEFDHADIFENLAAVQKQFHHLVRVVPGSGKILVPDNDINLKHVIGMGCWSELEHVGETGNWQTKKVSQDSSIYQVFHQSEQVGEVNWSLVGEHNMHNGLIAIAAAHHVGVQPADACQVLGDFINARRRLELRGEVNGISVYDDFAHHPTAILVTLAALRSKVGGVARILAVLEPRSNTMKMGMSKNDIAPSLGRADEVFLYQPANIPWQVAEIAEHCIQPARWSADIDALVRMIVEAAQPGDYILIMSNGGFDGIHEKLLTELGKKVHEA

SEQ ID NO: 9999 - protein, 395 aa, Xenorhabdus bovienii
  Peptide sequence Name=Xb4151_4152.C443.gene202.pep
  Gene classification: Gene name=Fbp; Function=Fructose-1,6 -bisphosphatase; Function class=G Carbohydrate transport and metabolism
  Homolog annotation: Query=62..393bp; Hit=1..330bp; Blast score=567; Percent Identity=83.0; E value=1e-162; Homolog= fbp COG0158
MNTHLFLSNIMKCVTILTINAEIRNAIAYQSSHSLAKLPRMSATRKCSTLSKTTTKFRAFVMKTLGEFIVEKQQDFPHATGELTALLSAIKLGAKIIHRDINKAGLVDILGTSGVSNVQGEVQMKLDLYANEKLKAALKARGEVAGIASEEEDEIVVFDGDRAENAKYVVLMDPLDGSSNIDVNVSVGTIFSIYHRITPIGQPVTEDDFLQPGNRQVAAGYVVYGSSTMLVYTTGYGVHTFTYDPSLGVFCLTHEKVQFPAKGNMYSINEGNYIKFPMGVKKYIKYCQEQDEATQRPYTTRYIGSLVADFHRNLLKGGIYIYPSTASNPTGKLRLLYECNPIAFLAEQAGGKASDGKNRILDITPTQLHQRVPFFVGTKSMVEKAESFMAEFPGE

SEQ ID NO: 10000 - protein, 176 aa, Xenorhabdus bovienii
  Peptide sequence Name=Xb4151_4152.C443.gene203.pep
  Gene classification: Gene name=Ppa; Function=Inorganic pyrophosphatase; Function class=C Energy production and conversion
  Homolog annotation: Query=1..176bp; Hit=1..176bp; Blast score=327; Percent Identity=90.0; E value=5e-90; Homolog= ppa COG0221
MSLNNVPAGKELPEDIYVIIEIPANADPIKYEVDKESGALFVDRFMSTAMFYPCNYGYINNTLSLDGDPVDVLVPTPYPLQPGSVIRCRPVGVLKMSDESGEDAKLVAVPHTKLSKEYDHIKDVNDLPELLRAQITHFFEHYKDLEKGKWVKVDGWDNVEAAKAEILSSFERAAKK

SEQ ID NO: 10001 - protein, 115 aa, Xenorhabdus bovienii
  Peptide sequence Name=Xb4151_4152.C443.gene204.pep
  Gene classification: Function=Uncharacterized ACR; Function class=S Function unknown
  Homolog annotation: Query=1..111bp; Hit=1..111bp; Blast score=140; Percent Identity=59.0; E value=3e-34; Homolog= ytfP COG2105
MRVIVYGSLRRKQGNHHWMTYAQLLGEHRLEGYEIYDLGHYPAVIRGEGTIECEVYRITPSILTELDALKKNYQEYERELIKTPYGSAWIYLYRLPVDGLHRITCGDWIKRHEEE

SEQ ID NO: 10002 - protein, 1255 aa, Xenorhabdus bovienii
  Peptide sequence Name=Xb4151_4152.C443.gene205.pep
  Gene classification: Function=Uncharacterized BCR; Function class=S Function unknown
  Homolog annotation: Query=5..1255bp; Hit=5..1259bp; Blast score=1377; Percent Identity=54.0; E value=0; Homolog= ytfN COG2911
MRWVKRLSMTFLLLVGLLLITIVGLVGTQTGLHFMINSAARWVPGLDIANVSGGWRDLTLKGVKYQMPGVSVSADNLYLSLRLSCLKHSHLCVNALTTEGVAVSVNTADLPPSEKSPASEPLTELKTPYPISLDLLSLKNIHVKVDDIVIALDEFKTGAQWREKQLTLKPTKISNLLVALPKTRPEQSGTVQKGKQKPEPEKSLGETLKALFAKPFLAELPNVPIPLDIMAENIHGSQLRLTGDTDITINDLRLQASNQGQQVDVKTFSVSAPEGSLSLQGTAGLSEQWPVKLVIKSNTNLNELKGQKLDLTLNGALLQQLNLALHLSGPIIANLSAQTELAKAGLPVRLTLESKQLQWPLTGEPEYRLDGVKLRLNGKASGYDLSLRSDIKGRDIPPALLMLDAKGNEELLRLTRLRLSALQGKAEITGIVDWSKAISWNANLILDGINTAKQWPEWPAKMNGKMAIRGSLYGGSWQLQIPEIALDGYVKQNIVKAHGKASGNAAGQWNIPQFDLTFGRNRLNVQGQLTDEKWKLDGEINAPQLNGLLPGLSGVVIGNVKLRGNMKAPQIVADLNARNVRWQNDLKVDSATIKGDVRSAEQIEGQLSVAVHQLKQADLIINNLMLNAKGTEKQHDLHLNIEGNPVSGQLALSGRFDRSQERWQGTINNTYFDTPVGEWRLNKAMVIDYLNPQQKVTIGTHCWLNPNAQICVPKPIEAGASGHAEVVLKRFDLAMIQPFLDKMTQVKGVFSGNANVKWTAGQALPQAKVVLQGNGVQLHQMVEGAALPVDFETLTVNAGLTNGKANVAWLFKLAGNGQLNGNVQVDDLEGRRKLSGNVDIRALSLKLIKPILGKDEKAEGGLNANLRFGGNVKNPLLFGQLKTDDLQIVSHWLPFDITQGQLAIYFDGVRSGLEGVIKTPKGQLNLNGNADWRNLNAWYAKIAANGEKLRVTVPPMVKIDVSPNLVLEATPDLLKLDGNVDIPWARITVQELPESAVGISSDEVMLDKNLQPIEKKKSSILVKSNLNIRIGDDVRLNAFGLKAQLKGVLKVIQDKQGLGLNGQIDIPDGRFHAYGQDLLVRKGTIIFSGPPEQPMLNIEAIRNPDSTANKVVAGVKVTGLADKPKVEIFSEPAKSQQEALSYLLRGEGLEKSGSDNNQMTSMLIGLGVSQSGQLVGKIGETFGVSDLALDTQGVGDKSQVVVSGKITNNLQVKYGVGIFDSLATLTLRYRVMPRLYLDAVSGIDQALDLLYEFEF

SEQ ID NO: 10003 - protein, 580 aa, Xenorhabdus bovienii
  Peptide sequence Name=Xb4151_4152.C443.gene206.pep
  Gene classification: Function=Predicted outer membrane protein; Function class=M Cell envelope biogenesis, outer membrane
  Homolog annotation: Query=7..580bp; Hit=10..577bp; Blast score=732; Percent Identity=60.0; E value=0; Homolog= ytfM COG0729
VSRYPFIFVLCVSVATPSAYSANLRLKVEGLSGELEKNARVQLSNISTEEVAPDARFQARVEKAIQQGLRPLGYYDPTVEFTYQEKTPPSRPVLTANVTPGEPVRVVEVNVDLEGSAKTDKDYAALIKKNMPKEGAILNHGEYEHFKGALNSLAVRKGYFDAVMKKSELEVSQEQHKSYWNFDFDSGDRYRFGSVRYHGSQIRENYLNNLLPFKQGEYYTSDQLAEFNSRLANTGWFNSVVVVPDFKVGHTSQDKLLPLDAFLVPSSANYVELGGGYATDVGPRVKAKWKKPWLNSRGHSLSTNINLSAPEQVIDASYKMPLKSNPLEQYYELQTGYKRKDINDTISDTATLNLSRNWDLFTGWQYGVNLRWSLSHFTQANVTNTTMLLYPGATVSRIRQRGGTMPYWGDSQRYSIDFSDKTWDSNVDFLVLQAHHVWIRTYKDKHRFVVRGDLGWIETNEFNKVPPGLRFFAGGDRSIRGYKYQKISPKNSEGKLTGASKLAVGSLEYQYNIYGNWWSALFVDTGEAVDDIKKSDFKTGAGIGVRWASPVGPIKFDLATPVGDASNHGIEFYIGLGAEL

SEQ ID NO: 10004 - protein, 215 aa, Xenorhabdus bovienii
  Peptide sequence Name=Xb4151_4152.C443.gene207.pep
  Gene classification: Gene name=MsrA; Function=Peptide methionine sulfoxide reductase; Function class=O Posttranslational modification, protein turnover, chaperones
  Homolog annotation: Query=11..211bp; Hit=10..210bp; Blast score=248; Percent Identity=63.0; E value=3e-66; Homolog= ZmsrA COG0225
LPNSANESQHVSTQDALLGRAIPLTVSPYHVITQHSINDIPENMEIAYIGMGCFWGVERLFWQQEGIYTTSVGYSGGTTPNPTYEEVCTGLTGHAEVVRIVFDPTKITYGQLLTLFWENHDPAQGMRQHGDIGTQYRSAIYTISSQQYEQALATREQFQQAMNENGDQRTITTEIHAAKPFYFAEDYHQQYLFKNPEGYCGLGGIGVCLLPTHKN

SEQ ID NO: 10005 - protein, 443 aa, Xenorhabdus bovienii
  Peptide sequence Name=Xb4151_4152.C443.gene208.pep
  Gene classification: Function=Hemolysins and related proteins containing CBS domains; Function class=N Cell motility and secretion
  Homolog annotation: Query=1..425bp; Hit=1..425bp; Blast score=643; Percent Identity=75.0; E value=0; Homolog= ytfL COG1253
MLNSLLIILLLCAISAFFSLSEISLAASRRIKLKLMADEGNLNAAHVLKLQETPGMFFTIVQIGLNAVAILAGVVGESAFSPALKTLFSNFMRQEWADQLGFICSFIIVTSFFILLADLIPKRIGMIKPEAVAVRIVNPMRFCLATFRPLVWLFNGLADCFFKIFKIPMARNEDITSDDIYAVVAAGALAGVLRKQEHELIENVFELESRTVPSAMTSRESVIYFDKNEDENSIKEKISTHPHSKFLVCDGGIDHVTGYVDSKDLLNRVLNGQSLSLKDGVQTRNALMIPDTLSLSDTLESFKAAGEDFAIILNEYALVMGVITLNDVMTTLMGDLVDQGQEEQIVVRDENSWLVEGGTPIEDVLRVLDIDDFPDSNNYETIAGFMMFRLRKIPKRTDFVKFSGYKFEVVDIDNYKIDQLLVTKIVDTPAQSNPSPSSQAQVQ

SEQ ID NO: 10006 - protein, 68 aa, Xenorhabdus bovienii
  Peptide sequence Name=Xb4151_4152.C443.gene209.pep
  Homolog annotation: Query=1..68bp; Hit=1..68bp; Blast score=115; Percent Identity=85.0; E value=2e-25; Homolog= Pa|Phot5-469d04.q1k _g28| 22682 - 22888 1264 68 aa, chain -
MKIFHHYNPLKVALYVKTLFRGRLYIKDMGAFEFNYGKILPPKIKDKRHLNVMSEINQQVLRLQAEMG

SEQ ID NO: 10007 - protein, 185 aa, Xenorhabdus bovienii
  Peptide sequence Name=Xb4151_4152.C443.gene210.pep
  Gene classification: Function=Predicted transcriptional regulator; Function class=R General function prediction only
  Homolog annotation: Query=7..183bp; Hit=3..183bp; Blast score=210; Percent Identity=55.0; E value=6e-55; Homolog= ZytfJ COG3054
MIKNIMLYAILSLTSVFASAHNIAVGQPVPTVSVTDKGELLLNNDKFSYQNWNSTELPGKVRTIQHIAGRSSAKEMNDPLIQALKQADLPKEKYQTTSIVNTDDAIFGTSVFVRNSLEDSKKEFPWSQFIVDSEGLAKKAWGLEPKSSAIIVLDKNGNVKFVKDGKLSNEDITHVLNLIKEELNN

SEQ ID NO: 10008 - protein, 251 aa, Xenorhabdus bovienii
  Peptide sequence Name=Xb4151_4152.C443.gene211.pep
  Gene classification: Gene name=CysQ; Function=3'-Phosphoadenosine 5' -phosphosulfate (PAPS) 3'-phosphatase; Function class=P Inorganic ion transport and metabolism
  Homolog annotation: Query=6..251bp; Hit=1..246bp; Blast score=333; Percent Identity=70.0; E value=1e-91; Homolog= ZcysQ COG1218
MQRCMMLQQICQLAREAGAAIMVVYQDEQPLKVEHKMDDSPVTAADIAAHKIIKAGLMRIAPDIPLLSEEDPPVWEERKNWQRYWLVDPLDGTKEFIQRNGEFTVNIALIEDGVPVMGVVYVPVLNVLYAGQGHQAWKETNGQTIPIKVAAAVLPTVVISRSHIDEELKDYLTQLGTHQTVSVGSSLKFCMVAEGKAQLYPRFGPTNIWDTAAGHAVAIAAGAHVTDWEGKKLNYAPRESFLNPGFRVTIF

SEQ ID NO: 10009 - protein, 53 aa, Xenorhabdus bovienii
  Peptide sequence Name=Xb4151_4152.C443.gene212.pep
MAAPASRANWQICCSIIHLCIHYSAITLDYIFSVFCTGIANTLSQKTRKKIAG

SEQ ID NO: 10010 - protein, 206 aa, Xenorhabdus bovienii
  Peptide sequence Name=Xb4151_4152.C443.gene213.pep
  Gene classification: Gene name=FkpA; Function=FKBP-type peptidyl -prolyl cis-trans isomerases 1; Function class=O Posttranslational modification, protein turnover, chaperones
  Homolog annotation: Query=1..206bp; Hit=54..259bp; Blast score=323; Percent Identity=77.0; E value=7e-89; Homolog= fklB COG0545
MTTPSFESIEARASYGIGLQVGQQLQESGLQGLEPEALLAGLCDALENRSPAIPVEELHRALREIHERADSVRHEHQQTMAEEGKKFLAENAEREGVSSTESGLQFSVLTQGDGAIPARSDRVRVHYTGRLMDGSVFDSSVQRGTPAEFPVSGVIPGWIEALTLMPVGSKWELYIPHNLAYGERGAGASIPPYSTLIFEVELLEIL

SEQ ID NO: 10011 - protein, 170 aa, Xenorhabdus bovienii
  Peptide sequence Name=Xb4151_4152.C443.gene214.pep
  Homolog annotation: Query=62..168bp; Hit=16..122bp; Blast score=109; Percent Identity=60.0; E value=2e-23; Homolog= gi|26251100|ref|NP _757140.1| Hypothetical protein [Escherichia coli CFT073] gi|26111532|gb|AAN83714.1|AE016771_225 Hypotheti
MNEDSSITALPEWVNARRILIEIGNEKIQTKNAGIASVFCHMFALANQRLSFRNDVNVQLCEYIAVYLEVNFVLTSGTQNAVRQANFALRYRNASSRNCVSDVTSTNRTEQFTFVTRFRSDGDRAQCVNLCCTSFCCCQNVSQFGFQFNTASFEEFDVFLSRRNSFALWN

SEQ ID NO: 10012 - protein, 75 aa, Xenorhabdus bovienii
  Peptide sequence Name=Xb4151_4152.C443.gene215.pep
  Gene classification: Gene name=RpsR; Function=Ribosomal protein S18; Function class=J Translation, ribosomal structure and biogenesis
  Homolog annotation: Query=1..75bp; Hit=1..75bp; Blast score=115; Percent Identity=98.0; E value=7e-27; Homolog= rpsR COG0238
MARYFRRRKFCRFTAEGVQEIDYKDIVTLKNYITESGKIVPSRITGTRAKYQRQLARAIKRARYLSLLPYTDRHQ

SEQ ID NO: 10013 - protein, 105 aa, Xenorhabdus bovienii
  Peptide sequence Name=Xb4151_4152.C443.gene216.pep
  Gene classification: Gene name=PriB; Function=Primosomal replication protein N; Function class=L DNA replication, recombination and repair
  Homolog annotation: Query=4..105bp; Hit=3..104bp; Blast score=155; Percent Identity=77.0; E value=5e-39; Homolog= ZpriB COG2965
VAANRLVLSGTVCKVPIRKVSPSGIPHCQFVLEHRSQQQEAGCSRQSWCKVPVIASGQLLQEFTHSITVGSRITVSGFINSHQGRNGLSKLVLHAEQIELIDSGD

SEQ ID NO: 10014 - protein, 132 aa, Xenorhabdus bovienii
  Peptide sequence Name=Xb4151_4152.C443.gene217.pep
  Gene classification: Gene name=RpsF; Function=Ribosomal protein S6; Function class=J Translation, ribosomal structure and biogenesis
  Homolog annotation: Query=1..132bp; Hit=1..131bp; Blast score=199; Percent Identity=84.0; E value=7e-52; Homolog= rpsF COG0360
MRHYEIVFMVHPDQSEQVPGMIERYSATITNAQGQIHRLEDWGRRQLAYPINKLHKAHYVLLNVEAPQEAIDELETNFRFNDAVIRSMVMRVKHAVTEPSPMVKAKDERRSRDLVLEEDMADDADEAGDSEE

SEQ ID NO: 10015 - protein, 245 aa, Xenorhabdus bovienii
  Peptide sequence Name=Xb4151_4152.C443.gene218.pep
  Gene classification: Gene name=SpoU; Function=rRNA methylases; Function class=J Translation, ribosomal structure and biogenesis
  Homolog annotation: Query=1..243bp; Hit=1..243bp; Blast score=399; Percent Identity=79.0; E value=1e-111; Homolog= yjfH COG0566
MSEIIYGIHAVKALLDREPQRFMEVYVLKGREDRRLTPLLRELEDIGITVQLANRQWLDTQTESAVHQGIIAKVKPGRQYQESDLPDFLSQLDRPFLLVLDGVTDPHNLGACLRTADAAGVDAVIIPRDRSAQLNATTKKVACGAAENVPLIRVTNLARTLRLLQESNIWIVGTAGEATHSLYQSKLTGPVALVMGAEGEGMRRLTREHCDELISIPMAGSVSSLNVSVATGVCLFEIMRQRSAQ

SEQ ID NO: 10016 - protein, 826 aa, Xenorhabdus bovienii
  Peptide sequence Name=Xb4151_4152.C443.gene219.pep
  Gene classification: Gene name=VacB; Function=Exoribonucleases; Function class=K Transcription
  Homolog annotation: Query=8..786bp; Hit=6..782bp; Blast score=1192; Percent Identity=76.0; E value=0; Homolog= vacB COG0557
MKHGEQQLADDNRGITMSKDPFQEREAEKYESPIPSREYILDILSKHTTPVSRQELAKELQLTSADAQEAFRRRLRAMERDGQLIFTRRQCYALPERLDLLKGTVIGHRDGYGFLRAEGHKEDFYLPAEQMKMAIHGDVILAQPLQPDRKGRVEVRIVRVLEPKNSQIVGRYFVDAGMGFVVPDDSRLSFDILIPKEEICGARMGNVVVVELTSRPTRRTKAIGKIVEVLGETMGTNMAVEIALRTHEIPHSWPPMVEKQVVDLDENVPDSAKKGRVDLRGLPLVTIDGEDARDFDDAVYCERKRGGGWRLWVAIADVSYYVRPQTPLDTEARSRGNSVYFPSQVVPMLPEILSNGLCSLNPEVDRLCMVCEMTISAQGKLSSYKFYEAVMNSHARLTYTKVWKILQGDQELREHYQPLVTHIEYLHELYQALEQAREQRGAISFESEEAKFIFNAERRIERIEPVTRNDAHKLIEECMILANIAAARFVEKNNEPALYRVHDQPREESILNLRSVFNELGLSLLGGMKPEPKDFAQLMKDVAERPDHELLQTMLLRSMKQAIYDPENRGHFGLALSSYAHFTSPIRRYPDLALHRAIKYLLAQENGVVEQHWTPTGGWHNDMDHMLQLGNHCSMTERRADEATRDVADWLKCDFMQDQVGNVFTGLITSVTGFGFFVRLNELFIDGLVHVSTLDNDYYRYDNVGQRLIGESSGQTYRLGDEVEIRVEAVHMDERNIDFTLLSSTRKARNQGKTARDKSKRGTPERNSGKKGYDHKKSANFEPDNASSKKKKAEKPKASKKKTSDKTKKITAKLKAKRVKKTQEKS

SEQ ID NO: 10017 - protein, 123 aa, Xenorhabdus bovienii
  Peptide sequence Name=Xb4151_4152.C443.gene220.pep
  Gene classification: Function=Predicted transcriptional regulator; Function class=K Transcription
  Homolog annotation: Query=1..123bp; Hit=17..141bp; Blast score=186; Percent Identity=74.0; E value=3e-48; Homolog= yjeB COG1959
MASLPEGQMTSITEVTEVYGVSRNHMVKIINQLSNLGLVNAIRGKNGGISLGKPASEIKIGDVVRSLEPLSLVNCSACYITPACRLKLVLNQAVENFLQELDKHTLADMVKDNRPLYQLLLAK

SEQ ID NO: 10018 - protein, 31 aa, Xenorhabdus bovienii
  Peptide sequence Name=Xb4151_4152.C443.gene221.pep
MYNRALCPVFYFLGIGFWVRGYKTQLVLLNF

SEQ ID NO: 10019 - protein, 432 aa, Xenorhabdus bovienii
  Peptide sequence Name=Xb4151_4152.C443.gene222.pep
  Gene classification: Gene name=PurA; Function=Adenylosuccinate synthase; Function class=F Nucleotide transport and metabolism
  Homolog annotation: Query=1..432bp; Hit=1..432bp; Blast score=763; Percent Identity=85.0; E value=0; Homolog= purA COG0104
MGKNVVVLGTQWGDEGKGKIVDLLTERAKYVVRYQGGHNAGHTLVINGEKTVLHLIPSGILRENVISIIANGVVLAPDALMKEMNALESRGIPVRERLLISEACPLILPYHVALDNAREKARGAKAIGTTGRGIGPAYEDKVARRGLRVGDLFDKETFAVKLQEIIEYHNFQLVNYYNEPAVDYQKTLDDILAVADILTNMVVDVSDLLYKATQKGELVMFEGAQGTLLDIDHGTYPYVTSSNTTAGGVATGSGLGPRYVDYVLGIIKAYSTRVGAGPFPTELFDETGEYLRQKGQEFGATTGRSRRTGWLDIVAIRRAIQINSLSGFCMTKLDVLDGLKEVKVCIGYRMPDGSVIDTTPLAAENWEGLEAVYETLPGWDESTFGVKDHSLLPEAALSYIKRVEELTGVPVDIISTGPDRAETMILRDPFDA

SEQ ID NO: 10020 - protein, 30 aa, Xenorhabdus bovienii
  Peptide sequence Name=Xb4151_4152.C443.gene223.pep
MNNRCLSHCKKTCSGFFVTSIITNAYLTAR

SEQ ID NO: 10021 - protein, 336 aa, Xenorhabdus bovienii
  Peptide sequence Name=Xb4151_4152.C443.gene224.pep
  Gene classification: Gene name=HflC; Function=Membrane protease subunits, stomatin/prohibitin homologs; Function class=O Posttranslational modification, protein turnover, chaperones
  Homolog annotation: Query=1..327bp; Hit=1..329bp; Blast score=411; Percent Identity=72.0; E value=1e-115; Homolog= hflC COG0330
MRKSFVFAIAIILVVLYTSIFIVYEGQRGIVLRFGKVARDAENKPLVYQPGLHFKIPFIETVKTLDARIQTMDIKADRFLTRENKDLIVDSYLKWRIKDFSRYYLATGNGEIAQAELLLKRKFSDRLRSEIGRLDVRGIVTDSRGRLTTDVRNSLNLGTNDGGTAETADNPVASAAANVGQETKDKQPILNQNSMAELGIEVVDVRIKQINLPQEISEAIYQRMRADREAEARLLRSQGLEEAEKIRAVADKTATEIKAKSNREALILRGEGDAEAAKLFADAFNKDPEFYAFIRSLRAYEKSFKNDGNNIMVLSPDSDFFRYMKAPFKQHSNTND

SEQ ID NO: 10022 - protein, 414 aa, Xenorhabdus bovienii
  Peptide sequence Name=Xb4151_4152.C443.gene225.pep
  Gene classification: Gene name=HflC; Function=Membrane protease subunits, stomatin/prohibitin homologs; Function class=O Posttranslational modification, protein turnover, chaperones
  Homolog annotation: Query=1..367bp; Hit=1..372bp; Blast score=457; Percent Identity=67.0; E value=1e-128; Homolog= hflK COG0330
MAWNQPGNNGQDRDPWGSSNNNGGNSGGNNKGGRNRGATNLDDLFRKLSEKLGGFGGKKGGNGSEQGPKFGGRIIGLAVAAAVAVWVVSGFYTIKETERGVVIRLGKFSHVVQPGLNWKMTFIDRVRAVNVESVRELATSGVMLTSDENVVRAEMNVQYRVTDPAAYLFNVTSPDNSLSQATDSAVRGVVGKYTMEKILTADRTIVRNDTQKVLEETIRPYNMGITLLDVNFQTARPPEEVQVAFDDVIAAREEEQKTIREAESYKNAVLPMAKGDAQRMIEDARAYKVSVVLNAQGEVASFAKILPEYKAAPEITRERLYIETMEYVLSNTRKVIANEKSNNMLVLPLDQVFRKQAEVPKTQSSDAKVAPEKSGSTHFAPEQGQTGYNNSSNNHSSYGNPSSLRGETPRQGRP

SEQ ID NO: 10023 - protein, 43 aa, Xenorhabdus bovienii
  Peptide sequence Name=Xb4151_4152.C443.gene226.pep
MTVTESVLSEASPKNIGCLQNDEICRFCPQRPLSDLSGTGNGL

SEQ ID NO: 10024 - protein, 426 aa, Xenorhabdus bovienii
  Peptide sequence Name=Xb4151_4152.C443.gene227.pep
  Gene classification: Gene name=HflX; Function=GTPases; Function class= R General function prediction only
  Homolog annotation: Query=1..426bp; Hit=1..426bp; Blast score=679; Percent Identity=80.0; E value=0; Homolog= ZhflX COG2262
LFDRYEGGELAVLVHVFFSQEKDTENLSEFESLVTSAGVSPVQIVTGSRKAPNPKYFVGEGKAEEIAEAVKNSGADVVLFNHALSPAQERNLERLCQCRVVDRTGVILDIFAQRARTHEGKLQVELAQLRHLSTRLVRGWTHLERQKGGIGLRGPGETQLETDRRLLRDKIKQILGRLGKVEKQREQGRQARNKADIPTVSLVGYTNAGKSSLFNRITSAEVYTADQLFATLDPTLRRIDVNDVGTVVLADTVGFIRHLPHDLVAAFKATLQETRQARLLLHVVDAADSRLDENIVAVDSVLEEIEANEIPSLLVMNKIDMLEDFVPRIDRDEENRPIRVWLSAQTGAGIPLLFQVLTECLSGEIAHYELHLPPEAGRLRSRFYQLQAIEREWIEDGGQIGIEVRMPMVDWRRLCKQELNLLDYVV

SEQ ID NO: 10025 - protein, 100 aa, Xenorhabdus bovienii
  Peptide sequence Name=Xb4151_4152.C443.gene228.pep
  Gene classification: Gene name=Hfq; Function=Uncharacterized ACR, host factor I protein; Function class=R General function prediction only
  Homolog annotation: Query=1..100bp; Hit=1..102bp; Blast score=144; Percent Identity=80.0; E value=2e-35; Homolog= hfq COG1923
MAKGQSLQDPFLNALRRERVPVSIYLVNGIKLQGQIESFDQFVILLKNTVSQMVYKHAISTVVPSRPVSHHGNNPNVTTGVGNYHAGVNPAAPQESDGAE

SEQ ID NO: 10026 - protein, 313 aa, Xenorhabdus bovienii
  Peptide sequence Name=Xb4151_4152.C443.gene229.pep
  Gene classification: Gene name=MiaA; Function=tRNA delta(2) -isopentenylpyrophosphate transferase; Function class=J Translation, ribosomal structure and biogenesis
  Homolog annotation: Query=1..311bp; Hit=1..311bp; Blast score=484; Percent Identity=78.0; E value=1e-137; Homolog= ZmiaA COG0324
MSDLKTQHLPTAIFIMGPTASGKTALSIALHQHLPVELISVDSALIYREMNIGTAKPTAAEQAQAPHRLVDILDPAEIYSAADFRRDALKEMADITAAGRIPLLVGGTMLYFKALLEGLSPLPSSNLEIRAQIEQQAAKHGWEALHRQLQEIDSVAAARIHPNDPQRLTRALEVFRISGKTLTALTEMSGEILPYRVHQFAIAPASREILHQRIAARFEQMIKSGFEDEVKALYARSDLHTDLPSIRCVGYRQMWSYLSGEISHDEMVYRGICATRQLAKRQITWLRGWDNVTWLDSDQPEQALNTVMQVIST

SEQ ID NO: 10027 - protein, 647 aa, Xenorhabdus bovienii
  Peptide sequence Name=Xb4151_4152.C443.gene230.pep
  Gene classification: Gene name=MutL; Function=DNA mismatch repair enzyme (predicted ATPase); Function class=L DNA replication, recombination and repair
  Homolog annotation: Query=1..647bp; Hit=1..615bp; Blast score=721; Percent Identity=62.0; E value=0; Homolog= mutL COG0323
MAIRILPPQLANQIAAGEVVERPASVVKELVENSLDAGATRIDIEIERGGAKLIRIRDNGCGIDQQDLTLALARHATSKIASLDDLEAIVSMGFRGEALASISSVSRLTLTSRTESQTEAWQAYAEGRDMEVTVKPAAHPVGTTVEVLDLFYNTPARRKFLRTEKTEFGHLDEVVRRIALARLDVAINLHHNGKLVRQYRPAKEESQHERRLAAICGMAFVQQALALSWQHDSLSIKGWVADPMSDTVGGDIQYCYVNGRMMRDRLINHAIRQAYQDLLQGEKQPAYVLYLEIDPHQVDVNVHPAKHEVRFHQARLVHDFIYQGVAAVLKQRGKGAELALGCEEPAASWVPENRLSAGENHFLQQNTASLKASPPSRAAAAPSVSSGGHDKEQPQLDRPHSGNDTRQLHHGENYQKKQGELYQKMMQSAPEEKRPLFPERAVSVREKAAPIPVGAALLQGKNISYSFGKVLSIHAASYALIESPLGIGLLSLPVAERWLKQVQLTPGELGLKSQPLLIPLKLSLSQAEIDALKQNSELLKTFGIESTVAHGKVTIHAVSLPLRQQNLPKLLPELLNYLVEQPSACAEQVAIWLSRHVGSEHETWNIAQAVQLLADVERLCPQLVESPPEGLLQLIDLQAVVALLNHE

SEQ ID NO: 10028 - protein, 441 aa, Xenorhabdus bovienii
  Peptide sequence Name=Xb4151_4152.C443.gene231.pep
  Gene classification: Gene name=AmiC; Function=N-acetylmuramoyl-L -alanine amidase; Function class=M Cell envelope biogenesis, outer membrane
  Homolog annotation: Query=16..440bp; Hit=7..425bp; Blast score=428; Percent Identity=55.0; E value=1e-120; Homolog= ZamiB COG0860
MMNAFFVKVIKKWQAHWVMSCVLFVMLSQLIMMTATAATLSNIHVNNSPSEATVTLGFTGGHPDYRFFPLHAPERLVVDIRQSGHVMGLPMRLSGQNLVKVIRTSQSPDAQHKRLVLELAHQATATSSVKESASEYQVMFTLKTNSATAKSTTNSTSMLKGNTSLHESKQLLANNAQSPKQEIKQTPAHHDQGVKKQATKAAQGKYPIVIAIDAGHGGTDPGAIGQGGLKEKNVTISVARKLEVLLHNDPMFKPVLTRGGDYFISVAGRSEVARKHKANMLVSIHADAAPNRSARGASVWVLSNRRANSELGNWLEQHEKQSELLGGAGDVLSNGINPLLSQAVLDLQFGHSQRVGYDVAVQVLSQLSHIGSLHKRRPEHASLGVLRSPDIPSILVETGFISHLSEEELLGSNDYQARLAQAIHFGLRHYFQANPLQTSPM

SEQ ID NO: 10029 - protein, 154 aa, Xenorhabdus bovienii
  Peptide sequence Name=Xb4151_4152.C443.gene232.pep
  Gene classification: Function=Predicted ATPase or kinase; Function class=R General function prediction only
  Homolog annotation: Query=1..151bp; Hit=1..151bp; Blast score=210; Percent Identity=70.0; E value=4e-55; Homolog= yjeE COG0802
MKELVLLLPNENATVALGNAVAATGDRGYVIYLYGDLGAGKTTFSRGFLQALGHQGHVKSPTYTLVEPYALLPRPVYHFDLYRLSDPEELEFMGIRDYFHQDAICLVEWPQQGAGFLPDADIELHLSYDSEGRRARFVALSEYGENLLDNLKSL

SEQ ID NO: 10030 - protein, 385 aa, Xenorhabdus bovienii
  Peptide sequence Name=Xb4151_4152.C443.gene233.pep
  Gene classification: Function=Uncharacterized Fe-S protein; Function class=C Energy production and conversion
  Homolog annotation: Query=1..385bp; Hit=1..379bp; Blast score=622; Percent Identity=76.0; E value=1e-178; Homolog= yjeS COG1600
MATPLDLNLLATNIKQWSLSLGFQQVGICDTDLSAEEPKLQEWLDKQYHGEMDWMARHGMMRARPHELLPDTLRVISVRMNYLPAKAAFASTLNNPELGYVSRYSLGRDYHKLLRQRLKKLGEQIQDYCSAHEYQGTLNFRPFVDSAPIMERPLAAKAGLGWVGKHSLILNRESGSWFFLGELLINLPLPIDAPQEEQCGRCVACMTTCPTGAIVEPYTIDARRCISYLTIELDGVIPEELRPLMGNRIYGCDDCQLICPWNRFSQLTDEVDFSPRAALHTPKLLDLFSWSEEKFLRITEGSAIRRIGYLRWLRNISVALGNALYQDDIVLALKKRIGLSEVLDEHIHWAIDQQITRRNANTIEVQTSQQKRLIRAITKGIPRDA

SEQ ID NO: 10031 - protein, 57 aa, Xenorhabdus bovienii
  Peptide sequence Name=Xb4151_4152.C443.gene234.pep
MCEWILVLLLISDSFPLKYNYCFLSTVFNLTAILTCLTMLYLLHRVIHRRNFCICIF

SEQ ID NO: 10032 - protein, 55 aa, Xenorhabdus bovienii
  Peptide sequence Name=Xb4151_4152.C443.gene235.pep
LYFSGKESEISNKTRIHSHILDAGEEIFLCLFKNEAALWTCCIWIASALSTIYLW

SEQ ID NO: 10033 - protein, 128 aa, Xenorhabdus bovienii
  Peptide sequence Name=Xb4151_4152.C443.gene236.pep
MDLLYLDSKCFIDNLFMVVIDGTDQVVTPCDRSPQRRKKENCSSYANCDKHESPAKLFRSGAARKKIPRYSSKAVGKQKWINPAIIELVDGLEQWSYICVRHKMTNDQKNVTNIQNIDLLLYGLVKDN

SEQ ID NO: 10034 - protein, 35 aa, Xenorhabdus bovienii
  Peptide sequence Name=Xb4151_4152.C443.gene237.pep
MIPSYYLASQACRKSANYSGADGLGLITSLIFMKS

SEQ ID NO: 10035 - protein, 42 aa, Xenorhabdus bovienii
  Peptide sequence Name=Xb4151_4152.C443.gene238.pep
MLMINNTIFISAYQEQALLWTCSKKMTSPLHPLLCQALKKHS

SEQ ID NO: 10036 - protein, 1122 aa, Xenorhabdus bovienii
  Peptide sequence Name=Xb4151_4152.C443.gene239.pep
  Gene classification: Gene name=PorB; Function=Pyruvate; Function class=C Energy production and conversion
  Homolog annotation: Query=406..670bp; Hit=54..317bp; Blast score=331; Percent Identity=58.0; E value=4e-90; Homolog= mlr5175_2 COG1013
MTQHYPSKFVTGTDALAELLLAQAELDKSHNLNTAGFVAGYRGSPLARLDQALWQHGKELAQSNIRFQPAINEDLAATALIGTQKVESDPDRNVIGVFGMWYGKGPGVDRSGDALRHGNAYGSSPHGGVLVILGDDHGCVSSSMSHQSDLVLMAWSMPILHPASVSDYHDVGLWGWAASRASGAWVGFKAISEVVESSAIRKSKPFPEYKTPEIDSGPDGLHWRWPDLPGPQIEKRLAYKLKAVEAFARANPIDQLLAPCAHPRALLVTVGKAHRDVLEALRAGGLTPSQLAKQGVAFVHVRLVYPLSPLLSDLASQVTDIFVIEEKNAVVEILLARHLVNSQKNIKLIGKHNHLGQQFLPADIELRPSLITPLLSGWLNKLDLFLSVPLEWATKTTPHDLTLPKRTPYFCAGCPHSTSTRLPEGSQAQIGIGCHVMAAWMDRNTGFGLVQMGGEGADWVGHSPFINRPHLFQNLGDGTYFHSGHLSIRQSIAAGNHITYKLLFNQAVAMTGGQPLDGNLTIPQIVALMLAEGVKEVAIVTDDIDKYQDKNLLTAKVTLYQRDYLEEVQKRFREIAGVTVIIYDQACATELRRKRKRGLEPKATRRAVINELVCEGCGDCQVQSNCLAVIPVKTSLGTKRKIDQHVCNSDLSCLKGFCPSFVTVENANPRHDLSKIIPQGDLDKLLRELPQPILIISDNPYEILLVGVGGTGIVTAGNLLAIAAEADNYSVSLLNFTGFAQKGGEAITHVRLCHDMNKLHQVRIDRGRANLIIAADLVAATGQNSLTVMSKSATKCVLNTHETQIGTMLRAPTLNLDHPKMMTTLHQHCQTLNSIDAEIMAADLVGDRNQTNIVLIGYAWQLGKIPITLSAIDHTIQALGNAADSARRAFHIGRIAAVQPDILNERLHIKPQESIKTLDDLIMHRYQFLVDYQNEGYAQRYLSRVAQIQLVTQQIDAEEIAKAVAENLFKLMAYKDEYEVARLYAKSDFFENLRSQFDNTDNIRFHFSLPLFNRKDPRTGERGKREYGTWIIPIFRVLAACKPLRGTMFDIFGYQEERRQERNLLLEYERLLDFLIEKLNRDNLAICQQLAELPDQVRGFGHVKQKAIKNMMERKEALLEKL

SEQ ID NO: 10037 - protein, 40 aa, Xenorhabdus bovienii
  Peptide sequence Name=Xb4151_4152.C443.gene240.pep
MNERLRKHRSHCWRVFIQPFSLIQMMRHYQYAFFDMTSPC

SEQ ID NO: 10038 - protein, 393 aa, Xenorhabdus bovienii
  Peptide sequence Name=Xb4151_4152.C443.gene241.pep
  Gene classification: Gene name=UbiH; Function=2-polyprenyl-6 -methoxyphenol hydroxylase and related FAD-dependent oxidoreductases; Function class=H Coenzyme metabolism
  Homolog annotation: Query=3..385bp; Hit=1..384bp; Blast score=281; Percent Identity=43.0; E value=8e-76; Homolog= PA3328 COG0654
MLMSRKPSALIVGTGIGGLSCAIALKKIGWSVRLFEKTDSLRATGSGLSVMSNASSAMKKLLDIDLGLKNYGAEVRNFEIRHSSGLLLKRLPVQKISDEQGTPSICISRENLQRALLDQLGDADISFGKRVTGYNETSDAVHINFEDGTVSSGDIIVGADGFYSAIRDAIGTESIIQEAGYICWLALVKYSHPKITPGYVAHYWGRGKRMGIVDIGDGWVYWWGTANMSNDDAKRWKGTNRDVAEFYAGWPDLVQDIINSTDSESIITVDAKDRTFPEHWTKGRVTLLGDAAHPMLTSLGQGAGISIEDAAVLGYVLKNTEDYRVALRRYEAIRQPRARAIVNTSRSLSDIEQHDRFFPCLERDVSMLLTSKKSMRKRLQDSLLFDDLAIQAQ

SEQ ID NO: 10039 - protein, 2434 aa, Xenorhabdus bovienii
  Peptide sequence Name=Xb4151_4152.C443.gene242.pep
  Gene classification: Gene name=EntF; Function=Non-ribosomal peptide synthetase modules and related proteins; Function class=Q Secondary metabolites biosynthesis, transport and catabolism
  Homolog annotation: Query=1108..2152bp; Hit=7..1030bp; Blast score =740; Percent Identity=40.0; E value=0; Homolog= PA3327_2 COG1020
MSSEIIFSNIKSRDGAVWLGSIKGTASAQKYSVCVVIRRANVISLNGVQAMSIATDIGEPTSYERDLWVEELHDPHCHQFTVALSELLPRSIDLVNLKGVAEQVLESEQASHKSFHEQEGHLVLKKAPVVVCAELYEFKNEDDFALFFNEWSRKIWDLSVSPLVEIAIGQTDQATILMVRAHHIVADGWGLNLLSKKILGAYADNHLGLNEQLKGVKRYATKYPTLQGSKLDEAIHDVVVKIADTDPVLFPKSGAALSTSPSYIRPFKISAHEVAHGIENGFTPFLAVSTALAVLLSNAYGSEKFFIGVPFLNRTDAEITSVSHRANILPVKVEVLPQNTLRAIYSQIKDFIVFLKDKESVPLGGIISALASSSRQLFDVTMSYLRYPEWGAIAGFEEKTQNIAHMHTQDAIAIHLYTYGNNADVWGDVCLNSSVFDTEDSANAFLDTFIHLINNFGNNVDKHVSEVNLLTSKQMEQLRQYENGPTKQYSVNETVVSLFEAKAEQFPENIALRDQIGTSLSYSQLNAWSSTIAAALEGRGIGQGDIVAVSVERSPEMLAAIFGVLKTGAAYLPIDSDYPEDRIQYMLNDSNAKLVISNLPHVMKSDDPRLFRLDALPTELPSHHQYRSKAQPHEPAYVIYTSGSTGRPKGVIVEHHSVVNRLEWMQEIHPLTSDDVILQKTSISFDVSVWELFWWAMTGASVALLKQGAQRDPRELIQTISTLGVTVAHFVPSMFEPYVQTLTDDRQSLLSVSSLKCLFTSGEALTPAVVNKYRKLFGRDTRPPRLINLYGPTEATVDVTYYELNLEQDSDINAVPIGFPINNTSVRIASLHGVRQPIGISGELQIGGVQLARGYLNRPELTAERFIIDQNDSCSRWYRTGDLAAWAEDGSILYLGRMDGQVKIRGNRIELGEIKNALLNLPEVLNAEVIVEDDARGKHLIAVYVGRQDLNERDIRAKLGKQLPSFMVPARFVRLGGIPLTPNGKFDRASALREVSGNKASPQTVKLDESETIVAKIWEKVLGRSNIGADDDFYTLGGDSILMLKVRSELESHGYDVGLSDLAQYTTVCSLGNVLESVSRVLSSPKEALPPFALISATDQKMLSSVYDDAYPVSQLQLGLLFHSREMEGARTYKDVFRYTLKSAWNEAAFRSALQGLVRRHPALRTVFNLSDYHLPLQLIRPEILIDDVLSIKTPDVVEYEHTVLAHMDKWSRYNYSFLSGPLFHVAIFANSESNYIDLVFSFHHAILDGGSVANLIRELLLSYSQGNDGANLGYPEDELPNPSIFVQNEIETLEASESKNYWKEYLSGATNTLPIGLAGYSTAPVKRIFSYRFLIDPVLDVALNQLARTIRVPIKHLYLAAHCTTIALMSGKEEIVTGVVTHTRPEIKHSERILGLFLNTLPLRVDIKNWNWLQVVEGLYRNEKRSHKHRCFPLSQIQADNELLSVQTAFNYVHFHILQDISAKSGIEIVAFDPKEETNFDILVNVMRDVDGERTSVRVDLNGSIYAREQGAVFSRLFNRVLERIAYQPELPVSLSHSITEVGCLVERTSDKVFISLPAMIRNSVQRDPDAVAITYDNVEWSYQQLWDAATEIAFLLSERGVHKQDVVGIALPRSFEQIATVLAILRIGAICLPIDLSYPASRIELILKIANPAVVVTDHSITELPTSVRMLFLEHDSIAATAERDDATIDSADAAYILFTSGSTGTPKGVTMLHRGLTNLVGWQNKISSGAKVTSTLQFSPLSFDVSFQEILSTLSSGATLHLISEMERRDPVALVRHLDRKGVERIFLPYIALQQLAETAVMLEFFPKKLRVIVSSGEQLRVTKEIRTLVDNLPGGILENQYGPTETHVVTSYTMSSDPSQFPALPPIGIPITGVGIVILDESSNVVPDGVPGEICVFGDALASGYYRSPEETKKKFIAHADVPGGMFYRTGDIGIRSACGEIISLGRKDTLVKVRGYRVELSEIELKILEFFEKIKKNVEVAVVARPRDDLDSYLIAYLVGKEDGIALEELRQFIGAELPAYMVPTHITWINELPKTPSGKRDDAMLRKLDIQLVSEKNYRGPAGEYESRLCELTAELLKIPEIAPEQSIFDCGATSLTAMRIVVLVEKLYGINVPLSAFVSAPTIAKLAMLIQNGGGQFKFDPLVPLRKAGNSRPLFLVHPMGGNILSYLRMLPYLPSDQPLYALQASGVDAGSSPITTIEEQAAFYIEAIKRIQPTGPYVIGGWSYGGFIAFEMANQLIRSGEMVSNILILDTMALSSQAKGQASDDALLSWFFWELLWTSKGSSLPVHVVPSYIESLQEKFEYITDHATQIGAIPEGSTKAVMQRLFEVYSANWQAAAEYNAQCPNLDVTLIRAKQPLPQILQEMHNTIRSEYHDPLNGWGGKTSGRVNLIEVDGDHLTIMEEPFVGPMVSAIITEINKVKGVNANV

SEQ ID NO: 10040 - protein, 199 aa, Xenorhabdus bovienii
  Peptide sequence Name=Xb4151_4152.C443.gene243.pep
  Homolog annotation: Query=3..181bp; Hit=30..214bp; Blast score=95; Percent Identity=32.0; E value=4e-19; Homolog= gi|21220841|ref|NP _626620.1| putative transcriptional regulator [Streptomyces coelicolor A3(2)] gi|6562775|emb|CAB62706.1| put
MLRDALIKTSYELFAIKGFDETRVEDITEKVDVSTRTFFRYFSSKEDVVLDYQEAEHKDFIAALIRRPPHEPALSALRHTAVEIMRKCEGGSYGFNTNCFMTLQDLIRNHPLVRAKNLQRGEDRKPPIISLIAQRMGTDPKIDIRPGILAGVLDYAHWATYDVWKRKKHSSMRYSDVLDEVFLIIENGLNFPANNQPDI

SEQ ID NO: 10041 - protein, 50 aa, Xenorhabdus bovienii
  Peptide sequence Name=Xb4151_4152.C443.gene244.pep
MKVCKPQKKGPKGPFYVPVIMTKIHSHPALFSRSLITPGLRLPEPFGYLG

SEQ ID NO: 10042 - protein, 51 aa, Xenorhabdus bovienii
  Peptide sequence Name=Xb4151_4152.C443.gene245.pep
MVVGCSYLEIKADSSHQQCGNSSVGRAQPCQGWGREFESRFPLQIQDCRFL

SEQ ID NO: 10043 - protein, 49 aa, Xenorhabdus bovienii
  Peptide sequence Name=Xb4151_4152.C443.gene246.pep
MRQENEGNNGCKMSTSRQLACILNVWYWVVCKELAIFSKQVHNGAHLGT

SEQ ID NO: 10044 - protein, 116 aa, Xenorhabdus bovienii
  Peptide sequence Name=Xb4151_4152.C443.gene247.pep
MRRCSKWPHQKRRKRMADNYIVRTAGEWLIVGLLPDVCKTPMGASTPPIPYPVVAKLADSSAPEMLWKAFVIQGLKLISLLGSQLSVLSGLFMHIRLLCGRKMRVTTGVKCPRHVS

SEQ ID NO: 10045 - protein, 341 aa, Xenorhabdus bovienii
  Peptide sequence Name=Xb4151_4152.C443.gene248.pep
  Homolog annotation: Query=1..302bp; Hit=96..345bp; Blast score=93; Percent Identity=33.0; E value=5e-18; Homolog= gi|22957521|ref|ZP _00005220.1| COG5351: Uncharacterized protein conserved in bacteria [Rhodobacter sphaeroides]
MEFRNLTPFAVMNYSMLDVADTEHRVMVMKIGYQLLPDRRGHCLAELLPAPPLCLQDEYRGQMNASQVLQESDLAPFKPRCDVIVNGTAYAPDNRPCTAFPVRLHVQSKQGQTLLDKTLTVTGEREFIRDAGGQWQLTDPKPFSTLPLDYRYAFGGECKIQADDKAVAQLKESDRLTSAQRQQHPDGEKAPVAHAACETNPLGMGFITPWYANAKPLTRCPAPRISAPEVPFTAPHFAKQLAGTLSADTPACQPQGLGFLGRPWLPRRQLAGTYDADWRAPACHPAGASSVYFAAAARREDVARADAPRYVNARQRGADAASDLSAECENRAAHSGGGSAI

SEQ ID NO: 10046 - protein, 95 aa, Xenorhabdus bovienii
  Peptide sequence Name=Xb4151_4152.C443.gene249.pep
  Gene classification: Gene name=VgrG; Function=Uncharacterized BCR; Function class=S Function unknown
  Homolog annotation: Query=12..95bp; Hit=584..689bp; Blast score=58; Percent Identity=35.0; E value=2e-09; Homolog= ZvgrE COG3501
MIFQIYSFLRAAHTLTVGGVMNTAVALSQSEQVGVHKSVIVGNTLSIKAGDVIELQCGASTLRMDSSGKITLIGTEFKFEASGPVQITGKDIDLN

SEQ ID NO: 10047 - protein, 146 aa, Xenorhabdus bovienii
  Peptide sequence Name=Xb4151_4152.C443.gene250.pep
  Homolog annotation: Query=3..144bp; Hit=43..183bp; Blast score=150; Percent Identity=54.0; E value=3e-36; Homolog= gi|23137510|ref|ZP _00119216.1| hypothetical protein [Cytophaga hutchinsonii]
MTRMTWIKPSFLWMMYRAGWGTKDSGQERILAIDITHEGFREILQQGVISHYDPDLFYSQEEWKKEVQQSDVVIQWDPERDIHLNKLEQRTIQIGLRNQAVERYVNKWIINIEDITNRAHQIHELVKMNKLDMAYNLLPEETIYLE

SEQ ID NO: 10048 - protein, 140 aa, Xenorhabdus bovienii; identical to SEQ ID NO: 6982
  Peptide sequence Name=Xb4151_4152.C443.gene251.pep
  Gene classification: Gene name=InsB; Function=Insertion element IS1 protein InsB, putative transposase; Function class=L DNA replication, recombination and repair
  Homolog annotation: Query=1..139bp; Hit=27..166bp; Blast score=117; Percent Identity=42.0; E value=5e-27; Homolog= insB_g4 COG1662

SEQ ID NO: 10049 - protein, 92 aa, Xenorhabdus bovienii
  Peptide sequence Name=Xb4151_4152.C443.gene252.pep
MCHYPFHTRLPGIPEPALIFLTPHKRLLLIHFTDKMNVIPVKRKRRHVPGVEFLSVFITVAVATFNTRAVSRMPLLFIAISIVCSLTPGLQA

SEQ ID NO: 10050 - protein, 46 aa, Xenorhabdus bovienii
  Peptide sequence Name=Xb4151_4152.C443.gene253.pep
MAKVDVYCRYCHKSEQVKGHGKGNGGHPRYRCYSCCKVFQLGSCIK

SEQ ID NO: 10051 - protein, 243 aa, Xenorhabdus bovienii
  Peptide sequence Name=Xb4151_4152.C443.gene254.pep
MIHSKYCIYINDVECAIADDIDFFHLSNHESDDFGLILLRSKEIKMQSSVKVKKEDTITISYYINGICAFEFNGHIIDKENTLTNSQGFSFVIKTSDEPPLTIIAILKEWVKGNDFIYWKNNKCIEAKNLWLTACLYWQQIFPPKPNKILNASLSLEGINNYLDFFCMLGEAFWGKRGYIGRDFHGFDDLLGDLSYEKSEINIYIENMNKLKLFLERISPPDYNYHEIFMGILVNRKCNINKK

SEQ ID NO: 10052 - protein, 103 aa, Xenorhabdus bovienii
  Peptide sequence Name=Xb4151_4152.C443.gene255.pep
MITQVKKVNIIGYSAFYIINIYAIFTVDHSIAILLNNLMFIISLTCALDIYHHRGTKDSEIYRLFRNHDLIHIHIFFDHSVMFVLVCDGVGQALFLNELLAIL

SEQ ID NO: 10053 - protein, 109 aa, Xenorhabdus bovienii
  Peptide sequence Name=Xb4151_4152.C443.gene256.pep
  Gene classification: Gene name=RhsA; Function=Rhs family protein; Function class=M Cell envelope biogenesis, outer membrane
  Homolog annotation: Query=22..90bp; Hit=227..295bp; Blast score=85; Percent Identity=57.0; E value=8e-18; Homolog= Z0702 COG3209
VWAQRLTTWGRAEKSQVLASNDADYHVSCNLRFVGQYEDEESGLYYNRFRYYDRETGQYLTPDPIGLAGGVNPYGYVHNPTGWVDPFGLAGKDCDKFTKLSSPNPVPKR

SEQ ID NO: 10054 - protein, 188 aa, Xenorhabdus bovienii
  Peptide sequence Name=Xb4151_4152.C443.gene257.pep
MIADDVMQFTPFITRRRRKFTRFVQPADTLIFGGRAIRIQRRFLNQLVAAPQVILPHHGTGFRRHIRLAVQPALEIRSGQFTVMDFEFPNAPPERIILVMPARAVRSFTLGQLVQCIPAVAPHLWPKTIALCGLFYQPPAVIIAVADITAPDNPPGLLALGHLRHGTLRVQKIKPEDHRDLSGLYFLS

SEQ ID NO: 10055 - protein, 195 aa, Xenorhabdus bovienii
  Peptide sequence Name=Xb4151_4152.C443.gene258.pep
MEKSLKLINNNFSLSEFNFSGFSSSVNWVGFFERKHDFSYHLIDESIELFSDFFEGKHASPTIITALSFDDDKEDDIETIARYQEIYHSVKEKNLLLPMTESYENYLYGETLLPAHSLSFSFTKNDFIDLSKLIMCHAGVIGQVCFYINPALNIGVYPHEDTGFGCIALNGEKNTCIDFLTYCKKNENFNVVIDN

SEQ ID NO: 10056 - protein, 356 aa, Xenorhabdus bovienii
  Peptide sequence Name=Xb4151_4152.C443.gene259.pep
  Gene classification: Gene name=RhsA; Function=Rhs family protein; Function class=M Cell envelope biogenesis, outer membrane
  Homolog annotation: Query=2..270bp; Hit=1235..1495bp; Blast score =145; Percent Identity=35.0; E value=5e-35; Homolog= Z0705 COG3209
MTQSQQAGRVIRRGDVSYRYDDSGRLVEKTVQRDGFRPQVWRYRWDALNQLTQCETPDGSRWYYQYDAFGRRIRKLKVHDGKLAAANLQRWLDGKPDLTPKPRTMMGQDYLWSGDQLIEETPLYADGTPAEDQRIRWLYEPGKLTPSARYERGKLHYIVSDHQGTPREMLNEEGGLVWAQRLTTWGKAEKSQVIASNDPDYHVGCHFRFMGQYEDEESGLYYNRFRYYDRETGQYLTPDPIGLLGGLNPYGYVDNPVNFIDPFGLAKCHLDNPKKKVNSADVGDFVRTPTSHPDDFTKIKGGNYKNKNTNEIWSKSNTTHSDKEGEWKVGIGKAEPKPRHKITIGMSDGKIIKIDK

SEQ ID NO: 10057 - protein, 175 aa, Xenorhabdus bovienii
  Peptide sequence Name=Xb4151_4152.C443.gene260.pep
MSIESLNNILPLPIHPNENGQNRKWSLIDERHAFPKDYIDFITQYGTGRIADFITIFNPFSEDDDLNFFRQKEWIIEDFNSLVESDPDYYPFILYPKKDGLLPIGVTDNGDYIFWVVSSDDSELWKVAIIAARAPEVEYRQENFTDFLEGVLSRKIKCMSFPDGFPPNSIEFDRI

SEQ ID NO: 10058 - protein, 58 aa, Xenorhabdus bovienii
  Peptide sequence Name=Xb4151_4152.C443.gene261.pep
MSGIEGRIRKALEQGQVVEMSSVPIYKDPSRIPAGITMKAEGSGGFYEYVTVLNPPGM

SEQ ID NO: 10059 - protein, 115 aa, Xenorhabdus bovienii
  Peptide sequence Name=Xb4151_4152.C443.gene262.pep
MMEKTHMSQSRFTQAEWRDLFEQQKKSELTVPQFCQKIGVSTTRFYHHRQRTSHPPEKPSGLASPSAFIKVSTAQKKSASSSILPILFETPHGTLRFPAGTDKHVIIAIIRGLAA

SEQ ID NO: 10060 - protein, 117 aa, Xenorhabdus bovienii; identical to SEQ ID NO: 9566
  Peptide sequence Name=Xb4151_4152.C443.gene263.pep
  Gene classification: Function=Transposase; Function class=L DNA replication, recombination and repair
  Homolog annotation: Query=6..101bp; Hit=7..101bp; Blast score=70; Percent Identity=39.0; E value=3e-13; Homolog= SPy0133 COG3436

SEQ ID NO: 10061 - protein, 339 aa, Xenorhabdus bovienii
  Peptide sequence Name=Xb4151_4152.C443.gene264.pep
  Gene classification: Function=Transposase; Function class=L DNA replication, recombination and repair
  Homolog annotation: Query=1..258bp; Hit=1..272bp; Blast score=129; Percent Identity=32.0; E value=6e-30; Homolog= Z1162 COG3436
MKIDIDALPNDPAELKRLLIKQSQRLAFLEEQFRLAQQKRFGASSEAFPGQGELFNEAEEIALPAETAAAQETLIPPRRKPTRNPLPKDLPRETVFHDIAEEEKQCVCCGGRLHQMGADRSEKLLFIPAQIRVVEHVRPKYACRECEKSGIQTPVKQASLPAMPIKKGMATSSLLSQLITNKYQYGLPLYRQESVFKQYGIDLSRQTQSDWILKSAQLFTPLVARFREMLLQQPVLHADETPVKVVTSEKTTHYMWVYCGSCIKWLVAVICFRLFKDEVWPKLMSIAVIATNQNRSKDMGKEMADILVIAVIAAVRSFSWRIPIRPANPALKNRLSISR

SEQ ID NO: 10062 - protein, 92 aa, Xenorhabdus bovienii; identical to SEQ ID NO: 6203
  Peptide sequence Name=Xb4151_4152.C443.gene265.pep

SEQ ID NO: 10063 - protein, 96 aa, Xenorhabdus bovienii; identical to SEQ ID NO: 5468
  Peptide sequence Name=Xb4151_4152.C443.gene266.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 10064 - protein, 248 aa, Xenorhabdus bovienii
  Peptide sequence Name=Xb4151_4152.C443.gene267.pep
  Homolog annotation: Query=34..163bp; Hit=1..130bp; Blast score=239; Percent Identity=91.0; E value=4e-62; Homolog= gi|18957979|gb|AAL79614.1| putative transposase [Xenorhabdus nematophila]
VVSAFSVEKGLSLCQCAVDGKSNEIKAIPTLLSMLSLKGHLVTLDAMGCQRTIAQQLRESGADYILSLKGNQGKTFSEAVNYFQQQQATQKPYLKPDHDEFEDSHGRTVRRRGWVLPLTPETKHLGSWPDIQALLVTETIRQEQYSETVTSYFRYYLSSCQDAPAFQLAAIRKHWAIENSLHWVLDVTFREDDSRMREQIATRIFAQLRKMALNIVKRDTNSKLSLSARRKSAGWDNGYMEALLFNQF

SEQ ID NO: 10065 - protein, 40 aa, Xenorhabdus bovienii
  Peptide sequence Name=Xb4151_4152.C443.gene268.pep
MRNPWQDISGIALTVSLNYGMVWRWRHKTKKPGSVLKEQF

SEQ ID NO: 10066 - protein, 357 aa, Xenorhabdus bovienii
  Peptide sequence Name=Xb4151_4152.C443.gene269.pep
  Gene classification: Gene name=MltE; Function=Soluble lytic murein transglycosylase and related regulatory proteins (some contain LysM/invasin domains); Function class=M Cell envelope biogenesis, outer membrane
  Homolog annotation: Query=1..357bp; Hit=2..359bp; Blast score=550; Percent Identity=77.0; E value=1e-156; Homolog= mltC COG0741
MKRLLALILLTPLLISCSSKKDIEYNEAYVKDTNGFDILMGQFAHNIENIWGLQEVLIAGPKDYVKYTDQYQTRSHINFDAGTITIETLSPIEPSEHLRKAIITTLLMGDDPGSVDLYSDINDIQISKEPFLYGQVLDNAGEAIRWEWRARHFANYLLQNKLQKRQSGLHMIWTVTIQLVPNHLDKRAHKYLPMVRKAAIKYGVDESLILAIMQNESSFNPYAVSRSDALGLMQVMQHTAGRDVFKMQGKSGQPSRSYLFDPENNIDAGTAYLSILQNIYLGEINNATSRRYAVITAYNGGAGSVLRVFSSDKKKAAQIINTMAPGDVYETLTNKHPASESRRYLMKVNNTQKGYRR

SEQ ID NO: 10067 - protein, 90 aa, Xenorhabdus bovienii
  Peptide sequence Name=Xb4151_4152.C443.gene270.pep
  Gene classification: Function=Uncharacterized BCR; Function class=S Function unknown
  Homolog annotation: Query=1..90bp; Hit=1..90bp; Blast score=139; Percent Identity=83.0; E value=4e-34; Homolog= yggX COG2924
MSRTIFCTFLQREAEGQDFQLYPGELGKRIFNEISKEAWQQWMSKQTMLINEKKLNTINPEHRKLLEQEMVKFLFEGHDIKIDGYTPPEK

SEQ ID NO: 10068 - protein, 346 aa, Xenorhabdus bovienii
  Peptide sequence Name=Xb4151_4152.C443.gene271.pep
  Gene classification: Gene name=MutY; Function=A/G-specific DNA glycosylase; Function class=L DNA replication, recombination and repair
  Homolog annotation: Query=2..345bp; Hit=1..344bp; Blast score=528; Percent Identity=72.0; E value=1e-150; Homolog= mutY COG1194
MMEAEQFSQAVLEWYHRYGRKTLPWQLEKTSYHVWLSEVMLQQTQVATVIPYFQNFISRFPNVASLAAAPLDEVLHLWTGLGYYARARNLHKAAQQIVAIHNGQFPTTFSDVIALPGVGRSTAGAILSLSQGKHFPILDGNVKRVLARCYAIAGWPGKKEVENQLWDISTRVTPKQGVEYFNQAMMDLGAMVCTRSKPKCEICPLNTGCISYANHSWASYPGKKPKQIIPEKTAYFLLMQYGDTVWLEQRPLSGIWGGLFAFPQFTDQTSLEQWLKDSGISHSKPDQLIAFRHTFSHFHLDIVPIKIDILSFDSCMDESKGLWYNLRQPATIGLAAPVEYLLQQLG

SEQ ID NO: 10069 - protein, 48 aa, Xenorhabdus bovienii
  Peptide sequence Name=Xb4151_4152.C443.gene272.pep
MLICVALRNKVRVYTEVTLCCNPVHETMIIYKDNYSNDGSRAIFTGGT

SEQ ID NO: 10070 - protein, 239 aa, Xenorhabdus bovienii
  Peptide sequence Name=Xb4151_4152.C443.gene273.pep
  Gene classification: Function=Predicted S-adenosylmethionine -dependent methyltransferase; Function class=R General function prediction only
  Homolog annotation: Query=1..239bp; Hit=1..239bp; Blast score=370; Percent Identity=73.0; E value=1e-103; Homolog= yggH COG0220
MINNVISPEYDENGRALRRVRSFVRRQGRLTSRQQQALDDMWPKMGMDYQPELFDMGELFGREAPVVLEIGFGMGASLVMMAGQNPEKNFFGIEVHVPGVGACLASAEDENLSNLRVMCHDAIEVLENMLPEQSLEMVQLFFPDPWHKARHNKRRIVQPEFAQLIRSKLKIGGVFHMATDWQPYAEHMLKVMSGAEGYCNVSENSDYVPRPDSRPVTKFEMRGQRLGHGVWDLMFKRVK

SEQ ID NO: 10071 - protein, 108 aa, Xenorhabdus bovienii
  Peptide sequence Name=Xb4151_4152.C443.gene274.pep
  Gene classification: Function=Uncharacterized BCR; Function class=S Function unknown
  Homolog annotation: Query=1..108bp; Hit=11..118bp; Blast score=154; Percent Identity=68.0; E value=2e-38; Homolog= ZyggL COG3171
MAKNRSRRLRKKLHIDEFQELGFSVKWNFPANTPVDIVDNTVDAFIEELVEPNGLALDASGYLQWEGLLCLQKIGKCTEEHRQLVEKWLKDRGMEDVAISELFDVWWD

SEQ ID NO: 10072 - protein, 308 aa, Xenorhabdus bovienii
  Peptide sequence Name=Xb4151_4152.C443.gene275.pep
  Gene classification: Gene name=GlsA; Function=Glutaminase; Function class=E Amino acid transport and metabolism
  Homolog annotation: Query=3..308bp; Hit=3..308bp; Blast score=434; Percent Identity=67.0; E value=1e-122; Homolog= yneH COG2066
VKVRFSNSLLADILDEVRPLIGQGKVAGYIPALAEVAVNNLAMAICTVDGQVFRAGDAEKRFSIQSISKVLSLTLAMTRYQEQDIWQRVGTEPSGQPFNSLVQLELEKGIPRNPFINAGALVICDMLQSRLSAPKHRMLEFVRSLTGQKYICYDDIVARSEMEHSSRNAAIAYLMKSFGNFENDVLTVLQTYFHYCALKMNCVELAQCFIYLANQGRMIGSGQQILSLRQTRQINALMLTCGMYDGSGEFAFRIGMPGKSGVGGGIVCVVPGEFTVAVWSPELNSSGNSLAGCAALEKLAERIGRSIF

SEQ ID NO: 10073 - protein, 240 aa, Xenorhabdus bovienii
  Peptide sequence Name=Xb4151_4152.C443.gene276.pep
  Homolog annotation: Query=1..240bp; Hit=1..240bp; Blast score=278; Percent Identity=64.0; E value=6e-74; Homolog= Pa|Phot3-157a10.p1k _g76| 41934 - 42656 2512 240 aa, chain -
MLRRIAIAASLLFVAQVQADSDCQATIQDDIIVTSKSVQIVGASGNLRILPDGSMLRNGKALSLNSEQRGKAQRYQQAIRQDLPWVKKETLSHLTSARQALDKVVVNTMGKESNIRNRLSQLESGLNKQIDKVLETRSDGIAFNSQAIKKVESEGQNLIQQSLGGILQDSINEVSRKKSEQNGDGKQMLMSFLGGLGGMQNGFDAEWKKQEQELDRFKGEVCSKANQLEQLRTSLMNSIK

SEQ ID NO: 10074 - protein, 321 aa, Xenorhabdus bovienii
  Peptide sequence Name=Xb4151_4152.C443.gene277.pep
  Gene classification: Gene name=FecB; Function=ABC-type cobalamin/Fe3+- siderophores transport systems, periplasmic components; Function class=P Inorganic ion transport and metabolism
  Homolog annotation: Query=48..321bp; Hit=37..315bp; Blast score=200; Percent Identity=40.0; E value=2e-51; Homolog= BS_yclQ COG0614
MRNSGVTMKKILPVVLASLLSVTSYSAFSQPSVLFTPNSVIVQSGDFVTVKHFSGETQVKKNPERIVLFDFGIYDSLVKLGLSDRVIALPVGNAPEYVRGNMSANMQNAGGMKEPDLEKLAGMKPDLIVITGRQGNFYPSLSKIAPTVNLDTDSKNYLSSVESNLKLLGELFNKQNAVKTQIEDLEKTIATAQEKAKYSNSKVLVLLHNAGTLYPNNQAIVYDVVKTQRAELPLPTDKEKSRAVTAEMIAKANPDAIFIIDRSKAIGAGELTKNQFENDQVKSTNAYKNGKIVYLQSDLWYLSGGGLDSLTQQVNAVADVL

SEQ ID NO: 10075 - protein, 73 aa, Xenorhabdus bovienii
  Peptide sequence Name=Xb4151_4152.C443.gene278.pep
LADHQTRQVIPEFTVRAVSLKDKLHLKISGAAFIGECLACKNCFKSRLFLMVIISVLIPTNSLEFSIDFLGMI

SEQ ID NO: 10076 - protein, 376 aa, Xenorhabdus bovienii
  Peptide sequence Name=Xb4151_4152.C443.gene279.pep
  Gene classification: Gene name=HemN; Function=Coproporphyrinogen III oxidase and related Fe-S oxidoreductases; Function class=H Coenzyme metabolism
  Homolog annotation: Query=1..376bp; Hit=1..376bp; Blast score=636; Percent Identity=80.0; E value=0; Homolog= yggW COG0635
MLKLPPLSLYIHIPWCVQKCPYCDFNSHALKGDVPHQEYVEHLLADLRADLPMIEDREVSTIFIGGGTPSLLSAEGMQRLLDGVRASLPLSSQAEITMEANPGTVEAGRFSAYQKAGVNRISIGVQSFGSDKLIRLGRIHGPDEAKRAAHLAADLGLRSFNLDLMHGLPNQTLNEALDDLRQAIELSPPHLSWYQLTIEPNTSFGSRPPVLPDDDALWDIFSQGHQLLTAAGYQQYETSAYAKAGYQCQHNLNYWRFGDYLGIGCGAHGKISFEDGRILRTVKTKHPRGYMQGRYLDQQNQLDNEDRPFEFFMNRFRLLEAMPRHDFSDFTGLPESAIRPQLDEALAKGYITENATHWQITKHGKLFLNSLLELFL

SEQ ID NO: 10077 - protein, 197 aa, Xenorhabdus bovienii
  Peptide sequence Name=Xb4151_4152.C443.gene280.pep
  Gene classification: Function=Xanthosine triphosphate pyrophosphatase; Function class=F Nucleotide transport and metabolism
  Homolog annotation: Query=1..196bp; Hit=1..196bp; Blast score=317; Percent Identity=78.0; E value=7e-87; Homolog= ZyggV COG0127
MQKIVLATGNAGKVRELADLLTDFGLDIVAQTELGVDSADETGLTFIENAIIKARHAAAITGLPAIADDSGLSVNALGGAPGIYSARYAGIDASDRDNLEKLLEAMRDIPDEKRQAQFNCVLVYLRHAEDPTPLIFHGRWSGIITHEPAGNGGFGYDPIFYVPEFGCTAAELSHEQKSAVSHRGQALKMLLEAMLNA

SEQ ID NO: 10078 - protein, 187 aa, Xenorhabdus bovienii
  Peptide sequence Name=Xb4151_4152.C443.gene281.pep
  Gene classification: Function=Predicted integral membrane protein; Function class=S Function unknown
  Homolog annotation: Query=1..178bp; Hit=1..178bp; Blast score=150; Percent Identity=52.0; E value=7e-37; Homolog= VC0459 COG0762
MQFLNFIFLTVLDLYIAVLLLRVWMQWVRCDFYNPFAQFIVKITQPVVRPLRKVIPAIGPIDTASIVFAYLIVLLKMLIPAWLATGQFVIPLAILFLVGMIELLTAAGKLIFWLVIARALLSWISQGRNPVDYVLIQLTEPLMAPIRRIIPAMGGIDFSAMIVMLVLYALNVLRYNVMTWLISMISG

SEQ ID NO: 10079 - protein, 318 aa, Xenorhabdus bovienii
  Peptide sequence Name=Xb4151_4152.C443.gene282.pep
  Gene classification: Gene name=ProC; Function=Pyrroline-5-carboxylate reductase; Function class=E Amino acid transport and metabolism
  Homolog annotation: Query=46..318bp; Hit=1..272bp; Blast score=303; Percent Identity=57.0; E value=2e-82; Homolog= VC0460 COG0345
MIWKLLSPAALHWCALERQFSVPVSTILNPKLTGQNQLINMRDYLMKNRKITFIGAGNMAHAIIAGLVRTGYPAEFITVCSPNTTRRDVLAKEYGINSENDNIRYAQEADVIVLAVKPQMMEEVCDSLRSQIDFSHKLVLSIAAGIPVARFYTLLQDNLNIIRIMPNTPALVGQGISGLFAPEYVTQPDRQFTESLMCGVGKVCWVNDENGINNIIAVAGSAPAYFFLFMESMQQEAERLGFDSQTARELVLQAATGSAKLAESQADLPFAILREQVTSKGGTTAEALRIFYEGHLPEIVSSAMQAAIRRAQEMEKLF

SEQ ID NO: 10080 - protein, 233 aa, Xenorhabdus bovienii
  Peptide sequence Name=Xb4151_4152.C443.gene283.pep
  Gene classification: Function=Predicted enzyme with a TIM-barrel fold; Function class=R General function prediction only
  Homolog annotation: Query=1..230bp; Hit=1..232bp; Blast score=316; Percent Identity=67.0; E value=1e-86; Homolog= yggS COG0325
MNNIEQNLHDVRNRIALTAQKCGRYPQEITLLAVSKTKPADAIAKAIETGQREFGENYVREGVEKVQHFANHNDLVWHFIGPLQSNKSRLVAEHFDWCHTIDRLKIAQRLSEQRPENMAPLNILIQINISGEDSKSGIILTALPELAKTINALPNLVLRGLMAIPAPESDFERQMAIFHQMEQAFIELKTQYPRVDTLSMGMTDDMEAAISCGSTLVRIGTAIFGARQYNTQP

SEQ ID NO: 10081 - protein, 336 aa, Xenorhabdus bovienii
  Peptide sequence Name=Xb4151_4152.C443.gene284.pep
  Gene classification: Function=Predicted ATPases involved in pili biogenesis, PilT homologs; Function class=N Cell motility and secretion
  Homolog annotation: Query=1..325bp; Hit=16..335bp; Blast score=317; Percent Identity=54.0; E value=1e-86; Homolog= ZyggR COG2805
MNMEKLVALSVKHNASDLHLCVGKVPVLRINGVLYPQMQLAEMQGDTLIAWSRKILTEEQQQQLQEYGHVDFVVEMPDKQRFRGNLFYQQCHVSLVLRLIADKCPTLEQLYAPDIIQRLILQEQSGLVLVTGATGSGKSTTLSAIINAFNNHGNKHIITLEDPIEFVHQSRNCLIQQRQISRDVPDYQTALKGALRQDPDVILLGELRDKETIRLALTAAETGHLVLSTLHTRGAIQALDRLVDVFSAEEKGWICSQLAGSLKAVISQQLLPAREGGRVAIYEVLVVNQAVSHLIREGKNHQIATLMQTGAAYGMQTHEQSRQQRELLGLLAVVPQ

SEQ ID NO: 10082 - protein, 141 aa, Xenorhabdus bovienii
  Peptide sequence Name=Xb4151_4152.C443.gene285.pep
  Gene classification: Function=Predicted endonuclease involved in recombination (possible Holliday junction resolvase in Mycoplasmas and B. subtilis); Function class=L DNA replication, recombination and repair
  Homolog annotation: Query=5..139bp; Hit=4..138bp; Blast score=215; Percent Identity=74.0; E value=1e-56; Homolog= ZyqgF COG0816
MKNRTIIAFDFGTHSIGTAIGQEITGTARALSAFKAKEGSPSWELIEKLLKEWQPDLIIVGLPLNMDGTEQLVTAQARKFANRLHGRFGVQVELHDERLTTIEARSHLFDHGGYKALDKGKVDSVSAVVILESWFEQQYSQ

SEQ ID NO: 10083 - protein, 187 aa, Xenorhabdus bovienii
  Peptide sequence Name=Xb4151_4152.C443.gene286.pep
  Gene classification: Function=Putative transcriptional regulator; Function class=K Transcription
  Homolog annotation: Query=1..187bp; Hit=25..211bp; Blast score=275; Percent Identity=66.0; E value=3e-74; Homolog= yqgE COG1678
MNLQHHFLIAMPSLSDPYFNRSVVYICEHDQNGAMGLVINKPIAQISIQSILEKLDITPEGRDDSINLDKPVMAGGPLSEEHGFILHTPQSGFSSSIQISDETMITTSKDVLEALGTTRQPENVLMTLGYSSWEKGQLEQEIMENSWLTVSAESSIIFETPVADRWHEAASLLGINIYNLAPQAGHA

SEQ ID NO: 10084 - protein, 319 aa, Xenorhabdus bovienii
  Peptide sequence Name=Xb4151_4152.C443.gene287.pep
  Gene classification: Gene name=RimK; Function=Glutathione synthase/Ribosomal protein S6 modification enzyme (glutaminyl transferase); Function class=H Coenzyme metabolism
  Homolog annotation: Query=1..317bp; Hit=1..316bp; Blast score=525; Percent Identity=78.0; E value=1e-149; Homolog= gshB COG0189
MIKLGIVMDPISSIKIKKDTSFAMLLEAQKRGWEIHYMEMNDLYLHQGEARARTRLLTVEENLQQWYQFGSEQEIALDNLHVILMRKDPPFDTEYIYATYILERAEDKGSLIVNKPQSLRDCNEKLFTAWFPELTPDTLVTRNAKTLREFHQKHGDVIFKPLDGMGGASIFRLKQDDPNIGVIIETLTEHGSRYCMAQNFLPAIKDGDKRVLVVDGEPVPYCLARIPAQGETRGNLAAGGRGEARPLSESDWAIARAVAPVLKEKGLIFVGLDIIGDRLTEINVTSPTCVREIEAAFPAISITGMLMDAIEKRLEKQPA

SEQ ID NO: 10085 - protein, 243 aa, Xenorhabdus bovienii
  Peptide sequence Name=Xb4151_4152.C443.gene288.pep
  Gene classification: Function=Uncharacterized BCR; Function class=S Function unknown
  Homolog annotation: Query=1..243bp; Hit=10..252bp; Blast score=392; Percent Identity=78.0; E value=1e-109; Homolog= yggJ COG1385
MRIPRIYHPERLSVETEIYLSDEAANHVGRVLRMSNGQPLQLFDGSNQVFDAELIEASKKTIKVRITDGKLSDHESPLNLHLGQVMSRGEKMEFTIQKSVELGVNTITPLLSERCGVKLDAERLEKKLQQWKKIVISACEQCGRNCIPEIRPVMSLEAWCAENDGSLKLNLHPRASQSINTLPLPVEKIRLLIGPEGGLSAEEIEMTANHQFTDILLGPRVLRTETTALTAITALQVRFGDLG

SEQ ID NO: 10086 - protein, 39 aa, Xenorhabdus bovienii
  Peptide sequence Name=Xb4151_4152.C443.gene289.pep
MAMNQLCDMAIAPYRKHPDKRRKEEICEFPASITLNGSP

SEQ ID NO: 10087 - protein, 168 aa, Xenorhabdus bovienii
  Peptide sequence Name=Xb4151_4152.C443.gene290.pep
  Gene classification: Gene name=PppA; Function=Signal peptidase, cleaves prepilin-like proteins; Function class=N Cell motility and secretion
  Homolog annotation: Query=20..155bp; Hit=134..266bp; Blast score=92; Percent Identity=41.0; E value=2e-19; Homolog= NMB0332 COG1989
MFSWMIIKDGLTNMDSIMIMVFCSVLIFLSIIDIKTYQLPDVITQPLLWVGLIFNSSENLVSIKSAIYGVISGYLFLWLLNKFCRYILKKEGIGYGDLKLTAAIGAWLGMEMIPVLMLLSSISGLFGFMIVWFKRKTYPDFIAFGPYICLSAIVLMGLRVSNIDIMGI

SEQ ID NO: 10088 - protein, 271 aa, Xenorhabdus bovienii
  Peptide sequence Name=Xb4151_4152.C443.gene291.pep
  Gene classification: Function=Metal-dependent hydrolases of the beta -lactamase superfamily II; Function class=R General function prediction only
  Homolog annotation: Query=1..270bp; Hit=4..272bp; Blast score=119; Percent Identity=31.0; E value=3e-27; Homolog= PAB0518 COG1237
MVLKITALLENQVFAPYKTALTGKPGLSLLIQNQDTTILFDTGPDGSFIDNAKKLNIDLSVVSTVVISHGHFDHCGGLPFFSTDAKVICHPDVKNERYYGWVITDNKALTFKKLSKQVDYGKFDTFFSKDETHINDSFVYSGEIKKEENKCYGVIVGEKVEGKYSPDFVKDEGVLIYKSRHGLIIFIGCGHRGVIEIIKFCKKITGIDQVYAVIGGLHLRYASPFKLLPIRKYIKKENIRHVYACHCSGMWGRLWLPNAKSLSTGQSIEID

SEQ ID NO: 10089 - protein, 294 aa, Xenorhabdus bovienii
  Peptide sequence Name=Xb4151_4152.C443.gene292.pep
  Gene classification: Gene name=GloB; Function=Zn-dependent hydrolases, including glyoxylases; Function class=R General function prediction only
  Homolog annotation: Query=1..293bp; Hit=1..295bp; Blast score=331; Percent Identity=56.0; E value=4e-91; Homolog= PA0057 COG0491
MARKTTLNIALAATLSLGVASLAQATNLKLDIYNPGETGVFPVSSEIISGDHEVVLIDAQFKKSDAQELVKMIQQTGKKLTTIYISQSDPDFYFGLDVITTAFPEAKVIASPETIKTINETKDGKLAYWGGILQDQAPKKVIVPEPLKGNTFTVDGEKLIVEGLDGPAADRTFVWVPKLKAVVGGVTISGNIHVWIADTQTKVSRQHWMQTLDRIKSLKPDTIVPGHYVGNAPMTLESVTFTQKYLTTLEKELPKAKDSEALIAAMKKHYPNLADESSLELSAKVLKGEMKWPQ

SEQ ID NO: 10090 - protein, 43 aa, Xenorhabdus bovienii
  Peptide sequence Name=Xb4151_4152.C443.gene293.pep
MPLPEKGSPPERYLMLFCEPLLNSCIKMFICLNGTYNKLHISI

SEQ ID NO: 10091 - protein, 304 aa, Xenorhabdus bovienii
  Peptide sequence Name=Xb4151_4152.C443.gene294.pep
  Gene classification: Gene name=LysR; Function=Transcriptional regulator; Function class=K Transcription
  Homolog annotation: Query=1..299bp; Hit=1..299bp; Blast score=322; Percent Identity=56.0; E value=2e-88; Homolog= PA0056 COG0583
MDRITAAQVFVTIVEQGSLVAAAERLDMSRAMVSRYLAEMEKWAGVRLLHRTTRKISLTSAGENAYQRSLKLLELAETMPVQQSLVSQTLRGLLRVSCSQSLGTSALSVAIPEFMRIYPQIAVNLQINNKVINLIEERIDLAIRITNNLEPNLIARPLSICHSVVCAAPSYLDRKIIPQKPTDLASHNCLTYNFFGKSLWLFEKQHEQYSVPVSGTLSANESTVLMEAALQGAGITMQPYYSAAPHLISGQLVELLPDYQPQAMGIYGIYTSRQNMPVTLRALLDFLVGWFANAPHWQQLMLKS

SEQ ID NO: 10092 - protein, 309 aa, Xenorhabdus bovienii
  Peptide sequence Name=Xb4151_4152.C443.gene295.pep
  Gene classification: Gene name=LysR; Function=Transcriptional regulator; Function class=K Transcription
  Homolog annotation: Query=1..293bp; Hit=1..291bp; Blast score=380; Percent Identity=65.0; E value=1e-106; Homolog= lysR COG0583
MHSCSWRHIEIFHAVMTTKNLTDAAVLLKTSQPTVSRELARFEQLLKFKLFDRIKGRLFPTAQGLRLFEEVQRSYYGLERILNAAESIRQFEHAQLSIACLPVFSQSLLPKACHSFIQRYPEAKLTIIPQESPLLEEWLSAQRHDIGLTEHLQTPAGTEQETLITLNEVCVLPANHPLSQKSQLTPEDFHEQKFISLSITDSYRQLIDTIFSEHHVNRNMIMETHSAASICAMISEGIGMSVVNPLTALDYLDKNAGICVRPFSIDIPFTVSLIKPIHRPFSEPVEIFITHLKQQTGQFPLKLALAFQH

SEQ ID NO: 10093 - protein, 427 aa, Xenorhabdus bovienii
  Peptide sequence Name=Xb4151_4152.C443.gene296.pep
  Gene classification: Gene name=LysA; Function=Diaminopimelate decarboxylase; Function class=E Amino acid transport and metabolism
  Homolog annotation: Query=15..418bp; Hit=13..411bp; Blast score=591; Percent Identity=69.0; E value=1e-169; Homolog= ZlysA COG0019
MTISTLTGFSGEKFTPENLLRLPVDYGTPLWVYDSDIIIRKINRLKRFDIIRFAQKACSNTHILSLMRAQGVKVDAVSLGEIERALYAGYQPGRDRSEIVFTADLIDEITLNRVIELDIPVNVGSIDMLEQIGTRQSGHPIWLRINPGFGHGHSQKTNTGGENSKHGIWFQDLPLAIEKVRQYGLKLVGLHMHIGSGVDYQHLANVCNAMVEQVISCGEDIQAISAGGGLSIPYKTGDEIVDTEHYYSLWHKARQRIERHLGHHVELEIEPGRFLVAESGILMAEVRAVKPMGSRHYVLVDAGFNDLMRPTMYGSYHHISVLSVNSQHIDEAVSQDAELHETLVAGPLCESGDVFTQSAGGDVVPRLLPRVCVGDYLIFHDTGAYGASMSSNYNSRPLIPEILFIEGDARLIRRRQTIEELLALEAV

SEQ ID NO: 10094 - protein, 678 aa, Xenorhabdus bovienii
  Peptide sequence Name=Xb4151_4152.C443.gene297.pep
  Gene classification: Gene name=CaiA; Function=Acyl-CoA dehydrogenases; Function class=I Lipid metabolism
  Homolog annotation: Query=1..678bp; Hit=150..826bp; Blast score=1137; Percent Identity=80.0; E value=0; Homolog= yafH COG1960
MANDFQISHELADLPPELWTYLKENRFFAMIIKKEYGGLDFSAYAQSQVLQKLSGVSGILAITVGVPNSLGPGELLQHYGTDEQKKHYLPGLARGEEIPCFALTSPEAGSDAGAIPDTGVVCMGEWQGEQVLGMRLNWNKRYITLAPIATVLGLAFKLYDPEHLIGNTESLGITCALIPTNTPGVEIGNRHFPLNVPFQNGPTRGKDIFVPIDYIIGGPKMAGQGWRMLVECLSVGRGITLPSNATGGLKSAAMAIGAYSYIRRQFKLPIGKMEGIEEPLARIAGNTYLMDAAATMITGGIMLGEKPAVLSAIVKYHCTHRGQRSIIDAMDIAGGKGICLGPSNFLARAYQGAPIAITVEGANILTRSMIIFGQGAIRCHPYVLAEIAAAENNNVKAFDKALFGHLGHVASNTLRSLWLGITNGRTSRTPVSDATRRYYQHINRLSANLALLSDVSMGVLGGSLKRRERISARLGDILSQIFLATAALKRYEDEGRQKEDLPLLQWAVEDSLYQAEQALNDLLRNFPNRLVAGLMRVMVFPLGRSHTAPSDKLDHKLAQILQTPSATRSRIGRGQYLTPSEHNPHGLLEEALHDIIAAEPIHARLSREAGKNLSFTRLDQLAERALADHKITQEEADILKRAENSRLRSINVDEFEPDAFAVPHSAKKPESQRQTKAA

SEQ ID NO: 10095 - protein, 119 aa, Xenorhabdus bovienii
  Peptide sequence Name=Xb4151_4152.C443.gene298.pep
  Gene classification: Gene name=CaiA; Function=Acyl-CoA dehydrogenases; Function class=I Lipid metabolism
  Homolog annotation: Query=1..91bp; Hit=13..103bp; Blast score=99; Percent Identity=53.0; E value=7e-22; Homolog= yafH COG1960
MTALSIILFLVLIGGLCYRKVSLSASSLLLVAYTLVMGITGLWSYWLLLPLAIILFPLVFTPTRISLFSAPGLKAFRKVMPSMSTTRKKPLMQEQPGGKVSCSVVILIGKNCTAIRNHS

SEQ ID NO: 10096 - protein, 50 aa, Xenorhabdus bovienii
  Peptide sequence Name=Xb4151_4152.C443.gene299.pep
MRKTYLSIYLHLNYNLAHKVIVVCCVKISLRCDGIFFQERESVTLIGRFY

SEQ ID NO: 10097 - protein, 193 aa, Xenorhabdus bovienii
  Peptide sequence Name=Xb4151_4152.C443.gene300.pep
  Gene classification: Gene name=GmhA; Function=Phosphoheptose isomerase; Function class=G Carbohydrate transport and metabolism
  Homolog annotation: Query=1..192bp; Hit=1..192bp; Blast score=337; Percent Identity=88.0; E value=5e-93; Homolog= gmhA COG0279
MYQDLIRSELSEAADTLAKFLNDDANIDAIQQAAVLLADSFKAGGKVLSCGNGGSHCDAMHFAEELTGRYRENRPGYPGIAISDPSHLSCVSNDFGYDYVFSRYLEAVGQKGDVLLGISTSGNSGNIIKAIEAARAKGMKVITLTGKDGGKMAGTADVEIRVPHFGYADRIQEIHIKVIHILIQLIEKEMVKD

SEQ ID NO: 10098 - protein, 255 aa, Xenorhabdus bovienii
  Peptide sequence Name=Xb4151_4152.C443.gene301.pep
  Gene classification: Function=Predicted glutamine amidotransferase; Function class=R General function prediction only
  Homolog annotation: Query=1..255bp; Hit=1..255bp; Blast score=411; Percent Identity=74.0; E value=1e-115; Homolog= yafJ COG0121
MCELLGMSANVPTDIVFSLSGLIQRGGYTGPHKDGWGITFYEGLGYRTFKDHQSSYHSPVARFVQSYPIKSEVIVAHIRQANRGNVSLVNTHPFTRELWGKYWTYAHNGQLQGYRNLKTGNYRPVGETDSEWAFCWILQQLSLKYPKRPSNWPAVFRFIASLAGELKKKGVFNMLLSDGQFVMAYCSTQLHWITRKAPFGTAKLLDQDVEIDFQQHTHPGDVVSVIATQPLTGNEDWQRIEPGSYELFYFGERVV

SEQ ID NO: 10099 - protein, 67 aa, Xenorhabdus bovienii
  Peptide sequence Name=Xb4151_4152.C443.gene302.pep
  Homolog annotation: Query=1..61bp; Hit=180..240bp; Blast score=74; Percent Identity=57.0; E value=3e-13; Homolog= gi|37525163|ref|NP _928507.1| hypothetical protein [Photorhabdus luminescens subsp. laumondii TTO1] gi|36784589|emb|CAE13489.1|
MTQQNMQRYRNNDNYSFWIQLQPAYEYFAKNSKPTTVNVIDGQYIVSTKSESSLLLSKSTQTTRSPK

SEQ ID NO: 10100 - protein, 425 aa, Xenorhabdus bovienii
  Peptide sequence Name=Xb4151_4152.C443.gene303.pep
  Homolog annotation: Query=59..419bp; Hit=6..372bp; Blast score=262; Percent Identity=40.0; E value=8e-69; Homolog= gi|16131356|ref|NP _417941.1| putative receptor [Escherichia coli K12] gi|140772|sp|P28912|YHHI_ECOLI H repeat-associated prot
LDPKRIIIVIAITLHILLRHPERVNIYSGQSHLKFIDNGLISCRYAAFKSILMSSVSPLLQHFASLEDPRVQRTQLHSLENILTIAICAVICGAEGWVEIEEFGESKQDFFTQLLDLTNGIPSHDTFGRVFAALDAQAFADCFTSWISTLAQGVDQDIIAIDGKTMRRSLDKANGKAAIHLVSAFACTNRLVLGQVKVESKSNEITAIPELLRRLVLSGSLVTIDAMGCQKAIAHQLHEAGADYVLSLKENHPGLYNDVSHYFDYVSSQPEHLSEYEDVDAGHGRIERRTVQMTHVDWLPEKACWCGLHSIIRVIRERYVGNEVSRESCYFISTLRPTEAQRAATAIRSHWQIETQLHWCLDIAFNEDQQRMREGNAAANMALLNKIALNLLRLAPTKAGIKARRKRAGWDGEYLLTVLGKAHQI

SEQ ID NO: 10101 - protein, 180 aa, Xenorhabdus bovienii
  Peptide sequence Name=Xb4151_4152.C443.gene304.pep
  Gene classification: Function=Uncharacterized BCR; Function class=S Function unknown
  Homolog annotation: Query=1..175bp; Hit=1..173bp; Blast score=174; Percent Identity=51.0; E value=4e-44; Homolog= yafK COG3034
MKKTAFYLSLLLLFHMSCSALAQSTPSWLQSPNERRPLKQPGAEIFIQIFKEEKVLELYTKDNTDHYQLAQSYPICNYSGGLGPKTLTGDFKSPEGFYHVNLKQLKPNSRYYRAINLGFPNEFDKFRGYSGNNLMIHGGCKSIGCYAMTDRYIDEIYRYAESAISYGQDEIKINIQGNRI

SEQ ID NO: 10102 - protein, 31 aa, Xenorhabdus bovienii
  Peptide sequence Name=Xb4151_4152.C443.gene305.pep
MSQVIHSDNRYNFLLIFSDGNSNISPHKLSD

SEQ ID NO: 10103 - protein, 447 aa, Xenorhabdus bovienii
  Peptide sequence Name=Xb4151_4152.C443.gene306.pep
  Gene classification: Gene name=NqrA; Function=Na+-transporting NADH; Function class=C Energy production and conversion
  Homolog annotation: Query=1..447bp; Hit=1..447bp; Blast score=598; Percent Identity=65.0; E value=1e-171; Homolog= NMA0752 COG1726
MIKIKKGLNLPIAGAPAQVIEDGPTIRHVALLGEEYVGMRPSMLVKEGEHVKKGQILFEDKKNPGVIFTSPASGKIITIGRGERRVLQSVVIEVSGDEQVMFDRYDRTELAGLTREQVENNLLISGLWTALRTRPFSHSPAPGSTPKAIFVTAIDTQPLAADPLVVIATQEEAFVDGLNILSILTDGKVHVCHGAGNIPNAGNNTQITYNQFAGPHPAGLVGTHIHFIEPVSAKKSVWHLGYQDVIAIGKLFTTGELYTDRVVSLAGPQVKSPRLVRSRLGADLQELTQDQLKEGENRIVSGSVLCGTKSDGVRHYLGRFHTLVSVLAEGREKELFGWIAPGVNKFSITRTTIGHFLKNKRFAFSTSTNGGERSMVPIGNYERVMPLDIMATHLLRDLLAGDSDSAQALGCLELDEEDLALCTYVCPGKYEYGPVLRDVLTKIEQEG

SEQ ID NO: 10104 - protein, 412 aa, Xenorhabdus bovienii
  Peptide sequence Name=Xb4151_4152.C443.gene307.pep
  Gene classification: Gene name=NqrB; Function=Na+-transporting NADH; Function class=C Energy production and conversion
  Homolog annotation: Query=1..411bp; Hit=13..423bp; Blast score=602; Percent Identity=75.0; E value=1e-172; Homolog= VC2294 COG1805
MGLKNLFEKVEHHFEAGGKLEKYYPLYEAVSTVFYTPGTVTRGRAHVRDAIDLKRMMILVWLSVFPAMFWGMYNVGNQAIPALTHLYSGEALQQVLASDWHYVVAQYLGASLTPDAGWDSKMLLGATYFLPIYAVVFAVGGFWEILFAMIRRHEINEGFFVSSILFALIVPPTLPLWQAALGITFGVVIAKEIFGGTGRNFLNPALAGRAFLFFAYPAQISGDLAWTAADGFSGATPLSQWANAGSHGLMNTITSQPVTWMDAFIGNIPGSIGEVSTLMIFIGGAIILFTRIASWRIVAGVMVGMIAMSYLFNAIGSSTNPMFSMPWYWHMVLGGFAFGMIFMATDPVSAAFTDKGKWAYGILIGVMCILIRVVNPAYPEGMMLAILFANLFAPLFDYLVVQANIKRRKARG

SEQ ID NO: 10105 - protein, 264 aa, Xenorhabdus bovienii
  Peptide sequence Name=Xb4151_4152.C443.gene308.pep
  Gene classification: Gene name=NqrC; Function=Na+-transporting NADH; Function class=C Energy production and conversion
  Homolog annotation: Query=8..261bp; Hit=4..256bp; Blast score=283; Percent Identity=56.0; E value=1e-76; Homolog= VC2293 COG2869
VANEKPKNNDSIGRTFLVVFVLCLVCSIVVAGAAVGLKAQQQEQKLLDKQRNILDVAGLLKPNMTTAEIKETYSSRIQPELLDLKTATLEKGDGKFDLKNALRSDETSMALPSEQDLARIHRRANMAEIYLVKDGQGKTTELVLPVYGSGLWSMMYAFISIDVDGVTSRGITYYSHGETPGLGGEVDNPQWRKQWVGKKLYNSQGVPAIKVVRGGAGDNPYGVDGLSGATLTSNGVQHMFDFWLGDNGFGPFLKKVREGALKDG

SEQ ID NO: 10106 - protein, 209 aa, Xenorhabdus bovienii
  Peptide sequence Name=Xb4151_4152.C443.gene309.pep
  Gene classification: Gene name=NqrD; Function=Na+-transporting NADH; Function class=C Energy production and conversion
  Homolog annotation: Query=1..208bp; Hit=1..208bp; Blast score=290; Percent Identity=75.0; E value=6e-79; Homolog= NMB0566 COG1347
MADSKEVKRVLLGPLFDNNPIALQVLGVCSALAVTTKLETALVMTIAVTLVTAFSSFFISLIRNYIPGSVRIIVQMAIIASLVIVVDQILQAYAYEISKQLSVFVGLIITNCIVMGRAEAYAMKSPPVESFMDGIGNGLGYGVILLLVGFLRELFGSGKLLGMTVLESVKNDGWYQPNGLFLLAPSAFFIIGMLIWGLRTLKPAQVEKE

SEQ ID NO: 10107 - protein, 198 aa, Xenorhabdus bovienii
  Peptide sequence Name=Xb4151_4152.C443.gene310.pep
  Gene classification: Gene name=NqrE; Function=Na+-transporting NADH; Function class=C Energy production and conversion
  Homolog annotation: Query=1..198bp; Hit=1..198bp; Blast score=274; Percent Identity=84.0; E value=4e-74; Homolog= VC2291 COG2209
MEHYISLFVRAVFIENMALAFFLGMCTFLAVSKNVKTAFGLGVAVTVVLGISVPANNLVYNLVLRDGALMDGVDLSFLNFITFIGVIAALVQILEMILDRYVPALYNALGIFLPLITVNCAIFGGVSFMAQRDYNFSESVVYGFGSGMGWMLAIVLMAAIREKMKYADVPAGLKGLGITFVTTGLMALGFMSFSGVQL

SEQ ID NO: 10108 - protein, 408 aa, Xenorhabdus bovienii
  Peptide sequence Name=Xb4151_4152.C443.gene311.pep
  Gene classification: Gene name=NqrF; Function=Na+-transporting NADH; Function class=C Energy production and conversion
  Homolog annotation: Query=4..408bp; Hit=3..405bp; Blast score=655; Percent Identity=80.0; E value=0; Homolog= NMA0747 COG2871
MDIIILGVVMFTLIVLALTAMILFAKSKLVNTGNIKIEVNGDEEKSFTAPAGDKLLNMLSNQGVFVSSACGGGGSCGQCRVKIKEGGGDILPTELSHINKREAKEGCRLACQVNVKQDLKIELPEEIFGVKKWECEVISNDNKATFIKELKLKIPDGEVVPFRAGGYIQIECPPHVARYADYDVPEEYREDWDKFNLFRYVSEVKEPTVRAYSMANYPEEHGIIMLNVRIATPPPRNPDVTPGIMSSYIWSLKAGDKVTISGPFGEFFAKDTKAEMVFIGGGAGMAPMRSHIFDQLSRLNSKRKISFWYGARSKREMFYTEDFDQLAAKNDNFNWHVALSDALPEDNWDGYTGFIHNVLFENYLKDHPAPEDCEFYMCGPPVMNAAVIKMLKDLGVEDENIMLDDFGG

SEQ ID NO: 10109 - protein, 343 aa, Xenorhabdus bovienii
  Peptide sequence Name=Xb4151_4152.C443.gene312.pep
  Gene classification: Gene name=ApbE; Function=Membrane-associated lipoprotein involved in thiamine biosynthesis; Function class=H Coenzyme metabolism
  Homolog annotation: Query=3..341bp; Hit=31..367bp; Blast score=414; Percent Identity=63.0; E value=1e-116; Homolog= VC2289 COG1477
MLSKKIIHWGVLMFTVLLLSACGGPEQQNLSGQTMGTYYSVKYVADSSIPSPENLQKEIDRLLEEVNDQMSTYRPNSELSRFNQSREVNTPFLVSAATAKVVKEAIRINQLTDGALDVTVGPLVNLWGFGPEGRITKAPTDEELVMRRAWTGIDKLSVEGNSLIKSIPELYVDLSSIAKGYGVDVVAEYLASQNIKNFMVDIGGEVRTLGNNGKGAPWRIAIEKPSDSGIEQRAQEIIEPDRMSIATSGDYRNYFEQNGVRYSHTINPKTSRPITHNLVSITVIAPTCMSADGFSTGLDVLGPDKGMEVAEKLKIPVFMVVKTQDGFEERYSSAFKPYIQQKK

SEQ ID NO: 10110 - protein, 139 aa, Xenorhabdus bovienii
  Peptide sequence Name=Xb4151_4152.C443.gene313.pep
MALKSAIVQPLSHTYNRRNEEERLWKSLLQPLSFSCWLLQEWHWATFLSVKVFREVVVVWGVLVWRKFVIAQNPAIPVKNAWQEKLLVMRSWKKTEFFEVFFVVKKFSAKKCDPLPDTQRVFVGCSDDVERVTFAVSLL

SEQ ID NO: 10111 - protein, 50 aa, Xenorhabdus bovienii
  Peptide sequence Name=Xb4151_4152.C443.gene314.pep
  Homolog annotation: Query=Organism:..not_definedbp; Hit=..bp; Blast score=; Percent Identity=; E value=; Homolog= Pa|Phot5-381a01.p1k _g14| 18705 - 19223 224 172 aa, chain +
LPKKARRAFLLTQLQGMCYKEVAKNLDVSMSSVKNYLQQAHSKCHSLNII

SEQ ID NO: 10112 - protein, 92 aa, Xenorhabdus bovienii; identical to SEQ ID NO: 6203
  Peptide sequence Name=Xb4151_4152.C443.gene315.pep

SEQ ID NO: 10113 - protein, 96 aa, Xenorhabdus bovienii; identical to SEQ ID NO: 5468
  Peptide sequence Name=Xb4151_4152.C443.gene316.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 10114 - protein, 70 aa, Xenorhabdus bovienii
  Peptide sequence Name=Xb4151_4152.C443.gene317.pep
MSQFEKLPFGDKTPLILIFGGIFLLAVSILKWMTSDIEVDWLYNSIESLLAIYLVNLGIRLRKKYRNNNE

SEQ ID NO: 10115 - protein, 162 aa, Xenorhabdus bovienii
  Peptide sequence Name=Xb4151_4152.C443.gene318.pep
  Gene classification: Gene name=WecD; Function=Histone acetyltransferase HPA2 and related acetyltransferases; Function class=K Transcription
  Homolog annotation: Query=24..158bp; Hit=1..134bp; Blast score=85; Percent Identity=33.0; E value=2e-17; Homolog= mlr1969 COG0454
MCSILVLLICSHLECGMLIALVDINKDNYEAVCDLSVTDEQLEYIAENVFSLAQSKFFPSYETRAIYLDGTPVGFFMWVPSDTGQKTTIWRFMVDKSHQNKGIGRKALSLAIEEIRRTEQLEEIEICYDPNNLVAKNFYASFGFIEVGIDEEVKEMLAVIRV

SEQ ID NO: 10116 - protein, 36 aa, Xenorhabdus bovienii
  Peptide sequence Name=Xb4151_4152.C443.gene319.pep
MSIGYNYNLYLEFQGLALAGLFIAKKTDKNCHSLWL

SEQ ID NO: 10117 - protein, 165 aa, Xenorhabdus bovienii
  Peptide sequence Name=Xb4151_4152.C443.gene320.pep
MTCDWVKMDFMLSFDLFIGTANATLQGSEGHVAWGYVKDGYKWDEQEWSKSFGDLKVIQNKTGIVETTSFYWHVNREHSDGVILWLAYSDTSQESFHNLINFFQTKELHITVDGMTYNLGKSLDITTKPEYGHVIDNTYKNNDAKKLGAILKHTGVTKRLYVNWI

SEQ ID NO: 10118 - protein, 92 aa, Xenorhabdus bovienii; identical to SEQ ID NO: 8540
  Peptide sequence Name=Xb4151_4152.C443.gene321.pep

SEQ ID NO: 10119 - protein, 96 aa, Xenorhabdus bovienii; identical to SEQ ID NO: 5468
  Peptide sequence Name=Xb4151_4152.C443.gene322.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 10120 - protein, 102 aa, Xenorhabdus bovienii
  Peptide sequence Name=Xb4151_4152.C443.gene323.pep
  Homolog annotation: Query=1..99bp; Hit=1..106bp; Blast score=99; Percent Identity=53.0; E value=1e-20; Homolog= gi|37526431|ref|NP _929775.1| hypothetical protein [Photorhabdus luminescens subsp. laumondii TTO1] gi|36785862|emb|CAE14913.1| u
MSEINKPEKTSANQNCFINPDQYKNHDVVAPVGSYPWAIIQLYLGNLMYRNDWDYPNEYIGLVPESGEGDNLPYVIKKRIHNNFEQWQPAQEDMMACDWVMY

SEQ ID NO: 10121 - protein, 153 aa, Xenorhabdus bovienii
  Peptide sequence Name=Xb4151_4152.C443.gene324.pep
  Homolog annotation: Query=7..149bp; Hit=78..218bp; Blast score=104; Percent Identity=37.0; E value=5e-22; Homolog= gi|15802443|ref|NP _288469.1| putative antiterminator Q homolog of prophage CP-933U [Escherichia coli O157:H7 EDL933] gi|15832
MRKQPKPPINPITYRGSSWRRAVLAMDKPKLAWVLYCYAHSLDYRYQVEICEYLWGGFLAGQTNRRLSIKVSTRLKGLVWLAVQQRAKGCRSENFLSYTRSELASLTGVSLYNWKNNYAAHWIALVELCENMDREALQDIIRLRIKQKSDHDL

SEQ ID NO: 10122 - protein, 49 aa, Xenorhabdus bovienii
  Peptide sequence Name=Xb4151_4152.C443.gene325.pep
MTKWYSHDLQYVRTQIIPALFDIAGETKGQLAAFEDSPLTCTDHYNCDT

SEQ ID NO: 10123 - protein, 335 aa, Xenorhabdus bovienii
  Peptide sequence Name=Xb4151_4152.C443.gene326.pep
  Homolog annotation: Query=16~similar..tobp; Hit =[SwissProt..Accessionbp; Blast score=Q06262]; Percent Identity =[Escherichia; E value=coli] gi|1742589|dbj|BAA15291.1|; Homolog= gi|20140526|sp|P76162|YDFU_ECOLI Hypothetical protein ydfU gi|17
MNYLLTPHIVRDLGLVVFKPGRHLLDGFYGRMLLTPEPAVLRSAPSGQVTEGQWLASDKRLYPFFQHERVIKVAGGLEGMKHYIAQTISFCQAADEENYHHNLLTITVYNNSAVRTCWHHDNQCRDGSDRIQNAAEQNLYQWVLHNVISDFRLPAHHQVTWPELFSWAVIHRVADLLPSFISHRALQRADDHGEKIGSTTSEHDIRWEPLTSQDIVNERVEQVKNVLTAEVDAEPPASFMRLPKLQRWRNTQWLKWVKSQPCAACQRPADDPHHIIGHGQGGMGTKAHDLFCLPLCRECHDDLHRDRLAWEEKHGSQVDLLFRFLDRSLGIGAIK

SEQ ID NO: 10124 - protein, 226 aa, Xenorhabdus bovienii
  Peptide sequence Name=Xb4151_4152.C443.gene327.pep
  Gene classification: Function=Uncharacterized phage-encoded protein; Function class=S Function unknown
  Homolog annotation: Query=96..221bp; Hit=103..227bp; Blast score=147; Percent Identity=59.0; E value=1e-35; Homolog= Z1797 COG3645
MASLMAYGLTMSSREIADLVESRHDSVKRTVERLAERAVIQLPPMVEVKNHQNQTTYEYRIGKRDSYVIVAQLSPEFTARLVDCWQALEQHQISHIPQTLPDALRLAADLAEHNQALESQLADAAPKVAFVDRYVDARGSMTFRQVCKLIEAKEPEFRGFLLDRRIMYRLNGTMLPYQNHIDAKRFEVKTGTNITNAHAFTQSRFTTKGIRWVAGLWAEYKVGYMA

SEQ ID NO: 10125 - protein, 78 aa, Xenorhabdus bovienii
  Peptide sequence Name=Xb4151_4152.C443.gene328.pep
MFQRSKMVYGVNIFPLLVMAYQLRRRWSLRQLRGHWCEGQILLKIIRQSQRDWPYFNFEIHYQDLRKRVKRGQGKGVI

SEQ ID NO: 10126 - protein, 205 aa, Xenorhabdus bovienii
  Peptide sequence Name=Xb4151_4152.C443.gene329.pep
MTFALDIAENDIPEEPNDPAHQVLNYFNQATDSNYRDGKTSMGYIRARLSEGYATEDLILITDYLIAKWANDGKMRDYLRPKTLFSPENCAEYFDKACKWHKAERPACVNGRWLKAGEADVVIDTVERDATFRQLFSTGWTPANRIQERAAQLARKAGVGRMNEVPGLAAWRGIWKQAAEQIAKDELLSGFRVVGGSSEQNGGTA

SEQ ID NO: 10127 - protein, 120 aa, Xenorhabdus bovienii
  Peptide sequence Name=Xb4151_4152.C443.gene330.pep
  Homolog annotation: Query=12..72bp; Hit=26..86bp; Blast score=93; Percent Identity=62.0; E value=6e-19; Homolog= gi|16759888|ref|NP _455505.1| putative methyltransferase [Salmonella enterica subsp. enterica serovar Typhi] gi|29142339|ref|NP_
MSGIVRFLGNVIFCDIQRERHILCDGRELNIAPDIVCDFRSLPFASNTFQLVVFDPPHLERAGENGWQRKKYSERPKNLNDILTTELNNIIFDATREGKATLAGVAKVILENSYQKGEKQ

SEQ ID NO: 10128 - protein, 89 aa, Xenorhabdus bovienii
  Peptide sequence Name=Xb4151_4152.C443.gene331.pep
MRMNTAFLLMAEFETSQIPLSTIAEKYLELTPATAERKAIEGKLKFPTYRMNDSQKSPRIVHVHDLAEYIDKQRELAAKEVERMQFKKK

SEQ ID NO: 10129 - protein, 54 aa, Xenorhabdus bovienii
  Peptide sequence Name=Xb4151_4152.C443.gene332.pep
MQVSCQTEIKGKMLMLDKSQRIDSGSVSKRRYNPAIFLSAGYIQWGLFYYISTN

SEQ ID NO: 10130 - protein, 361 aa, Xenorhabdus bovienii
  Peptide sequence Name=Xb4151_4152.C443.gene333.pep
  Gene classification: Gene name=PurM; Function =Phosphoribosylaminoimidazol (AIR) synthetase; Function class=F Nucleotide transport and metabolism
  Homolog annotation: Query=9..359bp; Hit=1..344bp; Blast score=584; Percent Identity=80.0; E value=1e-167; Homolog= purM COG0150
MQPPGGYAVTNKTSLSYKDAGVDIDAGNTLVNRIKGVVKQTRRPEVMGGLGGFGALCALPQKYREPILVSGTDGVGTKLRLAMDLKRHDTIGVDLVAMCVNDLVVQGAEPLFFLDYYATGKLDVDTAASVITGIAEGCKQAGCALVGGETAEMPGMYHGEDYDVAGFCVGVVEKSEIIDGSQVQVGDALIALASSGPHSNGYSLIRKILDVSQTNPETAELEGKSLADHLLVPTRIYVKPVLELIEQFEIHAIAHLTGGGFWENIPRVLPENMQAKINASSWQWPAIFTWLQQAGNVSNHEMYRTFNCGVGMIIALPQSLAEQAVEWLNAAGENAWQIGTITEFDTNTELNTNEQQVIISE

SEQ ID NO: 10131 - protein, 215 aa, Xenorhabdus bovienii
  Peptide sequence Name=Xb4151_4152.C443.gene334.pep
  Gene classification: Gene name=PurN; Function=Folate-dependent phosphoribosylglycinamide formyltransferase PurN; Function class=F Nucleotide transport and metabolism
  Homolog annotation: Query=7..215bp; Hit=3..211bp; Blast score=298; Percent Identity=68.0; E value=2e-81; Homolog= purN COG0299
MKTMKKIVVLVSGNGSNLQSIIDASQQNRINGHICAVFSNNDNAYGLQRAEQADIPAHFLNPQAFSDRTAYDCALLTAIDQYQPDLVVLAGYMRILSPDFVQHYCGRMLNIHPSLLPKYPGLHTHRKAIENGDQEHGTSVHFVTEQLDGGPVILQAKVPIFEEDQEEDVIRRVQVQEHDIYPLVIGWFLDGRLGMSDNVAILDGKILPQQGYASE

SEQ ID NO: 10132 - protein, 187 aa, Xenorhabdus bovienii
  Peptide sequence Name=Xb4151_4152.C443.gene335.pep
  Gene classification: Gene name=RimL; Function=Acetyltransferases, including N-acetylases of ribosomal proteins; Function class=J Translation, ribosomal structure and biogenesis
  Homolog annotation: Query=10..182bp; Hit=7..179bp; Blast score=263; Percent Identity=76.0; E value=9e-71; Homolog= speG COG1670
MSSGSENPPVNLRPLEREDLPFAHQIDNNASVMRYWFEEPYEAFVELCDLYDKHIHDQSERRFIIESMNAKVGLVELVEIDYIHRRAEFQIIITPAYQGQGYATKAAKLAMEYAFCVLNLYKLYLIVDKENEKAIHIYNKLGFHTEGELIDEFFINGSYHTAIRMCTFQHHYFANKACESQTSSLAH

SEQ ID NO: 10133 - protein, 689 aa, Xenorhabdus bovienii
  Peptide sequence Name=Xb4151_4152.C443.gene336.pep
  Gene classification: Gene name=Ppk; Function=Polyphosphate kinase; Function class=P Inorganic ion transport and metabolism
  Homolog annotation: Query=1..686bp; Hit=1..688bp; Blast score=1084; Percent Identity=79.0; E value=0; Homolog= ppk COG0855
MSHDRLYNEKELSWLSFNERVLQEAADKSNPLIERMRFLGIYSNNLDEFYKVRFADVKRRILISEERGSATSGRQLLKKIQAKVVKIDQEFDELYNDLLLEMARNQIFLINERQISPNQQIWLRQYFRQHLRPHITPIVINPETNLVEFLKDDYTYLAIEIIRGQETKYALLEIPSDKVPRFVNLPPEMPRRRKSMILLDNILRYTLDEIFKGFFDYDTLNVYSMKMTRDSEYDLATEMESSLLELMSSTLKQRLTAEPVRFVYQRDMPDEMVDLLRSKLGLSNDDSVIAGGRYHNFKDFIKFPNEGNRNLLNKTMPRLRHTWFEHFRNGFDAIREQDVLLYYPYHTFEHVLELLRQASFDPSVLSIKINIYRVAKDSRIIDSVIHAAHNGKKVTVVVELQARFDEEANIHWAKRLTEAGVHVIFSAPGLKIHAKLFVISRLEGDEIVRYAHIGTGNFNEKTARSYTDYSLLTAKPEVTNEVRRVFNFIENPYRPVTFENLMVSPQNSRAMLNQLITQEIENAKAGEAAGITLKINNLVDKELVDRLYDASEAGVKVRLLIRGMCSLVPNQAGFSENIQVTSIVDRFLEHDRVYVFTNKGDEKVFLSSADWMTRNIDYRIEVAVCLLDPQLKQRVLDILELQFSDTVKARYIDKELSNRYVPRGNKRKIRAQIAVYDYLKTLEQPEPRA

SEQ ID NO: 10134 - protein, 510 aa, Xenorhabdus bovienii
  Peptide sequence Name=Xb4151_4152.C443.gene337.pep
  Gene classification: Gene name=GppA; Function=Exopolyphosphatase; Function class=F Nucleotide transport and metabolism
  Homolog annotation: Query=1..509bp; Hit=1..507bp; Blast score=721; Percent Identity=71.0; E value=0; Homolog= ppx COG0248
MPLKHDKPMPKPMEIATIDLGSNSFHMVIARIVNGALQVIGRLKKRVHLADGLNSKNELSEEAINRGLACLSLFAERLQGFSPNNVCLVGTHSLREATNAQEFLKRAKEVIPYPIEIISGHEEARLIFMGVEHTQPEKGRKLVIDIGGGSTELVIGEDFEPLLIESRRIGCVSFSRQFFPDNIINEQNFRRARLQAAQKLENLVWQFRMKGWDFALGASGTIKAVQELLVGLGEKDGLITPERLNMLVKRVLKYKNFKSLDLPGLSEDRKQTFVSGLAILCGVFDVLHIQELRLSDGALREGVLYEMEDRFRHQDIRQRTAKSLADHYNIDREQAERVWSTAKTLYDQWVTQNPKRLQPQLESILLWAAMLHEVGLSINLSGLQRHSAYILQHTDLPGFNQEQQSLLATLVRYHRKAIKVHEHPRFYLFKKKQYLPMLQILRLATLLNNQRQSTTTPESLRLDTSHGHWTLYLPQNYLIKNALMQLDLEKEQAYWSDVVGWYLHIKEETA

SEQ ID NO: 10135 - protein, 487 aa, Xenorhabdus bovienii
  Peptide sequence Name=Xb4151_4152.C443.gene338.pep
  Gene classification: Gene name=MgtE; Function=Mg/Co/Ni transporter MgtE (contains CBS domain); Function class=P Inorganic ion transport and metabolism
  Homolog annotation: Query=45..487bp; Hit=38..482bp; Blast score=465; Percent Identity=54.0; E value=1e-131; Homolog= PA0913 COG2239
MLQPAFKSGNSTVASQHSQKLAVVRQRLLSLFINDKLFVDTLLGQADEHSTISDEQLLEKIEEVSAQLANLHAADIADILEALPYDERLALWRLIDNNQRGEVLVEASIPVWDNLIKDMSDLELLKAIGTLHVDEQAYIAEYLPRDTTRRLLTYLEPSQRNRIREVLQYHKDSIGQMMDFEFVTVRSNITLSTVQRFLRSRGSIPDATDKIFVIDRKNRLQGELPLTTLLTNAPDKLVAEVMNTETVTFLPEQKGEDAASAFERYDLISAAVVDNNGRLMGRLTVEDIVDTLSEETDTNIRRMGGLSRQEDVFAPVGQTVKTRWTWLAINLCTAFIASRVIGLFEHTISQLVALATLMPIVAGIGGNTGNQTITMIVRALALHQIQSGSFSYLLLREFGVALINGVIWGGIMGVVTYLLYGDLAMGGVMTMAMILNLLMAALMGVLIPFIMMKLGRDPAIGSSVMITAMTDTGGFFIFLGLATLFLI

SEQ ID NO: 10136 - protein, 82 aa, Xenorhabdus bovienii
  Peptide sequence Name=Xb4151_4152.C443.gene339.pep
LCRYPVCQRADFCPIETVASLPTSPQSPAFLSGSRSDHNVWLRRRAFLSLISELIPPFSQCKINCYMSYRVLFFVCTYMCAF

SEQ ID NO: 10137 - protein, 32 aa, Xenorhabdus bovienii
  Peptide sequence Name=Xb4151_4152.C443.gene340.pep
MVGGTLTKSICLWLTDKTMSLKGTILPFNLTS

SEQ ID NO: 10138 - protein, 70 aa, Xenorhabdus bovienii
  Peptide sequence Name=Xb4151_4152.C443.gene341.pep
MQDKKPDVPVSEDSNLVIVTTPEYVKDSIKEAIAAHATSRNHPYATQAEPGFVTLNNEVNSDSELTVATL

SEQ ID NO: 10139 - protein, 260 aa, Xenorhabdus bovienii
  Peptide sequence Name=Xb4151_4152.C444.gene1.pep
  Homolog annotation: Query=1..259bp; Hit=5..258bp; Blast score=229; Percent Identity=51.0; E value=4e-59; Homolog= Pa|Phot5-499g08.q1k _g3| 3833 - 4609 354 258 aa, chain - [Photorhabdus asymbiotica]
MNRHHLSAAIFDHHQIEDKFFSSISQMHAHISEHVRAYVTGLGTYALNFLLVTDGQMKTEEVLKMAIQLMDESVSVPFGIFAVEPDSKTLEVIKQAGFVPDPDGTTTAMWLDLANWQMGEGAFLAYEIRNVDHCLADWAIPIESAFETGSMLSGQYQICHQAALDAGKCLQHYALYVDGQPLCALTLSRMDNIVRLDDIGTVVGKQGKGYASALINYVLHEAKQYGAGACYLDASHDGNALYQRIGFKPLFEYQGFIRES

SEQ ID NO: 10140 - protein, 616 aa, Xenorhabdus bovienii
  Peptide sequence Name=Xb4151_4152.C444.gene2.pep
  Gene classification: Gene name=RpoD; Function=DNA-directed RNA polymerase sigma subunits (sigma70/sigma32); Function class=K Transcription
  Homolog annotation: Query=1..616bp; Hit=1..613bp; Blast score=963; Percent Identity=90.0; E value=0; Homolog= ZrpoD COG0568
MEQNPQSQLKLLVTRGKEQGYLTYAEVNDHLPEDIVDSDQIEDIIQMINDMGIQVMEEAPDADDLMLAENTNDTDEDAAEAAAQVLSSVESEIGRTTDPVRMYMREMGTVELLTREGEIDIAKRIEDGINQVQCSVAEYPEAITYLLEQYDRVEAGECRLSDLITGFVDPNAEEDLSPTATHIGSELPQAELDDSDDDDDEESEDDADSEDDNSIDPELARQKFQELRDQYETTRQSIKSYGRSHPNTAAEILTLSEVFKQFRLIPKQFDYLVNNMRSMMDRVRLQERQIMKMCVELCKMPKKNFITLFSGNETTDTWFTAAKAMNKPWSDKLSEVEDDVMRSLQKLRQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPSPEELAERMLMPEDKIRKVLKIAKEPISMETPVGDDDDSHLGDFIEDTTLELPLDSATSESLRSATHDVLAGLTAREAKVLRMRFGIDMNTDHTLEEVGKQFDVTRERIRQIEAKALRKLRHPSRSEVLRSFLDD

SEQ ID NO: 10141 - protein, 582 aa, Xenorhabdus bovienii
  Peptide sequence Name=Xb4151_4152.C444.gene3.pep
  Gene classification: Gene name=DnaG; Function=DNA primase (bacterial type); Function class=L DNA replication, recombination and repair
  Homolog annotation: Query=1..582bp; Hit=1..581bp; Blast score=850; Percent Identity=71.0; E value=0; Homolog= dnaG COG0358
MAGRIPRAFINDLLARTDIIDLIDIRVPLKKKGKNHQACCPFHNEKTPSFTVNADKQFYHCFGCSAHGNAIDFLMNYDRLDFVESIEELAAMHGLEVPYEANSGGGHIERHQRQNLYQLMDTINSFYQHSLTTPNGQSAQQYLLRRGLSEEIIHRFAIGFAPTGWDNVLKQFAHNAEERKQLNDAGMLVTNDNGRTYDRFRERVMFPIRDRRGRVIAFGGRVLGDALPKYLNSPETEIFHKGRQLYGLYEAQQNHNSLSRLLVVEGYMDVVALAQFGIDYAVASLGTSTTAEHVQLLFRTTDNVVCCYDGDRAGRDAAWRALETALPYLNDGRQLRFMFLPDGEDPDSLIRKEGREVFEQRMEKALTLSTFLFESLLPQVDLSTPEGTTKISSLAMPLISQVPGETLRLYLLQELGNLLGTPDTTQLERFLAKLVKKDTSTYQALKLKPTTMRILIALLVQNPHLATLVPSLQGLFSVQIAGLPLFIELVDTCLAQPGLTTGQLLEQYRDNKYAKQLEKLAAWNDIQVDEIAEKTFSDALNHLFASALDERFSFLIAKERTEGLTPEEREEVRLITESGDRK

SEQ ID NO: 10142 - protein, 71 aa, Xenorhabdus bovienii
  Peptide sequence Name=Xb4151_4152.C444.gene4.pep
  Gene classification: Gene name=RpsU; Function=Ribosomal protein S21; Function class=J Translation, ribosomal structure and biogenesis
  Homolog annotation: Query=1..71bp; Hit=1..71bp; Blast score=77; Percent Identity=100.0; E value=2e-15; Homolog= rpsU COG0828
MPVIKVRENEPFDVALRRFKRSCEKAGVLAEVRRREFYEKPTTERKRAKASAVKRHAKKLARENARRTRLY

SEQ ID NO: 10143 - protein, 345 aa, Xenorhabdus bovienii
  Peptide sequence Name=Xb4151_4152.C444.gene5.pep
  Gene classification: Gene name=QRI7; Function=Metal-dependent proteases with possible chaperone activity; Function class=O Posttranslational modification, protein turnover, chaperones
  Homolog annotation: Query=1..341bp; Hit=1..335bp; Blast score=572; Percent Identity=85.0; E value=1e-163; Homolog= ZygjD COG0533
MRVLGIETSCDETGIAIYDDRTGLLANQLYSQVKLHADYGGVVPELASRDHIRKTVPLIQAALKEAGLTSKDIDAVAYTAGPGLVGALLVGATIGRSLAFAWNVPAIPVHHMEGHLLAPMLEENTPEFPFVALLVSGGHTQLISVTGIGEYKLLGESIDDAAGEAFDKTAKLLGLDYPGGPVLARMAQHGEARRFVFPRPMTDRPGLDFSFSGLKTFAANTIRNHIHGHDSGEDEQTKADIARAFEDAVVDTLAIKCKRALEQTGFKRLVMAGGVSANRTLRTKMQEVMEKLGGEVFYARPEFCTDNGAMIALAGMMRLQGSTESALGVTVKARWPLADLPPLKK

SEQ ID NO: 10144 - protein, 324 aa, Xenorhabdus bovienii
  Peptide sequence Name=Xb4151_4152.C444.gene6.pep
  Gene classification: Gene name=SmtA; Function=SAM-dependent methyltransferases; Function class=Q Secondary metabolites biosynthesis, transport and catabolism
  Homolog annotation: Query=31..321bp; Hit=42..336bp; Blast score=83; Percent Identity=23.0; E value=3e-16; Homolog= mll8050 COG0500
MLTEMTTVYRKSIALYTFVESNAPTYLSTQDGKTAEQLAKLCHVSVDRFHRLLNYMRSLGVLLEKDDKFYLTEQCSSLSDPNSLETLHIKFELDSINWNSWAKYNASLNKENNKSAFEINHHEKFFDYFGHEKNKILKDNFDNLMSKVTNIMNEYIIEHIPLHNISSVIDVGGGYGALAKRIKENYPNIRCAVMDQYDFIKQESEGITFINGDFFSAIPSGYDAYCMKNVLHNWPDERVTDILKNCHQAMHKDSTLYIIDMIKEQSNAEAESFDLYMDVLLLGKERYQFELEALVKQVGLTITNIYKIGGSKTGGPQYVIEIKK

SEQ ID NO: 10145 - protein, 267 aa, Xenorhabdus bovienii
  Peptide sequence Name=Xb4151_4152.C444.gene7.pep
  Gene classification: Function=Predicted membrane protein; Function class=S Function unknown
  Homolog annotation: Query=49..249bp; Hit=1..201bp; Blast score=327; Percent Identity=82.0; E value=1e-89; Homolog= ygiH COG0344
MTANSSINTISITTFSPFFGSPDTTSGQMCVLSIVRVKKTTLIHWRYLMSAIALGMIIFAYLCGSISSAILICRLAGLPDPRQNGSGNPGATNVLRIGGKGAALAVLICDVLKGMIPVWLAYKLNIQPTYLGIIAIVACLGHIYPVFFRFKGGKGVATAFGAIAAIGWDLMGLIAGTWLLTVLLSGYSSLGAIVSALIAPFYVWWFKPELTFPVAMLSCLILLRHHDNIQRLWRGQESRIWQKLKKKQEMTDKEKIQAVKEQEQQDE

SEQ ID NO: 10146 - protein, 145 aa, Xenorhabdus bovienii
  Peptide sequence Name=Xb4151_4152.C444.gene8.pep
  Gene classification: Gene name=FolB; Function=Dihydroneopterin aldolase; Function class=H Coenzyme metabolism
  Homolog annotation: Query=22..139bp; Hit=1..118bp; Blast score=168; Percent Identity=71.0; E value=2e-42; Homolog= ZygiG COG1539
MDNTHIWPEVVSGEPKNGEKVVMDIVFIEELAVITTIGVYDWEQTIKQKLVFDIEMGWDNKRASSSDNVEHCLDYAKVSEAVIHRVESQRFALVERVAEEVADILLNQFHSPWVKIKVSKPGAVAQAKSVGVVIERSSNDVIING

SEQ ID NO: 10147 - protein, 393 aa, Xenorhabdus bovienii
  Peptide sequence Name=Xb4151_4152.C444.gene9.pep
  Gene classification: Gene name=PcnB; Function=tRNA nucleotidyltransferase/poly(A) polymerase; Function class=J Translation, ribosomal structure and biogenesis
  Homolog annotation: Query=1..389bp; Hit=1..405bp; Blast score=489; Percent Identity=59.0; E value=1e-138; Homolog= cca COG0617
VKVYLVGGAVRNQLLGLPVTERDWVIVGGNPEELLSQGYQQVGKDFPVFLHPKTHEEYALARTERKSGQGYTGFTCYAAPDVTLEEDLLRRDLTINAIAQTAEGELIDPYHGADDLKHRILRHVSGAFSEDPLRVLRLARFAAYFAHLSFSIAPETQSLITKMVKSGELSSLTPERVWRETEKALTSPSPQIYFQVLHDCGALAILFPEIDRLFGVAPISSWEKSSLQMDAGIHSLKALHMATQLSQEIDIRFASLCAHTEAIQVKQMCERLRIPNTARDLAVIVAQYHDWVHTAEQLPPETLLALFNAVDAWRKPQRIEQLILCSQADARAYTELEASRYPQGRYLRDAFTTVSQVNVQDVIARGFQGAEIRTELDRQRQLAITKWKQPSID

SEQ ID NO: 10148 - protein, 206 aa, Xenorhabdus bovienii
  Peptide sequence Name=Xb4151_4152.C444.gene10.pep
  Gene classification: Function=SH3 domain protein; Function class=T Signal transduction mechanisms
  Homolog annotation: Query=1..206bp; Hit=1..206bp; Blast score=224; Percent Identity=58.0; E value=6e-59; Homolog= ygiM COG3103
MQKLHRLFILFLGFTLPLSIHAEEKRYVSDELSAYIRSGPSNQHRIMGSLNSGEEVILLSSNSENGYSQVKDSKGRISWILTNELSTIPSLRERIPAMEQEIRTLTSKLANIDNNWKQRTADMQNKVSASDKIINDLKEENAKIQNKLTVAEKKVDMANLQLDDKQREIILQWFIYGGAVAGIGLILGLVLPHIIPRRKRKDRWMS

SEQ ID NO: 10149 - protein, 313 aa, Xenorhabdus bovienii
  Peptide sequence Name=Xb4151_4152.C444.gene11.pep
  Gene classification: Function=Uncharacterized ACR; Function class=S Function unknown
  Homolog annotation: Query=5..312bp; Hit=4..321bp; Blast score=209; Percent Identity=43.0; E value=2e-54; Homolog= ygiF COG3025
MRSVEVELKLSVKPDAIPAVRQQLFQFPHHYFSPQHLTNIYFETSDNQLRRWDMGLRIRGFDGHYEMTIKTAGKVLGGLHQRPEFNVPLHHPELDLAQFPAHIWPENTDITQLQDQLTALFSTDFTREKWILNHGQSEIEVALDQGVIRSGNRTAAICEFELELKKGNVADILLLADKLALQEGLRLAHKSKAARGYALTYGLTQTDLSQVPETLGWQQPLSVLLPEILAQWQEQEEGWLAGIPEGKTGLEQVLVWIEQLTEQQAEAFPVLGSLPALKGALSAVNADAETLCYSASWLQCKLALTQWLMAQAR

SEQ ID NO: 10150 - protein, 946 aa, Xenorhabdus bovienii
  Peptide sequence Name=Xb4151_4152.C444.gene12.pep
  Gene classification: Gene name=GlnE; Function=Glutamine synthetase adenylyltransferase; Function class=O Posttranslational modification, protein turnover, chaperones
  Homolog annotation: Query=1..944bp; Hit=1..943bp; Blast score=1192; Percent Identity=66.0; E value=0; Homolog= glnE COG1391
MLPLSVPLAHQLQHVIANFQQSAGTIKSFVPHEQAVLSLSDFVAENLLLHPAWLDEIRQNPPQPEEGQHYSDWLNQALSVASDENSLMRILRLFRHRMLVRIAWLQALQGSTTEQTLRQLSMLAEVLIVAARDRLYLRCCQDWGTPTNHEGVAQPLLILGMGKLGGGELNFSSDIDLIFAYPENGVTQGGRREMDNSQFFTRLGQKLIKVLDQQTVDGFVYRVDMRLRPFGDSGPLVFSFSALEDYYQEQGRDWERYALVKARILGYDEQVYCQELRQMLRPFIFRRYIDFSVIQSLRNMKGMIEREVRRRGLKDNIKLGAGGIREIEFITQVFQLIRGGREPSLQSRSLLLTLKAIEVLALLTPEQVRELEESYLFLRRLENLLQSIRDQQTQTLPESTLDRARLSWGMGFADWDGLLAETEHRMHAVRSIFRQLIGDETDENVEEASHVPFKSVWQEALTRSELMMLVPHLDEEDAQKVLDVIALFRHDVSKRTIGPRGRDVLDQLMPRLLAKIGVREDTNTVLERMVPLLLSIVSRTTYLELMLESEQVMIHVIRLCAASPMIASQLSLHPLLLDELLDPKSLYEPLPLEAYRDELYQYLLRIPEDDEEQLLEALRQFKQAQLLRIAAEDISGVLPVMKVSDHLTYLAEAIIGTVVQQAWNQMVKRYGAPAHLSRQQGLGFAIIGYGKLGGWELGYGSDLDLVFLLDCPMDVVTDGERAIDARQFYLRLAQRIIHLFSTRTASGVLYDVDARLRPSGESGMLVSTLDAFDDYQKHEAWTWEHQALIRARMVFGDEKMRGDFERIRHETLCRPRDPDLLCQQVREMREKMHRHLGSHQHDQFDIKADPGGITDIEFIAQYQVLRYAPENAKLTRWSDNVRIFELMASYNIMDEQEAMALTQAYITMRDELHHLALQALPSRVPAESFSQQQILVRDSWQKWLGR

SEQ ID NO: 10151 - protein, 474 aa, Xenorhabdus bovienii
  Peptide sequence Name=Xb4151_4152.C444.gene13.pep
  Gene classification: Gene name=RfaE; Function=ADP-heptose synthase, bifunctional sugar kinase/adenylyltransferase; Function class=M Cell envelope biogenesis, outer membrane
  Homolog annotation: Query=1..472bp; Hit=1..472bp; Blast score=758; Percent Identity=80.0; E value=0; Homolog= rfaE COG2870
MKVTLPDFHRAGVLVVGDVMLDRYWYGPTSRISPEAPVPVVKVDTIEERPGGAANVAMNIASLGANTHLIGLTGIDDAARALSEKLSSVKVQCNFVSVPTHPTITKLRVLSRNQQLIRLDFEEGFQNVDAQPMLEKIQQSLPYVGALVLSDYAKGALSQIQTMIKLANEAHVPVLIDPKGSDFERYRGATLLTPNMSEFEAVVGHCKDDDELMEKGTKLVQDLELKALLITRSERGMSLLRVGQPTLHLPTQAQEVFDVTGAGDTVIGVLATALAAGKPLNEACYLANAAAGVVVGKLGTSTVSPVELENAVRGRAETGFGVMSEAQLKDVVAQARQRGERIVMTNGCFDILHAGHVSYLSNARKLGDRLIVAVNSDASTKRLKGETRPVNPLDQRMIVLSALESVDWVVAFEEDTPQRLIAGVLPDTLVKGGDYTPDEIAGSQEVWAAGGEVMVLNFEDGISTSNIINAIKNQ

SEQ ID NO: 10152 - protein, 95 aa, Xenorhabdus bovienii
  Peptide sequence Name=Xb4151_4152.C444.gene14.pep
  Gene classification: Function=Uncharacterized BCR; Function class=S Function unknown
  Homolog annotation: Query=1..79bp; Hit=21..99bp; Blast score=103; Percent Identity=75.0; E value=4e-23; Homolog= yqiC COG2960
MLDPKKIEQIARQIHNSMPKGVKEFGDDVEKKLRTVLQSQLSKLDLVNREEFDIQTQVLLRTREKLAAMEQRLNELEARIGNPQAGIEKKTEQAE

SEQ ID NO: 10153 - protein, 96 aa, Xenorhabdus bovienii
  Peptide sequence Name=Xb4151_4152.C444.gene15.pep
MGYQNQGNFEELMLQKIRNKTTGKRKHLIDAVILSHPDYHRRLQNHTGSADLCFIHRCSETSENNKKITANRALAGLMKSPESYFTLPPVGTFTLP

SEQ ID NO: 10154 - protein, 217 aa, Xenorhabdus bovienii
  Peptide sequence Name=Xb4151_4152.C444.gene16.pep
  Gene classification: Gene name=RibB; Function=3,4-dihydroxy-2 -butanone 4-phosphate synthase; Function class=H Coenzyme metabolism
  Homolog annotation: Query=1..217bp; Hit=1..217bp; Blast score=342; Percent Identity=81.0; E value=1e-94; Homolog= ribB COG0108
MNQTLLSSYGTPFQRVERAIAALRAGRGVMVLDDENRENEGDMIFAAETMTVEQMALTIRHGSGIVCLCLTEERRQQLQLPMMVENNSSQYQTAFTVTIEAAQGVTTGVSAADRITTIHAAIAEGAQPNDLSRPGHVFPLRAQPGGVLTRRGHTEATIDLVKLAGFKPAGVLCELTNDDGSMARAAEVIEFAKQHDMPVVTIEDLVDYRQQMAKAAS

SEQ ID NO: 10155 - protein, 67 aa, Xenorhabdus bovienii
  Peptide sequence Name=Xb4151_4152.C444.gene17.pep
MARLRLFFLEYSQSKMMEYFKNTEGRRGWTAAFQAYTQYNRYIRFRYVFYSEQLSISPKKTIWQKTI

SEQ ID NO: 10156 - protein, 258 aa, Xenorhabdus bovienii
  Peptide sequence Name=Xb4151_4152.C444.gene18.pep
  Gene classification: Function=Uncharacterized ACR; Function class=S Function unknown
  Homolog annotation: Query=1..258bp; Hit=10..271bp; Blast score=318; Percent Identity=61.0; E value=3e-87; Homolog= ygiD COG3384
MSLLKMPALFVGHGSPMNALEDNRYSRAWFELGKKLPRPRAILVISAHWYTDGTVVTAMTQPRTIHDFGAFPQALHDMQYPAKGFPELAVLIQDILDPIEVETDFGDWGLDHGSWGILAKMYPDADIPVIQLSMDRNQPASFHYEIGKKLAVLRDEGILIMGSGNVVHNLPAEKLGAEPYSWSLSFEQFVRESLTSLEEPHPLFHALDRGDGKLSNPTPEHFLPLFYVIGTWDKKEPISTPVEGIEDGSLSMLSIQVG

SEQ ID NO: 10157 - protein, 386 aa, Xenorhabdus bovienii
  Peptide sequence Name=Xb4151_4152.C444.gene19.pep
  Gene classification: Gene name=Gsp; Function=Glutathionylspermidine synthase; Function class=E Amino acid transport and metabolism
  Homolog annotation: Query=1..386bp; Hit=1..386bp; Blast score=640; Percent Identity=77.0; E value=0; Homolog= ygiC COG0754
MKRIGITERPDWREKATEYGFNFHTMHGQPYWSEEAYYQFTLSQIEEIEDATAELHQMCLQVVEKVVNSEELLTKFQIPKHCWEFIRSSWITSQPSLYSRLDFAYDGKNPPKLLENNADTPTSLYESAFFQWIWLEDQLNAGNLPANADQFNSLQEKLIERFDQLREKHGFGLLHMACCQDTEEDRGTIQYLQDCALEAGIPTEFLFIEDIGLGEKGQFTDLQNQVIGNLFKLYPWEFMLREIFSTKLADAGVRWLEPAWKSIISNKALLPMLWKMFPNHPNLLPAYFADEHYPEMDSYVIKPLFSREGANIRIIEQGREIASADGPYGKEGMIVQQFHALPKFGDSYTLVGSWLVDDQSAGICIREDRELITQDLSRFYPHIILD

SEQ ID NO: 10158 - protein, 238 aa, Xenorhabdus bovienii
  Peptide sequence Name=Xb4151_4152.C444.gene20.pep
  Homolog annotation: Query=16..226bp; Hit=1..221bp; Blast score=310; Percent Identity=81.0; E value=1e-83; Homolog= gi|37527811|ref|NP _931156.1| hypothetical protein [Photorhabdus luminescens subsp. laumondii TTO1] gi|36787247|emb|CAE16328.1
MGLALIQIPPRWMPPMTMKRTKEINHDTFRKTWRNYRLAPVALAISAVFMLSACEQNDETVSLYTNADECSQANPSQSEQCKTAYNNALKEAEKTAPKYASREECVAEFGEQQCTQTPAQAGVGTQAQAQSSSGSFWMPLMAGYMMGRLMGGSSTPSQPLFTSKSATSPANGKFVDATGKSYGSAAAGGRTMTVPKTAMAPKPATTTTVTRGGFGDSVAKQSTMQRSSSGSTSRSMGG

SEQ ID NO: 10159 - protein, 454 aa, Xenorhabdus bovienii
  Peptide sequence Name=Xb4151_4152.C444.gene21.pep
  Gene classification: Gene name=TolC; Function=Outer membrane protein; Function class=M Cell envelope biogenesis, outer membrane
  Homolog annotation: Query=1..444bp; Hit=3..454bp; Blast score=472; Percent Identity=61.0; E value=1e-133; Homolog= tolC COG1538
MKKLLSLFIAMNLVGFSTLSHAEDLLQIYKQAKETNPELLKAQADRNSIIEKINEVRSPLLPQLGLNAGVDYGKSFRSKADSESYGTNAKLQLTQTIFDMSKWYQLNQAEKSAGIADISYQIAQQKLILDTAKAYFDVLSKIDALTYTEAQKASLYRQLDQSSQRFKVGLVAITDVQNAQAQYDTILALEVSDRNNLENSLEGLRLMTGIYYPQLASLNIDRFKTNQPNPVDSVRKEAETRNLSLLSARLTQDLKREFIKDARTGYMPTINLTASTGVINSHKRGTQRIDSYDGGNNVGLSLSLPLYSGGLTNSQVEQAKYNFVSASQDLENTYRKVIQDVHSSSNNLSASISSIKANKQAVVSTQSSLDSMEAGYQVGTRTIVDVLDATTKLYQAKQSLSKARYDYLINQLVNKQARGTLNEDDLVALNSILGTKISTDSSNIIKEMKTPTTR

SEQ ID NO: 10160 - protein, 211 aa, Xenorhabdus bovienii
  Peptide sequence Name=Xb4151_4152.C444.gene22.pep
  Gene classification: Gene name=MutT; Function=NTP pyrophosphohydrolases including oxidative damage repair enzymes; Function class=L DNA replication, recombination and repair
  Homolog annotation: Query=8..208bp; Hit=8..208bp; Blast score=297; Percent Identity=75.0; E value=4e-81; Homolog= rdsA COG0494
MSENLVSPLTFTTQDVEIISRKTLYRGFFKMTEYQFRHRLFRGGWSDNIKREVFERGHAAVLLPYDPVRDEVVLIEQIRIPAIETSETPWLLEVIAGMIEEGEDVEQVVRREAMEEAGLEVKRCQPALSYLSSPGGTTERMAIFVGEVDAATASGIHGLADEHEDIRVLVVSREQAYLWVEEGIIDNAASVIAIQWLALHHEKLKTAWLGK

SEQ ID NO: 10161 - protein, 63 aa, Xenorhabdus bovienii
  Peptide sequence Name=Xb4151_4152.C444.gene23.pep
VICSILAVAPSATGTLSRLSKWFPFPVSHKNYSSASLQKRSADWDTLPVFQHKLGTIFLTMLF

SEQ ID NO: 10162 - protein, 279 aa, Xenorhabdus bovienii
  Peptide sequence Name=Xb4151_4152.C444.gene24.pep
  Gene classification: Gene name=Icc; Function=Predicted phosphohydrolases; Function class=R General function prediction only
  Homolog annotation: Query=1..279bp; Hit=1..275bp; Blast score=339; Percent Identity=62.0; E value=2e-93; Homolog= icc COG1409
LESLLKVPVAEGATARILQITDTHLFASKGDSLLGINTYRSYHAVLDAILEQSIDIDLIVATGDLVQDQTIGAYQNFAEGIARLPAPCVWLPGNHDYQPAMVDVLAAAGISPSKQVLIGQHWQLVMLDSQVQGVPHGELTDYQLEWLQKCLDKHNDRNTIVMLHHHPVPSGCTWLDQHSLRNAPALAESLKDKLQVKAILCGHIHQELDRMWNGIRVMATPSTCMQFKPHCTNFMLDTVAPGWRYLELSVADNREAKLQTQVHRLKSNEFCPDLASDGY

SEQ ID NO: 10163 - protein, 202 aa, Xenorhabdus bovienii
  Peptide sequence Name=Xb4151_4152.C444.gene25.pep
  Gene classification: Function=Predicted esterase; Function class=R General function prediction only
  Homolog annotation: Query=1..190bp; Hit=1..190bp; Blast score=287; Percent Identity=70.0; E value=6e-78; Homolog= yqiA COG3150
MSTLLYLHGFNSSPQSAKANALKMWLHQQHPEIDMLVPQLPSYPEDAASLLEDLVMTRAGENIGLVGSSFGGYLAIWLSQCFGLPAVVVNPAVRPFDLLQNYLGENVNPYTEERYTLQQSHIYDLKVMHIDPLESPDLIWLLQQTGDEILDYRQAIAYLMQCRQTVESGGNHAFIGFEHYFPQIINFLGLTSGNNKKIAKNK

SEQ ID NO: 10164 - protein, 631 aa, Xenorhabdus bovienii
  Peptide sequence Name=Xb4151_4152.C444.gene26.pep
  Gene classification: Gene name=GyrB; Function=DNA gyrase (topoisomerase II) B subunit; Function class=L DNA replication, recombination and repair
  Homolog annotation: Query=1..631bp; Hit=1..630bp; Blast score=1127; Percent Identity=85.0; E value=0; Homolog= parE COG0187
MTQSSYNAEAIEVLSGLEPVRRRPGMYTDTTRPNHLAQEVIDNSVDEALAGHAKHIEVILHSDQSLEVIDDGRGMPVDIHPEEKVSAVELILTRLHAGGKFSNKNYQFSGGLHGVGISVVNALSRRVEVTVRRDSQVHQIAFESGDKVQELEVIGSCGKRNTGTSVHFWPDESYFDIPRFSASRLTHLLKAKAVLCPGVEIVFKDKLAGTEQKWCYADGLTDYLLEAVNGLVTLPQTPFVGVLRGDTEAVDWALLWLPEGGELLAESYVNLIPTIQGGTHVNGLRQGLLDAMREFCEFRNILPRGVKLSADDIWDRCAYVLSLKMQDPQFAGQTKERLSSRQSAAFVSGVVKDAFSLWLNQHIQDAEQLAEMAIASAQRRMRAAKKVVRKKLTNGPALPGKLADCTSQDLKLTELFLVEGDSAGGSAKQARDREYQAIMPLRGKILNTWEVSSDEVLASQEVHDISVAIGIDPDSDDLSQLRYGKVCILADADSDGLHIATLLCALFVRHFLTLVKRGHVYMAMPPLYRIDLGKEVHYALDEGEKGAILERLSRKRGKPNVQRFKGLGEMNPIQLRETTLDPNTRRLVQLTIDDDNYQETFSVMDMLLAKKRSEDRRNWLQEKGNSIDIEV

SEQ ID NO: 10165 - protein, 751 aa, Xenorhabdus bovienii
  Peptide sequence Name=Xb4151_4152.C444.gene27.pep
  Gene classification: Gene name=GyrA; Function=DNA gyrase (topoisomerase II) A subunit; Function class=L DNA replication, recombination and repair
  Homolog annotation: Query=7..750bp; Hit=3..743bp; Blast score=1185; Percent Identity=78.0; E value=0; Homolog= parC COG0188
MSEITHDGVECQPLHTFTENAYLNYSMYVIMDRALPFIGDGLKPVQRRIVYAMSELGLSNSAKFKKSARTVGDVLGKYHPHGDGACYEAMVLMAQPFSYRYPLVDGQGNWGAPDDPKSFAAMRYTESRLSKYAELLLSELGHGTVDWVPNFDGTLQEPKMLPARLPNILLNGTTGIAVGMATDIPPHNVREVVSALVAMLDNPNCSLDDVMEYIKGPDYPTEAEIITSKEDIRKIYKNGRGSVRMRAVWSKEESNVVITALPHQVSGAKVLEQIASQMRAKKLPMVDDLRDESDHENPTRLVIVPKNNRVDVEQVMNHLFVTTDLEKSYRVNLNMIGLDNRPNVKGLVEILSEWLVFRRETVRNRLNYRLEKVLKRLHILDGLLKAYLSIDEVIQIIRNEDEPKPVLMQRFELTETQAEAILELKLRHLAKLEEVKIRGEQDGLAKERDKLQAILGSERKLSTLLKKEIIADAENYGDHRRSPLKERSEAKAMSDHDILPSEPITVVLSEMGWVRSAKGHEIDPAGLNYKSGDSFRSAARGKSNQPVVFIDTTGRSYSVDPLDLPSARGQGEPLTGKLLALPAGASIEHLLIAKEEQKFLMASDAGYGFICTFSDLIAKNRAGKALITLPENAKVMQPLEITNEQDDMLLAITKEGRMLMFPVADLPQLSKGKGNKIVSIPAAQAASGEDMLSWLLVLPVQSSITLYFGKRKLLLRPEDLQKFRAERGRKGTSLPRGLQRVERIEVEMPRS

SEQ ID NO: 10166 - protein, 243 aa, Xenorhabdus bovienii
  Peptide sequence Name=Xb4151_4152.C444.gene28.pep
  Gene classification: Gene name=PlsC; Function=1-acyl-sn-glycerol-3 -phosphate acyltransferase; Function class=I Lipid metabolism
  Homolog annotation: Query=1..236bp; Hit=1..236bp; Blast score=355; Percent Identity=71.0; E value=3e-98; Homolog= ZplsC COG0204
MLAIIRGIIVFLLSILICLFGSIYCLFSPRNPSHVMTFGHAFGKLHKIFGIKMLERIPEEAKQYGPSIYIGNHQNNYDMVTMSNAVQPRTVTVGKKSLLFIPFFGPLYWLTGNILINRENRSKAHGTISQVVQQIKKRHISVWMFPEGTRSRGRGLLPFKTGAFHAAIAAGVPIVPVCVSSTHDRIKFNRWNNGTVIVEMLPPIDTTKYTKDQVRQLAEHCRQMMQARIEELNNEVEVMDKRK

SEQ ID NO: 10167 - protein, 473 aa, Xenorhabdus bovienii
  Peptide sequence Name=Xb4151_4152.C444.gene29.pep
  Gene classification: Gene name=SufI; Function=Putative multicopper oxidases; Function class=Q Secondary metabolites biosynthesis, transport and catabolism
  Homolog annotation: Query=1..470bp; Hit=1..468bp; Blast score=606; Percent Identity=63.0; E value=1e-173; Homolog= ZsufI COG2132
MSLSRRQFIQASGLAMCLGALPFAVRANKYQQTALPIPPLLESRGGQPLFLALQKTHWSFDGKNKVQVWGINGRYLGPTIRVRKGDNVKLIYSNRLSEPVSMTVGGLLVPGTLVGGSARLISSNENWSPIIPINQPAATCWYHANTPNRMAQHVYAGLAGMWLVEDENSRSLPLPKNYGVDDFPVILQDKRLDNFGVPQYNPAINQGFLGDTLLINGVENPFIEVARGWVRLRLLNASNARRYQLQLSDDRPFYMVGTDQGLLPAPVTVQQLSLAPGERREVLVDMSKVDSVAITAGESAGMLDRLKGLFESSTKLLSTTVLTIKASGLLSLVTDQLPTQLVADTTEINSSIHNRQFVLGDATQGINGVLLNRNRIDISSQQGAWERWVVTTSVPQPFHIQGGRFKVISHNGNRPFPQDYGWKDTVWIEGRTELLVNMMQPSYEIFPFKYYSQILEMADDGVAGQMVVTPATS

SEQ ID NO: 10168 - protein, 161 aa, Xenorhabdus bovienii
  Peptide sequence Name=Xb4151_4152.C444.gene30.pep
  Gene classification: Gene name=FolA; Function=Dihydrofolate reductase; Function class=H Coenzyme metabolism
  Homolog annotation: Query=3..160bp; Hit=2..159bp; Blast score=261; Percent Identity=75.0; E value=2e-70; Homolog= folA COG0262
MNISLIAAMAMDRVIGMENAMPWTLPGDLAWFKRNTLGKSVVMGRVTYESIGRPLPGRLNIVISSQPARDDSVTWVRTIEEALAAAGDVDEIMVMGGGKIYEQFIPLAHRMYLTHIDAEVIGDTHFPDYAPDEWNSVFTEYHDADEHNSHGYCFEILERRE

SEQ ID NO: 10169 - protein, 43 aa, Xenorhabdus bovienii
  Peptide sequence Name=Xb4151_4152.C444.gene31.pep
MSGSSKKQSQKTVVVSTTNQISSTECRKALRRHRFYSVGSLTI

SEQ ID NO: 10170 - protein, 272 aa, Xenorhabdus bovienii
  Peptide sequence Name=Xb4151_4152.C444.gene32.pep
  Gene classification: Gene name=ApaH; Function=Diadenosine tetraphosphatase and related serine/threonine protein phosphatases; Function class=T Signal transduction mechanisms
  Homolog annotation: Query=1..268bp; Hit=1..268bp; Blast score=434; Percent Identity=75.0; E value=1e-122; Homolog= ZapaH COG0639
MATYLIGDIHGCYHEFRALLQQVSFHPSKDTLWLTGDLVARGPYSLEVLRFIKQLGPAVKLVLGNHDLHLLAVYAKISRNKPKDQLDKLLSAPDVDDLINWLRKQPMLQIDDELKLVMAHAGLAPQWDLDTARICAREVEAILRSDSYPLFLDAMYGDMPNNWDPELSGLARLRYSTNALTRMRYCFPNGQLDMICKSKPENVSAPLKPWFELPCNIPEEYSVAFGHWAALEGKGTPAGIYALDTGCCWGGKLTMMRWEDKQYFSQSSLLNR

SEQ ID NO: 10171 - protein, 125 aa, Xenorhabdus bovienii
  Peptide sequence Name=Xb4151_4152.C444.gene33.pep
  Gene classification: Gene name=ApaG; Function=Uncharacterized protein affecting Mg2+/Co2+ transport; Function class=P Inorganic ion transport and metabolism
  Homolog annotation: Query=1..125bp; Hit=1..125bp; Blast score=175; Percent Identity=65.0; E value=5e-45; Homolog= apaG COG2967
MLNEPRIHIQVQSTYVESQSEPEHQRFVFAYTISIHNLGHSPVQLISRYWRITNSDGHRTEVQGEGVVGKQPVILPGTDYRYSSGTILETPLGTMEGHYEMRDHDGRPFRVAIPVFRLAIPTLIN

SEQ ID NO: 10172 - protein, 274 aa, Xenorhabdus bovienii
  Peptide sequence Name=Xb4151_4152.C444.gene34.pep
  Gene classification: Gene name=KsgA; Function=Dimethyladenosine transferase (rRNA methylation); Function class=J Translation, ribosomal structure and biogenesis
  Homolog annotation: Query=1..268bp; Hit=1..268bp; Blast score=430; Percent Identity=77.0; E value=1e-121; Homolog= ZksgA COG0030
MNNKVHQGHYARKRFGQNFLTDQFIIESIVDAMNPQPGQAIVEIGPGLGALTEPVGERMDKMTVVELDRDLAARLHVHPKLKDKLTIIQQDAMTVDFGQLAKDQGQSLRVFGNLPYNISTPLMFHLFSYADAIADMSFMLQKEVVNRLVAGPGCKAYGRLSVMAQYYCQVIPVLEVPPTAFTPAPKVDSAIVRLMPHKAMPYPVKDIRMLARVTTQAFNQRRKTIRNSLGDLFSVEQLSELGVDPGTRAENISVEQYCKMASWLSSQAKTARNQ

SEQ ID NO: 10173 - protein, 333 aa, Xenorhabdus bovienii
  Peptide sequence Name=Xb4151_4152.C444.gene35.pep
  Gene classification: Gene name=PdxA; Function=Pyridoxal phosphate biosynthesis protein; Function class=H Coenzyme metabolism
  Homolog annotation: Query=4..331bp; Hit=1..328bp; Blast score=483; Percent Identity=74.0; E value=1e-137; Homolog= pdxA COG1995
MVAMHNNKPIIITPGEPAGVGPDLVIALAQKEWPIQLVVCADPELMLLRAKQLNLPLQLQPYSPEYISPTQAAGTLTILPVSLHSPVIAGELNRENGIYVTETLAKACEGCLNGEFSALVTGPVHKGVINEAGVPFTGHTEFFADHSQCSRVVMMLATEELRVALATTHLPIMDVPKAITFDSLREVVTILNHDLKTKFGIRRPHIYVCGLNPHAGEGGHMGHEEIDVIIPALDSLRAEGIWLEGPLPADTLFQPKYLDHADAVLSMYHDQGLPVLKYQGFGRAVNITLGLPFIRTSVDHGTALELAGTGQADVGSFITALNLAIKMIQNSNE

SEQ ID NO: 10174 - protein, 435 aa, Xenorhabdus bovienii
  Peptide sequence Name=Xb4151_4152.C444.gene36.pep
  Gene classification: Gene name=SurA; Function=Parvulin-like peptidyl -prolyl isomerase; Function class=O Posttranslational modification, protein turnover, chaperones
  Homolog annotation: Query=1..428bp; Hit=1..426bp; Blast score=506; Percent Identity=62.0; E value=1e-143; Homolog= surA COG0760
MKNWRALILGLMFSVNTVAMAAPQELNRVAAVVNNGVVLESDVDEQLQSVKLSAKHAGQQIPDEKALRHQILERLIMDDIILQMAKQMQITIPDQVLDSTIANIAAQNHMGLDELKKNLTAEGLNFNTYRNQIRKEMIIAEVRNNEIRRRVTILPQEVEALAKNLSSENNQNTELNVSNILIPLRENPSQAQVEKATAIINKILSELKNGADFGKLAITYSGDTQALKGGNMGWRKLQELPSLFAEQLQSAHKGQIIGPIRSGVGFHILKINDIRGSNMPQVAATEVNARHILLKTSPIMTDDQARSTLMKLREEILSGKTTFNAAAEKYSEDPGTAMRGGELGWNVPSTYAPAFRDALVKLKKGELSQPVHSTFGWHLIQLIDTRKVDRTDSAQKDNAYRLLLNRKLGEETQNWMQDLRASAYVKVLDGSDAQQ

SEQ ID NO: 10175 - protein, 777 aa, Xenorhabdus bovienii
  Peptide sequence Name=Xb4151_4152.C444.gene37.pep
  Gene classification: Gene name=Imp; Function=Organic solvent tolerance protein OstA; Function class=M Cell envelope biogenesis, outer membrane
  Homolog annotation: Query=1..774bp; Hit=1..781bp; Blast score=942; Percent Identity=60.0; E value=0; Homolog= imp COG1452
MNKCYPTLLATMVWAAIYSQQAHADLAAQCMLGVPVYDKPIITADPNQIPVNIKSDDTHGEYPNAVEFVGNVDIRQGNKTLTADKVRLEQTQDEVPVRTVTATGNVNYDDPQIILKGPRAWSNLNNKDTDMEHGKYQMVGRQGRGSADKLMVRDENRYTIMNNGIFTSCLPGNDSWSVVGSEVILDRKEEVAEIWNARFRVANVPVFYSPYLQLPIGDKRRSGFLIPNASYSNKEGFQFKLPYYWNIAPNYDATITPNLISKRGLKLDNEFRYLTKAGAGTVAFDWLGHDRLYADDKKLDKNLSDRESNNRWLFYWNHSGVLNQAWRFSADYTKVSDPKYFTDFTSQYGTSTDGYATQKFSIGYAQQNWDATLASKQFQIFTAGKNRKAYRAEPQLDLNYYKNDLGPFDFRTHAQIAKFTSVGKDYPEATRWHVEPTINLPLSNRWASLNNEFKLMATHYQQDIPATTQNSTLEKSVNRVLPLFKSDAKMVFERAMYMNKYYTQTLEPRVQYLYVPYKNQDNINNFDSSLLQANYSGLFRDRFFSGLDRISSANQFTSGITTRIYDEDLVERFNLSVGQIYYFESPRTQDTDLKDSTKKSTGTTTWAGDVEWKINDSWGFKGGMQYDTRLNSVAMGNTVLEYRRDAERLVQLNYRFVNRDYIQATLGSQAPSFQQGISQVGLVASWPLADRWAFVGSYYYDTKEKQPASQLVGLQYNTCCWAVSVGYERKIVSWKDNSSEYDNKWSFNVELRGLSSNQSLGSQKMLERGILPYQRAF

SEQ ID NO: 10176 - protein, 269 aa, Xenorhabdus bovienii
  Peptide sequence Name=Xb4151_4152.C444.gene38.pep
  Gene classification: Gene name=DjlA; Function=DnaJ-domain-containing proteins 1; Function class=O Posttranslational modification, protein turnover, chaperones
  Homolog annotation: Query=1..269bp; Hit=1..271bp; Blast score=329; Percent Identity=67.0; E value=2e-90; Homolog= djlA COG1076
MQYWGKLFGLIFGIASGAGFWGIVIGLLLGHVLDKVRMRNQRLSDKGPTRQALFFRSTFQVLGHLTKAKGRVTETDIQLASQLMDRMQLHGDARVAAQQAFREGKQLRFPLRETLRQLRRACFGRFDLIRMFLEIQLQAAFSDGELHPNERIVLFVIAEELGISRPQFEQFLAMMEGGRHFGGQYQQHGRYQEHGQPRATLADACKVLGVKEHDEATVIKRAYRKLMSEHHPDKLVAKGLPPEMMDIAKQKAQSIQSAYDLIKKEKGFK

SEQ ID NO: 10177 - protein, 217 aa, Xenorhabdus bovienii
  Peptide sequence Name=Xb4151_4152.C444.gene39.pep
  Gene classification: Gene name=RluA; Function=Pseudouridylate synthases, 23S RNA-specific; Function class=J Translation, ribosomal structure and biogenesis
  Homolog annotation: Query=2..217bp; Hit=3..219bp; Blast score=326; Percent Identity=76.0; E value=9e-90; Homolog= rluA COG0564
MLESYNPPTDPWLHVLYQDEHIMVVNKPSELLSVPGKAEDHKDSIMTRIQAEFPTAESVHRLDMATSGVMVVALTKAAERELKRQFREREPKKVYIARVWGKLEREKGLVDLPLICDWPNRPKQKVCFETGKSAQTEYQVLEYEAQATRVRLAPITGRSHQLRVHMLALGNPILGDRFYAHQQARELAPRLQLHAQELSITHPAYGTPMHFECKADF

SEQ ID NO: 10178 - protein, 969 aa, Xenorhabdus bovienii
  Peptide sequence Name=Xb4151_4152.C444.gene40.pep
  Gene classification: Gene name=HepA; Function=Superfamily II DNA/RNA helicases, SNF2 family; Function class=K Transcription
  Homolog annotation: Query=1..969bp; Hit=1..968bp; Blast score=1504; Percent Identity=75.0; E value=0; Homolog= hepA COG0553
MPFTLGQRWISDTESELGLGTVVALDTRMVTLLFPASGENRLYARNDSPITRVMFNAGDTLTSHEGWKLKVDEVQQDNGLLIYIGTRLDTEEENITLREVFLDSKLTFNKPQDRLFAGQIDRMDRFALRFRARKHQSEQFRLAESGLRGIRASLIPHQLHIANEVGKRHAPRVLLADEVGLGKTIEAGMVIHQQLMAGRAERVLVIVPESLQHQWLVEMLRRFNLRFSLFDDGRYSEALHDSDNPFETEQLIICSLDFVRRNKQRFEHLLEASWDLMVVDEAHHLEWSEKAPSREYQVIEELAEQIPSVLLLTATPEQLGQESHFARLRLLDPNRFHDYQAFIDEQQTYRPVADAVTLLLSGETLNNDQQNLIVELISEQDIEPLLKAANSHQDEESEKSRRELIAMLMDRHGTSRLLFRNTRSGVKGFPHRELHEIKLPLPAQYQTAIKVSEIMGAKKSVEARAKDMLYPERIYQEFEGENATWWNFDPRVEWLLGFLLANRDEKVLVICAKAETALQLEQVLREREGIRSAVFHEGLSLLERDRAAAYFASEDEGAQVLLCSEIGSEGRNFQFANQLVMFDLPFNPDLLEQRIGRLDRIGQSRNIKISIPYLENTAQSILLRWYHEGLNAFEQTCPTGRPIYDKYYETLVNFLAKPNEQAGFTPFIAECREHHEQLRQELEQGRDRLLEMNSNGGEQGQKLAETIAAQDNDTDLVSFALNLFDIIGINQEDRSDNIITLNPSDHMLVPDFPGLPADGCSITFDREKALSREDTQFLSWEHPIIRNGLDLILSGDTGSCAVSILKNKALPVGTLLVELIYVVEAQAPKHLQLTRFLPPTPVRLLMDLKGTNLAPQVEFESFNRQLNAINRHNASKLVSAVQKEVHAILQQSEPLVEQQAREVIEKAKKEADNVLSAELSRLEALKAVNPNIRDDELEAVDSEHKHLLLNLDQANWRLDAIRLVVVSHQ

SEQ ID NO: 10179 - protein, 781 aa, Xenorhabdus bovienii
  Peptide sequence Name=Xb4151_4152.C444.gene41.pep
  Gene classification: Gene name=PolB; Function=DNA polymerase elongation subunit (family B); Function class=L DNA replication, recombination and repair
  Homolog annotation: Query=7..778bp; Hit=3..782bp; Blast score=1059; Percent Identity=66.0; E value=0; Homolog= polB COG0417
MQTKHVEQGFILTRHWKDTPSGIELVYWLATDQGARRITISHQKAVAFIPQHDLQKAKRIIDQEPRCELKPLPLKDFNRQPVTALYCLQYRQLQQLEKTLKEQDIPLYETDIRPPDRFMMERFITAPVWFNQKPDGSYQMKPNPTYRPKLKWVSLDIETSQHGELYSIGLAGCGEQTVFMLGSENGSRQDRDFKLEYVASRPQMLEKLNEWIAFYDPDAIIGWSLIQFDLKVLQKHAERYNVPLKLGRRHGLLEWREHGFKPGHFFASAEGRLIIDGIDALKTATWNFPSFSLEYVAQALLGEGKAIDSPYDRMDEINRRFQEDKPALAHYNLQDCILVNRIFDKTDLMTFLLERATVTGLAVDRSGGSVAAFTHLYLPRMHRIGYVSPVHATDSGDSPGGFVMDSFPGLYDSVLVLDYKSLYPSIIRTFLIDPVGMVEGLAQPDSEHAIPGFRQAFFSRTQHCLPDIITQIWHERDKAKKQQNAPLSQALKIIMNAFYGVLGASGCHFFDPRLTSSITLRGHQIMHQTRELIESQGYQVIYGDTDSTFIWLKHPHSEAEASQIGHSLAQFVNQWWQSHLKTQFNLESTLELEFETHYRRFLMPTVRGTEQGSKKRYAGLSGDKMIFKGLETIRTDWTPLAQIFQNELYTLIFHQKPYQDYIRDYIADTLAGKFDDRLIYRKQLRRKLSDYQRNVPPHVRAARLADEYNQQNNRPLQYQNVGWISYLITQSGPEPLENQTTLPDYEHYINKQLMPIADAILPFIQDNFMTLLTGQMSISFE

SEQ ID NO: 10180 - protein, 521 aa, Xenorhabdus bovienii
  Peptide sequence Name=Xb4151_4152.C444.gene42.pep
  Homolog annotation: Query=55..519bp; Hit=3..459bp; Blast score=332; Percent Identity=40.0; E value=9e-90; Homolog= gi|24306037|gb|AAN52497.1| SpnT [Serratia marcescens]
MLCLHNISATAFVLRAKSRLYIVMNSSLNYSTCSGYLYSGFLIKSEYRVFMMKNALNKKQSELLASFNKEELLEIIHALIRNNELAQITLVSGYLLESEDILKLIEKEYKKRSKSKRFFDYYETDTFFNELHNSMATLLNRVIPLKPVESEVLLSYMLQDFERMSETKDTSSGGWQDYYYYLVESWIKALSLQKDTDKVTVANKLFKIFQGEYYFSLSQLGEYKSTLGLDILRQLRDIFYQHKKDDEALELSYSIKDIEFFKTYLDKKKGFLYPRYYLDYAELLIEDVRSDEAIVLLENLREKNNKLPVELNDDKIMELLIKANIEEGKKEEARQLCIDAFKEYYNHKFYKLYENTLDKDEKGGAIKLFLDIANQYEENRFFYLLFLIEVERFDVINDYILNLGKDNVIKITDSIIPSTARKVSSLLYKSGFPFSATLVRRALVEDVLGRGASKYYKYSVSDLKKSLDYGEKIQSTDDISSNQTYLTALYAKHKKKVSFWSLAEEKIKNVSMDNDGVYYGK

SEQ ID NO: 10181 - protein, 114 aa, Xenorhabdus bovienii
  Peptide sequence Name=Xb4151_4152.C444.gene43.pep
MSLHVSFRHTDIPELMLNGSTLSDAGFSADALFHISQLSNGIIISLVDPDVDLVSLIHEVEDHADQGIDNIRENGELYIAGDWLTSSQLVEQPINIEVTPGKIILKPKLTELLD

SEQ ID NO: 10182 - protein, 178 aa, Xenorhabdus bovienii
  Peptide sequence Name=Xb4151_4152.C444.gene44.pep
  Gene classification: Gene name=InsB; Function=Insertion element IS1 protein InsB, putative transposase; Function class=L DNA replication, recombination and repair
  Homolog annotation: Query=30..178bp; Hit=19..167bp; Blast score=202; Percent Identity=66.0; E value=2e-52; Homolog= insB_g1 COG1662
MAKIDVTCPSCCSVKGIYRNGRSRSGHSSFKKLKPKSVTEAIKLGTEVIVCCERDEQWSYVKSKKPPRWLFYADDRIRRKVIAHVFGPRTKKTLMRLLALLTPFNIIIYMTDSWQSYEKALAGKLHVACKRYTQRIERHNLNLRQHLARLTRKTLSFSKSIEMHGRIIGYYLNIHHDQ

SEQ ID NO: 10183 - protein, 229 aa, Xenorhabdus bovienii
  Peptide sequence Name=Xb4151_4152.C444.gene45.pep
MFRSKSFINRSLSFNSLPLSQSTSNIEKTVYSVNTLITVKKVSAEEAVKAIDIILTKNMMEEWSFCDFHDQLDVQHDVNQKKWRERYMNSHHIFHNIKDHAEDYMKKAKSNDDRLFFIVYFGSVPIGGLQLSLKNLSESNLIFPKLPEVEYIVTHCGIRNCGIILMEQAVNESQQLNMGGKLMLYPLPDAVPAYLKMGFTKQNGTYLYLDPSESSVWHIVNGCYKYKKC

SEQ ID NO: 10184 - protein, 47 aa, Xenorhabdus bovienii
  Peptide sequence Name=Xb4151_4152.C444.gene46.pep
MAKIDVTCPSCCSVKGIYRNGRSRSGHSSFKKLKPKSVKKPLNPSPK

SEQ ID NO: 10185 - protein, 91 aa, Xenorhabdus bovienii
  Peptide sequence Name=Xb4151_4152.C444.gene47.pep
MVVRKVKEAASLAFLCRRQDKTKSDRPCFWSQNKKDINAPSSTAFGKTDSQDIVFFKIHRNAWQNYRVLSEHSSRSINWSHDPFRIEIKTD

SEQ ID NO: 10186 - protein, 210 aa, Xenorhabdus bovienii
  Peptide sequence Name=Xb4151_4152.C444.gene48.pep
  Gene classification: Gene name=XerC; Function=Integrase; Function class=L DNA replication, recombination and repair
  Homolog annotation: Query=3..193bp; Hit=9..199bp; Blast score=231; Percent Identity=58.0; E value=6e-61; Homolog= fimB COG0582
MLKRKYLTHSEIEQLLAELEKGPNAERNICMFFMGFIHGFRVSELLRLRMSDVDLRDRSLSVNRLKNGFSTIHPMIAREIQLIRKWMTIRKKLEKFGKSEWLFISRTGEPLSRQQFYKIIRNTSIKAEIAICANPHMLRHSCGYALADNGVDTRLIQDYLGHRNIRHTVIYTASNAGRFDGIWRARGKRRRVIFSTKLLTADEFSGSELS

SEQ ID NO: 10187 - protein, 191 aa, Xenorhabdus bovienii
  Peptide sequence Name=Xb4151_4152.C444.gene49.pep
  Gene classification: Gene name=TerZ; Function=Uncharacterized proteins involved in stress response, homologs of TerZ and putative cAMP-binding protein CABP1; Function class=T Signal transduction mechanisms
  Homolog annotation: Query=1..191bp; Hit=1..191bp; Blast score=301; Percent Identity=82.0; E value=3e-82; Homolog= ZterE COG2310
MGVSLVKGGNVSLTKEAPAMNIALVGLGWDMRATDGAAFDLDASVFMVGEDGKVLSDGHFVFFNNKVSPCGSVNHQGDNRTGEGAGDDEQIKIDLAKVPADVKKMVFAVTIYDADNNKQNFGMVSNSFIRVVNNDNDQEIARFDLSEDASTETAMIFGELYRHNTEWKFKAVGQGFAGGLSALAIQHGITI

SEQ ID NO: 10188 - protein, 192 aa, Xenorhabdus bovienii
  Peptide sequence Name=Xb4151_4152.C444.gene50.pep
  Gene classification: Gene name=TerZ; Function=Uncharacterized proteins involved in stress response, homologs of TerZ and putative cAMP-binding protein CABP1; Function class=T Signal transduction mechanisms
  Homolog annotation: Query=1..192bp; Hit=1..192bp; Blast score=327; Percent Identity=88.0; E value=6e-90; Homolog= ZterD COG2310
MGVSLSKGGNVSLSKEAPTMKNVLIGLGWDARATDGQDFDLDASAFLLSANGKVRGDADFIFYNNLKSADGSIMHTGDNRTGEGDGDDESLKIKLDQVPADVEKVVFVVTIHDAQTRHQSFGQVSGAFIRLVNDDTQVEVARYDLTEDASTETAMLFGELYRHNTEWKFRAVGQGYAGGLASVCAQYGINAS

SEQ ID NO: 10189 - protein, 343 aa, Xenorhabdus bovienii
  Peptide sequence Name=Xb4151_4152.C444.gene51.pep
  Gene classification: Gene name=TerC; Function=Membrane protein TerC, possibly involved in tellurium resistance; Function class=P Inorganic ion transport and metabolism
  Homolog annotation: Query=1..342bp; Hit=1..342bp; Blast score=528; Percent Identity=84.0; E value=1e-150; Homolog= ZterC COG0861
MVSTHIGFPMETVAVFIILSVGALFIDLFMHRHDKPISLRSAALWSIFWIAIAFVFAGFLFVHHGAETASLFVTGYALEKVLSVDNLFVIMAIFSWFAVPDRYRHRVLYWGIIGAIVFRGIFVAIGTSLLTLGPWVEMVFAVIVGWTAVMMLKSGDDGDEIEDYSQHLAYRLIKRFFPIWPKLRGHAFMLNQKEVNAELTKPENADVKVGRTGKAALYATPLMLCLAVVELSDVMFAFDSVPAVIAVSREPLIVYSAMMFAILGLRTLYFVLEALKKYLVHLEKAVIVLLFFIAIKLGLNASEHMFHHGYSISATTSLFVVIGVLTVGIIVSLLFPQKEENES

SEQ ID NO: 10190 - protein, 151 aa, Xenorhabdus bovienii
  Peptide sequence Name=Xb4151_4152.C444.gene52.pep
  Gene classification: Function=Tellurite resistance protein; Function class=P Inorganic ion transport and metabolism
  Homolog annotation: Query=1..151bp; Hit=1..151bp; Blast score=211; Percent Identity=72.0; E value=3e-55; Homolog= ZterB.2 COG3793
MSFLNKIKTAFSAGREELTNQVGRFKNRKFMEGTVAVCAHIAMASNGVSSEEKQKMVGFIKNSPELKVFDTTEIIEFFNKLVSSYEFDADIGKGEAMKFIMILKPQPEAAQLALRVGIAVAKSDGDFDNDEKTAAREICTTLGFTPADFEL

SEQ ID NO: 10191 - protein, 388 aa, Xenorhabdus bovienii
  Peptide sequence Name=Xb4151_4152.C444.gene53.pep
  Gene classification: Gene name=TerZ; Function=Uncharacterized proteins involved in stress response, homologs of TerZ and putative cAMP-binding protein CABP1; Function class=T Signal transduction mechanisms
  Homolog annotation: Query=1..162bp; Hit=1..162bp; Blast score=224; Percent Identity=68.0; E value=1e-58; Homolog= ZterA.2_1 COG2310
MNLTPGGNAPVSNQTLTVRVLSGTAVDVSAFRLYADGKVQGDPDMVFYGQPVNDDNTIRQAGGNVNTSFFVNLPTLRHDVQKVAFTVTCDGNQTISSLRTLSIQVELNGSIVLQGSVDVQGRTESALILGELYRRNNEWKFRFIAQGFNGGLKPLAEHFGVNIVDDAPAKTPVPPPAPTPAPNSVNLSKVSLTKEKPAISLSKRDNFGEIRVNLNWNQAASPAKKGVLQGIFSANKGVDLDLGAFIRLHDGERYVVQAIGKSFGDYHREPYVKLQGDDRTGAVRDGEWLHINGLEWKNISEVLVYALIYEGVPSWDNTDGVVTIHISGQAPIETRMTEGNNQKRMCAVGRLVNENGAIKVERINQYFSGHKEMDRAFGWGFRWVAGSK

SEQ ID NO: 10192 - protein, 195 aa, Xenorhabdus bovienii
  Peptide sequence Name=Xb4151_4152.C444.gene54.pep
  Gene classification: Gene name=TerZ; Function=Uncharacterized proteins involved in stress response, homologs of TerZ and putative cAMP-binding protein CABP1; Function class=T Signal transduction mechanisms
  Homolog annotation: Query=1..195bp; Hit=1..193bp; Blast score=269; Percent Identity=69.0; E value=1e-72; Homolog= ZterZ COG2310
MISLSKNQSISLAKQSASLAKVDFGLGWDPVSKNKGFLSRMFGGGNDEIDLDASCILLDNAGKTIDTVWFGQLDSLCGSVAHSGDNRTGEGSGDDETISVDLIKLPASVEYLVFTVNSFRGQTFNDVENAFCRVVDQSGKELARYQLDEQGAHTGIIISSLRRNRGQWDFTAHGAACRGRTIDDMYPQIVETVVR

SEQ ID NO: 10193 - protein, 384 aa, Xenorhabdus bovienii
  Peptide sequence Name=Xb4151_4152.C444.gene55.pep
  Homolog annotation: Query=11..384bp; Hit=5..378bp; Blast score=533; Percent Identity=67.0; E value=1e-150; Homolog= gi|16120631|ref|NP _403944.1| conserved hypothetical protein [Yersinia pestis] gi|22124467|ref|NP_667890.1| hypothetical [Yer
MTAFNDTQSYQGQISKWKLNSGTLTVTAARGTASLETLFDIAERRNPKRAFLFVSKVLGRHIPVSPSIMRSVYRQLSEQFPTHIPGPVLYIGMAETAVGLAAGVFQETRKQAEAPVFLTSTRHPVEGDLLCEFKENHSHATDHLIYWPEENRLRQRVVNARTLVLIDDEATTGNTFLNLLNALSHAGLNQIEHIVTVTLTDWSGKSVIERCPLPVSTVALIEGNWHWDADISAPIPVMPQVNVTARGDAGIIGKQSWGRLGLDDIQCDIGTEIHAKAGEKVLVLGSSEFVWQPFLLAERLEQEGAQVKFGSTTRSPISCGHAIQSVMSFTDNYGLGIPNFLYNVAHQQFDRILLCLETPKTAVDPALMTQLARVSPIVEIVSYD

SEQ ID NO: 10194 - protein, 264 aa, Xenorhabdus bovienii
  Peptide sequence Name=Xb4151_4152.C444.gene56.pep
  Homolog annotation: Query=1..259bp; Hit=1..255bp; Blast score=312; Percent Identity=55.0; E value=4e-84; Homolog= gi|15830602|ref|NP _309375.1| hypothetical protein [Escherichia coli O157:H7] gi|25390224|pir||D90797 hypothetical protein ECs1
MIKPVFLTDLDDTLFQTRRKIKKAPDIESCRVGALDRKYSPCSYMTEEQSILIDWLLAYAEVIPVTARNTEQLSRVKIPFNSWRIAAHGAVLLTPESTLDQEWQAHILAELTPYRDQFRELEHLSHRLIAAHGIEAWARIDYEYGDVPVYLVIKHRDCNRLEGLDVLAENITQEMADVFDSGNFYLHQNNNNLTLLPKCIDKGLATRHLLTRLRTERGVFPIIGLGDSLSDHRFMKLCNWFGMPQHSQFANTLMTSLFGTVNNE

SEQ ID NO: 10195 - protein, 333 aa, Xenorhabdus bovienii
  Peptide sequence Name=Xb4151_4152.C444.gene57.pep
  Homolog annotation: Query=1..332bp; Hit=27..358bp; Blast score=505; Percent Identity=72.0; E value=1e-142; Homolog= gi|16120629|ref|NP _403942.1| conserved hypothetical protein [Yersinia pestis] gi|22124465|ref|NP_667888.1| hypothetical [Yer
MTPVDIKEQLIQSGVRHYSEMLSQEPEPTPYHLDLFDRALEQGAIRLATEVVMLANALISRFGDTPIVLVSLVRAGVPLGVMLHQTLRKMGRQSYHYGISIIRDRGIDSTALSYIEQQHGTDGLVFVDGWTGKGAIMAELSRSLAGRSGYSGIPRLVVLADPCGCSWLAASDDDWLIPFGIMGAPVSGLISRSIWREEGMHGCVQCDHLSEFECSRLLVDTVADCRDRLDLGTIPVVDWQPQEKISLLELSKTVISTLTEVYRVDSINRIKPGIAEATRAVLRRVPEHVLVRSQYDPDVALLVHLARQKNVVITEVGDLIGQYRAVTIIKKVA

SEQ ID NO: 10196 - protein, 317 aa, Xenorhabdus bovienii
  Peptide sequence Name=Xb4151_4152.C444.gene58.pep
  Gene classification: Gene name=CitE; Function=Citrate lyase beta subunit; Function class=G Carbohydrate transport and metabolism
  Homolog annotation: Query=1..316bp; Hit=1..311bp; Blast score=423; Percent Identity=66.0; E value=1e-118; Homolog= Z1166 COG2301
MKPIPSPHQLGATLYIPATRQGIAEIVLHNKIPGLRSLVICLEDAVSDQDIPAAIENLDGVLQSLAGADISSSHTERDYPLIFIRPRNEEMGRYLVDNVNLSAVDGLVLPKFTRASLAGWWNIVGSTHLSMMPTLETEEVFDSRQLNQLADSLKAHPCYKRIIALRIGGNDLMNVISLRRSRDFTLYEGPMGYVIKMLVTIFAARGFSLTAPVCEHIDDLRLLEKELVLDIAHGLVGKTAIHPGQIEYIQRALMVNGHDYADALRILNSSQAVFKSQGTMCEPATHRRWAVNILDRAKYYGIAPEFNEESCKTFNLF

SEQ ID NO: 10197 - protein, 158 aa, Xenorhabdus bovienii
  Peptide sequence Name=Xb4151_4152.C444.gene59.pep
  Homolog annotation: Query=1..146bp; Hit=1..148bp; Blast score=132; Percent Identity=53.0; E value=3e-30; Homolog= gi|16120627|ref|NP _403940.1| putative exported protein [Yersinia pestis] gi|22124463|ref|NP_667886.1| hypothetical [Yersinia p
MLLSPKQFRNFRLTLLLSHEKPVSKVRMIRELNCSEPTLTRALRELRDLYCADIRFSKMGNTYQLVDKGTLTKKDVRRIEELLIQNNSLKAEEAISHVFLDKEKKKPVSLSLRMSVIRKIDGLANRLETTRSDVVEMVVDRFMETLQKEAMDVDSQKR

SEQ ID NO: 10198 - protein, 164 aa, Xenorhabdus bovienii
  Peptide sequence Name=Xb4151_4152.C444.gene60.pep
  Gene classification: Function=Uncharacterized membrane protein; Function class=S Function unknown
  Homolog annotation: Query=1..164bp; Hit=1..164bp; Blast score=240; Percent Identity=89.0; E value=6e-64; Homolog= yqhA COG2862
MERFLENIMYASRWLLAPVYFGLSLALLALAVKFFQEIIHILPHIFSIAESDLILTLLSLIDMALVGGLLVMVMFSGYENFVSTLDIYEHKEKLSWLGKMDATSLKNKVAASIVAISSIHLLRIFMDAKNIPDNKLMWYVIIHLTFVMSAFVMGYLDKLTRHKH

SEQ ID NO: 10199 - protein, 152 aa, Xenorhabdus bovienii
  Peptide sequence Name=Xb4151_4152.C444.gene61.pep
  Gene classification: Gene name=WecD; Function=Histone acetyltransferase HPA2 and related acetyltransferases; Function class=K Transcription
  Homolog annotation: Query=18..149bp; Hit=8..140bp; Blast score=79; Percent Identity=27.0; E value=2e-15; Homolog= yiaC COG0454
MSNKYFGDIKLRPIEHDNDVQAVVDVWFNTSIKCHAFVSEDFWHSCKTDMKEIYIPNSETVVATINNEVVGFISLLDNILASIFILPEYQNRGIGLQLLNHAFEVRNSLTLNVYEKNTNARKFYASQGFEEKEQGIDEHTGEPEITMVWNRS

SEQ ID NO: 10200 - protein, 44 aa, Xenorhabdus bovienii
  Peptide sequence Name=Xb4151_4152.C444.gene62.pep
MVVLCHRFYRKVVLGDWRDAREYLPHLIKLTKQQRRGAGYDVKP

SEQ ID NO: 10201 - protein, 1040 aa, Xenorhabdus bovienii
  Peptide sequence Name=Xb4151_4152.C444.gene63.pep
  Gene classification: Gene name=AprE (BS); Function=Subtilisin-like serine proteases; Function class=O Posttranslational modification, protein turnover, chaperones
  Homolog annotation: Query=29..600bp; Hit=15..556bp; Blast score=258; Percent Identity=35.0; E value=2e-68; Homolog= PA3535_1 COG1404
MNKRYRIFQQIPVAGRLSVKTESRILFRAVACCLAAVSASAFAGSYNDPGRLNDPASWRTSEFRADWGLGAIHADEAYARGYTGKGIKLGIFDQPVYTKHPEFMSPDKVITLATSGIREYTDPYIKVKKGDKFNYNGTPTVGSSGKLGAHGTHVGGTAAGIRDGEKMHGVAYNAQIISADNGDPGPEDGIILGNDGGVYQAGWNALIGSGARIINNSWAIGITKKFTLGGYNPAYPHFTVADARKQFDEIKLILGTKPGGAYQGAIDAARGGIVTIFAAGNDGNLNNPDAMSGLAWFVPEIAPNWLTVASLQQDLKSTNSVPYSISYFSSRCGYTASLCVSAPGSHIYSAIISGTGMDNLTTGYAHYDGTSMAAPHAAGSIAVLMERFPYMAGDQIASVLRTTATDMGEPGIDALYGWGMINLGKAIHGPGMFYTAEDIPQAFRIPDPDGVAYGSSQFIADISGIGTVLDKGKPTERICDSQQCAQDIWSNDISGHGGLTKQGSGTLILAGKNTYSGPTLVRQGLLDINGELTSSVSVLESGVLGGNGTIGALSVQRGGTVAPGNSVGTLNVSRDVAFEAGSHYAVEIAADGRSDHIQAAGRAQLRGGDVAVSLENSANLLSRNEVRSLIGQQYRILSAKQGINGRFDQVAPNYFFLGTRLSYQPDEVTLHVGRNNTAFADVAKTPNERAVAAAADTLSVGNPVYESILSFTSVDQARQAFSRLDGQIHSDITSSLVNDSRYLRDTLNTRLSQAEGRASSSDIREDDNGAWARLLGAWSHASGTNNSTGYQASTYGVLLGFDAPTDAYSRLGIATGYTRTSLDGGYDSSADSNNYHLALYGDRQFGDLALRVGGGYTWHRIDTARSVSYGSQFDSQSAKYSGRTAQLFAEAAYNLPAGSVNFEPFVNLAYVGFRNNGINENGAAAALHGDKQHTEAKLSTLGLRANHSWQAMGGTSVALQGELGWQHQYGDRERVTSLAFRGSDTSFVTRSVPASRDGLVLKANAEMTASDNVSLTLGYSGLLSSSHQDNSVHAGFNWRF

SEQ ID NO: 10202 - protein, 211 aa, Xenorhabdus bovienii
  Peptide sequence Name=Xb4151_4152.C444.gene64.pep
  Gene classification: Gene name=PspE; Function=Rhodanese-related sulfurtransferases; Function class=P Inorganic ion transport and metabolism
  Homolog annotation: Query=105..207bp; Hit=1..103bp; Blast score=112; Percent Identity=51.0; E value=2e-25; Homolog= Rv1674c_2 COG0607
MFDKQTLVEIAEIAKVLGNTHRLTLLECLADTEQSVERLSDLSGLSVANTSQHLQHLKRVGLLQSRKEGKHVLYRQGEGPLADILSALLQYAEFNRTEMRRLIDDTNNQESISWEELLDRIKEKSMTLLDVRPKEEFEQGHLPNAINIPVDELGSRLDELATGQELIAYCRGPYCVLSANALELLRAKGVRARRFKKGFSGWKDAGMHTEV

SEQ ID NO: 10203 - protein, 165 aa, Xenorhabdus bovienii
  Peptide sequence Name=Xb4151_4152.C444.gene65.pep
  Homolog annotation: Query=9..161bp; Hit=7..159bp; Blast score=141; Percent Identity=48.0; E value=4e-33; Homolog= gi|28900641|ref|NP _800296.1| conserved hypothetical protein [Vibrio parahaemolyticus RIMD 2210633] gi|28809021|dbj|BAC62129.1|
MNEGLELIVRSVLIGAGATVVMDLWAVFIKRSFGVPSLNYSMVGRWIGHIPKGIFVHKSIVQAEPVKGETGIGWFAHYLIGIIFAGLLLLIWGLDWAKNPTLIPALIVGIVTVVAPYFIMQPGIGMGIAASKTPTPNIARLKSLMAHTSYGVGLYLAALLLTLFS

SEQ ID NO: 10204 - protein, 92 aa, Xenorhabdus bovienii; identical to SEQ ID NO: 6203
  Peptide sequence Name=Xb4151_4152.C444.gene66.pep

SEQ ID NO: 10205 - protein, 106 aa, Xenorhabdus bovienii
  Peptide sequence Name=Xb4151_4152.C444.gene67.pep
MSAHHQKTFPRQLIRTTQKGYYNSIKWSCIKWLVAVICFRLFKDEVWPKLMSIAVIATNQNRSKDMGKEMADILVIAVIAAVRSFSWRIPIRPANPALKNRLSISR

SEQ ID NO: 10206 - protein, 105 aa, Xenorhabdus bovienii
  Peptide sequence Name=Xb4151_4152.C444.gene68.pep
  Gene classification: Gene name=AraJ; Function=Arabinose efflux permease; Function class=G Carbohydrate transport and metabolism
  Homolog annotation: Query=9..104bp; Hit=308..403bp; Blast score=63; Percent Identity=50.0; E value=4e-11; Homolog= PA2314 COG2814
MTILSSYNSLFVWFGLIVWGMSFGGAPTLLQTALADVAEENADVAQSMLVTIFNLAVAGGGIIGGGLLNNYGMTSFPITMIALSLFALSLVWRAKKNGFRPGQRR

SEQ ID NO: 10207 - protein, 42 aa, Xenorhabdus bovienii
  Peptide sequence Name=Xb4151_4152.C444.gene69.pep
MPEDLHNFIFFSKNFDRASGTLVPFLSKSQVSQVSVSQPSMF

SEQ ID NO: 10208 - protein, 193 aa, Xenorhabdus bovienii
  Peptide sequence Name=Xb4151_4152.C444.gene70.pep
  Gene classification: Function=Putative transposase; Function class=L DNA replication, recombination and repair
  Homolog annotation: Query=1..127bp; Hit=59..185bp; Blast score=201; Percent Identity=76.0; E value=5e-52; Homolog= XF2303 COG3316
MAERGIEVDHSTRHRWVTRLVPLLDKAFRRYKRPVGRRWRMDETYIKVKGQWKYLYRAVDTTGQTIDVLLTAKRDAPASLRFFHKAIRHHGEPEVVTIDKSGANTAALDKLNADKPEEEMITIRQNKYLNNLVEQDHRNIKRRTGSMLGFNSFRRAQTLLAGIEVVSMLRKGQYIQPKDNTLSPTEMFYRLIA

SEQ ID NO: 10209 - protein, 349 aa, Xenorhabdus bovienii; identical to SEQ ID NO: 5796
  Peptide sequence Name=Xb4151_4152.C444.gene71.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 10210 - protein, 89 aa, Xenorhabdus bovienii
  Peptide sequence Name=Xb4151_4152.C444.gene72.pep
  Gene classification: Gene name=MinE; Function=Septum formation topological specificity factor; Function class=D Cell division and chromosome partitioning
  Homolog annotation: Query=1..86bp; Hit=1..86bp; Blast score=126; Percent Identity=82.0; E value=4e-30; Homolog= minE COG0851
MALLDFFLSRKKPTANIAKERLQIIVAERRRGDSEPAYLPEMKRDILAVICKYVQIDPEMLSVQFEQKDDDISVLELNVTLPETEESPK

SEQ ID NO: 10211 - protein, 270 aa, Xenorhabdus bovienii
  Peptide sequence Name=Xb4151_4152.C444.gene73.pep
  Gene classification: Gene name=MinD; Function=Septum formation inhibitor-activating ATPase; Function class=D Cell division and chromosome partitioning
  Homolog annotation: Query=1..270bp; Hit=1..270bp; Blast score=461; Percent Identity=90.0; E value=1e-130; Homolog= minD COG2894
MARIIVVTSGKGGVGKTTSSAAIATGLAQSGKKTVVIDFDIGLRNLDLIMGCERRVVFDFVNVIQGDAALNQALIKDKRTENLYILPASQTRDKEALTREGVEKILNELDQQGFEFIICDSPAGIESGALMALYFADEAIITTNPEVSSVRDSDRILGILASKSRRAEKSNEPIKEHLLLTRYNPGRVNRGDMLSMEDVLEILCIPLLGVIPEDQSVLRSSNQGEPVILDKESDAGKAYEDTVLRLLGEERPFRFIEEEKKGFLKRLFGG

SEQ ID NO: 10212 - protein, 227 aa, Xenorhabdus bovienii
  Peptide sequence Name=Xb4151_4152.C444.gene74.pep
  Gene classification: Gene name=MinC; Function=Septum formation inhibitor; Function class=D Cell division and chromosome partitioning
  Homolog annotation: Query=1..226bp; Hit=1..230bp; Blast score=272; Percent Identity=59.0; E value=2e-73; Homolog= minC COG0850
MSQSPIELKGSNFTLSVVHLHDDQPEVIQRAMQEKMEQAPEFLKNAPVVINISDLPAGADLLALYRAVESVGLRIVGISGCQDEDQRKIVLKSGLPLLKEGKSQKIPTQENKPTEPIFKKTRIINTPVRSGQRIYAPNSDLIVTSNVSAGAELIADGNILIYGVLRGRVLAGASGDKESQIFCTHLNAELCSIAGQYWLSENIPENFVGKAAKLRLVINELTIETLV

SEQ ID NO: 10213 - protein, 89 aa, Xenorhabdus bovienii
  Peptide sequence Name=Xb4151_4152.C444.gene75.pep
  Gene classification: Function=Uncharacterized BCR; Function class=S Function unknown
  Homolog annotation: Query=1..87bp; Hit=12..98bp; Blast score=121; Percent Identity=70.0; E value=1e-28; Homolog= ycgL COG3100
MICVIYRSPKRDQTFLYVEKKGDFSRVPEALLKTFGEPQYSMMISLSGRKKLANADIEKVKIMLSEQGFYLQVPPPVESLMSEHLAVNK

SEQ ID NO: 10214 - protein, 361 aa, Xenorhabdus bovienii
  Peptide sequence Name=Xb4151_4152.C444.gene76.pep
  Gene classification: Gene name=MltB; Function=Membrane-bound lytic murein transglycosylase B; Function class=M Cell envelope biogenesis, outer membrane
  Homolog annotation: Query=48..352bp; Hit=16..321bp; Blast score=304; Percent Identity=49.0; E value=1e-82; Homolog= VC1956 COG2951
MKLISGVALMTVTLLVGCTSSNGKVLQDQSRQAVVIQKEIRVLDGQFPIASREPSQFPTYVALLKQQAKEQGFSEKTLDRAFADIHFISRVIQSDRNQPEKKITLADYLNRVLSARKIEQGVIQYQNNLPQLEIISRKYGVPKDYIVALWGLESGFGKIQGKEDVISALSTLAFEGRREDLFIKQLMAALEIIEKKYIDEHQTLKGSWAGAMGQSQFMPTSYLNYAADGNGDGKIDIWNSKEDVFASIANYLAKEGWQQGLPWGYGVSLPAGFDQNLEGVKLEQGKTIIQWQTLGVSSPNFASLPVNTKGWIVIPNDTEQRAFWVTQNFRTIMHWNRSYNFALSVGMMADHIGQKTHFLTH

SEQ ID NO: 10215 - protein, 218 aa, Xenorhabdus bovienii
  Peptide sequence Name=Xb4151_4152.C444.gene77.pep
  Gene classification: Gene name=MhpD; Function=2-keto-4-pentenoate hydratase/2-oxohepta-3-ene-1,7-dioic acid hydratase (catechol pathway); Function class=Q Secondary metabolites biosynthesis, transport and catabolism
  Homolog annotation: Query=1..218bp; Hit=1..219bp; Blast score=325; Percent Identity=68.0; E value=2e-89; Homolog= ycgM COG0179
MYQHRDWQGVLLDFPANKVVCVGSNYERHMKEMGSKVTEEPVLFLKPETALCDLCQPVSIPQGLGAVHHEIELAVLIGTTLKNANEERVGKAIAGFAVALDLTLRDLQHKFKQSGQPWEKSKAFDGSCPISGFIPVKVFSEPQNAQLSLTVNGESRQNGNTSDMRMPIIPLISYMSRFFTLRPGDIILTGTPEGVGPLQSGDVLDVSLNEHVLTTRVI

SEQ ID NO: 10216 - protein, 148 aa, Xenorhabdus bovienii
  Peptide sequence Name=Xb4151_4152.C444.gene78.pep
  Gene classification: Function=Uncharacterized ACR; Function class=S Function unknown
  Homolog annotation: Query=4..148bp; Hit=10..155bp; Blast score=239; Percent Identity=77.0; E value=6e-64; Homolog= ycgN COG2983
MTELMSQPFWQAKTLEQMTDREWEALCDGCGQCCLHKLMDEDTDAIYFTNVACNQLNIKTCQCKNYADRFRYEPDCIKLTRENMVTFEWLPMTCAYRLIGEGKKLLPWHPLVSGSKSAMHAERISVRHIAVREADVVDWEDHIMNKPE

SEQ ID NO: 10217 - protein, 48 aa, Xenorhabdus bovienii
  Peptide sequence Name=Xb4151_4152.C444.gene79.pep
MKYISYNHYLNLLTIPMNFDLQYDGKKTNPGSIRIYFSCPTDTQNTAI

SEQ ID NO: 10218 - protein, 212 aa, Xenorhabdus bovienii
  Peptide sequence Name=Xb4151_4152.C444.gene80.pep
  Homolog annotation: Query=1..212bp; Hit=1..212bp; Blast score=279; Percent Identity=79.0; E value=2e-74; Homolog= Pa|Phot5-515h10.p1k _g98| 63020 - 63658 2631 212 aa, chain -
MSIENININEQKIGKDSVVLGHAEALAIHAVAIGASPRNSKAISEAAIAIGQNQLAGKQGDATVVWPIAIGADSVSSGLASIALGQKVTASASQAVAIGQHSSATEKGSVALGADSIANKPNVVSVGKSGHERKIVHVAVGDISNHSTDAVNGQQLYSETAKINVLLDEKNKQLENRIETLESNIANLTLLNKNNADDIELLKQRLFDALNY

SEQ ID NO: 10219 - protein, 105 aa, Xenorhabdus bovienii
  Peptide sequence Name=Xb4151_4152.C444.gene81.pep
MVIHSIGIFLRKVSMDSGWLNFVMICNLRGRSDIKIWSQIIVWDQLCVRIPDITTHRIAMNTGFSSHISCFYQPRKTDNLSAPQSIQGMINGKLFGSCRTLWHGF

SEQ ID NO: 10220 - protein, 97 aa, Xenorhabdus bovienii
  Peptide sequence Name=Xb4151_4152.C444.gene82.pep
  Homolog annotation: Query=1..94bp; Hit=3..96bp; Blast score=66; Percent Identity=36.0; E value=1e-10; Homolog= gi|16760813|ref|NP _456430.1| hypothetical protein [Salmonella enterica subsp. enterica serovar Typhi] gi|25511840|pir||AB0739 hyp
MASYLVRVELYGTGSDGYEKLHNRMTANKFNKSIQFPNGKWHRLPSGTYIGNSSLESLQLAEKIKSIATPFSSKEPSIFVCIYSNWSAALYPDKGTG

SEQ ID NO: 10221 - protein, 144 aa, Xenorhabdus bovienii
  Peptide sequence Name=Xb4151_4152.C444.gene83.pep
  Gene classification: Gene name=HslJ; Function=Heat shock protein; Function class=O Posttranslational modification, protein turnover, chaperones
  Homolog annotation: Query=1..142bp; Hit=1..138bp; Blast score=97; Percent Identity=42.0; E value=5e-21; Homolog= hslJ COG3187
MKKAISFAIATLLLTACQSSGVSATGNVTVRDLQHRNFALISVNGATVSNKEDSKLSIAFSEKMFVSATMCNHFMGIGKLKKRVLTVSILEKSQMFCVNEQLHQWDQVIYDVLTEGATVRLKRKQLTLTNDKNTLVYVLRDITQ

SEQ ID NO: 10222 - protein, 331 aa, Xenorhabdus bovienii
  Peptide sequence Name=Xb4151_4152.C444.gene84.pep
  Gene classification: Gene name=LdhA; Function=2 Lactate dehydrogenase and related dehydrogenases; Function class=C Energy production and conversion
  Homolog annotation: Query=1..328bp; Hit=1..326bp; Blast score=516; Percent Identity=75.0; E value=1e-146; Homolog= ZldhA COG1052
MKLVVYSKKQYDRKHFEMLNQRLGLDYHIEFFDFSLSPQTAKNAIGADAICIFVNDDAGREVLEELAAMNIKILALRCAGFNNVDLDAAKELGIQVVRVPAYSPESVAEHAVGLMLCLNRRIHRAYQRTRDANFSLEGLTGFNMYKRTAGIIGTGKIGLATLRILKGFGMRLLAHDPYPNKEVLELGVKYVDLDTLYAESDVISLHCPMTPENHHLLDETAFNKMKDGVMIINTSRGALIDSIAAINALKQQKIGALGMDVYENERDLFFEDKSNDVIQDDIFRRLSSCHNVLFTGHQAFLTEEALTSISETTLQNIQQLTSGKSCPNLVG

SEQ ID NO: 10223 - protein, 872 aa, Xenorhabdus bovienii
  Peptide sequence Name=Xb4151_4152.C444.gene85.pep
  Homolog annotation: Query=1..868bp; Hit=2..869bp; Blast score=1063; Percent Identity=58.0; E value=0; Homolog= gi|37526062|ref|NP _929406.1| hypothetical protein [Photorhabdus luminescens subsp. laumondii TTO1] gi|36785492|emb|CAE14439.1| un
MTKIFKVFAVMITLLVLLVLAGWYTLPHWLPLIASHWLPQGVTLSLSQPKWEKNTLRLDDLALKAKGCEWVNVSGLSVGYPRKEQTKEHYWNIHAFSVHSNSPCLVQLPATENPSAPLSIEDILSSIPAVKLVVDHFELTPWQEFAGKLQFDSSRQGQTFSYQGKQLKLNVHTADKKTLVIHQFLVKLPEQEISLNGDISLPLDIDALPAQGQITGRLSISQYPDPLQIILKWQGQGGMLTIREERQQRILAELPWSFNQSQFLITDGKWHWMDMGQPLSGGVNLTFDHWKEGMGGMLVSGRVNLITQNELGKGNIVLSIKPALINMANAHIPFQLTGQMNHGQMVITMSLPAIVTGPLVAPKITFQPGALFRAWGKVSETFTVKEARLPLAGTYLTRDGLTGRLQAIVTAQDSYWGKFKLHLDGNAEDFIPDKGNWHWRYWGNGHLPPLQAKWDIAGTGSWNRSQVTVNALNTGFDVIQYGLVQVEAPRLQLIKPLVWERSATQPTFMGDLQLSTLRTDFRSGGFLPPFDFKATVTGQSPDNFILNGKLSPKGIEPIPFYGRWDGTRLRGEARWPSQSLLALQSLIPADLGMMVRGGNLYAQAAFSAAKGQGLRAGGHWVVKNASVWLKDGEIDGLNFVLPWRLQEHTWQLGVTSPVQLRVNEIKGLFGMQNVTADLLGFYPPTETQPLTLFNVNVDMLDGKLGLDKLQLPQKQAAVLRFDKLNLSKLFGVLKVKQIAMSGRISGELPLLLNDKNWIIQQGWVSNDGSLTLRLDKDTVDSIGKNDLTAGMTMDWLSYLEISHSKAHVTLDNLGTLILNSEVIGVNPRVDKKREVRLNYRHEENTFQLWHSLRFGSNLEEWLQKNISVRSDK

SEQ ID NO: 10224 - protein, 69 aa, Xenorhabdus bovienii
  Peptide sequence Name=Xb4151_4152.C444.gene86.pep
  Homolog annotation: Query=1..69bp; Hit=1..65bp; Blast score=76; Percent Identity=62.0; E value=8e-14; Homolog= gi|37526063|ref|NP _929407.1| hypothetical protein [Photorhabdus luminescens subsp. laumondii TTO1] gi|36785493|emb|CAE14440.1| un
MITKTGLRLSVGIASLMLASIILTGCIRLEVATPDKPIKIEMNVKIEHEIHIKVDRQIEDMLKNNSNLF

SEQ ID NO: 10225 - protein, 106 aa, Xenorhabdus bovienii
  Peptide sequence Name=Xb4151_4152.C444.gene87.pep
  Gene classification: Function=Uncharacterized BCR; Function class=S Function unknown
  Homolog annotation: Query=1..106bp; Hit=3..109bp; Blast score=93; Percent Identity=48.0; E value=4e-20; Homolog= ydbL COG3784
MKKAGVIFLASLLFSSFAVGMTLSEAKQQGLVGETFSGYLAPVKKTRDTQSVIQKVNEEREKKYAEIAAQNNMTTNQVAKMAGEKLVNRAGAGEYVLGINGNWVKK

SEQ ID NO: 10226 - protein, 204 aa, Xenorhabdus bovienii
  Peptide sequence Name=Xb4151_4152.C444.gene88.pep
  Gene classification: Gene name=AcpD; Function=Acyl carrier protein phosphodiesterase; Function class=I Lipid metabolism
  Homolog annotation: Query=1..200bp; Hit=1..200bp; Blast score=284; Percent Identity=69.0; E value=4e-77; Homolog= ZacpD COG1182
MNKVLVLKSSILAQHSQSNKMADYFIEKWQANHIDDNVTVRDLAENPVPVLDSELVGALRPSDVEMTARQKATLALSDELIAELKVHDVIVLTAPMYNFTIPTQLKAYFDLIARAGSTFRYTETGPEGLLKNKRAIVLTSRGGIHKDNPTDLITPYLRTFLGFIGINDVEFVFAEGFGLGAESAELAHQSAQNTINDMMAKISA

SEQ ID NO: 10227 - protein, 1301 aa, Xenorhabdus bovienii
  Peptide sequence Name=Xb4151_4152.C444.gene89.pep
  Gene classification: Gene name=HrpA; Function=HrpA-like helicases; Function class=L DNA replication, recombination and repair
  Homolog annotation: Query=21..1300bp; Hit=2..1280bp; Blast score =2028; Percent Identity=77.0; E value=0; Homolog= ZhrpA COG1643
VESPLTASFAELFAELEHTPLRDQFRLKKRLHGAAKIKNQASLQAVAQSISGDIATAKQKVINRQASCPPIKYPENLPVSQKKDDIYKAIRDNQVVIIAGETGSGKTTQIPKICLELGRGVKGLIGHTQPRRLAARSVASRIADELETPLGSTVGYKVRFNDHVSENTLVKLMTDGILLAELQQDRLLLQYDTLIIDEAHERSLNIDFILGYLRQLLLKRPDLKIIITSATIDPERFSRHFNNAPIIEVSGRTYPVEIRYRPVAGDDNDSDRDQLEAIIGAVDELGHESSGDILVFMSGEREIRDTADALDKQNFPHTEILPLFARLSNSDQNRIFQPHVGRRIILATNVAETSLTVPGIKYVIDTGFARISRYSYRTKVQRLPIEPISQASANQRKGRCGRVSDGICIRLYSEDDYLSRPEFTDPEILRTNLASVILQMTSIGLGDVSAFPFVEAPDKRNVQDGVRLLEELGAIDPESLSGGTYRLTQMGQQLAQLPIDPRLARMVLEARAHGCVREVMVITSALSIQDPRERPLEKQQASDEKHRRFADKDSDFITFLKLWDFLVEQQKALSSSQFRKLCRQDYLNYLRVREWQDVYTQLRQVVKEIGLPINSQEADYRSIHIALLTGLLSHVGQKDTDKQEYTGARNARFSVFPGSGLFKKPPKWGMVAELVETSRLWGRIAARIEPEWIEPLAAHLIKHHYSEPHWQKSQGAVMATEKVTLYGLPIVAGRLVNYSQIDPMLCRELFIRHALVEGDWQTRHSFFRANLKLREEVEELEHKSRRRDILVDDETLFSFYDQRIGKEVMSSRHFDRWWQVASKDQPELLNFEKSMLIKGDADKISASDYPNYWYQDNLKFRLSYQFEPGTDADGVTVHIPLPILNQVKDEGFDWQIPGIRHDLVVALIKSLPKPVRRNFVPAPNYAQAFLERITQPQATLLDSFEKELRRMTGVTVSRDDWQWDQIPDHLKITFRIIGEKNKPLAEGKVLSALKLQLKGKVQETLSAVADDGIEQSGLHIWSFGELPERYEQKRGGYSVKAFPALVDEKDSIGIKLFETESEQQNAMWEGTRRLLLMNIPSPIKYLHEKLPNKSKLGLYFNPYGKVLDLIDDCISCGVDRLIAENGGPAWNEEAFASLQNKVRADLNDAVVDIARQVEQILTTVFSINKRLKGRVDIALALALSDIKEQISGLVFNGFVTAHGWKRLADVLRYLNGIERRLEKLAIDPNRDRVHMSRIENIQRQWQQWLAKLSIQQKQLPEVKEVRWMIEELRISLFAQQLGTAYPISDKRILQVMENIAM

SEQ ID NO: 10228 - protein, 1036 aa, Xenorhabdus bovienii
  Peptide sequence Name=Xb4151_4152.C444.gene90.pep
  Gene classification: Gene name=EntF; Function=Non-ribosomal peptide synthetase modules and related proteins; Function class=Q Secondary metabolites biosynthesis, transport and catabolism
  Homolog annotation: Query=21..684bp; Hit=641..1235bp; Blast score =285; Percent Identity=33.0; E value=1e-76; Homolog= BS_dhbF COG1020
MLEHHNVVSLIHAQCQISKPSLGDRILQFVTVSFDISVSDIFPTLASGATLVLRPPHIKIPNVTFVDFLREQKMTIINIPTAFWHHWVQEIMAGRGGFSPYLHTVIVGGDKVEHRYLMDWLSCPETQSCRWFNAYGPTEITITATALMIDDKQTPSMTDNVPIGRPLSNTRIYILDALGQPVPVGVSGEIHIGGMGVARGYSNQPELTAEKFVVDPFSNHPNARMYKTGDLGRWRTDGNIEYLGRNDFQVKIRGFRIELGEIETRLLQCHGVREAIVLHREVLTCEGMPGDKRLVAYLLAEPNAELVPAELRQQLAQHLAEYMLPSAFVTLDAFPLAPNGKLDRQALPTPDQAAIVTRVYEAPVGDIEMALAEIWQALLGLEKVGRYDHFFELGGHSLMVVSLIERLRGQGWSLDIRTVFATPVLTEMAKVMLIAGDNAATFTAPSNLIPDGCTAITPDMLPLISLTQCEIDAIAATLPAGAANIQDIYPLAPLQEGMLFHHLLQTQGDNYLLHILLTFDTRERLDAFLTAFQQVIDRHDILRTAFCWQKLPQPVQIVWRQAPLRIDTFVPDSDKDIPAQLLAHTDPYRHRLDISQAPLLSTDIAHDPHQDKWLLALCCHHILNDHMSLDLIINEINELLYHRTGDLPPALPYRHFIAQSLRVPMSDHEAYFREMLADVDTPTAPFGILDVYSGNRPVTEVIKPLRAALARAIRTQARRQGVSPGVLFHVAWAQVLAKISGRDDVVFGTVLLGRMQGSADIERTLGLFINTLPVRIQLAGNSVQETVKAAYRSLTRLLEHEQAPLALAQRCSGVTPPLPLFSSLLNYRHSQSDITRTLWEGIHLTTAQERTNYPLYLTVDDLGKGFLLAAQTVPGIDPAGLIAYMTTALAGLVEALETEPQRPILSLSILTASEHRQLQDTLTQHFTQSHGVREETAVARGYEAPIGDMETALAQIWQKLLKREKVGRHDNFFELGGHSLTAIQLLARMYEQNMEIPLAAVFTHPTLCELASTVGKPTSPLVAELWTKLAKNFYSK

SEQ ID NO: 10229 - protein, 2812 aa, Xenorhabdus bovienii
  Peptide sequence Name=Xb4151_4152.C444.gene91.pep
  Gene classification: Gene name=EntF; Function=Non-ribosomal peptide synthetase modules and related proteins; Function class=Q Secondary metabolites biosynthesis, transport and catabolism
  Homolog annotation: Query=1922..2772bp; Hit=1..832bp; Blast score =636; Percent Identity=44.0; E value=0; Homolog= PA2400 COG1020
MSHSQNRSSEISLAVDNNNTLLPHVHPLSSPQQVIWLDQVIHPGSPNYNIGFFICIDGELDEALFTRAFEAVVYRHDTLRLQLINTHTLPLQEVAGTLPASIDIHDLSPHIDAEAQAKQHINAEFMRPFHLDGALWRTELLRVSHTRRYWHFCCHHLIMDGISLSILSEDVIDTYNRLMRGETLNKTAPSYLNFITDDRDYLASQRYSHDLQFWVKRYESLPPPLLPPANSNKAENHGQAKPILWQVDKALFQRIEDTVSRQGLSILHFMYAVLASYFSRTTGEDEIVIGIPVHNRKNAQQKRTMGMFASVIPIGVTISPEDTFLDVMHKASTELRRCYKHQRLPISEINRQTHIQQKTGRVQLFDITLSLEPFKANLHMAGEDTNIQLVDIHHGVPYPLSIIIEQYTTGLDDDLQSITIEFDFSTDYLSTTEVMALQSRLAVLIDAAITALDTPIVNLPILPEDERQQILVDFNATQANFPQNALIHQLFEAQVQRNPDAIAVVFEDQSLSYDELNRRANRLAHHLISLNVRPDDRVAVCVERSLDMVVGLLGILKAGGAYVPLDPAYPAERLAYMLDDAAPMVLLTQTALLDTLSTTIPTLVLNEPESTMATQPTHNPDVQALGLTSHHLAYVIYTSGSTGLPKGVMIEHHGLSNLISTQQDVLAIEPGSHILQFASNSFDACIWECCMALLGGACLHLAHRIHLLPGTALSDTLEANAITHILLSPTALAALDSIPVTLQTLIVGGEACPSSLVKRWATSRRMINAYGPTESTVCSAIYLCDNQEERTPPIGRPIANTRIYILDPYGQPVPLGVVGEIHIAGAGVARGYLNRPELTAERFLPDPFSGIPAARMYKTGDLGHWLPDGNIEYLGRNDFQVKLRGFRIELAEIESQLVQCHGVREAVVLAREDISDENTPGEKRLVAYLLAEPNAELVPAELRQQLAQHLAEYMLPSAFVTLDTFPLTPNGKLDRQALPAPDQTAVVARIYEAPADKMEMALAEIWQALLGLEKVGRYDHFFELGGHSLMAVNLIERLRSRGWVLDIRTVFSTPMLAEMAQAMLLAQDSIAAFSVPPNLIPDGCTTITPDMLPLISLSQREIDTLAATIPGGAANIQDIYPLVSLQEGILFHHLLQPQGDIYLLRNMLAFDTRESLNAFLTALQQVINRHDILRTAVYWQGLAQPVQVVWRQALLHTDIFVPTSDKDVQSQLLAHTDPDQRCLNLCQAPLFSIDIAHDPIQNEWLLALCFHHLVSDHITLGLIIAEISELLQNRAENLPATQPYRNFVAQSLSVPASEHETHFREMLASVDAPTTPFGILDVHSGNRQMTEATHLLDAILARAIRTQARRQGISPSVLFHVAWAQVLAKTSGRDDVVFGTVLLGRMQGSAGIDRSLGLFINTLPIRIRLAGNSVQTTVQTVYRDLTRLLEHEQASLTLAQHCSGVAPSLPLFSALLNYRHSQPETTFATWEDKGIRLLAEQERTNYPLTLSVDDLGEGFRLVAQTVPDIEPARLAAYMTTALTGLVEALETEPQRPIGNRSILPATEHQQLLVDFNATQVDFPQYALIHQLFEAQVQRTPDATAVVFEDQSLSYNELNHRANRLAHHLITLGIRPDDRVALYVERNLAMVVGLLGVLKAGGAYVPLDPAYPDERLAYMLEDATPKVMLTQKMLADRLASTVPTVMPIIILDNPEPLIEAMPTDNPDVRSLGLTSRHLAYVIYTSGSTGLPKGVAIEHRNTVNFLTWVQQAFRPEELAHTLFATSLNFDLAVYECFAPLISGGTVHLVSDALSLVTKKPSVSLINTVPSAITNLIDTNAIPAATRTVNLAGEALKPHVVEQLFACSSVQEVCNLYGPSETTTYSTWIRMNRMTGFVAHIGRPIANTQIYILDTDSQPVPLGVTGEIYIAGAGVARGYLNRPELTAERFLPNPFTTIAGARMYKTGDLGRWLPDGNIEYLGRNDFQVKLRGFRIELGEIEARLVQCHGVSEAVVIAREDISDENSTGQKRLVAYLLPQAGVELVPAELRQQLAQHLAEYMQPSAFMTLDAFPLTPNGKLDRQALPAPDLSAIVTRGYEAPIGEIEIALAQIWQALLGLERVSRYDHFFELGGHSLLATQLTSRVRQTLGLELSLSQLFAYPVLTDLAAVLISASVTTQTVILTADRRQSLPLSFAQQRLWFIAQLNPKASLAYHIPTVLRLHGQLDHTAFTATLDNLVARQESLRTRFVLIGEQPYQQIDDADIGFTLICQDLRGLDEASRLTRIDELMELETQTLFNFASEPLVRGQLLQLADEEHVLILTQHHLITDGWSVGVLIHELRALYCAALEGHGDPLPPLSIQYADYAVWQREWLQGDILTAQRDFWRERLQGAPTLLALPTDRPRPPEQRYVGSHVPIHLDADLLTALKALGQRQGTTLFMTLLTAWGIVLSRLSGQDDIVIGTPVANRPRSELEGLIGFFVNTLPLRIELGQCNTVAELSVAELLAHVRERALAAYAHQDLPFEQIVEILQPERSMSYSPIFQVMLALNNTPTQPFELPGLSVSLVEQTHHSAHFDLTLSLIETVDDLNGYLEYASDLFDRATVERMVGYITQVLTAMAADETQAIARLPMLSVAERQQLLVDFNATQVDFPQHGLIHQLFEAQVQRTPDAAAVIFEKHSLSYSELNRRANQLAHSLIAFGVCPDDRVAICVERGLDMIIGLFGILKAGAGYIPLDPEYPTERLVYQLSDSKPVILLTQKHLQTRFSIQDLSIWLLDDKIHQNSVAKQPAHNPDRTNGLTAHCLISTRLNRTPKRRHAGTSQCREPYPCSMPDQ

SEQ ID NO: 10230 - protein, 333 aa, Xenorhabdus bovienii
  Peptide sequence Name=Xb4151_4152.C444.gene92.pep
  Gene classification: Gene name=FimA; Function=Pilin; Function class=N Cell motility and secretion
  Homolog annotation: Query=29..333bp; Hit=39..354bp; Blast score=80; Percent Identity=27.0; E value=2e-15; Homolog= XF0078 COG3539
MISGLKLLLASTFIVGIMSSFDALANYDCQYSPGFSAGTTYVSFGTIVIPRDHPIGTTIKEIRLDHVDEKGDIAICNTLTPTSWEKPDFDPAHYNYDAIYESGVPGVGIRINTWAPGYGIDWLPRTATYPVTCSPPRQFQNKKQYCGRTWGYLTVQLIKIAPATGSGPTHQKLLTKAKLGLNLPIHTFFLTNTYIMTQGCSLKQKTTFVNMGEIRTSAFRGINSTAGMRNFELNLDCDANVKVGVTLDGRPAKSNANNIWALDYNSDNVTATGIGLQILYQNQPLSMGSPLMIHSVQAIRNFAIPLHARYIQTEGRVAPGKADATATITLTYQ

SEQ ID NO: 10231 - protein, 849 aa, Xenorhabdus bovienii
  Peptide sequence Name=Xb4151_4152.C444.gene93.pep
  Gene classification: Gene name=FimD; Function=PapC-like porin protein involved in fimbrial biogenesis; Function class=N Cell motility and secretion
  Homolog annotation: Query=48..849bp; Hit=33..857bp; Blast score=641; Percent Identity=41.0; E value=0; Homolog= Z4968m COG3188
MDNYRHYLQHNISDNLVLFIKPSKVFLYAVTITWLFTHYNEAYGEEYFNINALETHSGFPEDIDLSIFTQDDQQLPGRYWVDIYLNREKADTGNVDFIIVNHKLSPKINLQRLKKMGVNIDSFPSLRDLPQETEIADLGQHIPSASSFFDFNKQRLDISIPQAALNSQVRDYVSSHLWEQGLTSLLVNYNYSGSTNWLNNQPGSTSNNFLNLRTGANWEAWRLRNYSTYSSQNHKWQSLNTYLQRDVHTLKSQLVFGDSYTPSAIFDGFQFRGMQLASDDNMLPDSLKGFAPTIRGIAQSNAQVTIKQNGYIIYETYVSAGPFVVSDLYPTTSSGNLEIIIKEADGREHRSVQPFSAVPIMLRENSLRYSLTLGKYQSFTHRGKEPYFMQGTVIYGISNRVTVYGGTTLSKDYQSAAFGTGYSFSDWGSLSFDVTHAKSDLAENISDSGQSYRFQYAKDLSQTGTNLTLAGYRYSTHRFYDFKDANEIDITNNKDNRSNTNKRSKLQLHINQSLGNLGSVYLSAFQQDYWYQQGYERNISAGYNTSYHSINYNLNYTYSEFPGSKHNDQILSFSVQIPLDRWLKNSWVSYNLTNSKNRDTSHQISLNGTALEDNNLIYSIQQNYTHHDKDIGGNISAEYKGAYGQINAGYNYDKQSKQLNYGLNGGIVAHPYGVTLSQSLGDTLALVRAHGAKGVKVQNHTGISTDWNGYAIVPYVSSYRKNRIALDTYSMGNNVDIDINTQTIIPTQGSLALANFQTRIGYRVLMMLSHKGKEIPFGATATLEKQHDIDDTNSTIISNDGQAYLSGVPKTGRLWVKWGHKDIQECHVNYQLPDEIPISGLYMVNAACE

SEQ ID NO: 10232 - protein, 240 aa, Xenorhabdus bovienii
  Peptide sequence Name=Xb4151_4152.C444.gene94.pep
  Gene classification: Gene name=FimC; Function=PapD-like chaperone involved in fimbrial biogenesis; Function class=N Cell motility and secretion
  Homolog annotation: Query=20..238bp; Hit=9..228bp; Blast score=174; Percent Identity=40.0; E value=1e-43; Homolog= ZyraI COG3121
MNMKNNNILFGATILKYFRIFIILYIFSINISFAGVVIGGTRIVYISDRKEASISISNPETDVSYLIQSWVQDENNETKVPFIITPPLFKLTAGNENILRIVKTGENLPNDKESLFWLNVKSIPGTVKSDQNQLQITVKSRFKLFYRPVGLADNASIAYKALKFKTVGHKLIAENPTPYYISFSDLTTGNNSINHEIKPAGMISPYSQLSWDIPIKNINYVTWKTINDFGGVTPEEKRMF

SEQ ID NO: 10233 - protein, 177 aa, Xenorhabdus bovienii
  Peptide sequence Name=Xb4151_4152.C444.gene95.pep
  Gene classification: Gene name=FimA; Function=Pilin; Function class=N Cell motility and secretion
  Homolog annotation: Query=1..176bp; Hit=1..198bp; Blast score=103; Percent Identity=34.0; E value=7e-23; Homolog= Z5225 COG3539
MKTNLIISSLFLSSALVSAAYAADGQIKFTGDITATACKIDPSSANQTVNMGTISSSSFNGVNSTSAATRFSIILTDCPTEANYAQVKFDGNPDSRNNNLLALSNDNSKKKAAGGVALGLYEADSATLISLAQSSITQKLTNKSKQELNFIAKYIATNSTVNPGSGDAVANFTIVYN

SEQ ID NO: 10234 - protein, 45 aa, Xenorhabdus bovienii
  Peptide sequence Name=Xb4151_4152.C444.gene96.pep
MSSYYFYLCQLIATIFFEMSVDKETSFNVSLSCFGINSDKLLVIS

SEQ ID NO: 10235 - protein, 49 aa, Xenorhabdus bovienii
  Peptide sequence Name=Xb4151_4152.C444.gene97.pep
MFMDCITIIHISFVLVTTYILSLKNKSHKHRKKKLNKGSISTKKIKERS

SEQ ID NO: 10236 - protein, 489 aa, Xenorhabdus bovienii
  Peptide sequence Name=Xb4151_4152.C444.gene98.pep
  Gene classification: Gene name=PotE; Function=Amino acid transporters; Function class=E Amino acid transport and metabolism
  Homolog annotation: Query=27..488bp; Hit=1..459bp; Blast score=571; Percent Identity=70.0; E value=1e-163; Homolog= Z2605 COG0531
MSNMCSIVRTSVLTNRVDYITFRNLSLEKKLGLTSLTALVLSSMVGAGVFSLPQNMAQVGSPAALMIGWGITGVGILFLATSLLLLSRLRPDLDSGIFTYAREGFGELVGFCSAWGYWFCAIIANVSYLVIVFAALSFFTDTEYSVIFGDGNTWQSLIGESILLWFVHWLVLRGVQTAASINQLATVAKLLPLGMFIILAVIAFNMDVFTFDFTGIEMGIPVWQQVKDTMLITLWVFIGVEGAVVVSARAKKRKDIGIATVLAVVSALGVYILVTLLSLGLVARPELAAMRNPSMANLMVGLIGSTGEIVIIAGLIISVCGAYLSWTIMAAEVPFIASLHGSFPKVFNKQNTKKAPESSLWITNGAVQISLILIWLSGSNYNMLLSIASEMILVPYFLVGAFLAKVAFQRSNRILLLISAGACTYGVWLLYASGLMHLLLSVVLYAPGLLVFLYARRQNQGQKPLNMLEKTAIVILILMTIPSTWLLIH

SEQ ID NO: 10237 - protein, 41 aa, Xenorhabdus bovienii
  Peptide sequence Name=Xb4151_4152.C444.gene99.pep
MHKIYIFLHSHPLHTILSLRRIALFLDLTTESSVQSRVWMQ

SEQ ID NO: 10238 - protein, 54 aa, Xenorhabdus bovienii
  Peptide sequence Name=Xb4151_4152.C444.gene100.pep
MQWVTMQKNINFMHKIMYVRRDIKERIIQKTYFGNNKKAQMMICTFSINNRLII

SEQ ID NO: 10239 - protein, 325 aa, Xenorhabdus bovienii
  Peptide sequence Name=Xb4151_4152.C444.gene101.pep
  Homolog annotation: Query=9..325bp; Hit=1..317bp; Blast score=428; Percent Identity=77.0; E value=1e-119; Homolog= Pa|Phot2-44g08.q1ka _g114| 81729 - 82682 1985 317 aa, chain +
MRKAKGFFMKLKTTIIATAMLSLTTITAAHAAKELTPEQAVELKPFERISVTGRFNAIYEAADAISRQADKKGAYSFYIQSLDDFNGGGNLRVVADLYHKDAEKSDKITNYRIYRGIKELPKTEAITLEPFDTVTVNGYFSTAPDLKEAIAKAAKKKDAASFFIVRDISPNNGGNQIVTAYVYKTDAPKRQIQSNNAVIPADSEAGRQALAQGGEEAEKVEIPGVASSTSTSNLVGRFFETQSSKGGRYTVTLSDGTKIEELNKASAAQMVPFDSITFSGYYTTDPEISYQVAKRAAKKGAKYYHVTREWQSNGGNITVSADLFK

SEQ ID NO: 10240 - protein, 510 aa, Xenorhabdus bovienii
  Peptide sequence Name=Xb4151_4152.C444.gene102.pep
  Gene classification: Gene name=PntA; Function=NAD/NADP transhydrogenase alpha subunit; Function class=C Energy production and conversion
  Homolog annotation: Query=1..509bp; Hit=1..509bp; Blast score=795; Percent Identity=80.0; E value=0; Homolog= ZpntA COG3288
MHIGVPKERLSNEARVAATPSTVEQLRKLGFSVRVETRAGHLASFDDIAYQKAGADIAEHHEVWQSDIIFTVNAPEDKEIALMKEGATLVSFIWPAQHPELMAKLSKRRVTVLAMDAVPRISRAQSLDVLSSMANIAGYRAIVEAAHEFGRFFTGQITAAGKVPPAKVMIIGAGVAGLAAIGAAGSLGAIVRAFDTRPEVKEQVQSMGAEFLELNFKEEASGGDGYAKVMSEAFIEAEMELFSAQAQEVDIIVTTALIPGKPAPRLITKEMVESMKPGSVIVDLAAQNGGNCELTEADKLIVTPNGVKIIGYTDLPSRLPTQSSQLYGTNLVNLAKLLCKEKNGEITIDFEDIVVRGITVIKEGEVTWPAPPIQVSAPPTKPTTLKKKEDKPAKNPRSPWLKYGLFALAIILFGWLANVAPKEFLSHFTVFALSCVVGYYVVWNVSHSLHTPLMSVTNAISGIIVVGAVLQIGEGGWVSFFSFIAVLIASINIFGGFTVTQRMLKMFRKG

SEQ ID NO: 10241 - protein, 462 aa, Xenorhabdus bovienii
  Peptide sequence Name=Xb4151_4152.C444.gene103.pep
  Gene classification: Gene name=PntB; Function=NAD/NADP transhydrogenase beta subunit; Function class=C Energy production and conversion
  Homolog annotation: Query=1..462bp; Hit=1..462bp; Blast score=734; Percent Identity=85.0; E value=0; Homolog= pntB COG1282
MSNGVVTAAYIVAAILFIFSLAGLSRHESSRRGNIFGIAGMAIALIATILGPDAGKVGWIILAMIIGAVIGIRLAKKVEMTEMPELIAILHSFVGLAAVLVGFNSFITHDIFATPIMENIHLTEVFLGIFIGSVTFTGSIVAFGKLRGKISSKPLMLPHRHKLNLAALIVSFVLIVIFIKTQSVGLQVFTMLVMTAIALAFGWHLVASIGGADMPVVVSMLNSYSGWAAAAAGFLLSNDLLIVTGALVGSSGAILSYIMCKAMNRSFISVIAGGFGTDGTSTGDEQEMGEYRETNAEDVAELLKNSTSVIITPGYGMAVAQAQYPVHDITAKLREKGVKVRFGIHPVAGRLPGHMNVLLAEAKVSYDIVLEMDEINNDFTETDTVLVIGANDTVNPAAQEDPHSPIAGMPVLEVWKAQNVIVFKRSMNTGYAGVQNPLFFKENTQMLFGDAKASVEAILRAL

SEQ ID NO: 10242 - protein, 92 aa, Xenorhabdus bovienii
  Peptide sequence Name=Xb4151_4152.C444.gene104.pep
MTIHDFVSSSLPSLYSSGFWWFKISSLLLISMSSVQTSSNRIFTKQACRIMELILLALFLSIIMISLCKKCGSLPIQSYCRKATFSNVYFNK

SEQ ID NO: 10243 - protein, 305 aa, Xenorhabdus bovienii
  Peptide sequence Name=Xb4151_4152.C444.gene105.pep
  Gene classification: Gene name=XerC; Function=Integrase; Function class=L DNA replication, recombination and repair
  Homolog annotation: Query=52..304bp; Hit=46..293bp; Blast score=99; Percent Identity=29.0; E value=6e-21; Homolog= BS_ripX COG0582
MPLSVSGQQIHNNPAIAYLVSLGSKRSRQTMKSFLNIVAKMLGYQNVQDCTWNALRRHHVQAIMEMLSDSGKAPATINTYLAALKGVALEAWTMKQIDTDSFQHIKQVRSVRGNRLPKGRALDRYEIKTLFFTCENDFSTKGLRDAAIIGVLVGCGLRRSEIISLDLKHVIRREQALRVMGKGNKERLSYMPEGTWERLNRWIDEIRGDYAGPLFTRIRRDDDVTDNRLSDQAIYHILETRRIESGLEKFAPHDLRRTFASAMLDNGEDIVTVKDAMGHSSITTTQKYDRRGDERLKNAAKNLNF

SEQ ID NO: 10244 - protein, 314 aa, Xenorhabdus bovienii
  Peptide sequence Name=Xb4151_4152.C444.gene106.pep
  Gene classification: Gene name=UspA; Function=Universal stress protein UspA and related nucleotide-binding proteins; Function class= T Signal transduction mechanisms
  Homolog annotation: Query=1..314bp; Hit=1..313bp; Blast score=454; Percent Identity=70.0; E value=1e-128; Homolog= ydaA COG0589
MANYQNLLVAIDPNQDDQPALRRAVYIVQRNGGRIKAFLPIYDLSYEMTTLLSPEERNAMRKGVIGQRIAWIKKQAHYYLESGIDIEIKVVWHGHPYEAIIQEVITGKHDLLLKMAHQHSLLESMIFTPLDWHLLRKCPCPVWMVKDQAWPEKDSAVVAVNLSNEESYHTALNLKLVKETQDLANRIVKEPLIHLVSAYPTAPLNIAMELPDFNPSVYNQALRGQHLVAMKELRQKFYIDEQQTHVHEGLPEKVIPEICDELNTGVVVLGILGRTGLSAAFLGNTAEHVIDKLKCDLLAIKPDGFVCPISVDEE

SEQ ID NO: 10245 - protein, 251 aa, Xenorhabdus bovienii
  Peptide sequence Name=Xb4151_4152.C444.gene107.pep
  Gene classification: Gene name=Crp; Function=cAMP-binding domains - Catabolite gene activator and regulatory subunit of cAMP-dependent protein kinases; Function class=T Signal transduction mechanisms
  Homolog annotation: Query=1..244bp; Hit=1..244bp; Blast score=451; Percent Identity=92.0; E value=1e-127; Homolog= fnr COG0664
MIPEKRIIRRIQSGGCAIHCQNCSISQLCIPFTLNEHELDQLDNIIERKKPIQKGQTLFKAGDALKSLYAIRSGTIKSYTITEEGDEQITGFHLAGDLVGFDAIINTEHPSFAQALETSMVCEIPFETLDDLSGKMPNLRQQMMRLMSGEIKGDQEMILLLSKKNAEERLAAFIYNLSSRFAQRGFSPREFRLTMTRGDIGNYLGLTVETISRLLGRFQKNGILGVKGKYIAVENMEKLTELAGKAPACVS

SEQ ID NO: 10246 - protein, 63 aa, Xenorhabdus bovienii
  Peptide sequence Name=Xb4151_4152.C444.gene108.pep
MCGMRSDMNMERFHFETMNVSMFYLTKNVTPSLTVLCRTGGSGKLPNQGRMAVTFLRDDLYSY

SEQ ID NO: 10247 - protein, 649 aa, Xenorhabdus bovienii
  Peptide sequence Name=Xb4151_4152.C444.gene109.pep
  Gene classification: Gene name=GadB; Function=Glutamate decarboxylase and related PLP-dependent proteins; Function class=E Amino acid transport and metabolism
  Homolog annotation: Query=10..435bp; Hit=6..353bp; Blast score=100; Percent Identity=24.0; E value=5e-21; Homolog= BH2623 COG0076
MTKPLYTNLNVDALFLGPKSENAVFFREMMDYAVSEHMHWRSGFHPEDATLVTSVDRYEHNYRETLYRTEGILNQLSAKLKNTSIPFFSPRYLGHINSDTLMVSNLAYVMAMMYNPNNCTYEVSPTTTELELESGLDLCRMLGYDPQRAWGHITSGGTVANYEGLWVARNLKTLPFAVSQHPETKELVSHKSQKQLMNMPTAEVLDLISELQRRGIFDEIRNMTCRGTGSKTEILGKLLVPQSKHYSWMKAADILGIGQENIIPLPVNEHYQTDIGKMREITFDLIEKGEPILAMIGVVGTTEVGAIDRIDEVIALRQECEERYGESFYIHVDAAYAGYACSMLLNEQGEFMEYDDLVNYHHTLGIIPENISWPKPEVYQSFKALRYVDSITVDPHKVGFIQYSAGAICMKDKRILDLISSRALYVFEENDNQSNFPASNRGILGASIMEGSKAGATAAALWAAHRLLPLNISGYGKVIAAGIVTANQLLDKMANMLPIEVGEYRFKMYIMPTPDFHMINFTFKEVGNASLINHNALNKRIYELCSYSSGRAYSNDFLTSSTILDYKEYGDTPWYYAEKCGFSRSEWENTHRVYVLRAAVMTHCLRNPEHFDEYWKQLQTIFAKKLTQLVDEEEKKSRQILNREESFLN

SEQ ID NO: 10248 - protein, 56 aa, Xenorhabdus bovienii
  Peptide sequence Name=Xb4151_4152.C444.gene110.pep
MPFTLKPAKEHFGAYVTCQNVSELSFEEYEILKLHLYAINLKMRVLKSGSYQSTEW

SEQ ID NO: 10249 - protein, 349 aa, Xenorhabdus bovienii; identical to SEQ ID NO: 5796
  Peptide sequence Name=Xb4151_4152.C444.gene111.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 10250 - protein, 97 aa, Xenorhabdus bovienii
  Peptide sequence Name=Xb4151_4152.C444.gene112.pep
  Gene classification: Gene name=UraA; Function=Xanthine/uracil permeases; Function class=F Nucleotide transport and metabolism
  Homolog annotation: Query=1..76bp; Hit=267..342bp; Blast score=129; Percent Identity=92.0; E value=6e-31; Homolog= uraA COG2233
MFANGFSTMISGFFGSTPNTTYGENIGVMAITRVYSSWVIGGAAILAILLSCVGKLAAAIQVIPVPVMGGVSLLLYPSSLKMLDFSFVSDHDCAHEN

SEQ ID NO: 10251 - protein, 291 aa, Xenorhabdus bovienii
  Peptide sequence Name=Xb4151_4152.C444.gene113.pep
  Homolog annotation: Query=Organism:..Bacillusbp; Hit=halodurans..bp; Blast score=; Percent Identity=; E value=; Homolog= Pa|Phot5 -509b06.p1k_g119| 67935 - 68987 4449 350 aa, chain +
MIAPMKINLTDAQKDALELMHDTTRDGRVRDRIKAVLLASEGWTAQMIAQALRIHESTVSRHLKDYFSEEKLAPENGGSESRLSAEQTTELVEYLMANLMHTTAQIVAYVRARWQVTFTVAGMTKWLHRQGFSYKKPMGAPHKFDADKQQQFIETYNALKEECGQNAPILFIDAVHPTLSTKLSYGWMKSGRKHVKVVETTGSRTRLNIMGALNLQRIEETIVREYPTINAKNVVLFFGSIRETYPLSQKIHIILDGAGYHRSGVVQFFAEVLNIELHYLPPYSKRTGNPT

SEQ ID NO: 10252 - protein, 115 aa, Xenorhabdus bovienii; identical to SEQ ID NO: 10059
  Peptide sequence Name=Xb4151_4152.C444.gene114.pep

SEQ ID NO: 10253 - protein, 117 aa, Xenorhabdus bovienii; identical to SEQ ID NO: 9566
  Peptide sequence Name=Xb4151_4152.C444.gene115.pep
  Gene classification: Function=Transposase; Function class=L DNA replication, recombination and repair
  Homolog annotation: Query=6..101bp; Hit=7..101bp; Blast score=70; Percent Identity=39.0; E value=3e-13; Homolog= SPy0133 COG3436

SEQ ID NO: 10254 - protein, 501 aa, Xenorhabdus bovienii
  Peptide sequence Name=Xb4151_4152.C444.gene116.pep
  Gene classification: Function=Transposase; Function class=L DNA replication, recombination and repair
  Homolog annotation: Query=78..499bp; Hit=45..465bp; Blast score=241; Percent Identity=33.0; E value=2e-63; Homolog= Z4340 COG3436
MKIDIDALPNDPAELKRLLIKQSQRLAFLEEQFRLAQQKRFGASSEAFPGQGELFNEAEEIALPAETAAAQETLTPPRRKPTRNPLPKDLPRETVFHDIAEEEKQCACCGGRLHQMGADRSEKLLFIPAQIRVVEHVRPKYACRECEKSGIQTPVKQASLPAMPIKKGMATSSLLSQLITSKYQYGLPLYRQESVFKQYGIDLSRQTQSDWILKSAQLFTPLVARFREMLLQQPVLHADETPVKGVTSEKTTHYMWVYCVGTDTPEPAALTPNIVLYDHQASRSGTCAADYLAGFQGYLQVDGYQGYEQTGARLVGCMAHARRKFMEAKQAQGKNKTGKADIALSLIQSLYRVEHQVKGLSPAEKYRIRQEKALPIWDKLSAWLVKTRSQVIPKSKLGEAVTYLSNQWAKLIRYREDGRLSIDNNRAERAIKPFVIGRKAWLFSHTSRGAQASAILYSVIETAKANGLIPFDYVMTCLDELCQPTPDLEKLLPWKKVISKV

SEQ ID NO: 10255 - protein, 82 aa, Xenorhabdus bovienii
  Peptide sequence Name=Xb4151_4152.C444.gene117.pep
  Gene classification: Function=Transposase; Function class=L DNA replication, recombination and repair
  Homolog annotation: Query=3..79bp; Hit=364..445bp; Blast score=69; Percent Identity=46.0; E value=6e-13; Homolog= SPy0131 COG3436
LSIDNNRAERAIKPFVIGRKAWLFSHTSRGAQASAILYSVIETAKANGLIPFDYVMTCLDELCQPTPDLEKLLPWKKVISKV

SEQ ID NO: 10256 - protein, 72 aa, Xenorhabdus bovienii
  Peptide sequence Name=Xb4151_4152.C444.gene118.pep
  Homolog annotation: Query=Organism:..Bacillusbp; Hit=halodurans..bp; Blast score=; Percent Identity=; E value=; Homolog= Pa|Phot5 -509b06.p1k_g119| 67935 - 68987 4449 350 aa, chain +
LTLTPYSPNLNPIERLWKYVNEQVRNNVYFPDTKTFRETLRHFFHVTLPEKAKELTTRLTDNFQILKPASSS

SEQ ID NO: 10257 - protein, 3940 aa, Xenorhabdus bovienii
  Peptide sequence Name=Xb4151_4152.C444.gene119.pep
  Gene classification: Gene name=EntF; Function=Non-ribosomal peptide synthetase modules and related proteins; Function class=Q Secondary metabolites biosynthesis, transport and catabolism
  Homolog annotation: Query=2397..3681bp; Hit=1..1285bp; Blast score =777; Percent Identity=37.0; E value=0; Homolog= PA2400 COG1020
MLILLKELNKNRMSVWVCENKLKLAFTGETPPVQLIDKVKEKKQSVIDFLNERGIFSEEDFQGFIFNKDQSNFDINFVDPSQYPGNKIEAIFPATSLQQGFVYHHLAQPQDDAYRVQLLLDYHDRLDFAAYQQAWTLASLRFPVLRTAFDWEGEVLQIVTAGASIGPANFTIKDIRSLPAEEWDRAIEALQQNDRTQPFDLSQPGLIRFTLIRQQAQRVTVLITQHHCIADGWSTPILLQTVHEYYNALVQGRRPPEGVDTAYLATQQYHLDHKEASEAYWVERKARFQGANDLSALLSHGIDLTQIKTVEKPAEQRLTVEGNAYNQLKTMCREQGITLNVVLQFAWHKLLHSYCGDEQTLVGTVVSGRDVPVDGIESSVGLYINTLPLTVQWEPAGSVLAVLHAIQNDIAALNSHSAVSLASLQPDGARLFHSLLVFENYPAPVMSGDGTGIENKLAFRQAIEKVDYPVLLMAYEQGDSLTMKLSYGEDWLAGEQVRRLLCQLERILHTVTRDPHQPHRLVKFLSDDERHTLLHRWNQTDVPYPQSHTLQQQFEARAAATPDNVALVFEGAALTYRQVNEQANQLAFVIRERYQQQCHAPMPADMPIALYLDRSLEMVISMLAVLKAGGAYVPVSPAYPPERTQFILTDTAARCVVTQQRHLTDLGEYSPALSLIVADDPSVTRGQSVDNPVPVNTSADLAYIIYTSGTTGQPKGVMVEHASVINLSRFIARTHLLGETVKALFFSNYVFDASVFELFPALMAGSAIFIAPAAVTADSDQLLSFINTHEISKAFIPTALMNHFADELSRSTLQVIHTGGEELNALSLPPDVTLFNQYGPTEITVCATQHLLRDGDRAIGKGIDNTRLYVLDSEGNLSPIGAPGELYIGGAGLARGYWNRPALTAERFVVNPFATAEDQARGYTRLYKTGDWVRWRPDGNLEYRGRNDFQVKIRGYRIELGEIESALASHPQVKQAVVIDHEHESHKVLAAYLVTDGEPSDDTLMEHLSARLPDYMVPASFTRIETIPLTLNGKLDRRALPAPVWVSRDGYVAPRDALETRLCAVWQDVLGLEQVGIEDNFFRIGGDSIVSIRLVSKLRQAGFSLQVKSIFDAPTVARLAKLLTQVSATAGIIAEPGLLSGEFGLLPIQQAFFDRNLPCPHHWNQAFMMQLPGEIRHADIEQALNRLAGRHDMLRTRFVCTQDGYRQCYQAEMPSGLPALHRAEISELEKAALHQQLTQWQGGFDYAAGSLWQAGHLTGYADGSARLFFAFHHLIIDAVSWRIIAEDMRLLLQGATLPPKTSSYRQWVAAVHHYAALHQQEIPYWQRVMAGKETEPAAGEASQHRLALSAGLTDTLLREANSGYHTEINDLLLSALTLALSASFSRPVNHIILEGHGREPIDNTLDVSETVGWFTTVYPVRLEMQPEVTETIIHTKEMLRAVPNKGIGYGALHQAGDLAGELPAISFNYLGQLGGDAGQSRHQDWSLTDDDCGAVVASNNPSPLLLDINGAVQAGSLQFNVLSRLPQTQTQVFITAFEQALTTVITAGQKQARLGGIKTSSDYGIQGVSVERLSRFQQRYQVEAIFPATSLQQGFVYHHLAQPQDDAYRVQLLLDYHDRLDFAAYQQAWTLASLRFPVLRTAFDWEGEVLQIVTAGASIGPANFTIKDIRSLPAEEWDRVIEALQQNDRTLPFDLSQPGLIRFTLIRQQAQQVTVLITQHHCIADGWSNPILLQTVHEYYNALVQGRRPPEEVDTAYLTTQQYHLNHKDISEAYWAERKTRFQGANDLSALLSHGIDLTQIKTVEKPAKQRLTVEGDAYDQLKTMCREQGITLNVVLQFAWHKLLHSYCGDEQTLVGTVVSGRDVPVDGIESSVGLYINTLPLTVQWEPAGSVLAVLHAIQNDIAALNSHSAVSLASLQPDGARLFHSLLVFENYPTPVMSGDGTGIENKLAFRQAIEKVDYPVLLMAYEQGDSLTVKLSYGEDWLAGEQARRLLCQLERILHTVTRDPHQPHRLVEFLSDDERHTLLHRWNQTDVPYPQSHTLQQQFEARAAATPDNVALVFEGAALTYRQVNEQANQLAFVIRERYQQQCHAPMPADTPIALYLDRSPEMVISMLAVLKAGGAYVPISPAYPSERIQFILADTAARCVVTQQRHLTDLGEYSPALSLIVADDPSVTRGQSVDNPVPVNTSADLAYIIYTSGTTGQPKGVMVEHASVINLSRFIARTHLLGETVKALFFSNYVFDASVFELFPALMAGSAIFIAPAAVTADSDQLLSFINTHEISKAFIPTALMNHFADELSRSTLQVIHTGGEALNALSLPPAVTLFNQYGPTEITVCATQHLLRDGDRAIGKGIDNTRLYVLDSEGNLSPIGAPGELYIGGAGLARGYWNQPALTAERFVVNPFATAEDQVRGYTRLYKTGDWVRWRPDGNLEYRGRNDFQVKIRGYRIELGEIESALASHPQVKQAVVIDREHEGHKALVAYVVTDGELSDEVLMEHLSARLPDYMVPASFTRIETVPLTLNGKLDRPALPAPVWVSRDGYVAPRDVLETRLCAIWQDVLGLERVGIKDNFFRIGGNSLIAIKLTAAIRRALAVEIPLAQVFELKTVAGLAAQMGQQACTVIPHVELARYPLSFAQERMRFIEQFEQGTHAYHIPYLVQLHDGDGLSLLETAIHQVVERHPVMKTVYRTDEAGQAYQQVLEGNLVLRSQSCEAFDALLQAVRTELTTPFDLTAEPGLRLCHYRMDEHHYLLLLWHHIAIDGWSIDVFMDELAAIYAALREGGDSLLPPLEITYGDYARWQRDYLQGEVGERQLAYWQQALAGYEPLSLPTDRSRPAQVDYQGQDFNFALGSGLSEQLRALAKTQETTLYTVLLSAFYVTLAKLSGQHDIVLGTPTDNRHHAQTQPLIGMFVNSLVLRAQLEPAGSVETLIKQTHAVITQAKAHQDMPFEQLVDALEIERDTARHPIFQVMFGVQNLAEGGQSRASLPFSPVKLDGVLSSPAKFDLSLFMAEEPANIAGGINYAVSLFDESSIARMADIYQRVLTAFVADQTQSLAGLDVLSAQERHTLLHRWNQTDVPYPQSRTLQQQFEAQVVATPDNVALVFAGATLTYRQVNERANQLAAVIRERYQQQRNVPMPADTPVALYLDRSLEMIISILAVLKAGGAYVPVSPEYPPERTQFILTDTAAPCVVTQQRHLTALGEYTPVLSLIAADDPSVTAGRPMDNPVPVNGATDLAYIIYTSGTTGQPKGVMLTHQSVMNRLCWMQSQYALKAADNVLQKTPYTFDVSVWELLAANWVGARIVIAPPDSHRQPETLHKLMQETGVTVVHFIPPMLSAFCQSLQALNQRLAATVRYVFCSGEALTGSQVRAFKTINPGASALINLYGPTEAAIEVTYFDTAGEFNGNVPIGRAIDNTRLYVREGGGNLSPVGAPGELYIGGAGVARGYWNRPELTAEYFVANPFATAEDQARGYTRLYKTGDLVRWRADGNLEYRGRNDFQVKIRGYRIELGEVESVLAAHPQVKQAVVIDREHEGNKALAAYLITEGILSDELLIGYMSARLPDYMVPASFTRIESVPLTLNGKLDRRALPAPVWVSRDGYVAPRNALETRLCAVWQDVLGLERVGIEDNFFRIGGNSLMAIKLKAAILRETEIDIPLSILFSHKCISLLTEWLETGSLKYNLLNLLTPESIATNKLFMIHAAGCGSEVYDDLAKALSDVYNCIGIDNYNLFTDNHIESLQKIARIYLELILTETSIDKPIKILGWSLGGQLAMEIAFQLEQIGAKDIQLFLLDTIINTTQLTEIKNQLDMSYALNEAEIKLQKIGADNAYINKVLSAMPFEHQMVNCNLGGKLMHTNITLFKAGQMNTEYKGDIGLTVNQLIAKMPDNNISAWMVNPLVIKLINDRSHADILESTSIISAEIIDKLSIEENIRN

SEQ ID NO: 10258 - protein, 4686 aa, Xenorhabdus bovienii
  Peptide sequence Name=Xb4151_4152.C444.gene120.pep
  Gene classification: Gene name=EntF; Function=Non-ribosomal peptide synthetase modules and related proteins; Function class=Q Secondary metabolites biosynthesis, transport and catabolism
  Homolog annotation: Query=3183..4661bp; Hit=52..1541bp; Blast score =857; Percent Identity=37.0; E value=0; Homolog= PA2402_1 COG1020
MRTSESSLNSNLYNLHPAQEDVFYEQALYENNPLHNLGWYTLIEENVDIVTFQQVWNLLHQHIDMLRLRISVNSDNEAIQYIQDQGVPEEIIFYDAAMQPDPEKKAQLWMQQQIDNPINFLQETPYQISLIRMTEEKYYFFTIFHHIMIDGVGLFRLHEYVNKLYGCIKNGTSTAWLLEIPQYLDTITKARKYLNSSHYETDKHYWCDFLKEHEIYPLTPCYQNTGSGVGSLTLPSEMTSDLRIFCRENNTNVFAVFSSLVIIMMAELTGQQELTFSTITHGRKRRLDKHVIGMHANIYPVHCQVSHSLSVIEQIKLIDLSYKNSYRHCKFPHSHLIRIANNFGIPLPNLFIFYDRFSESASEITQNKYNHIEGTANIYPIVFRFKDYGGTDQELKININYLQAYFSDQDVGKIFERLKNLFAALIKKPSLLVNELPILLEQERHTLLHTWHQTDALYPQNQTLQQQFEARAAAMPDNVALVFEGETLTYRQLNERANQLAFMIREHYQQRHNQAMPADTLVALYLDRSLEMVISILAVLKAGGAYVPMPPEHPPERIQFILEDTQSPCVVTQQRHLTTLSECTKVLIDQPALIAADDKAVTDGRSVDNPVPVNGAADLAYVIYTSGTTGQPKGVLQTHHNAVRLFAITQGDYQFDQNDTWVLFHAYTFDFSVWELWGALIYGGRLIIPTVDCTKDFVSFSRLCSHQKVTVLNQTPGAFYAFIDASLSIGAKFPCLRYVIFGGDKLNPVQLKPWWDSYGDQSPTLVNMYGITETTVHVTYQKLIKDDVITASCIGRPLNDMHAYVLNDSGHLVPIGAPGELYIGGAGLARGYLNRPALTAERFVVNPFATAEDQARGYTRLYKTGDWVRWRPDGNLEYRGRNDFQVKIRGYRIELGEIESALASHPQVKQAVVIDREHEGHKALVAYVVTDGELSDEVLMEYVSARLPDYMVPASFTRIETVPLTLNGKLDRRALPMPMWGNRDGYVAPRNALETRLCVIWQDVLGLERVGIEDNFFRIGGDSLIAIKLTAAIRRALAVEVSLAQVFSLKTVAGLAAQMGQQACTVIPHVELARYPLSFAQERMRFIEQFEQGTHAYHIPYLVQLHDGDGLSLLETAIHRVVERHPVMKTVYRTDEVGQAYQQVLEGNLVLRSQSCEAFDALLQAVRTELTTPFDLTAEPGLRLCHYRMDEHHYLLLLWHHIAIDGWSIDVFMDELAAIYAALREGGDSLLPPLEITYGDYARWQHDYLQGEVGERQLAYWQQALAGYEPLSLPTDRSRPAQVDYQGQDFNFALGSGLSEQLRALAKTQETTLYTVLLSAFYVTLAKLSGQHDIVLGTPTDNRHHAQTQPLIGMFVNSLVLRAQLEPAGSVETLIKQTHAVITQAKAHQDMPFEQLVDALEIERDTARHPIFQVMFGVQNLAEGGQSRASLPFSPVKLDGVLSSPAKFDLSLFMAEEPANIAGGINYAVSLFDESSIARMADIYQRVLTAFVADQTQSLAGLDVLSAQERHTLLHRWNQTDVPYPQSRTLQQQFEAQVVATPDNVALVFAGATLTYRQVNERANQLAAVIRERYQQQRNVPMPADTPVALYLDRSLEMIISILAVLKAGGAYVPVSPEYPPERTQFILTDTAAPCVVTQQRHLTALGEYTPVLSLIAADDPSVTAGRPMDNPVPVNGATDLAYIIYTSGTTGQPKGVMLTHQSVMNRLCWMQSQYALKAADNVLQKTPYTFDVSVWELLAANWVGARIVIAPPDSHRQPETLHKLMQETGVTVVHFIPPMLSAFCQSLQALNQRLAATVRYVFCSGEALTGSQVRAFKTINPGASALINLYGPTEAAIEVTYFDTAGEFNGNVPIGRAIDNTRLYVREGGGNLSPVGAPGELYIGGAGVARGYWNRPELTAEYFVANPFATAEDQARGYTRLYKTGDLVRWRADGNLEYRGRNDFQVKIRGYRIELGEVESVLAAHPQVKQAVVIDREHEGNKALAAYLITEGILSDELLIGYMSARLPDYMVPASFTRIESVPLTLNGKLDRRALPAPVWVSRDGYVAPRNALETRLCAVWQDVLGLERVGIEDNFFRIGGNSLMAIKLTAAIRYALAVEVPLIQVFELKTVAGLAAQMGQQACTVIPHLELARYPLSPVQERILFIEQFEQGSSVYHVPYLVQLDDGDCLPLLETAINRVVERHPVMKAVYRTDDAGQVYQQVLEGSLIFRSQSCEEFNALLQAVRTELATPFDLTTEPSLRLCHYRVAEHHYLLMMWHHIAIDGWSIDIFMDELAEIYCALLASRDSQLPALDITYGDYAKWQRDYLQGEIRERQLAYWQQALAGYEPLSLPTDRSRPAQVDYQGRNFNFALGNTLSHQLRSLAKTQETTLYTVLLSAFYVTLAKLTGQNDIVLGTPTDSRHHAQTQPLIGMFVNSLVLRAQLEPTGSVETLIKQTHAVIAQAKAHQDMPFEQLVDALAIERDTARHPIFQIMFGVQNLGESLPDRAGLPFNPVRLDRVLHSPAKFDLSLFMSEEQSSIAGGINYAVSLFNESTIVRMTDIYQRVLAAFVADQTQSLAGIDVLSAQERHTLLHRWNQTDVPYPQSHTLQQQFEARAAATPDNVALVFEGVALTYRQVNERANQLAFVIRERYQQQCHAPMPADTPIALYLDRSPEMVISMLAVLKAGGAYVPVSPAYPSERTQFILTDTAAPCVVTQQRHLTDLGEYSPALSLIVADDPSVTRGQPVDNPVPVNTSADLAYIIYTSGTTGQPKGVMVEHASVINLSRFIARTHLLGETVKALFFSNYVFDASVFELFPALMAGSAIFIAPAAVTADSDQLLSFINTHEISKAFIPTALMNHFADELSRSTLQVIHTGGEALNALSLPPDVTLFNQYGPTEITVCATQHLLRDGDRAIGKGIDNTRLYVLDSEGNLSPIGAPGELYIGGAGLARGYLNRPALTAERFVVNPFATAEDQARGYTRLYKTGDWVRWRPDGNLEYRGRNDFQVKIRGYRIELGEIESALASHPQVKQAVVIDHEHESHKVLAAYLVTDGVLSDDTLMEHLSARLPDYMVPASFTRIETVPLTLNGKLDRRALPAPVWVSRDGYVAPRNALETRLCAVWQDVLGLERVGIKDNFFRIGGNSLIAIKLTAAIRRVLAVEIPLVQVFELKTIAGLTSQMGQQACTVIPHVELTRYPLSLAQERMRFIEQFEQGSSVYHVPYLVQLDDEANLLLLETAINRVVERHPVMKTVYRTDDEGNTYQQVLEGSLIFRSQSCEAFDALLQTVRAELATPFDLTTEPSLRLCHYRVAEHHYLLMMWHHIAIDGWSINIFMDELAEIYPALLASRDSQLPALDITYGDYARWQRDYLQGEIRERQLAYWQQTLAGYEPLSLPTDRSRPTQVDYQGQDFNFALESELSHQLRALAKTQETTLYTVLLSAFYVTLAKLTGQNDIVLGTPTDNRHHAQTQPLIGMFVNSLVLRAQLEPAGSVETLITQTHAVIAQAKAHQDMPFEQLVDALAIERDTSRHPIFQIMFGLQSLGEDQPNRAGLPFSPVILEGALHSPAKFDLSLFMAEGAGSIAGGINYAVSLFDESTIARMADIYQRVLTAFVADQTQSLAGLDVLSAQERHTLLHRWNQTDVPYPQDKTLQQQFEARAAATPDNVALVFEGAALTYRQVNEQANQLAVVIRERYQQQRHAPMPADTPIALYLDRSPEMVISMLAVLKAGGAYVPISPAYPPERTQFILTDTAAPCVVTQQRHLTDLGEYSPALSLIAADDPSVTRGQPVDNPVPVNTSADLAYIIYTSGTTGQPKGVMVEHASVINLSRFIARTHLLGETVKALFFSNYVFDASVFELFPALMAGSAIFIAPAAVMADSDQLLSFINTHEISKAFIPTALMNHFADELSRSTLQVIHTGGEALNALSLPPDVTLFNQYGPTEITVCATQHLLRDGDRAIGKGIDNTRLYVLDSEGNLSPIGAPGELYIGGAGLARGYWNRPALTAERFVVNPFATAEDQVRGYTRLYKTGDWVRWRPDGNLEYRGRNDFQVKIRGYRIELGEIESALAAHPQVKQAVVIDHEHEGHKALAAYVVTDGVLSDEVLMEHLSARLPDYMVPASFTRIETVPLTLNGKLDRPALPTPVWVSRDGYVAPRDALETRLCAVWQDVLGLEQVGIEDNFFRIGGDSIVSIRLVSKLRRAGFSLQVKSIFDAPTVARLAKLLTQVSATAGIIAEPGLLSGEFGLLPIQQAFFDRNLPCPHHWNQAFMMQLPGEIRHADIEQALNRLAGRHDMLRTRFVCTQDGYRQCYQAEMPSGLPALHHVDVSVLEKAALHQQLTQWQGGFDYAAGSLWQAGHLTGYADGSARLFFAFHHLIIDAVSWRIIAEDMRLLLQGATLPPKTSSYRQWVAAVHHYAALHQQEIPYWQRVMAGKETEPAAGEASQHRLALSAGLTDTLLREANSGYHTEINDLLLSALTLALSASFSRPVNHIILEGHGREPIDNTLDVSETVGWFTTVYPVRLEMQPEVTETIIHTKEMLRAVPNKGIGYGALHQAGDLAGELPAISFNYLGQLGGDAGQSRHQDWSLTDDDCGAMIASDNSSPLLLDINGAIQSGSLQFSVSSRLSQTQTQVFITALEQALTTVITAGQKQAHLGGVKTPSDYGIQGVSIEQLNQLTHRLDHVNNENVSIHLEKKTILDV

SEQ ID NO: 10259 - protein, 207 aa, Xenorhabdus bovienii
  Peptide sequence Name=Xb4151_4152.C444.gene121.pep
  Gene classification: Gene name=TfoX; Function=Regulator of competence- specific genes; Function class=N Cell motility and secretion
  Homolog annotation: Query=18..192bp; Hit=16..192bp; Blast score=127; Percent Identity=39.0; E value=7e-30; Homolog= VC1722 COG3070
MFLSGARFAQLKHGVSSLGKLKKKSQFGGFGLLLDGVLFAISSDGELYLRGNSHAEVLFKARGMEKFIFSKRGIPVTLRYYRVNESLWQDQKQLFEYVNLAYQYTMAEIIDKQKMPLRLKDLPNLGMTLERQLWKVGISKVEELHMLGAKAAYLKLQQHRKQTNVSILLALAGAIEGCHVAVLPEKVRDDLLLWHKELDPRNSGYHS

SEQ ID NO: 10260 - protein, 197 aa, Xenorhabdus bovienii
  Peptide sequence Name=Xb4151_4152.C444.gene122.pep
  Homolog annotation: Query=52..197bp; Hit=24..172bp; Blast score=183; Percent Identity=60.0; E value=1e-45; Homolog= Pa|Phot5-451c10.q1k _g229| 172590 - 173108 1573 172 aa, chain +
MGIRSSWGYLIEKKTAVNGTEKEQKTDNYPVFKIDKMTSLKTASRLSFVESSQSDSQVVKGMVSELIYCEHQPAINHLLLPLLRQSGHENRWLLWVTPNKRLSRQWLMSSGLPLDKVVQLNQIRPVASIDAMEKALASGNYSVVLGWLPELSEYDVQKLQLAAQKGTALGFIMRPQNSAHHFKPPVNRLQIYSVYYH

SEQ ID NO: 10261 - protein, 373 aa, Xenorhabdus bovienii
  Peptide sequence Name=Xb4151_4152.C444.gene123.pep
  Gene classification: Gene name=OmpA; Function=Outer membrane protein and related peptidoglycan-associated (lipo)proteins; Function class =M Cell envelope biogenesis, outer membrane
  Homolog annotation: Query=1..371bp; Hit=1..346bp; Blast score=461; Percent Identity=65.0; E value=1e-130; Homolog= ompA COG2885
MKKTAIAVAVAVAAFATVAQAAPKDNTWYTGAKLGWSQYHDVNFYGNGYDNQIGNGPTRKNQLGAGAYVGYQANPYLGFELGYDWLGRMAYKGSVNNGAFRAQGVQLAAKLSYPVMDNLDVYTRLGGMVWRADSSATYNANALGGAGDKDQRRLKNNDTGVSPLAAIGVEYALTKDLATRLDYQWVNNIGDAGSVGARPDNGMLSVGVSYRFGQDDVAPVVVPVAPVIPTPAPTVENKSFTLRSDVLFNFNKSTLKTEGKQELDNLYTQLAKIDPNQGRVLVIGHTDRIGSQQYNLPLSQKRAESVVDYLVAKGIPAASIQAEGRGKEGSVTGSTCDNIKGRAKLIDCLAPDRRVVINIQGTKEIVTQPKAAQ

SEQ ID NO: 10262 - protein, 149 aa, Xenorhabdus bovienii
  Peptide sequence Name=Xb4151_4152.C444.gene124.pep
  Gene classification: Function=Uncharacterized BCR; Function class=S Function unknown
  Homolog annotation: Query=1..149bp; Hit=1..149bp; Blast score=196; Percent Identity=75.0; E value=6e-51; Homolog= ycbG COG3120
MKYQQLENLECGWKWAYLAKKYREGELITKYIEKSAAQDAIIELMQLEREPIKVLKWISRHMNPDLSNRMKQTIRARRKRHFNAEHQHSRKKSIDLDFRVWQRLSALSRRRGNTLSETIVQLLEDAEYREKYTHQMSSLKQDLEAILGK

SEQ ID NO: 10263 - protein, 576 aa, Xenorhabdus bovienii
  Peptide sequence Name=Xb4151_4152.C444.gene125.pep
  Gene classification: Gene name=LonB (BS); Function=Predicted ATP -dependent protease; Function class=O Posttranslational modification, protein turnover, chaperones
  Homolog annotation: Query=1..575bp; Hit=1..580bp; Blast score=553; Percent Identity=49.0; E value=1e-157; Homolog= Z1305 COG1067
LTNIKLDWQALQLNSTPYQALFNSVAELAPVTMDAIQSRLHNGLTLFCQADLRQPFMLVKADESDIYLSHLSDTISALLPESRPKIGGYYQIEHQTITWRSSGEGSFAPTERVAYREWIEPEQLFGNIYTHQGALQLQPGLIHQVNGGVLILPLRTLLSQPLMWVRLKQMIIQRRFDWLSHNENHSLPLPVPSMPLNLQLVLVGDRLSIEELHALEPELANNALYGEFELDMPFHEEDDLALWCRYVNRIIQQQTLPPLSADAWPVLLKQAIRYTEDQLSLPLDIQWLQQKLETAAAYQQENQITSHSMQQAEDNRLWRHGYLAERSIDEILKGQILIRTQGSVIGQINGLSVLEYPGHPDPMGEPSRISCVAHLGDGEFIDVERKVELGGNIHAKGMMIMQAYLISELKLDQPQPFSASIVFEQSYGEVDGDSASLAELCALISALSQQPIDQQIAVTGAVDQFGYVQSIGGVNEKIEGFFRLCNYRELTGKQGVIIPTSNVQHLCLNQDIIDAVKNGQFHIWTVEHVSEAASLLTGIPYYDPQKEHLLAIIYERITQANSQERPKLPWFLRWLG

SEQ ID NO: 10264 - protein, 172 aa, Xenorhabdus bovienii
  Peptide sequence Name=Xb4151_4152.C444.gene126.pep
  Gene classification: Gene name=FabA; Function=3-hydroxymyristoyl/3 -hydroxydecanoyl-(acyl carrier protein) dehydratases; Function class =I Lipid metabolism
  Homolog annotation: Query=1..172bp; Hit=1..172bp; Blast score=300; Percent Identity=84.0; E value=6e-82; Homolog= fabA COG0764
MFNKQESYTKEELQTSGQGELFGENGPPLPADNMLMMDRIIKMTETGGAYDKGYVEAELDINPELWFFRCHFVNDPVMPGCLGLDAMWQLVGFFLGWIGGEGKGRALGVGEVKFTGQVLPTAKKVTYRINFKRIVNRKLIMGLADGEVLVDGKLIYTAKDLKVGLFKDTSAF

SEQ ID NO: 10265 - protein, 52 aa, Xenorhabdus bovienii
  Peptide sequence Name=Xb4151_4152.C444.gene127.pep
  Gene classification: Gene name=Rmf; Function=Ribosome modulation factor; Function class=J Translation, ribosomal structure and biogenesis
  Homolog annotation: Query=1..51bp; Hit=1..51bp; Blast score=60; Percent Identity=72.0; E value=4e-10; Homolog= rmf COG3130
MKRQKRDRLARALSRGYQAGIHGRPRENCPYHSLDARSHWLGGWRQAMEDRA

SEQ ID NO: 10266 - protein, 200 aa, Xenorhabdus bovienii
  Peptide sequence Name=Xb4151_4152.C444.gene128.pep
  Gene classification: Function=Uncharacterized BCR; Function class=S Function unknown
  Homolog annotation: Query=19..196bp; Hit=3..178bp; Blast score=177; Percent Identity=50.0; E value=8e-45; Homolog= ymbA COG3009
MKKLMSRLAFFISVCVFAVSSVFISGCSSSQPQKTYYQLPALTSTSQESRSGVKDERQLWVKGVTLADYLASPGIVYQTGDVIYVNASNHLWASPLEQQLKQVLITELSAAFPQRLIAGQPLEKNADTLDITITAFHGRYDGKVMIQGYWMLFNQGGVIKQPFKLELEQKIDGYAELVRTLATGYSQLAQSIASQIATSV

SEQ ID NO: 10267 - protein, 554 aa, Xenorhabdus bovienii
  Peptide sequence Name=Xb4151_4152.C444.gene129.pep
  Gene classification: Gene name=PqiB; Function=Paraquat-inducible protein B; Function class=R General function prediction only
  Homolog annotation: Query=10..553bp; Hit=2..545bp; Blast score=756; Percent Identity=67.0; E value=0; Homolog= ZpqiB COG3008
MRSRKVTDKEEDLTQARISKLKSWSPVWIVPIITVLIGAWILFYHFSHQGPEVTLMTSNAEGIEAGKTKIKSRSVDVGVVERVSLSDNLGQVIIKARLNDGMERLLYQDTAFWVVKPQIGREGISGLSTLLSGVFIELQPGNQGGEENKFSLLDSPPLASPDAKGMRLVLISEKAGQLTPGDPVLFRGYRVGSVETSTFDPKSRLIRYQIFVNAPYDGLLTTGVRFWKDSGVAFDMSSQGLRVEVASLSTLFGGGVSFDVPKGWDLGNPVKEKETFKLYDSEKNIQNSLYTKHKDLLLFFADSVRGLQLGAPVEFRGIRVGTVAKVSFYTEGVRQRLDNDFRIPVLIHIEPERFEKEIGSGFYTDKELEEIIARGLRASLKPGNLLTGALFIDLDFYPNEEKWIGPYEIAGYEILPTVSGGLAQIQQKVIMALDKINNIPIEPVFVQATRTLEESQKTIKAAQKTMDELNRILASKETQGLPKDIQNTLQELNRSMQGIQPGSPAYNKLIDNMQRLDQVLRELQPVLKTLNNKSNALVFEAEEMKDPEPKKARN

SEQ ID NO: 10268 - protein, 404 aa, Xenorhabdus bovienii
  Peptide sequence Name=Xb4151_4152.C444.gene130.pep
  Gene classification: Gene name=PqiA; Function=Uncharacterized paraquat-inducible protein A; Function class=S Function unknown
  Homolog annotation: Query=1..391bp; Hit=18..408bp; Blast score=505; Percent Identity=67.0; E value=1e-143; Homolog= pqiA COG2995
MLVAVPNLEQGNKAACPRCETLLTAKWKEPRNQPTGYAASALLMLFLANLFPFVSMNIAGIVSEISLPQIPKVMFSEDYSSIAVFFLIFVQLVPACCMVAIILLCQNIKMARRLKIELARILFQMKTWCMAEIFLAGVLVSFVKLMAYGDIGIGLSFLPYCLFCLFQVRAFQCLDRHWFWNEIEPAPEVCIPLQAGKPGLVQGVRLCLCCTAILPAQQPQCSRCLTTGHARRRYSLQYTMALLITSAILYIPANLLPIMVTQALSSHINSTILEGIILLWSTGSYPVAMVIFIASIMVPILKMLAISWLCWDAKSQSSHDSETMHFIYEMVEFVGRWSMIDVFVIAVLSALVRMGQFMSVYPATGAVLFALVVILTMFASITFDPRLTWDKANHKFELQKNEES

SEQ ID NO: 10269 - protein, 636 aa, Xenorhabdus bovienii
  Peptide sequence Name=Xb4151_4152.C444.gene131.pep
  Gene classification: Gene name=Uup; Function=ATPase components of ABC transporters with duplicated ATPase domains; Function class=R General function prediction only
  Homolog annotation: Query=1..636bp; Hit=1..634bp; Blast score=932; Percent Identity=75.0; E value=0; Homolog= Zuup COG0488
MSLINLSGAWLSFSDAPLLDDTELHIEENERVCLVGRNGAGKSTLLRVLAKEQPLDDGQVIYEQDLIVARLQQDPPRDVEGTVFDFVSEGVKEQADCIKAFHHASRLVETDPSDKNLNRLAELQEVLDIQGLWLLDSRISDVLKQLSLPAEAKLSSLSGGWLRKAALGRALVSSPKVLFLDEPTNHLDIDTIEWLENFLKDFNGSLVFISHDRSFIRSMATRIIDLDRGKLTSWPGNYDKYLESKEEALRVEELQNAEFDKKLAQEEVWIRQGIKARRTRNEGRVRALKALRVERSDRRNVMGTAKMQVEEATRSGKIVFELENVNYQIGDKSLVKNFSAQVQRGDKIALVGPNGCGKTTLLKLMLGDLLSDSGRIHCGTKLEVAYFDQHRAALDPDRTVMDNLAEGKQEVMVNGRSRHVLGYLQDFLFHPKRAMTPVRALSGGERNRLLLARLFLKPSNLLILDEPTNDLDVETLELLEELVDGYTGTVILVSHDRQFVDNSVTECWIFEGNGEINNYVGGYYDAQQQRTQTISLHQSSEKKNSIETKAVKSKETSKRTSNKISYHLLRELEQLPSLLETLEEEIEQLQSQVGDSEFFNQPHAITQNVLNELANKEQKLEKAFDRWQELEMIKNG

SEQ ID NO: 10270 - protein, 705 aa, Xenorhabdus bovienii
  Peptide sequence Name=Xb4151_4152.C444.gene132.pep
  Gene classification: Function=Predicted N6-adenine-specific DNA methylases; Function class=L DNA replication, recombination and repair
  Homolog annotation: Query=1..379bp; Hit=1..379bp; Blast score=535; Percent Identity=67.0; E value=1e-152; Homolog= ycbY_1 COG0116
MNSLFASTARGLEELLKNELEMLGAQSCKIAQGGVHFQGDDRVMYKSLLWSRLASRILMPLNEFNVYSDLDLYLGVQSVDWSEIFSVDSTFSVHFSGTNEEIRNTQYGALRVKDAIVDSFVRKIKQRPDVAKQQPDIRIDVFLNKEKATLSLDLSGEGLHIRGYRDLAGQAPLKETLAAAVVLRSGWKAETPLIDPMCGSGTLLIEAAMMAADGAPGLHRQHWGFTSWLKFDQEIWREMMAEAQVRFRKGLQETTSRFFGSDIDRRVMDMARSNARRAGVAQLIQFQQGDASKLENPLTEGVVGTILSNPPYGERLESEPALVALYSIFGRIMKSRFPGWRLSLFSASPELLSCLQLRAEREFKAKNGPLDCVQKNYQLSDKPQSLDAGIADDYANRLRKNEKKLSKWAKQQGIDCYRLYDADLPEYNVAVDRYADKVVVQEYSPPKTVDANKARQRLFDVISATMNVLELSSNQLILKTRQRQTGKNQYEKMAEKKEFFLVNEYGAKFWVNLTDYLDTGLFLDHRIARRKLGEMSQGKDFLNLFAYTGSATVHAGLGGARSTTTVDMSRTYLEWAEKNLQANGLSGRQHRLIQADCLGWLAQSREQFDLIFIDPPTFSNSKRMEDSFDVQRDHITLMKQLKCLLRRGGTLMFSNNKRGFKMDFAELDKLGLVAEEITEKTVSQDFARNRQIHNCWLLRHAGEEK

SEQ ID NO: 10271 - protein, 370 aa, Xenorhabdus bovienii
  Peptide sequence Name=Xb4151_4152.C444.gene133.pep
  Gene classification: Function=Uncharacterized Fe-S protein; Function class=R General function prediction only
  Homolog annotation: Query=1..273bp; Hit=1..273bp; Blast score=364; Percent Identity=60.0; E value=1e-101; Homolog= ycbX_1 COG3217
MITLSRLYTYPVKSMRGLQLSHSLTGESGLMFDRNFMITTTDGIFMTARQYPQLVLFTPFMLNNGIYLRAPNGESATVLYSDFKEERHPTEVWNNHFTALVAPDEVNIWLSSFFDTPVQLRWLSEELTRRVKQFPDISLSFADGFPYLIINEASFHALQQRCPASIKIEQFRANIVVTGAAPFEEDSWQTIQIGNIIFDLPKPCSRCILTTISTEKGRKNPKSEPLATLQSFRTAKENGAVDFGQNAIARNSGIIRVGDNVTILEKKIPREYGNGEQAKDLNIQKAAEQAISIEFNGQRFTGNNQQIILEQLEKQGIKIPYSCRAGICGSCKISLIEGNVSPLKSTAIRDNGKILACSCIPQNDLVIELN

SEQ ID NO: 10272 - protein, 183 aa, Xenorhabdus bovienii
  Peptide sequence Name=Xb4151_4152.C444.gene134.pep
  Homolog annotation: Query=1..183bp; Hit=1..181bp; Blast score=265; Percent Identity=72.0; E value=2e-70; Homolog= Pa|Phot5-451c10.q1k _g253| 193359 - 193904 1619 181 aa, chain -
MKIRPDDQWRWYFDSEHSRVMLDLANGMVFRSRFLAKMLTDYAITMEEMPFSVDDAALYYAFEEHFRCINIASELRAELALNGVVAFRFMKPQMPKSWYFSSFSVMTKPEQGEIVQVRLQDCGTEVLFMVAEVGDSASLCLLAQQKLELSDRVMNFCDPIKIMNDRLMPYVEPTRETIYGRVI

SEQ ID NO: 10273 - protein, 336 aa, Xenorhabdus bovienii
  Peptide sequence Name=Xb4151_4152.C444.gene135.pep
  Gene classification: Gene name=PyrD; Function=Dihydroorotate dehydrogenase; Function class=F Nucleotide transport and metabolism
  Homolog annotation: Query=1..336bp; Hit=1..336bp; Blast score=556; Percent Identity=79.0; E value=1e-158; Homolog= pyrD COG0167
MYYSLLRKALFQLDPEQAHELTFRQLKLVTGTPFEFLIRQSVATKPVTCMGLSFKNPLGLAAGLDKNGDCIDAFGAMGFGFVEIGTVTPRPQVGNDKPRLFRVIEAEGIINRMGFNNLGVDNLVENVKRAKYDGIIGINIGKNKDTPVENGKDDYLICMDKIYPHAGYITINISSPNTPGLRTLQYGEALDDLLSAIKNKQSELQQKFQKYVPIAVKIAPDLTEEELIQVADSLMRHRIDGVIATNTTLDRKLIEGLNHCQQAGGLSGRPVQLRSTEIIRCLSQELKGKIPIIGVGGIDSLIAAREKMEAGSSLVQIFSGFIYKGPKLIKDIVNHI

SEQ ID NO: 10274 - protein, 872 aa, Xenorhabdus bovienii
  Peptide sequence Name=Xb4151_4152.C444.gene136.pep
  Gene classification: Gene name=PepN; Function=Aminopeptidase N; Function class=E Amino acid transport and metabolism
  Homolog annotation: Query=1..870bp; Hit=1..869bp; Blast score=1290; Percent Identity=73.0; E value=0; Homolog= ZpepN COG0308
MTQQRLVKHRLDYQAPDYTITDIELDFDLHADKTTVTAISQVKRLNHDTTPLILDGENLTLKSIHIDGKAWEHYHERDGRLSIEQLPAQFTLTIVNEIHPSANTALEGLYISGDALCTQCEAEGFRNITYYLDRPDVLARFTTRIAADRSKYPYLLSNGNRIEQGELSDGRHWVKWQDPFPKPAYLFALVAGDFDVLRDTFVTRSGREVALELFVDRGNLDRADWAMTSLKNSMKWDETRFGLEYDLDIFMIVAVDFFNMGAMENKGLNVFNSKYVLAKTETATDKDYLGIEAVIGHEYFHNWTGNRITCRDWFQLSLKEGLTVFRDQEFSSDLGSRSFNRINNVRVMRAAQFAEDASPMAHPIRPDQVMEMNNFYTLTVYEKGSEVIRMIHTLLGEEQFQAGMQLYVHRHDGSAATCDDFVQAMEDASNVDLTLFRRWYSQSGTPILTVHDEYDAEKQQYTLHVSQMTPPTLDQKEKQPLHIPLDIELYDEHGSVIPLRRDGQPIHHVLNIINAEQTFVFDDVPSLPVPSLLREFSAPVKLNYPYSDTQLAFLMKHARNEFSRWDAAQSLLANYVKLNVARYQQSQPLELPIHVIDAFRAVLLNQDIDPALAAQILTLPSENEMAELFTVIDPKAIHDVLHAITRGLANEMADEFTAVYHSTHTGAYRVDHQDIAKRALRNTCLYYLAFIDDKEQVDELVAAQYYQADNMTDTVAALSAAMSAELPCSYQLMDEFEQRWHQDGLVMDKWFALQATNPAFDALDKVRSLMNNRSFSLSNPNRVYSLLRTFFANNLVAFHAEDGRGYQFLQEILTELNSRNPQVASRLIEPLIRWRRYDEARQSLMRATLEQLKVLENLSGDLFEKITKALES

SEQ ID NO: 10275 - protein, 63 aa, Xenorhabdus bovienii
  Peptide sequence Name=Xb4151_4152.C444.gene137.pep
MKPLFSDVNQLVNKGENDVSRILMLSCELSSHISCNMILSANGLTLIVTVRKNICGYVALITE

SEQ ID NO: 10276 - protein, 404 aa, Xenorhabdus bovienii
  Peptide sequence Name=Xb4151_4152.C444.gene138.pep
  Gene classification: Gene name=PncB; Function=Nicotinic acid phosphoribosyltransferase; Function class=H Coenzyme metabolism
  Homolog annotation: Query=5..403bp; Hit=5..399bp; Blast score=543; Percent Identity=67.0; E value=1e-154; Homolog= ZpncB COG1488
MNLDATPIIKSLLDTDAYKFHMQQAVYHHYRHIIVVAEFRCRGDELLGEYAETLRHQIDMMADLTLTEREANYLASLPFFKEDYLNWFKSFRFNPEQVKISVTNEGQLAIRISGLWHEVILWEVPLLALISELVHRHRSPEIKPEVAVSQLRKLIELFHQDAAKENIDLSGFKLMDFGTRRRFSHEVQYAIVNELKNNFPYLIGTSNYQLAEQLSLAPLGTQAHEWFQAHQQISPELANSQRAALQTWLNEYPAQLGIALTDCITMDAFLRDFDKPFATAYQGLRHDSGDPIEWGEKAIAHYQSLDIDPMTKTLVFSDSLDLQKSLNLYSRFHKRINVMFGIGTRLTCNIPGVKPLNIVIKLVECNGKPVAKLSDSPGKTICEDDEFVDRLRRAFDIPYIEKAV

SEQ ID NO: 10277 - protein, 317 aa, Xenorhabdus bovienii
  Peptide sequence Name=Xb4151_4152.C444.gene139.pep
  Gene classification: Gene name=AsnS; Function=Aspartyl/asparaginyl -tRNA synthetases; Function class=J Translation, ribosomal structure and biogenesis
  Homolog annotation: Query=1..314bp; Hit=1..314bp; Blast score=547; Percent Identity=83.0; E value=1e-156; Homolog= asnS COG0017
MSVAPVVDVLQGRVPVDSEVTVRGWVRTRRDSKAGISFLAVYDGSCFNPVQAVVNSNLPNYQDEVLYLTTGCSVEITGTVVASQGKGQNFELQATNVVVVGMIDDPDTYPMAAKRHSIEYLREVAHLRPRTNLIGAVARVRHTLSQALHRFFHEKGFFWVSSPLITASDTEGAGEMFRVSTLDLQNLPRTDKGDVDFSKDFFGREAFLTVSGQLNGEAYACALSKIYTFGPTFRAENSNTSRHLAEFWMLEPEVAFADLNDIASLAEEMLKYVFKAALEERADDLAFFAERVDNEVVSRLEKFVDSDFIQLDYTACH

SEQ ID NO: 10278 - protein, 111 aa, Xenorhabdus bovienii
  Peptide sequence Name=Xb4151_4152.C444.gene140.pep
  Gene classification: Gene name=AsnS; Function=Aspartyl/asparaginyl -tRNA synthetases; Function class=J Translation, ribosomal structure and biogenesis
  Homolog annotation: Query=1..111bp; Hit=356..466bp; Blast score=219; Percent Identity=91.0; E value=3e-58; Homolog= ZasnS COG0017
MKNYPKDIKAFYMRMNEDGKTVAAMDVLAPGIGEIIGGSQREERLDMLDQRMEEMDLNKEDYWWYRDLRRYGTVPHAGFGLGFERLVAYVTGVSNVRDVIPFPRTPRNASF

SEQ ID NO: 10279 - protein, 374 aa, Xenorhabdus bovienii
  Peptide sequence Name=Xb4151_4152.C444.gene141.pep
  Gene classification: Gene name=OmpC; Function=Outer membrane protein (porin); Function class=M Cell envelope biogenesis, outer membrane
  Homolog annotation: Query=1..374bp; Hit=1..351bp; Blast score=345; Percent Identity=55.0; E value=3e-95; Homolog= phoE COG3203
MKRNLLAVVIPALLVAGTANAAEIYNKDGNKLDLYGKVDVRHQFADKRSGEDGDDSYARLGIKGETQVNDQLTGYGRWEYNMKAHKEEGKQDYATRLAYAGLKFANYGSLDYGRNYGVVYDVNVWTDVLPIFGGDSMSQTDNFMTGRSTGLLTYRNTDFFGLVDGLGFALQYQGQNSDRTKNERTEPTKANGDGYGLSTTYDVGYGISVGGSYANSARTLNSQQHNADAFGKRAEAWNIGAKYDANNVYLAAMYGETRNMTSAKVSGFNDEGKLVKGDLIANKTQNVELVAQYYFSDFGLKPSLAYVQSKGKDLGEGEDRINHDLVKYVSVGTYYYFNKNLSTYVDYKINLLKKDNDLGINARNVFGVGLTYQF

SEQ ID NO: 10280 - protein, 396 aa, Xenorhabdus bovienii
  Peptide sequence Name=Xb4151_4152.C444.gene142.pep
  Gene classification: Gene name=TyrB; Function=Aspartate/aromatic aminotransferase; Function class=E Amino acid transport and metabolism
  Homolog annotation: Query=1..396bp; Hit=1..396bp; Blast score=656; Percent Identity=78.0; E value=0; Homolog= aspC COG1448
MFEKITAAPADPILGLADSFKADPRENKINLGIGVYKDETGKTPVLTTVKKAEKFLLENETTKNYLAISGLPEFGRVTQELLFGNTSTIITDKRARTVQSPGGTGALRTAADFIAKQTNAKRVWISNPTWPNHKGVFSSAGLEIREYQYYNAEKHALDFDGMLASLSEAQAGDVVLLHGCCHNPTGIDPTAEQWQKLADLSAANGWLPVFDFAYQGFARSLDEDAEGLRIFTKNHNELIVASSYSKNFGLYNERVGACTIVATDSDTAEKAFSQAKSIVRTNYSNPPAHGASVVTTILSNDEFKAEWIQELATMRERIRRMRQLFVNTLQEKGAKQDFSFIISQNGMFSFSGLTKEQVDRLREEFGIYAVSSGRINVAGLTLENMVPLCEAIVAVL

SEQ ID NO: 10281 - protein, 210 aa, Xenorhabdus bovienii
  Peptide sequence Name=Xb4151_4152.C444.gene143.pep
  Gene classification: Gene name=GloB; Function=Zn-dependent hydrolases, including glyoxylases; Function class=R General function prediction only
  Homolog annotation: Query=1..210bp; Hit=1..210bp; Blast score=285; Percent Identity=60.0; E value=3e-77; Homolog= ZycbL COG0491
MNYHIIPVTTVMQNCTLIWCEETLEAAIVDPGGEAEKLISEIEQRGLKLTQILLTHGHYDHVGATVDVATHFNVPVHGPHKADAFWIEALEVQCQMFGVEACPSFTPERWLDEGDTLQIGNIEFSVLHCPGHTPGHIIFVSHTDKLISMGDVLFKGSIGRTDFPGGNYDDLIQSIKEKVIPIGDDFHFIPGHGSMSTLGHERKTNPFLQD

SEQ ID NO: 10282 - protein, 182 aa, Xenorhabdus bovienii
  Peptide sequence Name=Xb4151_4152.C444.gene144.pep
  Gene classification: Function=Uncharacterized BCR; Function class=S Function unknown
  Homolog annotation: Query=1..182bp; Hit=1..182bp; Blast score=251; Percent Identity=67.0; E value=4e-67; Homolog= ycbK COG3108
MNDIDYSRRKWLGIGAAALGLSLLPQHALAALTTPRPRILRFDNLHTGETLKAEFFDGRRYNKSELARLNYLFRDYRQNKIKSIDPKLFDQIYLLQMMIGINKPVQLVSGYRSLTTNNMLRQASGGVAKRSYHTRGQAMDFHIDSVQLAHIRKAALKMRAGGVGFYPKSNFIHIDTGPVRTW

SEQ ID NO: 10283 - protein, 572 aa, Xenorhabdus bovienii
  Peptide sequence Name=Xb4151_4152.C444.gene145.pep
  Gene classification: Function=Uncharacterized BCR; Function class=S Function unknown
  Homolog annotation: Query=56..564bp; Hit=63..609bp; Blast score=531; Percent Identity=49.0; E value=1e-151; Homolog= ZycbB COG2989
MVKNTVRLLKVSFICSALAVSEETFASQQNGLIVNDTQQFLEEQKKEDVVVSPDQIIPISSVNSIEENRKQIQSWLPQQVKPIFIDRLATLYAVNKMKPLWQDKNTVQQFEQQLFELSLAGVQPQFGKWLTQLHSAELSDMGRDVILSDAMLGYLHFVNDVKKKGDSWLYSKKSYKINLPPPDLIDKWQQHITDNNVFSYITALSPNNPMYKNMRKEMLKQLADKQQWSDFSMKGTLRPGQNSESVVALREILIRSDTLDSLTVKPENKVYNKELVAAVKRFQALHGLSADGVIGQSTKVWLNTTPQTRARIMALNIQRLRIIPDNIPTGILVNIPNYSLFYYLDGKEVLNSKVVVGRPSRKTPIMSSNLNNVVINPPWTVPTSMTRKDIAPRAMRDPSYFRSRGYTVFSSWSNDAKVIDPSSINWDVTTPNNFPYRIRQAPGPTNSLGRFKFNMPNSEAIYLHDTPNQASFGREMRAVSSGCVRVNKAPELANMLLGNAGWNKDRVSNSLKTWTTAYVNIPKKIPVFLYYQTAWVDEGGVPQYRADIYDYDMSAREQSELLSEILATRNDS

SEQ ID NO: 10284 - protein, 237 aa, Xenorhabdus bovienii
  Peptide sequence Name=Xb4151_4152.C444.gene146.pep
  Gene classification: Gene name=AphA; Function=Acid phosphatase (class B); Function class=R General function prediction only
  Homolog annotation: Query=1..237bp; Hit=1..237bp; Blast score=304; Percent Identity=56.0; E value=5e-83; Homolog= aphA COG3700
MRKVTLVFSAIAFAFSLNGVVQAKVQMPESVSSGVTTVELSQRQAVHWVSVEQIEKSLQDQPPMAIGFDIDDTVLFSSPGFYRGKLKYSPNDNSYLKNPAFWEKMNNEWDEFSMPKQIGIELVQMHLKRGDNIYFITGRTKTKTETVTKYLQEDLHIPADKMNVVIFAGDDPGKNNKISWMKEHKLKLYYGDADADIAAAHELNIRGIRILRASNSSYQPLPKAGRFGEEVVIKSEY

SEQ ID NO: 10285 - protein, 211 aa, Xenorhabdus bovienii
  Peptide sequence Name=Xb4151_4152.C444.gene147.pep
  Gene classification: Gene name=WbbJ; Function=Acetyltransferases (the isoleucine patch superfamily); Function class=R General function prediction only
  Homolog annotation: Query=2..210bp; Hit=16..224bp; Blast score=266; Percent Identity=58.0; E value=1e-71; Homolog= VCA0253 COG0110
MNENQKHWSQVEYLHSTVTNPNIKIKGTHSYYSHCWSDSFEKSVVRYLHGDEISLGWEPLGVVDKLYIGNYVCIASEAVILMGGNHTHRIDWFSVYPFLEGIKESYQHSGDTILSDGCWIGMRSMIMPGVTIGEGAVVAAGSIVTKDVSPYTVVGGNPARFIKYRFEPSVISRLLALKMYDLDEDMVEKLLPYLKGDDIDSLESAYYSFNK

SEQ ID NO: 10286 - protein, 1483 aa, Xenorhabdus bovienii
  Peptide sequence Name=Xb4151_4152.C444.gene148.pep
  Gene classification: Gene name=MukB; Function=Uncharacterized protein involved in chromosome partitioning; Function class=D Cell division and chromosome partitioning
  Homolog annotation: Query=1..1472bp; Hit=1..1472bp; Blast score=1982; Percent Identity=76.0; E value=0; Homolog= mukB COG3096
MIERGKFRSLTLVNWNGFFARTFDLDELVTTLSGGNGAGKSTTMAAFVTALIPDLTLLHFRNTTEAGATSGSRDKGLHGKLRAGVCYSTLDVVNSRHQRIIAGVRLQQVAGRDRKVDIKPFMIQGVPASIQPTQLLTENIGERQARVLPLNELKERLDEMEGVQFKQFNSITDYHSLMFDLGVIPKRLRSASDRSKFYRLIEASLYGGISSAITRSLRDYLLPENSGVRKAFQDMEAALRENRITLEAIRVTQSDRDLFKHLITEATAYVSADYMRHTNERRIHLDEALALRSELFGSRRQLVAEQYRHVEIARELTEQSGASSDLEMDYQAASDHLNLVQTAMRQQEKIDRYQGDIEELTYRLEEQTEVVEEAKELQAEYDAVSEAAEQEVDELKSQLADYQQALDVQQTRSIQYQQALQALERARELCQLPDLLIDNADEWQETYQAKEQQATETLLALEQKLSVADAAHSQFEQAYQLVKNIVGEVSRSSAWQSAREVLREWPSQRHLADRVQPLRIQLAELEQRLNSQQNAERLLGEFCKRHNQQYQPEDLEALQGELEARSEELSLNASESGERRMQMRQQLEQLKQKIQGLTTRAPVWLTAQDALNQLCEQSGETFESANDVTEYMQQLLEQERETTVERDDVSAQKRELEKHIERLSQPSGAEDSRLLALAERFGGVLLSEIYDDITIDDAPYFSALYGPARHAIVVPDLSLVSPHLEALEDCPEDLYLIEGDPQSFDDSVLDFEERKNAVLVKSSDRQWRYSRYPDVPLFGRAARENRLEILNFERDTLAERYATLSFDVQKIQRAYQAFSRFVGKHLSVAFDDDPEADIRSLNQQRIELERELSQFEAQTQQHHQKLVQVKESLSALNRLIPQITLLLDETLIDRVETVREEMSEAQDAARFLQQHSHALNKLEPLVSVLQSDPQQHEQLKQDYETAKHTQNKAKQQAFALTEVVQRRAHFSYSDSVGMLSDNADLNDKLRQRLEHAESDRSRAREQLRQQQSQYAQFNQVLASLKSSYDTKQDMLKELEQEMKDIGVQADPNAESRARERRDQLHAALSTNRSRINQLEKQIAFCEAEMENLQKKLRKTERDYYQKREQVVSSKAGWCAVMRLVKDNGVERRLHRRELAYMNGDELRSMSDKALGALRLAVANNEHLRDALRLSEDPKRPERKIQFFVAVYQHLRERIRQDIIRTDDPVDAIEQMEIELARLTEELTAREQKLAISSKSVANIIRKTIQREQNRIRMLNQGLQAVSFGQVGGVRLNVNVRESHSILLDVLSEQQEQHQDLFKSQRLTFSEAMAKLYQRLNPQIDMGQRLPQTIGEELLDYRNYLELDVEVNRGSDGWLKAESGALSTGEAIGTGMSILVMVVQSWEEESRRLRGKDISPCRLLFLDEAARLDAKSIATLFELCERLQMQLIIAAPENISPEKGTTYKLVRKIFNNHEHVHVVGLRGFGQDAPAIEQLQPILAE

SEQ ID NO: 10287 - protein, 240 aa, Xenorhabdus bovienii
  Peptide sequence Name=Xb4151_4152.C444.gene149.pep
  Gene classification: Gene name=MukE; Function=Uncharacterized protein involved in chromosome partitioning; Function class=D Cell division and chromosome partitioning
  Homolog annotation: Query=10..238bp; Hit=1..225bp; Blast score=338; Percent Identity=77.0; E value=3e-93; Homolog= ZmukE COG3095
MSSTHIEQFMPVKLAQALSNTLFPELDSQLRSGRHIGMDDLDNHAFLMDFQEELETFYARYNVELIRAPEGFFYLRPRSTTLIPRSVLSEMDMMVGKILCYLYLSPERLSNQGIFTFQELYDELLSLADESKLMKLVNQRSTGSDLDKQKLQEKARTSLNRLRRLGMVYFLQNDSNKFTITETVFRFGADVRSGDNPREAQLRMIRDGEAMSVEGNLSQEDNEHEEVSEHSAEGAEDEQS

SEQ ID NO: 10288 - protein, 63 aa, Xenorhabdus bovienii
  Peptide sequence Name=Xb4151_4152.C444.gene150.pep
  Gene classification: Gene name=MukF; Function=Uncharacterized protein involved in chromosome partitioning; Function class=D Cell division and chromosome partitioning
  Homolog annotation: Query=1..63bp; Hit=378..440bp; Blast score=104; Percent Identity=77.0; E value=2e-23; Homolog= mukF COG3006
LGAVLRDYLAQYPHNRHFDVARILVDQAVRLGVAEADFSGLPAEWLAINDYGAKVQAHVIDTY

SEQ ID NO: 10289 - protein, 351 aa, Xenorhabdus bovienii
  Peptide sequence Name=Xb4151_4152.C444.gene151.pep
  Gene classification: Gene name=MukF; Function=Uncharacterized protein involved in chromosome partitioning; Function class=D Cell division and chromosome partitioning
  Homolog annotation: Query=1..351bp; Hit=1..351bp; Blast score=568; Percent Identity=82.0; E value=1e-162; Homolog= mukF COG3006
MSEYSQTVPELVSWARKNDFSISLPPERLAFLMAISVLNSERFDGEMSEGELVDAFREVCKGFEQTSEAVAVRANNAINDMVRQKLINRFTSELADGNAIYRLTPLGIGISDYYIRQREFSTLRLSMQLSIVANELHRAAEAAEEGGDEFHWHRNVFAPLKYSVAEIFDSIDMSQRTMDEQQNSVKIDIAALLNQDWQAAIANCEHLLSETSGTLRELQDTLEAAGDKLQANLLRIQDANMGSGGLELVDKLVFDLQSKLDRIISWGQQAIDLWIGYDRHVHKFIRTAIDMDKNRIFAQRLRQSIQHYFDHPWVLTIANAERLLDMRDEELTLRNEEVMGELPPDMEYEEF

SEQ ID NO: 10290 - protein, 261 aa, Xenorhabdus bovienii
  Peptide sequence Name=Xb4151_4152.C444.gene152.pep
  Gene classification: Gene name=SmtA; Function=SAM-dependent methyltransferases; Function class=Q Secondary metabolites biosynthesis, transport and catabolism
  Homolog annotation: Query=1..261bp; Hit=1..261bp; Blast score=320; Percent Identity=58.0; E value=7e-88; Homolog= smtA COG0500
MRDRNFDDIADKFSRNIYGTTKGKIRQAVVWQDINELLNHLPQRPLRILDAGGGEGNMACQLAALGHKVILCDLSEEMILRAKCNAQERGVLHQMQFIQSPVQDIRQHIKQPVDLILFHAVLEWITDQKDAIETLGEIITPGGALSLMFYNANGLVMRNAILGNFHLATPNIQRRRKRSLSPQNPLVPEQVYQWLTELNMEITGKTGVRVFHDYLQSRQLQNTDFPALLELEQRYCRQEPYISLGRYIHVMARKPTLKSEL

SEQ ID NO: 10291 - protein, 268 aa, Xenorhabdus bovienii
  Peptide sequence Name=Xb4151_4152.C444.gene153.pep
  Gene classification: Function=Uncharacterized ACR; Function class=S Function unknown
  Homolog annotation: Query=1..263bp; Hit=1..259bp; Blast score=254; Percent Identity=55.0; E value=6e-68; Homolog= ycbC COG1434
MLFLLKKYVGALLMPLPLIILVSLTALLFLWFTRWQKTGKALLSLSWLALLLFSLQPIADKLLLPIEGKYVQRYEPDKAYIAPVKYIVVLGGGFTYNPQWAPSANLISNSLPRVTEGIRLYHLNPGTKMIFTGGKGVNSISSAEIAAMVAQSLGIPVEDTIALREPLDTEEEAAEVEKVLGQQPFILVTSANHMERSLKFFERRGMHPIAGPANQLAVTTPLYAWEKYIPSAYYFSHTERAWYETLGKIWQAIKPVTKEAATEKTENS

SEQ ID NO: 10292 - protein, 249 aa, Xenorhabdus bovienii
  Peptide sequence Name=Xb4151_4152.C444.gene154.pep
  Gene classification: Gene name=KdsB; Function=CMP-2-keto-3 -deoxyoctulosonic acid synthetase; Function class=M Cell envelope biogenesis, outer membrane
  Homolog annotation: Query=2..243bp; Hit=3..244bp; Blast score=370; Percent Identity=76.0; E value=1e-103; Homolog= ZkdsB COG1212
MFTVIIPARFASTRLPGKPLADIHGKPMIVRVMERAIRSGANRVIVATDNQAVFDAVTAAGGEACMTSAHHHSGTERLAEVIDQYQFSDDEIIVNVQGDEPLIPEQIIKQVADNLAESDAGMATLAVQIQDAEEAFNPNTVKVVMDAQGYALYFSRATIPWERDRFMQSKETVGDNFLRHIGLYAYRAGFIRRYVQWAPSPLESIEMLEQLRVLWYGEKIHVAKALQAPGAGVDTPEDLEAVRKTFAEC

SEQ ID NO: 10293 - protein, 59 aa, Xenorhabdus bovienii
  Peptide sequence Name=Xb4151_4152.C444.gene155.pep
  Gene classification: Function=Uncharacterized BCR; Function class=S Function unknown
  Homolog annotation: Query=1..59bp; Hit=1..59bp; Blast score=87; Percent Identity=77.0; E value=2e-18; Homolog= ycaR COG2835
MDHRLLEIIACPVCYGKLNYDKENFELICKLDRLAFPVRDGIPVLLENEARALPAEEEK

SEQ ID NO: 10294 - protein, 331 aa, Xenorhabdus bovienii
  Peptide sequence Name=Xb4151_4152.C444.gene156.pep
  Gene classification: Gene name=LpxK; Function=Lipid A biosynthesis protein LpxK, tetraacyldisaccharide-1-P 4'-kinase; Function class=N Cell motility and secretion
  Homolog annotation: Query=1..323bp; Hit=1..324bp; Blast score=412; Percent Identity=64.0; E value=1e-115; Homolog= ZycaH COG1663
MIERIWSGRSWLYILLLPLSALYGLISGLRCLGYKLGLIRSWKAPVPVVVVGNLTAGGNGKTPIVIWLVEQLQRTGYQIGVVSRGYGGKAEHYPLLITGEVTTAQAGDEPVLIHRRTGAPVAVAPKRADAIKALLMHFPVDIIITDDGLQHYALQRDYEIVVIDGIRRFGNGCWLPAGPMRELAGRLNTVNTIIVNGGVPETGELPMTLKGELAINLLTGESRQVSDIPNGVAMAGIGHPPRFFATLQQLGAVLQETHAFADHQSYDKTQLSALTDDGQNLLMTEKDAVKCFQFAQPNWWYLPVSAHFPEEKEQKMLDEICALLPKLNMRR

SEQ ID NO: 10295 - protein, 581 aa, Xenorhabdus bovienii
  Peptide sequence Name=Xb4151_4152.C444.gene157.pep
  Gene classification: Gene name=MdlB; Function=ABC-type multidrug/protein/lipid transport system, ATPase component; Function class=Q Secondary metabolites biosynthesis, transport and catabolism
  Homolog annotation: Query=2..581bp; Hit=3..582bp; Blast score=934; Percent Identity=82.0; E value=0; Homolog= msbA COG1132
MNDKDLSTWQTFRRLWPLITPFKLGLAVAAIALVINAAGDTLMLSLLKPLLDEGFGKADMSVLEWMPLVVIGLMLLRGISGFISSYCISWVSGKVVMQVRRRLFTHMMGMPVSFFDQQSTGTLLSRITYDSEQVASSSSGALVTVVREGASIIGLFILMFYYSWELSLILIVIAPIVALVIRLVSVRFRNISKNMQNSMGMVTTSAEQMLKGHKEVLIFGGQKIETKRFNQVSNHMRQQGMKMVSASSISDPIIQLIASFALAFVLYAASFPEIMGALTAGKITVVFSSMIALMRPLKSLTNVNAQFQRGMAACQTLFAILDMEQEKDEGKLELKKAKGDLEFRNVTFCYPTKDHPALKSISMTIPKGKTVALVGRSGSGKSTIANLLTRFYDINEGGIMLDGHDLREYSLSSLRSQIALVSQNVHLFNDTVANNIAYASEGKFSREEIERAAEMAYAMDFIKKLDQGLDTMIGENGVLLSGGQRQRIAIARALLRDSPILILDEATSALDTESERAIQAALDELQKNRTSLVIAHRLSTIENADEIIVVEDGFIVEKGNHSVLLEKDGAYAQLHRMQFGQ

SEQ ID NO: 10296 - protein, 781 aa, Xenorhabdus bovienii
  Peptide sequence Name=Xb4151_4152.C444.gene158.pep
  Gene classification: Gene name=ComEC (BS); Function=Predicted multitransmembrane, metal-binding protein; Function class=R General function prediction only
  Homolog annotation: Query=23..440bp; Hit=27..436bp; Blast score=255; Percent Identity=37.0; E value=1e-67; Homolog= ZycaI_1 COG0658
MWPIIFFPLNYILSIWRKPLLIISLNQAAIAIILGMFPLLLLAELPQQREIYFLIGLAFCLWFVPRKSARITSLMLWTFIFGCWHGHLILNQITYFSETSRSATVMIESVSLDAEKNNAEETERHRIRFIESDGKYIFPALFASVLWNSSESLCAGQIWQVTMKLRPVHAQLNHGSYDSQRYALSIRQPLNGKITKARLLRGQCSFRQDLINKLVPEIQPLKYSGIALALTFGERKWLDQQTRLLLQQTGIAHLMAISGLHIAMASLFGWSLARGIQFFFPARWVSFRFPLLMGWLTAVLYAWLSGWGIPAVRAILGLTLWIYLRCRNRFCFSWQWALWSAALILLFDPLAILSDSFWLSFTAVMALLFWFHWMPLPEGIRYGWHWSWLRGLHMQLGMMLMLLPLQLLLFQGLNIASLVANLWAVPIVSFLSVPLVMLALSCFFLPVIQPILWQLVDYSIVFALAPLQVLTHSWFETGHFPIFITLVGWFSVVFWRLGWWKSYKWLLGVLIGIIVCYLKRDDEYQWRFSMLDVGHGLAVVIDKGGKAIIFDTGNRWETGSMAEKVIAPYLRWHRLTPEQIILSHDHLDHTGGVEYLRKKYPDIQIRSSLIGQSHLPCIRGEQWTWQELTFQVIWPQEKTAVVGNNQSCVIRIDDGKHSLLLTGDLEKQGEYRLVSLEREHLNATILQVPHHGSNTSSTAVFIRTIMPKYALTSVARYSPWKLPSVKVRQRYKNAEIQWYSTAISGQITGYFYRDHIKLAGYRQHIMSRWYHQWFGIHSDHG

SEQ ID NO: 10297 - protein, 96 aa, Xenorhabdus bovienii
  Peptide sequence Name=Xb4151_4152.C444.gene159.pep
  Gene classification: Gene name=HimA; Function=Bacterial nucleoid DNA -binding protein; Function class=L DNA replication, recombination and repair
  Homolog annotation: Query=1..93bp; Hit=1..93bp; Blast score=160; Percent Identity=89.0; E value=2e-40; Homolog= himD COG0776
MTKSELIERLTEQQSHMPAKAVEDAVKEMLDHMAETLAAGERIEVRGFGSFSLHYRAPRVGRNPKTGDKVELEGKYVPHFKPGKELRDRVNIYSDS

SEQ ID NO: 10298 - protein, 557 aa, Xenorhabdus bovienii
  Peptide sequence Name=Xb4151_4152.C444.gene160.pep
  Gene classification: Gene name=RpsA; Function=Ribosomal protein S1; Function class=J Translation, ribosomal structure and biogenesis
  Homolog annotation: Query=1..557bp; Hit=1..557bp; Blast score=960; Percent Identity=94.0; E value=0; Homolog= rpsA COG0539
MTESFAQLFEESLQVIETRPGAIVRGVVVSIDKDVVLVDAGLKSESAIPVEQFKNAQGELEIQVGDEIDVALDAVEDGFGETILSREKAKRHEAWLMLEKAYEEAETVTGVINGKVKGGFTVELNGIRAFLPGSLVDVRPVRDTAHLEGKELEFKVIKLDQKRNNVVVSRRAVIESENSAERDQLLENLQEGMEVKGIVKNLTDYGAFVDLGGVDGLLHITDMAWKRVKHPSEIVNVGDEITVKVLKFDRERTRVSLGLKQLGEDPWVAIAKRYPESTRLTGRVTNLTDYGCFVEIEEGVEGLVHVSEMDWTNKNIHPSKVVNVGDVVEVMVLDIDEERRRISLGLKQCKSNPWQQFAETHNKNDRVEGKIKSITDFGIFIGLDGGIDGLVHLSDISWNVAGEEAVREYKKGDEIAAVVLQVDAERERISLGIKQLAEDPFNNYLSVNKKGTIVNGKVTAVDAKGATVELADGVEGYLRASEASRDRIEDATQVLNVGDEVEAKYVGVDRKNRIVNLSVRAKDEADEKDAIASVNKQEDTNFANNAMAEAFKAAKGE

SEQ ID NO: 10299 - protein, 58 aa, Xenorhabdus bovienii
  Peptide sequence Name=Xb4151_4152.C444.gene161.pep
MGLFYIPRNYSLLQGALVCQHILLPTYQDSIYIFLVRCCKSTTCENYNYAGNANAFFA

SEQ ID NO: 10300 - protein, 244 aa, Xenorhabdus bovienii
  Peptide sequence Name=Xb4151_4152.C444.gene162.pep
  Gene classification: Gene name=Cmk; Function=Cytidylate kinase; Function class=F Nucleotide transport and metabolism
  Homolog annotation: Query=17..242bp; Hit=1..226bp; Blast score=330; Percent Identity=79.0; E value=6e-91; Homolog= cmk COG0283
MTRLLCGKRYAKRRKIMVAIASVITVDGPSGAGKGTLCQALAEALGWQLLDSGAIYRVLALAAIHHQVDIQSEDSLVPLAANLDVRFMPANGKLRVILEGEDVSNEIRTEAVGNTASQAATFPRVREALLRRQRAFRIAPGLIADGRDMGTVVFPDAPVKIFLDASAEERARRRMLQLQEKGFSVTFDSLLSEIQERDFRDRNRAVAPLVPAYDALLLDSTSMSIEEVIDKALTYAKNALALPA

SEQ ID NO: 10301 - protein, 428 aa, Xenorhabdus bovienii
  Peptide sequence Name=Xb4151_4152.C444.gene163.pep
  Gene classification: Gene name=AroA; Function=5-enolpyruvylshikimate -3-phosphate synthase; Function class=E Amino acid transport and metabolism
  Homolog annotation: Query=1..425bp; Hit=1..425bp; Blast score=670; Percent Identity=79.0; E value=0; Homolog= aroA COG0128
MQSLTLKPISCINGTINLPGSKSVSNRALLLAAFAKGTTCLTNLLDSDDIRHMLNALTTLEIPYRLSDDRTCCEIDGIGGTITGKGALELFLGNAGTAMRPLAAALCLGDNNVVLTGEPRMKERPIGHLVDALRQGGAKIDYLEQENYPPLHIKGGFSGGKVVVDGSVSSQFLTALLMAAPLAANDTDIHIQGDLVSKPYIDITLALMESFGVTVENHQYQVFHVKGQQQYQSPGHYLVEGDASSASYFLAAAAIKGGTVRVTGIGKNSLQGDTKFADVLERMGATIRWGHDFVECERGTLIGVDMDMNAIPDAAMTIATTALFAQGETVIRNIYNWRVKETDRLNAMAAELRKIGAEVEEGHDYIRVVPPQKLNHAEIETYNDHRMAMCFSLVALSDTPVTILDPGCTAKTFPDYFNQLEKLSQYIM

SEQ ID NO: 10302 - protein, 362 aa, Xenorhabdus bovienii
  Peptide sequence Name=Xb4151_4152.C444.gene164.pep
  Gene classification: Gene name=SerC; Function=Phosphoserine aminotransferase; Function class=H Coenzyme metabolism
  Homolog annotation: Query=1..361bp; Hit=1..361bp; Blast score=548; Percent Identity=70.0; E value=1e-156; Homolog= ZserC COG1932
MSQVYNFSAGPAMLPAEVLRRAEQELCNWHGLGTSVMEISHRSKEFMDVAAEAEKDLRDLLAIPENYKVLFCHGGARGQFSALPQNLLGDKTTADYIVSGYWSECAAKEAEKYCTPNVINITTEVDGIRSVKPMSEWALSSDAAYVHYCPNETIEGIAIFEEPDFGDDKIVIADYSSAILSAPIDVSRYGVIYAGAQKNIGPAGITVVIVREDLLGRAHQHTPSILDYTVQVKSASMYNTPPTFAWYLSGMVFKWLKEQGGLQEISKRNQAKAELLYRTIDNSNLYINCVAPQNRSIMNIPFQLANPMLDGKFLEEAYAHGLHALKGHKVAGGARASIYNAMPYEGVQALVEFMADFERRNA

SEQ ID NO: 10303 - protein, 348 aa, Xenorhabdus bovienii
  Peptide sequence Name=Xb4151_4152.C444.gene165.pep
  Gene classification: Gene name=AnsB; Function=L-asparaginase/archaeal Glu-tRNAGln amidotransferase subunit D; Function class=E Amino acid transport and metabolism
  Homolog annotation: Query=5..348bp; Hit=5..348bp; Blast score=459; Percent Identity=71.0; E value=1e-129; Homolog= ZansB COG0252
MRKTKKTAIAGFLTLVSGSALALPNITVLATGGTIAGGGESATQSSYTAGKVGIDSLLNAVPAIKNIANLKGEQVVSIGSQDMNDQVWLTLAKKINADCDKTDGFVVTHGTDTMEETAYFLDLTTQCQKPIVMVGAMRPSTALGADGPLNLYNAVVVAADKNSANRGVLLSMNDSVIHGRHIGKLSTTEVQAFQAINSGAEGFVHNGKVSYYSATAPEKEHKFAFDVSKLDKLPKVGIVYNYSNASELPAKAFVENGYQGIVSAGVGNGNIYKSVFDTLAQAAKDGVVVVRSSRIPFGYTTKNAEVNDSKYGFVASERLNPQKARVLLQLALTQTSDTAKIQEMFTQY

SEQ ID NO: 10304 - protein, 587 aa, Xenorhabdus bovienii
  Peptide sequence Name=Xb4151_4152.C444.gene166.pep
  Gene classification: Function=Uncharacterized ACR; Function class=S Function unknown
  Homolog annotation: Query=1..585bp; Hit=4..588bp; Blast score=965; Percent Identity=78.0; E value=0; Homolog= ZycaO COG1944
MTQTYIPGKDAALEDSINHFQSKLASFGFNIEEASWLNPVPNVWSVHIRDRDCPLCFTNGKGASKKAALASALGEYFERLSTNYFFADFYLGNTVANGEFVHYPNEKWFPLPEDDSLPEGILDERLHHFYNPDNELCASQLIDFQSGNEERGICALPFTRQSDNQTVYIPMNIIGNLYVSNGMSAGNTMNEARVQGLSEVFERYVKNRIIAECISLPEIPESVMNRYPGVVESVNKLQAEGFPLYCYDASLGGQFPVICVVLFNPNNGTCFASFGAHPDFGVALERTVTELLQGRSLKDLDVFTPPSFDDEEVSEHTNLETHFIDSSGAISWDLFKQDADYTFADWSFKGTTEEEFATLMGIFNTLDAEAYIADYEHLNVYACRILVPGMSDIYPVEDLHIANNTMGTHLRDTILALPNSQWQPAEYLAFLEQLDDEGLDDFTRVRELLGIAAGKDNGWSNLRIGELKSMLALAGNDLEQALIWVEWTQDFNASVFTAERANYYRCLQTLLLLTQEEDRDPSQYHQAFVKMYGQETVDAASAAIDGKNGFYGLWSVDSELKTLPAHQALLNAYEKLQKAKREFWSNK

SEQ ID NO: 10305 - protein, 285 aa, Xenorhabdus bovienii
  Peptide sequence Name=Xb4151_4152.C444.gene167.pep
  Gene classification: Gene name=FocA; Function=Formate/nitrite family of transporters; Function class=P Inorganic ion transport and metabolism
  Homolog annotation: Query=1..280bp; Hit=1..280bp; Blast score=391; Percent Identity=73.0; E value=1e-109; Homolog= focA COG2116
MKTDNPFNLFPPAVMAQIADDSGVYKVNKHPAVTYLSAIMAGVFISIAFVFYITATTGTSSIPYGLAKLTGGICFSLGLMLVVIFGADLFTSTVLTIVSKATGRITWSQMLKNWINVYIGNLIGALFFVILMWQSGQYAVANGFWGLNVLQTADHKMHHTFIEALCLGILANLMVCLAVWMSYAGRSLIDKLFALILPVAMFVASGFEHSIANMFLIPFGIIIKNFAPTEFWAKVGATPEQFPQLTVSHFITDNLIPVTIGNIIGGAILVGLIYWFMYLRGGQKY

SEQ ID NO: 10306 - protein, 760 aa, Xenorhabdus bovienii
  Peptide sequence Name=Xb4151_4152.C444.gene168.pep
  Gene classification: Gene name=PflD; Function=Pyruvate-formate lyase; Function class=C Energy production and conversion
  Homolog annotation: Query=1..760bp; Hit=1..760bp; Blast score=1412; Percent Identity=88.0; E value=0; Homolog= ZpflB COG1882
MSELNEKFSVAWQGFNEGSWQNEVNVRDFIQQNYAPYEGDETFLAGATKATDILWEKVMEGIKIENRTHAPVDFDTDVASTIISHDAGYIAKDLEQIVGLQTEAPLKRAIIPFGGIKMVESSCKAYNRELDPKLKQIFTDYRKTHNQGVFDVYTPDILKCRKSGVLTGLPDAYGRGRIIGDYRRVALYGIDFLRDEKYAQFTSLQEKLENGEDLEATIRLREEIAEQHRALSQIKEMAAKYGCDISYPAITAKEAVQWTYFAYLAAVKSQNGAAMSFGRVSSFLDIYIERDLQAGRLTEQEAQELIDHLVMKLRMVRFLRTPEYDELFSGDPIWATESLAGMSLDGRTLVTKNSFRFLNTLYTMGPSPEPNMTILWSEKLPINFKKFAAKVSIDTSSLQYENDDLMRPDFNSDDYAIACCVSPMIVGKQMQFFGARANLAKTMLYAINGGVDEKMKIQVGPKEEPMRDEVLDYDKVMARMDHFMDWLAKQYVTALNIIHYMHDRYSYEAALMALHDRDVYRTMACGIAGLSVAADSLSAIKYAKVSPIRDEDGLATDFNIEGEYPQFGNNDPRVDDIACDLVERFMKKIQKLQTYRNAVPTQSVLTITSNVVYGKKTGNTPDGRRAGAPFGPGANPMHGRDQKGAVASLTSVAKLPFAYAKDGVSYTFSIVPNALGKDDEVRKANLAGLMDGYFHHEADIEGGQHLNVNVMNREMLLDAMENPEKYPQLTIRVSGYAVRFNSLTKEQQRDVITRTFTQTI

SEQ ID NO: 10307 - protein, 246 aa, Xenorhabdus bovienii
  Peptide sequence Name=Xb4151_4152.C444.gene169.pep
  Gene classification: Gene name=PflA; Function=Pyruvate-formate lyase -activating enzyme; Function class=O Posttranslational modification, protein turnover, chaperones
  Homolog annotation: Query=1..246bp; Hit=1..246bp; Blast score=435; Percent Identity=83.0; E value=1e-122; Homolog= pflA COG1180
MSVLGHIHSFESCGTVDGPGIRFIVFFQGCLMRCLYCHNRDTWNTHGGTTVTVEELIKEATTYRHFMNASGGGVTASGGEAILQAEFVRDWFRACHAENIHTCLDTNGFVRRYDLIIDELLDDTDLVMLDLKQLDDEIHQKLIGVSNHRTLEFAHYLAKLNQKTWIRYVVVPGWSDDDKSIHMLGEFTKDMKNIEKIELLPYHELGKHKWIAMGEEYKLEGVKPPSKETMERVKEILVSYGHHVIY

SEQ ID NO: 10308 - protein, 222 aa, Xenorhabdus bovienii
  Peptide sequence Name=Xb4151_4152.C444.gene170.pep
  Gene classification: Gene name=Tra8; Function=Transposase, IS30 family; Function class=L DNA replication, recombination and repair
  Homolog annotation: Query=1..218bp; Hit=106..319bp; Blast score=235; Percent Identity=56.0; E value=3e-62; Homolog= NMB1022 COG2826
LHHKTVYRLIYKDKLNGDNLWLHLRIAKKPYRKRYGSYKRRGKIKNRVSIDKRPKLVDKKQRIGDWEGDTLVGKDHKSALLTLIERKSLFTIIIKLENKTAEGVAKAATRHLSLIKHKIKTMTFDNGLEFAEHELISKNLETKIYFAHPYSPWERGINENTNGLIRDYFPKGTDFNKVSEREINLVANRLNNRPRKTRDDKTPNELFKGIPTHLLRPLRCCA

SEQ ID NO: 10309 - protein, 43 aa, Xenorhabdus bovienii
  Peptide sequence Name=Xb4151_4152.C444.gene171.pep
  Homolog annotation: Query=1..43bp; Hit=1..43bp; Blast score=62; Percent Identity=79.0; E value=2e-09; Homolog= gi|37524850|ref|NP _928194.1| Transposase, IS30 family [Photorhabdus luminescens subsp. laumondii TTO1] gi|37525554|ref|NP_928898.
MAYKQLTETERYQIFSLKEAGFSQREISKSLNRNPSTISRELR

SEQ ID NO: 10310 - protein, 43 aa, Xenorhabdus bovienii
  Peptide sequence Name=Xb4151_4152.C444.gene172.pep
MHLPTNAWEQELRWFCRINKESLNEGSSVYYLCNQTVKHLCRR

SEQ ID NO: 10311 - protein, 74 aa, Xenorhabdus bovienii
  Peptide sequence Name=Xb4151_4152.C444.gene173.pep
MRQNQRSSCSQALVGKCIEHLSLFSGKNVRGYHATMGRTAVIRGSANALILILFIFYPCIVYIQYPYILHIAKI

SEQ ID NO: 10312 - protein, 70 aa, Xenorhabdus bovienii
  Peptide sequence Name=Xb4151_4152.C444.gene174.pep
MKRLSYIILLCISTFALANISFAESLYQNDPYPNPQCNIQAQNICRPSIFKSWLYARCMDIEYKQCMGKK

SEQ ID NO: 10313 - protein, 97 aa, Xenorhabdus bovienii
  Peptide sequence Name=Xb4151_4152.C444.gene175.pep
  Gene classification: Gene name=Tra5; Function=Putative transposase; Function class=L DNA replication, recombination and repair
  Homolog annotation: Query=23..95bp; Hit=25..110bp; Blast score=60; Percent Identity=39.0; E value=2e-10; Homolog= b4285 COG2801
LSIFRYHQTCSSLRDPHSGSASDGSKAALRLGSRTLSHWLTNEGQPVGRWKARRLMQECGLQSCQQGAHRYRPAGEEHATSPHLLRQHFTPECPNIQ

SEQ ID NO: 10314 - protein, 349 aa, Xenorhabdus bovienii; identical to SEQ ID NO: 5796
  Peptide sequence Name=Xb4151_4152.C444.gene176.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 10315 - protein, 46 aa, Xenorhabdus bovienii
  Peptide sequence Name=Xb4151_4152.C444.gene177.pep
MERVKTYPNRQVCAFKFLLLRLSLLLPSHIVIYMPGDPLTCYRATT

SEQ ID NO: 10316 - protein, 187 aa, Xenorhabdus bovienii
  Peptide sequence Name=Xb4151_4152.C444.gene178.pep
  Gene classification: Gene name=MutT; Function=NTP pyrophosphohydrolases including oxidative damage repair enzymes; Function class=L DNA replication, recombination and repair
  Homolog annotation: Query=7..180bp; Hit=8..181bp; Blast score=262; Percent Identity=73.0; E value=1e-70; Homolog= ZyrfE COG0494
MIDQKIPKILNINDVAHSRLFNIQSVNLEFSNGVKRVYERMKPSNREAVLIIPVIGDELLLIREYAVGIEQYELGFPKGAIDAGESTLEAANRELKEEVGFGAAKLELLTKLTMAPSYFSSRMNIVIAQDLYPECLEGDEPEPLVQVRWPIADMMSLLEHPDFNEARNVSALFFAQRYLQASSNGTR

SEQ ID NO: 10317 - protein, 685 aa, Xenorhabdus bovienii
  Peptide sequence Name=Xb4151_4152.C444.gene179.pep
  Homolog annotation: Query=1..683bp; Hit=18..706bp; Blast score=759; Percent Identity=56.0; E value=0; Homolog= gi|37524123|ref|NP _927467.1| hypothetical protein [Photorhabdus luminescens subsp. laumondii TTO1] gi|36783546|emb|CAE12392.1| un
MVSFLTFRWKRPDNARYLPSIAKTGHRKLNADEYQAIDSYLQNALSLMQPDRSHRSGQPALSVKNDTVYTINHTINRFSVATDESQYWRYYVDEMEIHLPALLESFIKQQNTIEIVQTTFMPLVIAVNGHFLKDYQQDLSIARIVKQTAQASIQKNGNSIANFLYIRKETPEENRLRRSTGILEGILMCIGLSLWFLALFMPTPILPWLMLAAVLFLITSFWLTFRSPSPRNILNISCFNGIPKRWGIFSESEPEQRRNISLGGIDLIYPSHWEPYVVRELDQNTDVDIYTNCHVVQQGRYLSLHEEEKHYPYQRYRKNLILVVFSICAMLVLYFYQPVSLSMRLSFAWLYGSNTQVITSVTELQNMPLKEGDVLRVKGIGMCYIPPRLNDNPGGIKHIFTAFDCTGIYWNNDSPLPIPESDIIENASTLITTVNEQLHPIERSRKTNSDLNEAIAKSGMTLLDNFSQVILKTHNLCMDEIDCIRLKSALVNLSNAEDWNDLLKQAERGKLNGTKVLLRSVSADALEKLIDTTTASFIYREIDKISILLNSPSPGGVLLISEEGNKLVELPYLPFLTYEYSALDQWRELQRLAEILLSAPFEAVGIVTKLSEDANETRRITLHSEPDSVTLIRYLGSCFFLAILMAILSINAILIISKRQKNKVRLQRIGEYYDNCFNSKQPPMD

SEQ ID NO: 10318 - protein, 137 aa, Xenorhabdus bovienii
  Peptide sequence Name=Xb4151_4152.C444.gene180.pep
  Gene classification: Function=Ribosome-associated heat shock protein implicated in the recycling of the 50S subunit (S4 paralog); Function class=J Translation, ribosomal structure and biogenesis
  Homolog annotation: Query=5..130bp; Hit=9..134bp; Blast score=161; Percent Identity=70.0; E value=2e-40; Homolog= PM1546 COG1188
MPNSDTDQTMRLDKWLWAARFYKTRSIAREMIDGGKVHYNGQRSKPSKLVELNAEIKLRQGNEEKIVTVLALNSHRRSATEAQQLYQETEKSIINREKTALARKMNVLTMPHPDRRPDKKERRTLIKFKNTKLNEPE

SEQ ID NO: 10319 - protein, 290 aa, Xenorhabdus bovienii
  Peptide sequence Name=Xb4151_4152.C444.gene181.pep
  Gene classification: Function=Disulfide bond chaperones of the HSP33 family; Function class=O Posttranslational modification, protein turnover, chaperones
  Homolog annotation: Query=1..282bp; Hit=3..283bp; Blast score=391; Percent Identity=67.0; E value=1e-109; Homolog= yrfI COG1281
MTKHDQLHRFLFESHSVRGELVSVSETYQRMMENHHYPLPVQQLLGELLVATSLLTATLKFNGDITVQIQGDGPVRLAVINGNNQQQMRGTARIDGDVDAASSLRDMVGNGYMVITVTPTEGERYQGVVALEGETLAECLDAYFKQSEQLPTRLFIRTGILDGKMAAGGMLLQILPGAQEGSEDLLDHLVQLTATIKGEELFTLDVKEILHRLYHEEDVTLYEPQQVEFRCTCSHQRCADTLVTLPDADLQEILLKDGKIDMECEFCGMHYIFNDKDISEIKIVKKELLH

SEQ ID NO: 10320 - protein, 539 aa, Xenorhabdus bovienii
  Peptide sequence Name=Xb4151_4152.C444.gene182.pep
  Gene classification: Gene name=PckA; Function=Phosphoenolpyruvate carboxykinase (ATP); Function class=C Energy production and conversion
  Homolog annotation: Query=5..539bp; Hit=6..540bp; Blast score=963; Percent Identity=85.0; E value=0; Homolog= pckA COG1866
MSVKGITAQELAVYGICDVSEIVYNPSYELLFSEETQPSLQGYERGTLTHLGAVAVDTGIFTGRSPKDKYIVRDDVTCDTVWWADQGKGKNDNKPLSQETWSQLKGLVTQQLSGKRLFVVDAFCGANADTRLKVRFITEVAWQAHFVKNMFIRPSDEELVNFTPDFIVMNGAKCTNPQWKEQELNSENFVAFNLTERMQLIGGTWYGGEMKKGMFSIMNYLLPLKGIASMHCSANVGGEGDVAIFFGLSGTGKTTLSTDPKRKLIGDDEHGWDDDGVFNFEGGCYAKTINLSKEAEPDIYHAICRDALLENVTVLADGTVDFNDGSKTENTRVSYPIYHIENIVKPVSKAGHATKVIFLTADAFGVLPPVSCLTPEQTQYHFLSGFTAKLAGTERGVTEPTPTFSACFGAAFLSLHPTQYAEVLVKRMQASGAKAYLVNTGWNGTGKRISIKDTRAIIDAILNGDIEDADTIELPIFDLAVPTALPGVDTGILDPRNTYADKSEWDVKAKDLAQRFVDNFDKYTDTAAGAALVKAGPNL

SEQ ID NO: 10321 - protein, 231 aa, Xenorhabdus bovienii
  Peptide sequence Name=Xb4151_4152.C444.gene183.pep
  Gene classification: Function=Pirin-related protein; Function class=R General function prediction only
  Homolog annotation: Query=1..230bp; Hit=1..230bp; Blast score=357; Percent Identity=73.0; E value=7e-99; Homolog= yhhW COG1741
MIYLRKASERGHANHGWLDSWHTFSFADYYDANFMGFSALRVINEDVIDAGQGFGMHPHKNMEILTYVLSGTVEHRDSMGNQGQISAGEFQIMSAGTGIRHSEYNPHDSSKLHLYQIWIMPEKNDLPPRYEQRCFDSAKGRQLILSPDTRDDSLKVFQNMILWRWALKNGETDEYDIEKSRKIWIQVVRGEVTINGVQATTSDGIAIWDESHLQLIASQESEILLFDLPPN

SEQ ID NO: 10322 - protein, 163 aa, Xenorhabdus bovienii
  Peptide sequence Name=Xb4151_4152.C444.gene184.pep
  Gene classification: Gene name=Hcp; Function=Hemolysin-coregulated protein (uncharacterized); Function class=R General function prediction only
  Homolog annotation: Query=5..155bp; Hit=1..151bp; Blast score=150; Percent Identity=50.0; E value=4e-37; Homolog= Z0248 COG3157
MELCMSYMIYLTLNGKKQGLISAGCSTLDSIGNRYQKGHEDQIQVLSLNHAISRQQNVSHQPIQFIKPIDKSSPLLAMAIDSNESLNGGFIFYRTSQTGQLELFYEVKITEATITDISCVYPHSINDHDMMPYEKVTLNYKSISWNHITAGTSAYIPVVIEDA

SEQ ID NO: 10323 - protein, 349 aa, Xenorhabdus bovienii; identical to SEQ ID NO: 5796
  Peptide sequence Name=Xb4151_4152.C444.gene185.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 10324 - protein, 98 aa, Xenorhabdus bovienii
  Peptide sequence Name=Xb4151_4152.C444.gene186.pep
  Gene classification: Gene name=UraA; Function=Xanthine/uracil permeases; Function class=F Nucleotide transport and metabolism
  Homolog annotation: Query=1..78bp; Hit=339..416bp; Blast score=121; Percent Identity=87.0; E value=1e-28; Homolog= uraA COG2233
LRIYGVIGASGIRVLIDSKVDYSKAQNLILTSVILIIGVSGAKIQIGTAELKGMALATVVGIGLSMIFKLISVIRPEEPYITSSVESIDNDKKREAVE

SEQ ID NO: 10325 - protein, 221 aa, Xenorhabdus bovienii
  Peptide sequence Name=Xb4151_4152.C444.gene187.pep
  Gene classification: Gene name=DnaA; Function=ATPase involved in DNA replication initiation; Function class=L DNA replication, recombination and repair
  Homolog annotation: Query=1..221bp; Hit=28..248bp; Blast score=366; Percent Identity=80.0; E value=1e-101; Homolog= yfgE COG0593
LPDDEIFASFFAGENTSLLAAIKLAISQSHGSYIYFWSRDGGGKSHLLHASCAELSQQGEAVGYVPLDKRAYFVPEVLDGMEHLSLVCIDNIECIAGDQEWEMAIFNLYNRIVEIGRTCLLITGDRPPRQINLTLPDLASRLDWGQIYKLQPLSDDEKIQALQLRAKLRGFELPEDVGRFVLKRLDREMQTLFRTLDELDRASIVAQRKLTIPFVKDILDL

SEQ ID NO: 10326 - protein, 118 aa, Xenorhabdus bovienii
  Peptide sequence Name=Xb4151_4152.C444.gene188.pep
  Gene classification: Gene name=ArsC; Function=Arsenate reductase and related proteins, glutaredoxin family; Function class=P Inorganic ion transport and metabolism
  Homolog annotation: Query=4..117bp; Hit=3..116bp; Blast score=138; Percent Identity=63.0; E value=8e-34; Homolog= VC2165 COG1393
MPQVIFYHNPRCSKSRETLKLVEDLGIAPEIIHYLDTPPTVEQLTVLLKQLGFKDARQLMRTKEELYKDLNLGDDTLSQAALLQAMEKYPILIERPIVVVGDKARLGRPPEQVKEILG

SEQ ID NO: 10327 - protein, 489 aa, Xenorhabdus bovienii
  Peptide sequence Name=Xb4151_4152.C444.gene189.pep
  Gene classification: Gene name=HtpX; Function=Zn-dependent protease with chaperone function; Function class=O Posttranslational modification, protein turnover, chaperones
  Homolog annotation: Query=1..309bp; Hit=1..307bp; Blast score=369; Percent Identity=60.0; E value=1e-102; Homolog= Z3757_1 COG0501
MIKTPKKSLIVTLISLLLFGNSPALSVSSENSLPDIGTSAGATLSINQEIEMGDFFIRQIRAGAPLIDDPLLKQYINQLGHKLVNHADSVKTPFQFYLINNPAINAYAVFGGNVVLHSGLFRYSRNESELASVIAHEISHVTQRHLARFMEDTQRKTPFAWAGVLGSILLMMANPQAGMATLSGTLGGFQQGIISFTQSNEQEADRIGMQILNNSGFNPHGMPNFMQILVDQTRYSSKPPEMLLTHPLPDSRLSDARNRANQYPKKTVPESESQNFLFARVRILIISATDQLNYIEQILNNYSQGTAKEQLAAAYGRVLLLSQAQKYAEAKTVLSPLLDKQPDNIWFIDAMTDIDIEQKQYEQAITRLQQALQKHQNNPVLQINLANAYIQAKHYPQASQLLFRYTFNDPNDPTGWSLMTELAKKQKKRDKELASYAETMALQGKFDMAINYLSQASALVTLNSDDQARYDARIDQLRQLQQRHIQYDK

SEQ ID NO: 10328 - protein, 69 aa, Xenorhabdus bovienii
  Peptide sequence Name=Xb4151_4152.C444.gene190.pep
MVKKTPQKSAKNNDRNCDNHRADIRDKYRQTNKYRISTNSQNNHLRGFFTNIIDALLILISCYRLPAKP

SEQ ID NO: 10329 - protein, 157 aa, Xenorhabdus bovienii
  Peptide sequence Name=Xb4151_4152.C444.gene191.pep
  Gene classification: Gene name=Bcp; Function=Peroxiredoxin; Function class=O Posttranslational modification, protein turnover, chaperones
  Homolog annotation: Query=1..156bp; Hit=1..156bp; Blast score=257; Percent Identity=77.0; E value=3e-69; Homolog= bcp COG1225
MSRLKAGDKAPKFSLPDQDGKTVGVSDFKGQRVLVYFYPKAMTPGCTVQACGLRDKMNELKEIGVEVLGISTDTPEKLSRFVKKEMLNFTLLADIDHQVAEQFGVWGVKQFMGKTYEGIHRISFLVDPKGDIEHVFDKFKTSNHHQIVLDYLKQHSS

SEQ ID NO: 10330 - protein, 202 aa, Xenorhabdus bovienii
  Peptide sequence Name=Xb4151_4152.C444.gene192.pep
  Gene classification: Gene name=GcvR; Function=Glycine cleavage system regulatory protein; Function class=E Amino acid transport and metabolism
  Homolog annotation: Query=17..197bp; Hit=22..202bp; Blast score=233; Percent Identity=64.0; E value=1e-61; Homolog= gcvR COG2716
MFNDDTQQTSTVERKIALPKSEQHFLVITALGADRPGIVNTITRLASACGCNIEDSRLAMFGEEFTFIMLLSGSWNAITLIESTLPQKGAELELLIVMKRTRCGVQTKFPSTISVRVDVDDSPGIVERFTNLFTTQNFNIAELASKTHPAVENMPARLQIHITGHNPLDDNGLMFKESFYRLCTELNAQGSISVLDHLNKND

SEQ ID NO: 10331 - protein, 299 aa, Xenorhabdus bovienii
  Peptide sequence Name=Xb4151_4152.C444.gene193.pep
  Gene classification: Gene name=DapA; Function=Dihydrodipicolinate synthase/N-acetylneuraminate lyase; Function class=E Amino acid transport and metabolism
  Homolog annotation: Query=8..299bp; Hit=2..292bp; Blast score=437; Percent Identity=73.0; E value=1e-123; Homolog= dapA COG0329
MVSGNSGFTGSMVAMVTPMNSNGQIDKTSLKKLIDYHVASGTSSIISVGTTGECATLNQDEHVDVVLTTLELADGRIPVIAGTGANATAEAISLTRRFENTGIAGCLSVTPYYNRPSQEGLYQHYKAIADNTDLPQILYNVPSRTACDLLPSTVARLAKLENIVAIKEATGNLGRVSQIQELVNDENFILLSGDDASFLDFVQLGGKGVISVTANVAAAEMAQIYELAQKGEFVKARSLNNRLMELHHQLFVEPSPTPAKWACRKLGLIADDTLRLPMIPLTQAGQVSVNNALKLAGLL

SEQ ID NO: 10332 - protein, 348 aa, Xenorhabdus bovienii
  Peptide sequence Name=Xb4151_4152.C444.gene194.pep
  Gene classification: Gene name=NlpB; Function=Uncharacterized lipoprotein; Function class=M Cell envelope biogenesis, outer membrane
  Homolog annotation: Query=1..344bp; Hit=2..345bp; Blast score=344; Percent Identity=51.0; E value=1e-94; Homolog= nlpB COG3317
MATLLQKSKVMKVAGLSLVVLLAACSKDQHYKRQVNGDESYLETPPLKALNVPAGMILPPQNSEYNISSATEKGVVGKSLDIRPPVQAMQLLTGSHMGNNVRAGKLLIENTPEHSNLWSQVVSLLAKKNYQISEKDDTRQTLVTDWISWPRADENIPYRGRYRIEVSPQGSQIALSVTNESLEHDGKVVSDPAIIQDYDLIMLNELSDGLNQQQELASLNSTKNTGALIVNSGSDNTALPQIIVRAPYTVVWNRLPHTLESIGMRVTDRTRATGMIEVTYKELSSSGWKELGVEAPSISEGNYKLQVGDLDNRSSLQFIKEKGQPLTQAENDQMMAVFKAAFSRATDK

SEQ ID NO: 10333 - protein, 237 aa, Xenorhabdus bovienii
  Peptide sequence Name=Xb4151_4152.C444.gene195.pep
  Gene classification: Gene name=PurC; Function =Phosphoribosylaminoimidazolesuccinocarboxamide (SAICAR) synthase; Function class=F Nucleotide transport and metabolism
  Homolog annotation: Query=1..237bp; Hit=1..237bp; Blast score=413; Percent Identity=87.0; E value=1e-116; Homolog= purC COG0152
MQKKAELYRGKAKTVYSTDNPDLLVLEFRNDTSALDGERIEQFDRKGMVNNKFNHFIMNKLEEAGIPTQMERLLSDNECLVKKLDMVPVECVIRNRAAGSLVKRLGVEEGMVLNPPLFDLFLKNDAKHDPMVNESYCETFGWVSKVHLAEMKQLSYKANEVLSKLFNDAGLILVDFKLEFGLFNGNVVLGDEFSPDGSRLWDQQTLDKMDKDRFRQSLGGLIEAYEEVARRIGVILD

SEQ ID NO: 10334 - protein, 115 aa, Xenorhabdus bovienii
  Peptide sequence Name=Xb4151_4152.C444.gene196.pep
MFSVTLTGCTTQWVPVGSHYTPFNEANSECNIEAFQQFPVRNEVAQRSSIKTVKHYCPACCKSDKADKSDKDCYFDQSVPTTESYVMDVNERSRHQLYSSCMERNGWEKQTKYLF

SEQ ID NO: 10335 - protein, 126 aa, Xenorhabdus bovienii
  Peptide sequence Name=Xb4151_4152.C444.gene197.pep
  Homolog annotation: Query=1..120bp; Hit=101..223bp; Blast score=103; Percent Identity=44.0; E value=7e-22; Homolog= gi|21228333|ref|NP _634255.1| Transposase [Methanosarcina mazei Goe1] gi|20906799|gb|AAM31927.1| Transposase [Methanosarcina
LPLAIAVAPANIHDIRLVIATLDGLQTGRRGYGTKLHLDKAYEAEWLEKELKTRGYVPCIQSRKEEQDALAEQYDFKVNRWVVERTHSWLNRFRRILVRWEKRVENYEAMLHLACSLIVWNIILLG

SEQ ID NO: 10336 - protein, 135 aa, Xenorhabdus bovienii; identical to SEQ ID NO: 6015
  Peptide sequence Name=Xb4151_4152.C444.gene198.pep
  Gene classification: Function=Predicted transposase; Function class=L DNA replication, recombination and repair
  Homolog annotation: Query=11..88bp; Hit=11..83bp; Blast score=58; Percent Identity=39.0; E value=2e-09; Homolog= sll1791 COG3293

SEQ ID NO: 10337 - protein, 210 aa, Xenorhabdus bovienii
  Peptide sequence Name=Xb4151_4152.C444.gene199.pep
VRRKNWDGKYAFLIRNPGLTNQTVKEGDYWAQAGVEVGTRFNYLSDIEHHASSGNVISWVALPNDLDGNDWEVLTRVSEPSDIASYWALMSVTPSEIIPGKKWGDNNARTGTLSYPDYSLDGIFWTLDDKTNDGVLSLRFLYRNKEDALQKATSKKLTITVSGVVYHLGYYSALTEFYEPQYRGTEAKKIGELLMQKNHPLKIEAKWYNY

SEQ ID NO: 10338 - protein, 121 aa, Xenorhabdus bovienii
  Peptide sequence Name=Xb4151_4152.C444.gene200.pep
  Homolog annotation: Query=33..116bp; Hit=390..471bp; Blast score=89; Percent Identity=54.0; E value=8e-18; Homolog= gi|37526851|ref|NP _930195.1| hypothetical protein [Photorhabdus luminescens subsp. laumondii TTO1] gi|36786283|emb|CAE15335.
MKYYKSTDNKVYAYESDGSQDSWIKPGLVPITEAEADAITNSPPTPEQLQQNAEYEKRYRMSKAANSIAPLQYAVDLKMETDSERAALTEWKKYMVLLNRVDCSTAPDVKWPEQPKSLLRE

SEQ ID NO: 10339 - protein, 385 aa, Xenorhabdus bovienii
  Peptide sequence Name=Xb4151_4152.C444.gene201.pep
  Homolog annotation: Query=1..132bp; Hit=1..171bp; Blast score=117; Percent Identity=38.0; E value=5e-25; Homolog= gi|9633540|ref|NP _050653.1| tail fiber [Enterobacteria phage Mu] gi|9910938|sp|Q9T1V0|VPS_BPMU Tail fiber protein (gpS) gi|601
MFGLDNPSGINVMPAITPTNNSVPLWFTEGGAGLSASYPGQEWFNQIQAELLGVLKEAGITPDKSKLNQLAVAIKSIVANGITLTDRTGNSSKMAASQKLVTEVNENANSRMEKNQNGADIPNKPEFVKNIGALPTTGGVLTGKLFVSGVSADIEAKGWVGATKLYDRFDHGGWSRAYSEAFPPSAAVVGAYSMKEANDRYALKKSHETFSCGGVDVEATHDWAGLKLKNANGYYVQFSATPHENPVMLTVYYRDGANKTQYYASLRKKSGEIALLSDVADNASIGINQSWRDVRSQRTGGRQYTNTAGRPIAVFVNTKKREKYNVALGIGASVNGVEVAYNWSGYDGPLSILSVFFIVPVGANYEVDAYLASEGNFIESWSELR

SEQ ID NO: 10340 - protein, 193 aa, Xenorhabdus bovienii
  Peptide sequence Name=Xb4151_4152.C444.gene202.pep
  Gene classification: Function=Uncharacterized BCR; Function class=S Function unknown
  Homolog annotation: Query=39..193bp; Hit=7..164bp; Blast score=110; Percent Identity=38.0; E value=1e-24; Homolog= HI1521 COG3778
MAMTAKDYQRSGLQLLPNGLAWSKNLDSNLAKLMLATGEEFARVDAINAVLLEEIFADRAFVLLDDWEDFVGLPDCSIDKESSINSRRQAVKTKLIMSGSLCNQFYERLAADRGYRIRLEEHYPHHCLRDCHYPIYPDINWFRVFVHVADRITHFATVLDHCQQRLRIADAADLECLLARYAPAETEFVFIYE

SEQ ID NO: 10341 - protein, 357 aa, Xenorhabdus bovienii
  Peptide sequence Name=Xb4151_4152.C444.gene203.pep
  Gene classification: Gene name=XkdT; Function=Uncharacterized homolog of phage Mu protein gp47; Function class=S Function unknown
  Homolog annotation: Query=1..356bp; Hit=1..354bp; Blast score=291; Percent Identity=42.0; E value=1e-78; Homolog= HI1520 COG3299
MPYKAPALSTLIARNQADIESRLPGTYARTAFRTTRAIAYANAGNAAGLHDHLAWTSRQVVPHLADDDKLLEHCEFWGVWRKAATNASGILTVTVSADTLIPEGTRWQRPDGVVLESIDDVQAIAGDNPVSVTAIEAGRKGNTAEGVPLELISPVVNVQTQARCRYLGGGAEQESMDSLRSRLLFRVQYPPSGGNQYDYERWALEVPGVTRAWCIPRYRGHGTVGVMFVMDEEPDIFPGTADLNRIKDYLTGHINPVTNQVEGKTTGAELIVMSPAAKVTNFAIRLSPNTEEVRDAVKTHLKIYLENLRPGGLAFLSEIRAAISNAPGEIDNTVFSPTGDIHAAENEIFVLGDITWR

SEQ ID NO: 10342 - protein, 149 aa, Xenorhabdus bovienii
  Peptide sequence Name=Xb4151_4152.C444.gene204.pep
  Homolog annotation: Query=4..142bp; Hit=1..138bp; Blast score=139; Percent Identity=56.0; E value=9e-33; Homolog= gi|15834240|ref|NP _313013.1| hypothetical protein [Escherichia coli O157:H7] gi|25332952|pir||B91252 hypothetical protein ECs4
MNAMNDIALQWQINGADIVINNADIALDDSLSTAVIISLFTDRRALDSDELPTGSGTDRRGWWGDSFNSRPIGSRLWLLAREKQLSAVLHRAKAYADEALAWLVDERHVRKIDVMATAPASGVLLLTVSVTLFDGSVLPLPFKTLLSRI

SEQ ID NO: 10343 - protein, 181 aa, Xenorhabdus bovienii
  Peptide sequence Name=Xb4151_4152.C444.gene205.pep
  Homolog annotation: Query=6..174bp; Hit=5..178bp; Blast score=176; Percent Identity=54.0; E value=1e-43; Homolog= gi|16273418|ref|NP _439667.1| hypothetical protein [Haemophilus influenzae Rd] gi|1175877|sp|P44238|VG45_HAEIN Mu-like prophage
MIAQFNKFTASLSRRIRLLVSRGVVNFVNDTLKQQNIQVSLLAEETADDVERFQNYGQTSVPPAGSEAIVLSVGGVRQHLVAIAVDNRRFRLGNLKSGDSAVYHLEGHHLLLTENGVVRIQCKRLEVVAEEGVVFDTPQTRFTGNVDIVGISQAQDHMSGQTSGKDHIHHEHDGYSTSPPR

SEQ ID NO: 10344 - protein, 362 aa, Xenorhabdus bovienii
  Peptide sequence Name=Xb4151_4152.C444.gene206.pep
  Homolog annotation: Query=1..351bp; Hit=1..345bp; Blast score=289; Percent Identity=47.0; E value=4e-77; Homolog= gi|15834238|ref|NP _313011.1| putative tail protein [Escherichia coli O157:H7] gi|25302035|pir||H91251 probable tail protein [i
MANTIELILGNNIYSGWKTLNVTRSLEEMSGQFSLGITVRNNDSPLVLKPGHACQLAINGQRVVTGYIDAVEVGINADERTITLSGRDKTGDLVDCAAIHGRGQWRNVSLETIAKDLCKPFGVTVRWQVKDAAAATVFRQWQIEPGETVFDNLSRAARHRGAIVTSNAAGELVFATAGSQSVATLVLGNAPPTGVKIKTLDTALSWQERFSLYRVKGASAAGGRWGETQTPVQSTAIYMDARDPAITRYRPTLFLADDNMTKAKGTARAAWEQKRAMAHSTTASVGIRGWFKPGGQLWQINDMVRLQAPQAGFPDEPLLIVSVNYLLDNDNGTITRLELMPRDGFTEAAEPEQKVRDIRWKP

SEQ ID NO: 10345 - protein, 92 aa, Xenorhabdus bovienii
  Peptide sequence Name=Xb4151_4152.C444.gene207.pep
MPLRRINRLICATLPVSRYNATNAGSVPTTRIGRAVGKGRKSSSIKTARLKCIFTGTAMTTRMTALPAGYVSRRAGTATAMALWPSPASGRK

SEQ ID NO: 10346 - protein, 242 aa, Xenorhabdus bovienii
  Peptide sequence Name=Xb4151_4152.C444.gene208.pep
  Gene classification: Gene name=VgrG; Function=Uncharacterized BCR; Function class=S Function unknown
  Homolog annotation: Query=1..242bp; Hit=430..676bp; Blast score=191; Percent Identity=42.0; E value=6e-49; Homolog= VCA0018 COG3501
MAIPRIGQEVIISYLNGDIDRPIVTGCVYNGLNRPPLDLPAQKTHTTFKTKTHKGKGFNELRFEDAKGSEEIYFHGQKDFTAHIENDAYWHIKHNQKSRIDSNRYHDIRADDHHQVAGSRKITTEGDVSHRIAGSQHIQTGDATVFDSGQEIHLKSGGKVVLEAASEITLKVGGTFLKVTPGGILCSPINVGQGSGGSGRGLALQLPEGVAPLPMVEFPAHPYCPLLAQQDVSPVIKPAKKE

SEQ ID NO: 10347 - protein, 263 aa, Xenorhabdus bovienii
  Peptide sequence Name=Xb4151_4152.C444.gene209.pep
  Homolog annotation: Query=12..259bp; Hit=2..249bp; Blast score=265; Percent Identity=54.0; E value=5e-70; Homolog= Pa|Phot2-44g08.q1ka _g181| 129578 - 130327 1542 249 aa, chain -
MTEEMMTETATSWQAWLNKSNDASVFFILNSLAQPNPVDQFYHNDWVEQAFPLYSGTPMHKMLKQSPWLVQAKSSRLYQIGEMLERHALSDNSWGWAYRSHIPWQEQLTHWQHRQLVMMNGEQVLFRIMDARVFSAMIPAFTPGDWSLMLSPVTELMIDTPQPVPFCRPKDCGEGNPEIPFTLGEHLLGVWLCSPYGLKVLTSSLYCDLWEKHGAMAKQWDQPAGSLEPRIEQWLKQKLEAGQRLEKVSGQDYLLALEQEKAR

SEQ ID NO: 10348 - protein, 76 aa, Xenorhabdus bovienii
  Peptide sequence Name=Xb4151_4152.C444.gene210.pep
MSNENSIYTHDCQKILKNDLYIKIIEDSTNTPIPNTPYTLNSKMVHSGISDGQGIDLAEGLTSTPFTVKIEPPQSV

SEQ ID NO: 10349 - protein, 399 aa, Xenorhabdus bovienii
  Peptide sequence Name=Xb4151_4152.C444.gene211.pep
MIEILKKHKYDDLALHQSTQPVAACDCHFEEKDGKQIKVIDVPILTCECVWRRYQKEAEDIVAPGGKLIADPKERNKRINAAYAKLWLNDNRFQWAGLAAFASKQVGCGLLHASEMAKKNQAHQDANRRVRQSAKELEHTMDNPLYFLHPKLKAQGEIAIEDFPRAIEEAREASRNNKLSIFSNVPGLQPISGLAQYSFNYVYDMMALGNTTLFLDVYPLHAFYKQRGLEELKTCIKKRENIYGNSQFPILWPIGQEKFTFGRFYPDILFAFEAIEAGDIAQGVVHLANHEQINILQPTMYSDTRLVTFLFGNQISFVTGLPSGVAESVELTLASQCRRVDDGRTIEFSDEALADLSDIKQRMPFVYKAAERFDEMLHDSNRSLLEESLQNIAAGRGVE

SEQ ID NO: 10350 - protein, 204 aa, Xenorhabdus bovienii
  Peptide sequence Name=Xb4151_4152.C444.gene212.pep
MSLLQQISRQRGGLIFILLIVFGLASAYLYHSFYSDKPEIALVIGEPYEDMRQRSSADIDPHLPGKIWHNIPKTDARLRFIDPKYGFVTPPARFFTVLYANDIITSVRMSPQIEPLPYDDAIKMVLDLQDQWRKTGWVMAKGYKPLVNTPELHENLRRMKGGAGTTYWQAADQYQIMLSLAFFKDDKHPNDERYLITMVIYKPW

SEQ ID NO: 10351 - protein, 61 aa, Xenorhabdus bovienii
  Peptide sequence Name=Xb4151_4152.C444.gene213.pep
MSLLQRIGRRRSGLIFALLIVLGLASVYLYHSFSDKPEIALVIGEPYEAMWQRSSANIAPK

SEQ ID NO: 10352 - protein, 98 aa, Xenorhabdus bovienii
  Peptide sequence Name=Xb4151_4152.C444.gene214.pep
MSPQIKPLLYNNAIKIVLDLQDQWRKAGWKLTKGYHSLVNTPELHDSLRKMKGTGMTFWQAGDKYQIMLNIARFKDDRHPDEERYLITLAIATPWVNQ

SEQ ID NO: 10353 - protein, 38 aa, Xenorhabdus bovienii
  Peptide sequence Name=Xb4151_4152.C444.gene215.pep
MKYIINMLFTPLFRENMCSGIEITNRNDYVSSILRVTG

SEQ ID NO: 10354 - protein, 316 aa, Xenorhabdus bovienii
  Peptide sequence Name=Xb4151_4152.C444.gene216.pep
  Homolog annotation: Query=1..316bp; Hit=74..384bp; Blast score=244; Percent Identity=41.0; E value=1e-63; Homolog= gi|15801311|ref|NP _287328.1| unknown protein encoded by prophage CP-933C [Escherichia coli O157:H7 EDL933] gi|25372197|pir||H
MPIDEIGQSSNPKEIANSAYSLFNGVGKIQGKREGGNRAVIRWKIAALSTGEEDLETFLIKGGITPKAGQLVRLLSVPFIDTECFNGYEDGDSHARAIKRESKRYCGAAGRAWVQWLSVNQEQVIEVTARKEKEWLDGLPEEASAQVKRVAVRFALLDAAGELAIHITGWSKEASHAAIKQSFDDWLADFGIGNREKYQVITRTRDFIQKYGLSRFQPYTYGRPNGDIDTSHSMRISDLAGYLVHNRRNDGQTEYHIIPSVFEAEILQGLQKKSGFEALEEAGMLVKAEKDRFISKTISVNGTQGRFVVLIFRDED

SEQ ID NO: 10355 - protein, 598 aa, Xenorhabdus bovienii
  Peptide sequence Name=Xb4151_4152.C444.gene217.pep
  Homolog annotation: Query=Organism:..Escherichiabp; Hit=coli..O157bp; Blast score=; Percent Identity=; E value=; Homolog= Pa|Phot5 -451c10.q1k_g195| 149072 - 151501 2582 809 aa, chain -
MADTQHNQTRPKFTSLDKSSSQKPFEFIQTVKQSAMYHWENLLPACGIDIPAKGKHSACPVCGGTDRFHFIDDHHHGNWHCRQCDLPNYGDGLDLVAKTNRISVLEAAKIVANVLALPLSELKPAKETTYPVQPIAERVAALMAQTVAGQSPYLTAKGLHCPNQRLLSDNSAVLRLATLDEKVTGAQIIKPDGEKKLLSGSQKKGSFIALSELKDNPDTVTITEGYATALTVNQFYKGTILAALDAGNLLSVAKAVRERWPDTKIILAADNDWHHPDELDKNGNPKVNIGKISAEKVALAVNGWVTLPSTEYKADWDDYRQQHGIESAKQTFSNGLYQVVENVAVSKSVTANSDEYREKEYDPLKPHIDIRKNGIYWVEPKEQGGKIVEVEKWLSDYMEIVGIGNDGSEGYLIIKLHQEGTGKCIIEALPRREIGMPVGWARLRSRGMNITVKNSLLPVLAEHLQRSGDRREWIVTQKAGWHCGAYVMPDGEIIGQPYMPVAFSGGTSAIAGYVVRGTAEDWKMHVASLLKGNRSMMLGVLVGLSAPLNSLTGGSCFGVHSFAQSSAGKTTTVEAASSLYGDPEELKLSWHGTNHGFK

SEQ ID NO: 10356 - protein, 113 aa, Xenorhabdus bovienii
  Peptide sequence Name=Xb4151_4152.C444.gene218.pep
  Homolog annotation: Query=23..107bp; Hit=149..233bp; Blast score=91; Percent Identity=56.0; E value=3e-18; Homolog= gi|24112534|ref|NP _707044.1| orf, conserved hypothetical protein [Shigella flexneri 2a str. 301] gi|24051427|gb|AAN42751.1|A
MYLPFDKNTKTKGSTCLPSTCFFQGLDSIHLDCNSLRTMRLIHAAKDSSPSCAWAISMSARSSGSSLNWNGGLPRRVFLCVDMSITLTVMCLCVITHYLYQYEKTTPSVLEHI

SEQ ID NO: 10357 - protein, 69 aa, Xenorhabdus bovienii
  Peptide sequence Name=Xb4151_4152.C444.gene219.pep
  Gene classification: Gene name=AlpA; Function=Predicted transcriptional regulator; Function class=K Transcription
  Homolog annotation: Query=11..67bp; Hit=8..64bp; Blast score=79; Percent Identity=64.0; E value=8e-16; Homolog= Z3946 COG3311
MPTITTSKKSLIRLPEVQRRTGYSKAWIYRLIKEDKFPKQVKIGPRSVAFVESEIDGWVDQRIAESRGI

SEQ ID NO: 10358 - protein, 116 aa, Xenorhabdus bovienii
  Peptide sequence Name=Xb4151_4152.C444.gene220.pep
MPPTTQLVLSGTVYPSKVSLALATIGDVAIHPGVGRTPFIDATIFDGKVWRALDLNGFGFSKNSRNFDRPQNIGSIMREIQIKIISCKGSSVYYDYPIGSKKRKYIYQGMTFPSFT

SEQ ID NO: 10359 - protein, 757 aa, Xenorhabdus bovienii
  Peptide sequence Name=Xb4151_4152.C444.gene221.pep
  Homolog annotation: Query=2..731bp; Hit=20..755bp; Blast score=436; Percent Identity=37.0; E value=1e-121; Homolog= gi|15612135|ref|NP _223787.1| putative [Helicobacter pylori J99] gi|7464942|pir||D71853 hypothetical protein jhp1070 - Helico
MIGEIQINSPLATYQNPARLSDLRRINYIFGANGTGKTTISRVIAQAHDHEHCQLQWQGGIELERMVYNRDFVDRNFNQDDPLQGVFTLGENQIEAERKIARLQTKIAKVNEQISSLNIQLDGSEEQPGKRKGLEDLEPTLRDKCWKQKELHDADFKEAYSAASVRRNKERFKEKVLSEANSNTAELLSLEELKQKAETVFSSNIERVTPLGNLLADDLVIVEGHVLLQKVIVGNQDIEIAALINRLGNSDWVKQGRKYHEQNPEICPFCQQPTDDHFSNKLTAFFSEAYDNDIQLLKELQANYQKASDRLTAAIQRNVEINNPFLNIDLFNAETQALVERLKVNQSKLVNKLDEPSRKMELESVQPLITQLQALVIEANEATTRHNQTMANIATEKQTLTSQVWRYVLNELADDLQLYHQTKDRLTRTIQGMEKSRREEKIQLRGLQNQVKELEKQTTSIQPTISAINDLLQKFGFHSFSIAEADEDYHYRIIRANGEDVGRSLSEGEKTFITFLYFYYLIKGAQSPSGITTNRVVVFDDPISSLDSDILYIVSSLMKSVMDEARNQSSSIKQIFILTHNVYFHKEISFNRSRPAGGVLNEESFWLVKKLQHGSVVERYETNPIRSAYELLWENVKSKNISSISLQNTLRRILENYFTMWGGMSKDEICTLFEGRDKLICQSLFSWVNDGSHSIHDDLYINHGEQTNEAYLRVFRSIFGKAGQIGHYSMMTGATIEELHDHSGAEDVAVGSELGAT

SEQ ID NO: 10360 - protein, 93 aa, Xenorhabdus bovienii
  Peptide sequence Name=Xb4151_4152.C444.gene222.pep
  Gene classification: Gene name=XerC; Function=Integrase; Function class=L DNA replication, recombination and repair
  Homolog annotation: Query=3..89bp; Hit=328..414bp; Blast score=133; Percent Identity=67.0; E value=4e-32; Homolog= Z4313 COG0582
MTRGMGYDTKTDVCGHGFRTMARGAMGESGLWNDDAIERQLSHVERKNVRAAYIHTSKHLDERRLMVQWWADYLDTNREKHITPYDFAKKRRK

SEQ ID NO: 10361 - protein, 98 aa, Xenorhabdus bovienii
  Peptide sequence Name=Xb4151_4152.C444.gene223.pep
LFGTHVRKHRFWCRIPCHGSCIKWLVAVICFRLFKDEVWPKLMSIAVIATNQNRSKDMGKEMADILVIAVIAAVRSFSWRIPIRPANPALKNRLSISR

SEQ ID NO: 10362 - protein, 92 aa, Xenorhabdus bovienii; identical to SEQ ID NO: 6203
  Peptide sequence Name=Xb4151_4152.C444.gene224.pep

SEQ ID NO: 10363 - protein, 300 aa, Xenorhabdus bovienii
  Peptide sequence Name=Xb4151_4152.C444.gene225.pep
  Gene classification: Gene name=Tsx; Function=Nucleoside-binding outer membrane protein; Function class=M Cell envelope biogenesis, outer membrane
  Homolog annotation: Query=82..299bp; Hit=47..278bp; Blast score=98; Percent Identity=31.0; E value=7e-21; Homolog= PA0165 COG3248
MDYYMLFSLNKHKIENRLQFCQKRSQYFLLFNVLYRVQSIYHTLKSIVSNQINLSLIPLLIFTNHAQASDFVNFQSIDTSLYLQFENKVAPQKTISPIIEAYGDYKIGDMYVYSIWQNSLQHDYQDDKSTYYYKFVPRLSASKITGYDLSYGPLKDVLFAQWIAKTKNVKYDYFPGISLDWQVPGFSWLRTLFYFENNAKGNWNDQRIHIDYAIPFNNQLGDFRIVGTLDYTLGLHDNPEMLEFKPELHYDLGKKLGYQSGHLWTGLVLNTTKNKYKIKDTPYYRTNQFSYGVFIRYSFF

SEQ ID NO: 10364 - protein, 425 aa, Xenorhabdus bovienii
  Peptide sequence Name=Xb4151_4152.C444.gene226.pep
  Homolog annotation: Query=1..421bp; Hit=1..420bp; Blast score=534; Percent Identity=71.0; E value=1e-150; Homolog= Pa|Phot5-469b05.q1k _g9| 5623 - 6897 439 424 aa, chain +
MSIQHDKFGRTYQWFLLVLLGMVYFLSTATTFTSLGVVLPSMINELGWNWTNAGLGFSLLGLTCGLSSFLPTLFIRKIGVRFTLFIGLLIFLAGFYHLYNTHVILSYFIGTALLGIGFTFLATVPGTYVISRLYEKQSLAFGFYFTIGGLGGVIGPWIYFLATRVWGTWRMHWMISAIVLTVFVLLTIFILQEGKREVAHAKAVNQKHNSQNPLKIYRTKQRWTARRALRTWQFYAIAATYTAFLWCGITVNSFAVAHIIENGFSEAIAAGLLSSMAFINAFSRLAGGAVGEWLDPKKLLIGSLTVIIIGLISLSIASSWPFLIGFTLFVGMGYGMTFLASSVLLANYFGRKPYLELFSVMNLISTLACLAPFFAGAVKDYSGSFTSAFLIIAIPVCVVLVVTLMMKPPAQKMKKRLVDNSPFTE

SEQ ID NO: 10365 - protein, 351 aa, Xenorhabdus bovienii
  Peptide sequence Name=Xb4151_4152.C444.gene227.pep
  Gene classification: Function=Coenzyme F420-dependent N5,N10 -methylene tetrahydromethanopterin reductase and related flavin -dependent oxidoreductases; Function class=C Energy production and conversion
  Homolog annotation: Query=4..350bp; Hit=10..354bp; Blast score=438; Percent Identity=59.0; E value=1e-123; Homolog= CC1169 COG2141
MSKKEFGVFLPIAKGGWIISKNTPPLDASYQQNREAAILADQIGLDFIMSMGKWRGFGGETDHWGSSLESVTMMAGIAEVTHRAKLIATVHAGLHNPAVTAKMIATLDHISQGRAGLNIVSGSFKDEFEQMGEWDGSLDHDQRYAMTEEWTQLVKRLWREKHVDHEGTYFHLKQCVSEPKPLSLPRPYLVCAGQSERGLHFSVRHTDVCFIGGKDEAETRKISLTAKRIASDCNTTTKTFCMCTVICAETDAYAETLAQFYRQGLDVEAVRNMMHSFGVDVDGKNNAMVERSQNAFMTHTAIGTPDTCYKQLSDLLHSCELDGLMLIFPDYIKGLKVFGDQILPKLRAEFG

SEQ ID NO: 10366 - protein, 810 aa, Xenorhabdus bovienii
  Peptide sequence Name=Xb4151_4152.C444.gene228.pep
  Gene classification: Function=Uncharacterized membrane protein; Function class=S Function unknown
  Homolog annotation: Query=1..807bp; Hit=1..801bp; Blast score=872; Percent Identity=59.0; E value=0; Homolog= ZybbP COG3127
MIWRWFWREWRTPSLLIVWLSLTLAVACVLALGSISDRIDQSVHYQSRDFLAGDLVLQASYPVDESWLKQAQERGLTLSRQISFSTMTYAGDVPQLAQVKAADEHYPLYGELETHPQGLKPEKGSVLVAPRLLVLLGIKVGDSLDVGDAVLKIRGELLQEPDSGFNPFQLSPRILINIEDAKATGAIQPGSRLTYRYMFSGSPESIQSFQQWIDPQLKADQRWLTLKQDSGALAQSIDRAQQFLLLSALLTLLLAAAAVAVSMTHYCRSRHNLIAILKTLGAGRWALRQWIVGQWLVILLAAIVVGSILGLIFESALIRVLAAMLPKTLPEAGMWPWMWAIGSLLGIALLVGIRPYRQLMATQPSRVLRSDITAAIWPLRYYLPTVALIMTGGLVLLAGTKPLLWSLLAGVPVVALLLAILGWGGLWLLRRMKFRQLSLRLAVNRLLCRPFQTMTQLAAFSLSFMLLALLVMARGDLLSRWQQQLPPDSPNYFLINMTQAQIPPVNDLLAKYQVKPTEFYPVVLARLTEVNGQSAIEWADERHPKSTTVRRELNLTWKAELPPFNTLVEGTWPPKPKEVSIEQGVAEQLQINVGDKLTFTGNTQTFQVSVSSIRKVDWESLHPNFFFIFSKETLDNQPQTWLTSFHYEGDGRLLTEINRHFPTISMLDIGTMLKQIQGILQQISQALEIMVVLVMICGALLLLAQIQVGMSQRQLELVVYRTLGASKKLLRRTLWSEFALLGFMAGLAAALGAEVALWLLQTKVFEFPWQPQWQMWFLLPIISSLLLSLCGSWLGIRLLRGKGLHRRLPE

SEQ ID NO: 10367 - protein, 228 aa, Xenorhabdus bovienii
  Peptide sequence Name=Xb4151_4152.C444.gene229.pep
  Gene classification: Gene name=PhnL; Function=ABC-type transport systems, involved in lipoprotein release, ATPase components; Function class=R General function prediction only
  Homolog annotation: Query=1..227bp; Hit=1..227bp; Blast score=311; Percent Identity=74.0; E value=2e-85; Homolog= ybbA COG1136
MAVESILEVHHLTKHVGQGEQVINILQGVELVVEPAQTIALIGESGSGKSTLLGIIAGLDDGSGGEVHLLGQNISRMNEEQRAQLRAKNVGFVFQSFMLIPTLNALENVQLPALLRGESENQSRQNAIELLKQLGLGQRLKHMPAQLSGGEQQRVALARAFSTRPKILFADEPTGNLDRQTGDRIADLLFSLNHDYATTLILVTHDSRLAARCQRRLRLVDGTLQEEV

SEQ ID NO: 10368 - protein, 215 aa, Xenorhabdus bovienii
  Peptide sequence Name=Xb4151_4152.C444.gene230.pep
  Gene classification: Gene name=TesA; Function=Lysophospholipase L1 and related esterases; Function class=E Amino acid transport and metabolism
  Homolog annotation: Query=5..212bp; Hit=1..204bp; Blast score=252; Percent Identity=60.0; E value=3e-67; Homolog= tesA COG2755
MFSEMMNFKNTFYSHVCFLLLLVLCSARAAAADTLLILGDSLSAGYRLPVEQSWPTLMAKEWHQSGNKTAIVNGSISGNTTAQSLERLPELLKQHNPKWVLVELGGNDGLRGFSVQQIEQDLQKIITLIKQADAQPLLMQIRISPNYGKRYTQSFTKIYPSLSERNQIPLLPFFMEHVAIKPEWIQDDGLHPNQFAQPFITHWMSNQLSAYIPFK

SEQ ID NO: 10369 - protein, 258 aa, Xenorhabdus bovienii
  Peptide sequence Name=Xb4151_4152.C444.gene231.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=1..255bp; Hit=14..268bp; Blast score=330; Percent Identity=63.0; E value=8e-91; Homolog= ybbO COG1028
MQKAVLITGCSSGIGLVAAKILHQRGYRVFAACRKSADLAHMRELGLEPIELDLDDKESVERAAEQVIQLTHGRLFGLFNNGGFGVYGPLESVSRELMEKQFSTNVFGTHQLTSLLLPAIRAYGKGRIVQTSSVLGLISTPGRGAYAASKFALEAWSDALRIELADTGIKVSLIEPGPITTRFTENVNQTQRDHPVENPGLADRFRLTPEDVVTKLIHALEAPNPKIRYPVTLLSHAMTILRRILPTRLIDKIVKWQS

SEQ ID NO: 10370 - protein, 292 aa, Xenorhabdus bovienii
  Peptide sequence Name=Xb4151_4152.C444.gene232.pep
  Gene classification: Function=Thioredoxin domain-containing protein; Function class=O Posttranslational modification, protein turnover, chaperones
  Homolog annotation: Query=3..292bp; Hit=6..296bp; Blast score=258; Percent Identity=50.0; E value=6e-69; Homolog= ZybbN COG3118
MESITNTNSHTAHIIHINESNIASMIQHSLTQLVVFYFWSPQNLHCHELEETLDKLAHEYAGQFALAKVDCDQLPNVAAQFGIRTAPTVIFVQEARPVHGFEGIQTDETIREMFSQFLTQQKKSLLEQANERLAEGKNQEALPLLKEAHQAEPKETEITLLLAQVYISLNHLEDAQNILDTLPLEEQDQRYNDLLAILESQKQAANSPEIQQLQQALEIQPENAELAVQLAAKLHNVGRNEEALELLFSFLKKDLSAADGAVKKTLMDIISALETGDTLASQYRRHVYSLLY

SEQ ID NO: 10371 - protein, 309 aa, Xenorhabdus bovienii
  Peptide sequence Name=Xb4151_4152.C444.gene233.pep
  Gene classification: Gene name=HflC; Function=Membrane protease subunits, stomatin/prohibitin homologs; Function class=O Posttranslational modification, protein turnover, chaperones
  Homolog annotation: Query=9..306bp; Hit=5..302bp; Blast score=452; Percent Identity=81.0; E value=1e-127; Homolog= ybbK COG0330
MDLLSFGTVPILIIIAVVIVFTCVKTVPQGYQWTVERFGRYTRTLTPGLHIIMPFVDRIGRRINVMEQVLDIPSQEVISRDNANVTIDAVCFIQVVDPVRAAYEVSNLELAIINLTMTNFRTVLGAMELDEMLSQRDLINSRLLTIVDEATNPWGVKITRIEIRDVRPPKELVSAMNAQMKAERTKRADILEAEGIRQAAILKAEGEKQSQILKAEGERQSAFLQAEARERAAEAEARATKMVSDAISDGNIQAINYFVAQKYTDALTRIGAADNSKVIMMPLEASNLMGAIGGIAELIGESKKSKQDK

SEQ ID NO: 10372 - protein, 153 aa, Xenorhabdus bovienii
  Peptide sequence Name=Xb4151_4152.C444.gene234.pep
  Gene classification: Function=Membrane protein implicated in regulation of membrane protease activity; Function class=N Cell motility and secretion
  Homolog annotation: Query=1..149bp; Hit=1..150bp; Blast score=116; Percent Identity=50.0; E value=1e-26; Homolog= ZybbJ COG1585
MIEQIATLPVWFWLCFGGLLLIAELLGTGGYLLWTGTAAVVVALITWVFPEMSWELQGILFAVLTLLSAIAWRSWLRYRPRKNNDETLNQKNQQLIGLHARLTSATENGYGRVKLADGSWRVHCDRELPANTEVEVIAVDGITLKVKPVANQP

SEQ ID NO: 10373 - protein, 134 aa, Xenorhabdus bovienii
  Peptide sequence Name=Xb4151_4152.C444.gene235.pep
  Gene classification: Gene name=SoxR; Function=Predicted transcriptional regulators; Function class=K Transcription
  Homolog annotation: Query=1..132bp; Hit=1..132bp; Blast score=177; Percent Identity=66.0; E value=2e-45; Homolog= ybbI COG0789
MNISEIAQKTGLTSKAIRFYEEKDLITAPDRGDNGYRYYQHKHIDELTLLRQAKEVGFTLEECRELLRLFHNPRRHSADVKTATLQKVAEIENTMVKLQKIREKLLALAAECPGDDGADCPIIEQLSSCCTHHG

SEQ ID NO: 10374 - protein, 915 aa, Xenorhabdus bovienii
  Peptide sequence Name=Xb4151_4152.C444.gene236.pep
  Gene classification: Gene name=ZntA; Function=Cation transport ATPases; Function class=P Inorganic ion transport and metabolism
  Homolog annotation: Query=71..914bp; Hit=5..833bp; Blast score=1082; Percent Identity=70.0; E value=0; Homolog= ZybaR COG2217
MSTTTILTLQGLTCMHCVGSVKKALENVSGVEQTDVTLDYAKVIGNVSSTVLITAITDAGYEAVVATQPDIELQLSGLSCMKCAGKTQKALESVEGVIAAKVDTQTAKIYGKVESNALIKAVEQAGYHAELAAGTRFPKTEPLTISAPQTPEFLAAAENATPVRNPENTVSHDTPDNDNDSIQLLLDGMTCASCVSKVQKALQSVDGVENARVNLAERSALVTGAVSPNALVDAVIKAGYGAEVIQDETERRERQQQVAQANMRRFRWQSAFALAVGVPVMVWGMLGDNMVLTPSNHAIWLTIGLVTLAVMVFAGGHFYRNAWQSLKNGSATMDTLVALGTGVAWLYSISVNLWPEIFPSQARHLYYEASAMIIGLINLGHALEQRARQRSSKALERLLDLTPPTARVITEKGEKTLPLADVKPNMILRLTTGDRVPVDGEIIQGTVWLDEAMLTGEPIPQQKSTGDGIHAGTVVQDGTVLFRAAAVGSQTTLARIIKLVRQAQSSKPEIGQLADKISSIFVPVVIAIALVAGAIWYFIGPAPQLMYSLVIITTVLIIACPCALGLATPMSIISGVGRAAELGVLVRDADALQQASQLDTLVFDKTGTLTEGMPQVTEISTFNGFTEEQVLLWAGALESGSNHPLAKAIALKVAGQKLPEVQQFRTLAGLGIRGVVGDTTLLLGNQSLLEQNQIETAELKTLMATQAEKGITPVILAADGKIAALFSIRDPLRQDTLSALQRLHHQGYRLVMLTGDNPVTANAIAKEAGIDQVIAGVLPDGKAAAIQTLQSEGRKVAMIGDGINDAPALAQADVSIAMGGGSDIAIETAAITLMRHSLNGVADAVALSRGTLRNMKQNLFGAFVYNTLGIPIAAGVLYPFTGTLLNPVVAGAAMALSSITVVSNANRLLRFKPKH

SEQ ID NO: 10375 - protein, 270 aa, Xenorhabdus bovienii
  Peptide sequence Name=Xb4151_4152.C444.gene237.pep
  Gene classification: Function=Uncharacterized BCR; Function class=S Function unknown
  Homolog annotation: Query=19..265bp; Hit=18..263bp; Blast score=244; Percent Identity=51.0; E value=5e-65; Homolog= ybaP COG3735
MGKLMTYLNNVLRLNSQRHYPYPAFDITLPKNRHLHIVGSIHMGTENMFPLSEILLEQLEQCDALIVEADITQPGSPFKEKFPEQVALSLRLSPEHFDRLTHYCHEIQYPLRSLDALPSWQVALILQAAQAQYLGLRPQYGIDCQLLDSAKAIDKVIIELEGTDTQVNLLSNLPNGGISLLEDTLTHWNTNARALQTMISWWMNYKPAQQNQALPQTFCEELHQTLMAERNHQWNEQLHALPAGKYLVAVGALHLHGENNLLQMMERIQG

SEQ ID NO: 10376 - protein, 158 aa, Xenorhabdus bovienii
  Peptide sequence Name=Xb4151_4152.C444.gene238.pep
  Gene classification: Gene name=EbsC; Function=Uncharacterized ACR; Function class=S Function unknown
  Homolog annotation: Query=1..157bp; Hit=1..157bp; Blast score=213; Percent Identity=71.0; E value=8e-56; Homolog= ybaK COG2606
MTPAVILLEKHKIHFKLHPYEHDTNEHSFGDEVVKKLGLDAKQVFKTLLVSLNGDPKNLAVAVTPVAGQLDLKKVAKVFKAKKAEMADPQMAQKVTGYLVGGISPLGQKKRLPTVIDSQAQILPTLFISGGKRGLDIELVPADLCQLLNCSFADIAKV

SEQ ID NO: 10377 - protein, 552 aa, Xenorhabdus bovienii
  Peptide sequence Name=Xb4151_4152.C444.gene239.pep
  Gene classification: Gene name=UshA; Function=5'-nucleotidase/2',3' -cyclic phosphodiesterase and related esterases; Function class=F Nucleotide transport and metabolism
  Homolog annotation: Query=1..549bp; Hit=1..547bp; Blast score=827; Percent Identity=71.0; E value=0; Homolog= ZushA COG0737
MKFSFKTSACALVVSLSLLPISAAAWEKNKTYDITILHTNDHHGHFWQNDHGEYGLAAQKTMVDSIRQEVAKKGGSVLLLSGGDINTGVPESDMQDAEPDFKGMNLVGYDAMALGNHEFDKPLNVLHQQEKWANFPFLSANIYQTSTGKRLFKPYVMFDNQGVKIAVIGLTTDDTAKVGNPANFPDVEFRVPAEEAKKVIDELKKNEKPDVIIAATHMGHYNDGHHGSNAAGDVEMARSLPAGYLNMIVGGHSQDPVCMSAENKNYKQMDYVPGTPCSPDRQNGTWIVQAHEWGKYVGRADFQFRNGEFKLVHYQLIPINLQKKVKNEDGSTGRAYYTHQITENPAMLKLLTPYQDKGSRKLNVQVGVVDGKLEGDRSKVRFIQTNMAHLVLAAQMERTNADFAVMSGGGIRDSIEAGDITYKDVLKVHPFANQLVYVDFKGREVLPYLTAAANMETDSGAYGQFYNVSFVVDGKKIRDVKIGGKPLDLNKTYRMATLNFNAIGGDGYPRVDNLPGYVDTGFVDAEVLKGYIEKHSPLKATDYEPKGEIVHK

SEQ ID NO: 10378 - protein, 54 aa, Xenorhabdus bovienii
  Peptide sequence Name=Xb4151_4152.C444.gene240.pep
MKIINLSHQDMLLFYSSVYITLSLLEQALIQHQNRVMHLGARIYFPIKITELCH

SEQ ID NO: 10379 - protein, 411 aa, Xenorhabdus bovienii
  Peptide sequence Name=Xb4151_4152.C444.gene241.pep
  Gene classification: Gene name=ProP; Function=77 Permeases of the major facilitator superfamily; Function class=G Carbohydrate transport and metabolism
  Homolog annotation: Query=1..400bp; Hit=3..401bp; Blast score=494; Percent Identity=74.0; E value=1e-140; Homolog= Zfsr COG0477
MSEQSTTKRLPDSSRKTHQTVFSILGAISLSHLLNDMIQSLILAIYPLLQSEFTLSFIQVGMITLVYQVTASLLQPLIGLYTDKHPQPYSLPIGMGFTLSGLLLLAYAESFPIILLAAALVGTGSSVFHPESSRVASMASGGRHGLAQSLFQVGGNLGSSLGPLLAAIFIAPYGKGNIGWFSLAALLAIVILLQVSQWYKMQHRASKFLSSTHISQPNFPRKMIVRSFAILLLLIFSKYFYLTSISSYYTFYLIQKFGLSVQNAQIHLFIFLFAVAAGTMIGGPIGDKIGRKYVIWGSILGVAPFTLLLPYTSLFWTGPLTVVIGLILASAFSAILVYAQELIPGKTGMIAGLFFGLAFGMGGIGAAVLGYVADKTSIELVYKICAFLPLLGIFTLFLPNIEIKPQKNHEK

SEQ ID NO: 10380 - protein, 566 aa, Xenorhabdus bovienii
  Peptide sequence Name=Xb4151_4152.C444.gene242.pep
  Gene classification: Gene name=KefB; Function=Kef-type K+ transport systems, membrane components; Function class=P Inorganic ion transport and metabolism
  Homolog annotation: Query=1..409bp; Hit=1..409bp; Blast score=506; Percent Identity=78.0; E value=1e-143; Homolog= ybaL_1 COG0475
MEHSTPLITTIVGGFVLAYLLGMLAQRLKISPLVGYLAAGVLAGPFTPGFVADTSLAPELSEIGVILLMFGVGLHFSLKDLLAVKSIAIPGAIAQIAVATLLGMGLSTLLGWGLFSGIVFGLCLSTASTVVLLRALEERQLIDSQRGQIAIGWLIVEDLAMVLALVLLPAAAGILDSQNANIGQLLLELAMTIGKVVAFILLMVFVGRRLIPWILAKTASTGSRELFTLAVLAIALGVAYGAVKLFDASFALGAFFAGMVLNESELSHRAAQDTLPLRDAFAVLFFVSVGMLFDPMVLFQQPLAILGTLVIIIIGKSLAAMLLVKMFGHSRRTALTISVSLAQIGEFAFILAGLGVTLGLLDGEARNLVLAGAIVSIMLNPILFSLLDRYLEKTETIEEQLLEETLEEETQIPVDICGHAIIVGYGRVGRLLCQRLQERNFPLVVLEDTRARFEELGEMGISAVMGNAASKDIMALARLDCACTLFLTIPNGYEAGEIVANAREIRPDINIIARAHYDDEVTYIMERGTNHIIIGEHEIARAMADALPTSEPICPIEPPASFSTAS

SEQ ID NO: 10381 - protein, 436 aa, Xenorhabdus bovienii
  Peptide sequence Name=Xb4151_4152.C444.gene243.pep
  Gene classification: Gene name=RbsK; Function=Sugar kinases, ribokinase family; Function class=G Carbohydrate transport and metabolism
  Homolog annotation: Query=1..436bp; Hit=1..434bp; Blast score=738; Percent Identity=79.0; E value=0; Homolog= gsk COG0524
MKFPGKRKSKHYFPVSLRDPLLQPIKEMIDTENNRAYIVGIDQTLVDIEAKVDESFIQRYNLSQGHSLVIEDDVAEALYKELTDNNLISHEFAGGTIGNTLHNYSVLADDKSVLLGTMCNSIQVGSYAYCYLCNTSSRMDLNHLQGVDGPIGRCFTLVTENGERTFAISPGLMNQLRPENIPEHIIAEASALVITAYLVRCKSGEPMPEATMKAIGYAKKHNVPVVLTLGTKYVIADDPQWWRDFLAENISVVAMNEDEAQELTGFSDPLLAADMALNWVDLVLCTAGPAGLYMAGYTEEEHKRQTSHPLLPGAIAEFNLYEFSRVLCKADCQNPMRVYSHIEPYMGGPEKIMNTNGAGDGALSALLHDITANSYHRMNVPNSSKHKRSYLTYSSLAQVCKYANRVSYQVLSQHSPRLMRGLPEKEDSLEESYWER

SEQ ID NO: 10382 - protein, 368 aa, Xenorhabdus bovienii
  Peptide sequence Name=Xb4151_4152.C444.gene244.pep
  Gene classification: Function=Chain length determinant protein; Function class=M Cell envelope biogenesis, outer membrane
  Homolog annotation: Query=25..368bp; Hit=25..370bp; Blast score=216; Percent Identity=36.0; E value=3e-56; Homolog= ZfepE COG3765
MSNKPIKHPDFYEENSNYYHPKQEDEIDLFELFSVIFQSKYLIIAISVVFAVIGFSIASFLPQKWTSTAAVVKPTLEQFQPLKNALTDLQVLSLDPKVTEASLYQRFVENYNSRVLREDYLVSTDYFKALLAKMDDGAIQGKRKLIEQVVNKNISISLPKKDNEEDDESILSFSAGTAEDSYNLLTGYINFVSSVVRDQVKDELNDMVHQKLVFSQKSYEIDLARIRNMRGVDIERLKYAISIANSAGVKKPVSNGGAMIKDDPDYSIALGADALQRKLQITEEITDPTQIDADLRNRLLYIENLKAVNINKIDFEPFRYMQQPYEPTAKDSPKRLLILIGAGFIGFILSVMFVLVRHMARGRQKQEA

SEQ ID NO: 10383 - protein, 321 aa, Xenorhabdus bovienii
  Peptide sequence Name=Xb4151_4152.C444.gene245.pep
  Gene classification: Gene name=HemH; Function=Protoheme ferro-lyase (ferrochelatase); Function class=H Coenzyme metabolism
  Homolog annotation: Query=1..316bp; Hit=1..316bp; Blast score=373; Percent Identity=58.0; E value=1e-103; Homolog= hemH COG0276
MSSNKYGVLLVNLGTPDEPTPVAIRRYLAKFLSDRRVVDIPSFIWKPLLYGIILPFRSSRVAKLYQEIWTDEGSPLLVYSQRQQKLLNERLTDIPVVLGMSYGFPSLPQAVGNLLQQGIDHLIVLPLYPQYSSTTSAAVFDSISKILKGYRTIPHLYFIRSYATHPAYIAALKETIEKSFEKHGLPDRLLLSYHGIPERLATIGDIYPQDCRATTELLIQALDYPADKIMMTFQSRFGRLPWLTPYTDKTMALLPEQGVEHVQVLCPGFSSDCLETLEEIQQQNQAIFRHAGGKKFEYISALNDNEAHISLLEQLVNNAMK

SEQ ID NO: 10384 - protein, 214 aa, Xenorhabdus bovienii
  Peptide sequence Name=Xb4151_4152.C444.gene246.pep
  Gene classification: Gene name=Adk; Function=Adenylate kinase and related kinases; Function class=F Nucleotide transport and metabolism
  Homolog annotation: Query=1..214bp; Hit=1..214bp; Blast score=343; Percent Identity=82.0; E value=6e-95; Homolog= adk COG0563
MRIILLGAPGAGKGTQAQFIMEKYGIPQISTGDMLRAAVKAGSELGLKAKELMDNGKLVTDELVIALVKERIKQDDCRSGFLLDGFPRTIPQADAMKEAGIKVDYVLEFAVPDAIIVERIIGRRVHAPSGRVYHIKFNQPKVENRDDVTGEELSIRKDDQEDTVRKRLVEYHAQTAPLVSYYQNEAQAGNTKYSKLDGTRQVAEVSEELVGILG

SEQ ID NO: 10385 - protein, 625 aa, Xenorhabdus bovienii
  Peptide sequence Name=Xb4151_4152.C444.gene247.pep
  Gene classification: Gene name=HtpG; Function=Molecular chaperone, HSP90 family; Function class=O Posttranslational modification, protein turnover, chaperones
  Homolog annotation: Query=1..622bp; Hit=1..624bp; Blast score=1020; Percent Identity=83.0; E value=0; Homolog= htpG COG0326
MKGQETRGFQSEVKQLLQLMIHSLYSNKEIFLRELISNASDAADKLRFRALSKPELYENDGELRVRLAFDNEHKTITISDNGIGMSRDEVIDNLGTIAKSGTKSFLESVGSDQVKDSQLIGQFGVGFYSAFIVADKVTVRTRAAGTAADQGVFWESTGEGDYTIADLEKTERGTEITLHLREGEDEFLNDWRLRSIIGKYSDHIALPVEIETKNEEDDTVTWEKINKAQALWTRGKAEISDEEYQEFYKHISHDFTDPLSWSHNRVEGKQEYTSLLYIPAQAPWDMWNREHKHGLKLYVQRVFIMDDAEQFMPNYLRFMRGLIDSNDLPLNVSREILQDSTITRNLRNALTKRVLQMLDKLAKDDAEKYQTFWQQFGLVLKEGPAEDGSNKEAIAKLLRFATTHHDGSAQTVSLEDYLSRMTEGQEKIYYITADSYAAAKNSPHLELFRKKGIEVLLLSDRIDEWMMSYLTEFDGKSFQSVSKTDESLDKLADENKAEQEEEDKKLEPFIERVKTLLGDRVKEVKLTHRLTDTPAIVTTNANEMSTQMAKLFAAAGQSAPEVSYNFELNPEHNLVKKAADIPDEAQFADWIELLLDQALFAERGTLDDPNQFIRRMNQLLLAEKA

SEQ ID NO: 10386 - protein, 42 aa, Xenorhabdus bovienii
  Peptide sequence Name=Xb4151_4152.C444.gene248.pep
MGITPNNFKLGQSEEYKIGLMNVQISYGWWRYPQHHPLEFPI

SEQ ID NO: 10387 - protein, 202 aa, Xenorhabdus bovienii
  Peptide sequence Name=Xb4151_4152.C444.gene249.pep
  Gene classification: Gene name=RecR; Function=Recombinational DNA repair protein (RecF pathway); Function class=L DNA replication, recombination and repair
  Homolog annotation: Query=1..199bp; Hit=1..199bp; Blast score=340; Percent Identity=86.0; E value=7e-94; Homolog= recR COG0353
MQTSPLLESLMESLRCLPGVGPKSAQRMAFHLLQRDRSGGMRLAQALTRAMSEIGHCQDCRTFTEQEQCTICGNPRRQQNGQICVVETPADIHAIEQTGQFAGRYFVLMGRLSPLDGIGPMDIGLDRLEERLSSETLSEIILATNPTVEGEATANYIAEMCSQYGVIASRIAHGVPVGGELEMVDGTTLSHSLAGRQRITDL

SEQ ID NO: 10388 - protein, 109 aa, Xenorhabdus bovienii
  Peptide sequence Name=Xb4151_4152.C444.gene250.pep
  Gene classification: Function=Uncharacterized BCR; Function class=S Function unknown
  Homolog annotation: Query=1..109bp; Hit=1..109bp; Blast score=179; Percent Identity=91.0; E value=3e-46; Homolog= ybaB COG0718
MFGKGGLGNLMKQAQQMQEKMQKVQEEIANLEVTGESGAGLVKVTINGAHNCRRVEIDPSLMDDDKDMLEDLIAAAFNDAARRIEETQKEKMSGVSNGMQLPPGFKMPF

SEQ ID NO: 10389 - protein, 658 aa, Xenorhabdus bovienii
  Peptide sequence Name=Xb4151_4152.C444.gene251.pep
  Gene classification: Gene name=DnaX; Function=DNA polymerase III, gamma/tau subunits; Function class=L DNA replication, recombination and repair
  Homolog annotation: Query=1..658bp; Hit=1..643bp; Blast score=765; Percent Identity=65.0; E value=0; Homolog= dnaX COG2812
MSYQVLARKWRPQIFSDVIGQQHVLTALANGLEHQRLHHAYLFSGTRGVGKTTIARLLAKGLNCETGITKTPCGQCANCLEIEQGRFVDLIEIDAASRTKVEDTRELLDNVQYAPARGRFKVYLIDEVHMLSRHSFNALLKTLEEPPEHVKFLLATTDPQKLPVTILSRCLQFHLKALNVDQISGQLEHVLNAEQIESDSRARHLLARAADGSMRDALSLTDQAIALGGGKLTADIVSQMLGTLDNDQPLEMIEWLVRADGQQLMALVEQIASRGVDWEHLLVDILSLLHRIAMLQLLPQQPDNDPSSMEGRLRLLARSISPADLQLFYQALLVGRKDLPYAPERRMGVEMALLRALAFHPKTIIEETPASGGEIPVVPQVSASAQRHPVSPVQNHVAGERSENGSEHSSPQSMSTEPVISSPTAKLLQARHSLTRQGNTPPKKSEPAEPVKAKSASSALERLAAVAEQRSQSYIPKAQEPKPIKQEAYRWRTTNTSIEEKPVCVTTPKAIKAALEHEKTPELAEKLAVESKQRDSWSAEIDKLNIPKLVQQVALNAFKEQIDESRFCLHLRSKQRHLNSASAQQMLSEALSELHGKPIELRIIEDDNPAVKTPLEWRQAIYEEKLAQARQSIISDRTIQTLQQLFDAELDEESIRPV

SEQ ID NO: 10390 - protein, 183 aa, Xenorhabdus bovienii
  Peptide sequence Name=Xb4151_4152.C444.gene252.pep
  Gene classification: Gene name=Apt; Function=Adenine/guanine phosphoribosyltransferases and related PRPP-binding proteins; Function class=F Nucleotide transport and metabolism
  Homolog annotation: Query=1..183bp; Hit=1..183bp; Blast score=265; Percent Identity=74.0; E value=2e-71; Homolog= apt COG0503
MTANAQKLQFIKDSIETIPDYPKVGVLFRDITTLLDNPVAYQATIDLLVIHYQEKGITKIVGTEARGFLFGAPVALRLGVGFIPVRKKGKLPRATLSETYDLEYGTDTLEIHKNSIKEGDKVLVVDDLLATGGTIEATVSLIRRLGGEVSEAAFIIGLPDLGGTERLKKQGIESYTLIEFPGH

SEQ ID NO: 10391 - protein, 180 aa, Xenorhabdus bovienii
  Peptide sequence Name=Xb4151_4152.C444.gene253.pep
  Homolog annotation: Query=1..180bp; Hit=1..180bp; Blast score=190; Percent Identity=69.0; E value=1e-47; Homolog= Pa|Phot5-390a06.p1k _g15| 12893 - 13435 259 180 aa, chain -
MSIQNLLVALEKQISMLETELESLPKTPFSIARFDQALFHQHSNKLGGYLNEIKKNMSQLKTCVKDNRTEQVRFLSERLVTQIEALKREISTQSLRKQEDKFERQSQERDFYHRLAEHQDYERRLMAMINDRELQLNKQVIPTNQYKLQKEIAALAGRLARCRQALMRIEKAIEKQENSD

SEQ ID NO: 10392 - protein, 54 aa, Xenorhabdus bovienii
  Peptide sequence Name=Xb4151_4152.C444.gene254.pep
  Homolog annotation: Query=1..50bp; Hit=1..50bp; Blast score=65; Percent Identity=78.0; E value=2e-10; Homolog= Pa|Phot5-390a06.p1k _g14| 12694 - 12870 181 58 aa, chain -
MDLEQAPPEVQLAVDLIYLLECNEISPDIALAALKIVKDDFQEKLKKQAQQPEE

SEQ ID NO: 10393 - protein, 1152 aa, Xenorhabdus bovienii
  Peptide sequence Name=Xb4151_4152.C444.gene255.pep
  Gene classification: Function=Small-conductance mechanosensitive channel; Function class=M Cell envelope biogenesis, outer membrane
  Homolog annotation: Query=26..1139bp; Hit=12..1117bp; Blast score =1039; Percent Identity=50.0; E value=0; Homolog= aefA COG3264
MVPFNRYLGILLNKWVLCDKRPDALHFRFVFMVSLFFLLLFFFSPAMATFSSEIPTRNDIQNQLKILTERKEHTVEEKTSIADLEKALYFFDKIDQVNLDSDLLKKNLQDSPQKSRQITVGLENLKNNAQQDENDYKQTLETLSLKQLESKLNSTLNSLQRAQENLASYNSQLIGLQTQPERAQNLLFHNVQRLQQIRNQLNNELTEQPESRYPQLDLLRVEQSFLMQQNELQRTSLQANTQLQTLLQQQRDYTSFQIDQLERYVQFIQNVVSGKRLIVSEETAKEAQNSDDTNSHIQSNPLVKEEIQINRELSERLIAETRESNQLVQKNILVKNFLDRAIQSERNLKEQVKVLRGSLLLSRILFQEQLKVPQNVLTKDLPIKIADLRLEQFEINQQRDKLYQFNDYVNQLLNLHSDEIKHESKEAVGEIRNAIEQILEIRRELLNQLNNQLGNQITHAINLQMDQQQLLDVSQSLEQTLVQQIFWVNSNKPMNLAWLKSLPDLIQEELSHLNIHLTLSGLATGLKNSIHFVIPLLLVGLFLRWQTKGINEQLKKISDEVGQLHRDSQLHTPLALILTLVKTLPLALIILAIGYWYSKSGDDLGDLIWSFSRQLALFWTMYRCSYQILAKGGIGEHHFSLNSADYTLFRKNLVRLSIVLLPILFWITLGVKHPLRLSDDVIGQCTVLICLLFVFIFIFPFCRRLWHVKSSHMIRTMVVTTLTFAPLVLMVLMVSGYFYTTLRLAERWLYSLYLLFLWHICYQACLRGLGIAARRIAYRRAISRRQAQAKEGAEGDVMEEPPMELKRINQQSLRLTTMVLFLIFLGAFYWVWSDLVTVFSYLDGINLWQYSTTTELGSVLQQVTLKDLGISMATLVISWVMMRNLPGLLEVLVLSRLQLQQGSSYAIKTTLTYLIIGVGGISALGTLGLSWNKLQWLAAALSVGLGFGLQEIFANFVSGLIILFERPVRIGDTVTIGTYSGSVSKIRIRATTITDFDRKEVIIPNRAFVTERLINWTLSDTITRIIIKVGVAYGSDLDKVKEVLLKAAKDNPRVMNEPIPQVYFMSFGASTLDHELRLYVKELGDRSHTVDEVNRNIDKLCRENDINIAFNQLEVYLHNGQGNSLQEVQKSLNGGSHHPDGKVSPGDQPLLP

SEQ ID NO: 10394 - protein, 232 aa, Xenorhabdus bovienii
  Peptide sequence Name=Xb4151_4152.C444.gene256.pep
  Gene classification: Gene name=AcrR; Function=Transcriptional regulator; Function class=K Transcription
  Homolog annotation: Query=17..216bp; Hit=1..200bp; Blast score=220; Percent Identity=53.0; E value=1e-57; Homolog= acrR COG1309
MYVNHPQVKNKVYGTKMARKTKQKAKETRQQIIEAAIKVFSERGVSATSLSDIAIAASVTRGAIYWHFKNKIDLISAVCKMHENKIDELEKEYQAKYPNNPLLALRSLLIFLLKMMIDDSRNRLLMEIFFHKCEFVGEMLLLAEKLRGLCISDYKKIENILEACIQSGELPHDLDLRRSAIMLKALVTGVLENWSFAPDSFNLKEQSTHLVDSLIDTLKYSHHLRCNEENKF

SEQ ID NO: 10395 - protein, 399 aa, Xenorhabdus bovienii
  Peptide sequence Name=Xb4151_4152.C444.gene257.pep
  Gene classification: Gene name=AcrA; Function=Membrane-fusion protein; Function class=Q Secondary metabolites biosynthesis, transport and catabolism
  Homolog annotation: Query=1..384bp; Hit=1..381bp; Blast score=461; Percent Identity=66.0; E value=1e-130; Homolog= acrA COG0845
MRKNRGVLPLATLLVLSGSFILSGCNDNKNSQQGAAGEHASEVGIVTLKAEPLAVITELPGRTSAYRVAEVRPQVSGIILKRNYKEGSDIAAGESLYQIDPATYQADYNKALANLSRVQANEKVSRLTVDRYKSLLGTQYVSKQEFDKVISAHAQAAAEVLSTKAELESTRINLAYTKVTSPISGRAGKSTVTEGALVSGGQPTALTTVQQLNPIYVDITQSSDDYLRLKNEIAKGTVHKEGGKTKTRLITDTGKEYSQEGYLEFSDITVDETTGSITMRAVFPNPNEELLPGMFVRTKLEEGVRQNAILVPQQAITRTPRGQATTLIVDKDNKVELRSINAVQAIGNKWLVTEGLKAGDRVIVTGLQKIAPGVTVKPMETNLDAKLTANQTEPAKKPQ

SEQ ID NO: 10396 - protein, 1049 aa, Xenorhabdus bovienii
  Peptide sequence Name=Xb4151_4152.C444.gene258.pep
  Gene classification: Gene name=AcrB; Function=Cation/multidrug efflux pump; Function class=Q Secondary metabolites biosynthesis, transport and catabolism
  Homolog annotation: Query=1..1047bp; Hit=1..1045bp; Blast score=1538; Percent Identity=75.0; E value=0; Homolog= acrB COG0841
MPKFFIDRPIFAWVIAIITMLSGLLAIMKLPVEQYPAIAPPSISISAVYPGADATTVQNTVTQIIEQNMNGIDNLVYMASNSDSAGRMSITLTFEANTDPDIAQVQVQNKLQLAMPLLPREVQQQGISVDKTTNSFLMVAGFISEDGSMTQDDIADYVGASVKDPLSRVSGVGETMLFGNQYAMRIWLDPDKLLNYKMTTQDVITAIKAQNNQVAAGQLGGTPPVPGQRLNASIIAQTRLNSPEEFSNILLRMNRDGSHIRLRDVSVVELGAESYSIIGRFNGNSAAGIGIKLATGANALDTSKAVKKALAEMAPFFPHGLTVVYPYDTTPFVKISIFEVVKTLAEAILLVFVVMYLFLQNFRATLIPTIAVPVVLLGTFAILAAFGYSINTLTMFAMVLAIGLLVDDAIVVVENVERVMQEEGLPPKEATRKSMGQIQSALVGIALVLSAVFVPMAFFGGATGAIYRQFSITIVSAMVLSVLVALILTPALCATMLKPVAKGSHGIQIGFFGWFNRLFEKSTHHYTDSVGRMLRGTGRYLLIYVVLIAGMAFMFTRMPSSFLPEEDQGVLLAIVQLPPGSTQDQTQKVLDEINDYFHTKETEIVKSVFTINGFSFSGQGQNAGLVFVSLKDWDERKDDKDKVPAIVDRANAHFSQIKEGIVFAFNIPSIVELGSASGFDFQLIDKGNLGHEALTQARNQLLGMVQSHPDMLTNVRPNGQNDTPQYRIHIDKEKAEALGVSTENINSTLTTMFGGAYVNDFIDRGRVKKVYIQSDAPHRMLPSDISKLYARNHHGEMVPFSAFIDISKDPWVYGSPRLERYNGLPSMEIVGEAVKGKSTGDAMVFMEQLASQLPSGIGYDWTGMSYQERLSGNQAPALYTLSLIVVFLCLAALYESWSIPFSVMLVVPLGIVGALLATSIRGLDNDVYFKVGLLTTIGLSAKNAILIVEFAKDLIEKEGKGLIEATLDAVKMRLRPILMTSLAFMLGVMPLVLSNGAGSGAQNAVGTGVLGGMIAATSLAIYFVPVFFVVIKRRFSKKSEDLEHISTHR

SEQ ID NO: 10397 - protein, 122 aa, Xenorhabdus bovienii
  Peptide sequence Name=Xb4151_4152.C444.gene259.pep
  Homolog annotation: Query=1..122bp; Hit=1..122bp; Blast score=124; Percent Identity=54.0; E value=3e-28; Homolog= gi|16123299|ref|NP _406612.1| conserved hypothetical protein [Yersinia pestis] gi|22124954|ref|NP_668377.1| hypothetical protei
MDEYSPRRHDIVELKYLCENLIHEAFSVLNRADNHWINDLTSEKSLKLNELIEHIAAFVWSFKIKYADNYNLSTLIDKYLDETYNLFGSDKISCFELTKWQKTNEHLTNILLHDLNACLSKT

SEQ ID NO: 10398 - protein, 67 aa, Xenorhabdus bovienii
  Peptide sequence Name=Xb4151_4152.C444.gene260.pep
  Homolog annotation: Query=1..67bp; Hit=73..139bp; Blast score=115; Percent Identity=86.0; E value=2e-25; Homolog= gi|1773143|gb|AAB40215.1| Hha protein [Escherichia coli]
MTKTDYLMRLRKCTSIETLERVIEKNKYELSDDELELFYSAADHRLAELTMNKLYDKIPSSVWKFVR

SEQ ID NO: 10399 - protein, 40 aa, Xenorhabdus bovienii
  Peptide sequence Name=Xb4151_4152.C444.gene261.pep
MFDFFNLVKTHDNPATMANQAFSIKTINKQNINILNNQKK

SEQ ID NO: 10400 - protein, 430 aa, Xenorhabdus bovienii
  Peptide sequence Name=Xb4151_4152.C444.gene262.pep
  Gene classification: Gene name=AmtB; Function=Ammonia permeases; Function class=P Inorganic ion transport and metabolism
  Homolog annotation: Query=6..430bp; Hit=1..427bp; Blast score=508; Percent Identity=67.0; E value=1e-144; Homolog= amtB COG0004
MKKRLLSITSITMGIIASVPSFAFAAGSTFDKADTVFMLVNTVLVLFMTIPGIALFYGGLLRRKNVLSLMSQVIVSFSLVCVLWVVYGYSMTFETGNRFWGGFEQVMLKNISITDLNGSFYQLIHVVFQGAFACITIALVVGALCERVRFSALLIFSALWLTASYIPMAHMVWGGGWLAQDGALDFAGGTVVHINAAVAGLVGAYLLGKRSGFGKEAFKPHNLPMTFIGTAILYIGWFGFNVGSAGAVNAIAALALINTMAATAGAVLSWVFSEWLFRDKPSLLGACSGCIAGLVAITPAAATVGIGGALIIGLIAGVAGLWGVVVLKRWLRVDDVCDVFGVHGVCGIVGCLLTSIFTASALGGTGFPEGMTMLRQIGVQIISILVCIVWSAVAAYLSFKIADLVAGLRISVESEREGLDIISHGESAYN

SEQ ID NO: 10401 - protein, 124 aa, Xenorhabdus bovienii
  Peptide sequence Name=Xb4151_4152.C444.gene263.pep
  Gene classification: Gene name=GlnK; Function=Nitrogen regulatory protein PII; Function class=E Amino acid transport and metabolism
  Homolog annotation: Query=13..124bp; Hit=1..112bp; Blast score=167; Percent Identity=73.0; E value=2e-42; Homolog= glnK COG0347
MFLANTAKSGGSMKLITTIIKPFKLEEVREALSDIGIQGMTVTEVKGFGRQKGHSELYRGAEYNVNFLPKVKIDIATHDERVEEVIHVIQQSAFTGKMGDGKIFIFELQHAVRIRTGETNDAAL

SEQ ID NO: 10402 - protein, 630 aa, Xenorhabdus bovienii
  Peptide sequence Name=Xb4151_4152.C444.gene264.pep
  Gene classification: Gene name=MdlB; Function=ABC-type multidrug/protein/lipid transport system, ATPase component; Function class=Q Secondary metabolites biosynthesis, transport and catabolism
  Homolog annotation: Query=46..628bp; Hit=3..585bp; Blast score=779; Percent Identity=70.0; E value=0; Homolog= mdlB COG1132
MARLRSKARTNSLLHNPVGILICTIISNLKPNWMVNMTNHDMRKPSVRKLWPSLKRLLSYSKNYRKPILLAVLMSWVAALTEVSGPLLVSYFIDNMVATGNLPLDVVSGLAVTFLVLQFVAAALHYFQFLLFNQASVGIVQKLRTDVMNSALRQPLSTFDSQPVGQLISRVTNDTEAIKDLFVNVIPTVFRCISLIGAMLIAMFILDWRMACVALTIFPAVLLVMIIYQHFSTPIIRRVRSYLADINDGFNETINGMTVIQQFRQQARFGEKMLATNREHYQSRMQALRLDGILLRPLLSLFSAAILCGLLLLFGFKGTEVIGVGVLYAFVNYLGRLNEPLIELTAQQSLLQQAVVSGERVFELMDSPQQQYGTDQQALMSGRIDIENLTFAYRNDKVVLSDINLHVPTHGFVALVGHTGSGKSTLTNLIMGYYPWQDGEIYLDGRPVSSLSHAVLRNGVAMVQQDPVVLAASFFDNITLGRDISEDKIWQVLEMVQLADFVRRLPDGLNSVLGEQGNTLSAGQKQLLAMARVLVQTPQILILDEATANIDSGTEQSVQQALRMIRKQTTLVVIAHRLSTIVEADSILVLHRGAIVEQGQHQQLLAKRGRYYQMYQLQQVGDILNESMHV

SEQ ID NO: 10403 - protein, 556 aa, Xenorhabdus bovienii
  Peptide sequence Name=Xb4151_4152.C444.gene265.pep
  Gene classification: Gene name=MdlB; Function=ABC-type multidrug/protein/lipid transport system, ATPase component; Function class=Q Secondary metabolites biosynthesis, transport and catabolism
  Homolog annotation: Query=1..552bp; Hit=27..578bp; Blast score=795; Percent Identity=72.0; E value=0; Homolog= mdlA COG1132
MIAMLQLIPPRLVGIIVDGISAKTMSSSQLLMWLGIMLFIALAIYGLRYVWRVWLFGASYRLAVKLRSDFYQKLSSQNPEFYLRHRTGDLMARATNDVDRVVFAAGEGVLTLVDSLVMGCAVLIVMSIEISWQLTLLSLLPMPIMALVIKRYGEQLHHRFKSAQGAFSALNNHAQESLTSIRMIKAFGLEDLQSSQFEEVATDAGRKNIHVARVDARFDPTIFIAIGVANLLAIGGGSWMVVHGSMTLGELTSFVMYLGLMIWPMLALAWMFNIVERGSAAYTRIRSLLQEPLVIDDGSQSLLVERGTLQANINTFIYPANDRPILHDVRFQLSPGQLLGVCGPTGAGKSTLLALLQRQFDVTDGEILFQSRHVSTLRLEEWRSRLAIVNQTPFLFSDTVAGNIALGRPDATQEQIEEVARLANVHDDILRLPQGYQTEVGERGVMLSGGQKQRISIARALLLDTEILILDDALSAVDGQTEHQIMKNLSQWRRQRTVIISAHRLSALTEADNILVIQHGTVAQQGPHKQLIAQSGWYSDMYHYQQLEAELDGEHD

SEQ ID NO: 10404 - protein, 153 aa, Xenorhabdus bovienii
  Peptide sequence Name=Xb4151_4152.C444.gene266.pep
  Gene classification: Gene name=Lrp; Function=Transcriptional regulators; Function class=K Transcription
  Homolog annotation: Query=1..151bp; Hit=30..180bp; Blast score=233; Percent Identity=74.0; E value=4e-62; Homolog= ybaO COG1522
MLDKIDRKLLELLQQDCSRSLNALAEAVNLTSTPCWKRLKRLEDDGYIVGKVALLNGSKLGLSLTVIVMIKTQQHSSEWYEQFVAFIKEMPEVLTFYRMAGEYDYLIHVEVVDMKSYDRFYKRMVNGVSGLIDVTSNFAMEKIKYTTALPIPD

SEQ ID NO: 10405 - protein, 350 aa, Xenorhabdus bovienii
  Peptide sequence Name=Xb4151_4152.C444.gene267.pep
  Gene classification: Gene name=CysK; Function=Cysteine synthase; Function class=E Amino acid transport and metabolism
  Homolog annotation: Query=5..343bp; Hit=7..345bp; Blast score=517; Percent Identity=71.0; E value=1e-147; Homolog= VC1061 COG0031
MSSSWATNAIKAIQADYQRSADTHLIHLNLPVFSGIHLYLKDESTHPTGSLKHRLARSLFLYALSNGWVKEGTPIIEASSGSTAVSEAYFARLLGLPFIAVMPSCTAKRKVQEIEFYGGKCHFVEHSALIYEESERLAKKLNGHYMDQFTYAERATDWRGNNNIAESIFRQMQLEPFPEPTYIVMSAGTGGTSATLGRYIRYQGYNTKLIVVDPENSVFYDCYHQNRRDIRGITSSKIEGIGRPRAEPSFIPTVINDMLQVPDCATIATIYWLEKLIGRKTGASTGTNVWGTLQLARQMHENNQKGAIVTLLCDSGERYLDTYYNPEWVRNNIGDITLYLTQLPKLDGYE

SEQ ID NO: 10406 - protein, 232 aa, Xenorhabdus bovienii
  Peptide sequence Name=Xb4151_4152.C444.gene268.pep
  Gene classification: Function=Predicted ATPase (PP-loop superfamily), confers aluminum resistance; Function class=R General function prediction only
  Homolog annotation: Query=1..231bp; Hit=1..230bp; Blast score=388; Percent Identity=80.0; E value=1e-108; Homolog= ZybaX COG0603
MKRAVVVFSGGQDSTTCLIQALRQYDEVHCVTFDYGQRHRAEIDVACRISKELGAAAHKVLDVTLLSELAISSLTRDNIPVPDFSESEKSGLPNTFVPGRNILFLTLAAIYAYQVEAEAVITGVCETDFSGYPDCRDEFVKALNKAVCLGIARDIRFETPLMWLNKAETWALADYYQKLNFVRTQTLTCYNGIQGDGCSECAACHLRANGLNLYLNNTQSIMEEMKSKTHLS

SEQ ID NO: 10407 - protein, 132 aa, Xenorhabdus bovienii
  Peptide sequence Name=Xb4151_4152.C444.gene269.pep
  Gene classification: Gene name=FcbC; Function=Predicted thioesterase; Function class=R General function prediction only
  Homolog annotation: Query=1..128bp; Hit=1..128bp; Blast score=156; Percent Identity=58.0; E value=4e-39; Homolog= ybaW COG0824
MRTIIKVRGYHIDLFQHVNNARYLEFMEEARWDLLTESDTLTWLKTNNVGFAVVNININYRLPAVFGDELEVRSSLKELRNKSGVFFQEIIRRSDNKILTDALTTFACIDLKTHKALTLEGDIQERLEAFKV

SEQ ID NO: 10408 - protein, 191 aa, Xenorhabdus bovienii
  Peptide sequence Name=Xb4151_4152.C444.gene270.pep
  Gene classification: Gene name=ComEA (BS); Function=DNA uptake protein and related DNA-binding proteins; Function class=L DNA replication, recombination and repair
  Homolog annotation: Query=65..191bp; Hit=1..112bp; Blast score=79; Percent Identity=40.0; E value=2e-15; Homolog= HI1008 COG1555
MMPRLRWGRLNKIAKLLATIFAKQQLKKATFVAFRIFEPFLLSINSVMASFPPSTKHGGIYMKYLRTLFNSLVMVFCISMPLSHAIAADESPDKAVKQSTNQHKAVIEKNDVKEGKELASEKEIQGKGSININTANAEQLVKELNGVGAKKAQAIIEYREKYGQFTAIEQLQEVQGIGPALMEKNRDKLTY

SEQ ID NO: 10409 - protein, 623 aa, Xenorhabdus bovienii
  Peptide sequence Name=Xb4151_4152.C444.gene271.pep
  Gene classification: Gene name=SurA; Function=Parvulin-like peptidyl -prolyl isomerase; Function class=O Posttranslational modification, protein turnover, chaperones
  Homolog annotation: Query=1..620bp; Hit=1..617bp; Blast score=545; Percent Identity=48.0; E value=1e-155; Homolog= ybaU COG0760
MMDNLRTAANGPVLKIVLALIILTFVLTGVTGYLSSEGGNYAAKVNGQTISRAQLEQAFQQDKIALQDRLGDQFSTLLSDEQKVQQIRRSSLDRLITVILSDQYARKLGLSASDEQVKEEIRNLPFFQTDGKFDNNKYLTLLTGANRSPDNFAEQVRQDLINRQLMSILTGSEIALPTEIKQETALAFQERTVRFATLELKSIEAQQKVTDKELKNYYDVNSNSFTVPEKVKVSYIKMDAADELKSVTVSDADIEKYYKNNLPQYMQVEQKKYSMVQLVSDAEAKSVLDELKKGADFSKLAAEKSTDKFSAQKGGDLGWMEESSLPDEIKSAKLIEKGQLSGVIKLSGGYAIFRLDDIKPQIIKSLVEVRSEIEKIVKQEKAVDAFYALQRKVSDAAANDNESLTAAEKAAGYKAVTTDWFDRDHIPAEINFGSVVQTIFSGNLIDDKGASGTNSDVISVDGDRAFIVRVDDIKPETIQPYEQAKTQIAELVKRQKAEKQLQLESEKLLAALKEGKGEQALKAAGIQFGVSTVIKHLSQTNQATNVAFTLPHPKDGKSEYGLAQDGFGNAVLIQLDKVVPGSVSEEQVKQYIAAYQYQIGTFMLESLMINLRDDAEIKMGQIE

SEQ ID NO: 10410 - protein, 96 aa, Xenorhabdus bovienii
  Peptide sequence Name=Xb4151_4152.C444.gene272.pep
  Gene classification: Gene name=HimA; Function=Bacterial nucleoid DNA -binding protein; Function class=L DNA replication, recombination and repair
  Homolog annotation: Query=6..95bp; Hit=1..90bp; Blast score=115; Percent Identity=80.0; E value=1e-26; Homolog= hupB COG0776
MGMIRVNKSQLIDKIAADVNISKAAAGRVVDAFISSVSDALKDGDDVVLVGFGTFTVRERAARTGRNPQTGKEIKIAAAKVPAFRAGKGLKDAVNE

SEQ ID NO: 10411 - protein, 784 aa, Xenorhabdus bovienii
  Peptide sequence Name=Xb4151_4152.C444.gene273.pep
  Gene classification: Gene name=Lon; Function=ATP-dependent Lon protease, bacterial type; Function class=O Posttranslational modification, protein turnover, chaperones
  Homolog annotation: Query=1..782bp; Hit=1..782bp; Blast score=1333; Percent Identity=89.0; E value=0; Homolog= lon COG0466
MNPERSERIEIPVLPLRDVVVYPHMVIPLFVGREKSIHCLEAAMDHDKQVMLVAQKEASTDEPGVNDLFSVGTVASVLQMLKLPDGTVKVLVEGLQRARITTLTDNSEYFYAQVEYLESPVVDEREQEVLVRTAINQFEGYVKLNKKIPPEVLTSLHSIEDLAKLADTIAAHMPLKINDKQTVLEMSDVVERIEYLIAMMESEIDLLQVEKRIRNRVKKQMEKSQREYYLNEQMKAIQKELGEMDDAPDEYETLRRKIEDAKMPKEAREKVEAELQKLKMMSPMSAEATVVRSYIDWMVQVPWVARSKVKKDLVKAQEVLDIDHYGLERVKERILEYLAVQSRVSKIKGPILCLVGPPGVGKTSLGRSIARATGRKYVRMALGGVRDEAEIRGHRRTYIGSMPGKLVQKMSKIGVKNPLFLLDEIDKMSSDMRGDPASALLEVLDPEQNVTFNDHYLEVDYDLSDVMFVATSNSMNIPAPLLDRMEVIRLSGYTEDEKLNIAKRHLLPKQIERNALKKGELAIDDGAILGIIRYYTREAGVRNLEREISKLCRKAVKALLMDKKLKHIEINADNLKNYLGVQRVDYGRADTENRVGQVTGLAWTEVGGELLTIETASVPGKGKLTYTGSLGEVMQESIQAALTVVRARADKLGISSDFHEKRDIHVHVPEGATPKDGPSAGIAMCTALVSCLTGNPVRADVAMTGEITLRGLVLPIGGLKEKLLAAHRGGIKTVLIPDENKRDLEEIPQNIIQDLEIHPVKRIEDVLSIALQSPAFGAEAVSLN

SEQ ID NO: 10412 - protein, 423 aa, Xenorhabdus bovienii
  Peptide sequence Name=Xb4151_4152.C444.gene274.pep
  Gene classification: Gene name=ClpX; Function=ATP-dependent protease Clp, ATPase subunit; Function class=O Posttranslational modification, protein turnover, chaperones
  Homolog annotation: Query=1..423bp; Hit=1..424bp; Blast score=757; Percent Identity=91.0; E value=0; Homolog= clpX COG1219
MTDKRKDGSGKLLYCSFCGKSQHEVRKLIAGPSVYICDECVDLCNDIIREEIKELVPHRERSALPTPHEIRQHLDDYVIGQETAKKVLAVAVYNHYKRLRNGDTNNGVELGKSNILLIGPTGSGKTLLAETLARYLDVPFTMADATTLTEAGYVGEDVENIIQKLLQKCDYDVQKAQRGIVYIDEIDKISRKSDNPSITRDVSGEGVQQALLKLIEGTVAAVPPQGGRKHPQQEFLQVDTSKILFICGGAFAGLDKVISQRLNVSSGIGFSATVKGESEKATEGELLAQAEPEDLIKFGLIPEFIGRLPVVATLTELSEDALIQILQEPKNALTKQYQALFNLEGAELEFRKEALTAIAKKAMARKTGARGLRSIVEGVLLDTMYDLPSMEHVEKVVVDETVVEEKSAPLLIYSKPDAQVSGE

SEQ ID NO: 10413 - protein, 207 aa, Xenorhabdus bovienii
  Peptide sequence Name=Xb4151_4152.C444.gene275.pep
  Gene classification: Gene name=ClpP; Function=Protease subunit of ATP- dependent Clp proteases; Function class=N Cell motility and secretion
  Homolog annotation: Query=1..207bp; Hit=1..207bp; Blast score=369; Percent Identity=86.0; E value=1e-102; Homolog= clpP COG0740
MSYSGKQDKYAPNMSLVPMVVEQTARGERAFDIYSRLLKDRIIFLTGPVEDHMANLIVAQMLFLEAENPEKDINLYINSPGGVITAGMSIYDTMQFIKPDVSTICMGQACSMGAFLLTAGAKGKRFCLPNSRVMIHQPLGGFQGQATDIEIHAQEILKVKARMNELMAKHTGKPLEKIVEDTERDRFLSAAESVEYGLVDSIFTQRN

SEQ ID NO: 10414 - protein, 434 aa, Xenorhabdus bovienii
  Peptide sequence Name=Xb4151_4152.C444.gene276.pep
  Gene classification: Gene name=Tig; Function=FKBP-type peptidyl -prolyl cis-trans isomerase (trigger factor); Function class=O Posttranslational modification, protein turnover, chaperones
  Homolog annotation: Query=1..430bp; Hit=1..430bp; Blast score=632; Percent Identity=80.0; E value=0; Homolog= tig COG0544
MQVSVETTQGLGRRVSITVPAADIEKAISSELVNVAKKVRIDGFRKGKVPMNIVKQRYGASVLQDVLGDLMQRNFVNAIIENKINPAGAPSYKPEQFKDGEDFIYAVEFEVYPEIELKGLEEIEVEKPVVEVKDADVDAMLETLRKQQADWKETDEAAAAEDRVTVDFTGSVDGEEFEGGKSTDFVLAMGQGRMIPGFEEGVVGHKAGEEFTLDVTFPEDYHAENLKGKAATFAINLKKVEQRELPELTEEFIKRFGIADGTVDGLRTEVRKNMERELKNAVRSRIKTQILDGLVNANEIEVPAAVIDGEIDVLRRQAAQRFGGNEKQALELPRELFEEQAKRRVVVGLLLGEVISSNELKVDEDRVNVLIEEMASAYEDPKEVIEYYSKNKEMLNNVRNIALEEQAVEFVLNKAKVSEKEVGFNDLMNQNQLA

SEQ ID NO: 10415 - protein, 75 aa, Xenorhabdus bovienii
  Peptide sequence Name=Xb4151_4152.C444.gene277.pep
MFITEVNEYCLLLSAILDSYCLRRYNAASEFLEWFRDASDHRDSRFLNTTAPVLDECCNQPVFQALRHSEVDRAL

SEQ ID NO: 10416 - protein, 107 aa, Xenorhabdus bovienii
  Peptide sequence Name=Xb4151_4152.C444.gene278.pep
  Gene classification: Gene name=BolA; Function=Stress-induced morphogen (activity unknown); Function class=T Signal transduction mechanisms
  Homolog annotation: Query=1..99bp; Hit=13..111bp; Blast score=139; Percent Identity=67.0; E value=6e-34; Homolog= bolA COG0271
MVRQEIEIKLQAAFKPSHLEVIDESYRHNVPAGSESHFKIIVISNEFVDHRVLNRHRAVYSVLAKELEEGVHALALHTYTEKEWAELGDTVLASPACRGGRTTTSGL

SEQ ID NO: 10417 - protein, 215 aa, Xenorhabdus bovienii
  Peptide sequence Name=Xb4151_4152.C444.gene279.pep
  Gene classification: Function=Uncharacterized lipoprotein; Function class=M Cell envelope biogenesis, outer membrane
  Homolog annotation: Query=18..215bp; Hit=29..226bp; Blast score=222; Percent Identity=57.0; E value=2e-58; Homolog= ZyajG COG3056
MIATVYTTGINISGIRILNEKIYMLKKIFTSLLALFFLAGCANSGNTLAIQPKITLPPVDPTMKAITISISGVDHRQSQALAQVNRDARLVTLTPSRDLRFLLQEALEKQMVARGYMIGSPANANLQVVVNQLYANVKEGSLRHDISTKAEISIIVYAQDGSQQIKNYRTSYNVQGPLSATNAKIADAVNTVLSDVIADMAQDLSVSTFIKQNVR

SEQ ID NO: 10418 - protein, 500 aa, Xenorhabdus bovienii
  Peptide sequence Name=Xb4151_4152.C444.gene280.pep
  Gene classification: Gene name=ProP; Function=77 Permeases of the major facilitator superfamily; Function class=G Carbohydrate transport and metabolism
  Homolog annotation: Query=1..497bp; Hit=1..488bp; Blast score=540; Percent Identity=64.0; E value=1e-153; Homolog= ampG COG0477
MTNHYLNKLSTLRNYYILLLLGFASGLPLALTGGTLQAWMTIENLDIKTIGFFTLVGQAYVFKFLWAPAMDRYSPSFLGRRRGWMLVTQLLLIVSIATMAFLKPSEHLWWLAALAVSVAFFSASQDIIFDAYKTDLLSQEERGSGAAISVLGYRIAMLVSGGLALWLTTYIGWQNMYLIMAGMMLIGVYATLTAKEPKINTAPPKTLHQAVLEPLSDFFSRNNAWLILLLIVLYKLADAFALSLSTTFLIRGVGFTAAEVGMINKTLGLAATIVGALYGGYLMHKWSLFRALMIFGILQTVSNLSYWILAVTPKDIYVMGGAVFLENICGGMGTAAFVALLMTLCNKSFSATQFALLSALAAIGRVYVGPVAGWFAESHGWPMFYLFSIFIGLPGLWLLFICRNTLTYTEKNDNFISRTLFKSYYRIAFIIMLLAASIFIIWLICSCLIIIISSITHFIVLDGLQKAISPVFSFSIAMGTVGLLLGGALDYLALRKTKFA

SEQ ID NO: 10419 - protein, 89 aa, Xenorhabdus bovienii
  Peptide sequence Name=Xb4151_4152.C444.gene281.pep
  Homolog annotation: Query=1..88bp; Hit=21..108bp; Blast score=129; Percent Identity=67.0; E value=2e-29; Homolog= gi|22124929|ref|NP _668352.1| putative sugar hydrolase [Yersinia pestis KIM] gi|21957767|gb|AAM84603.1|AE013705_6 putative suga
MKRHILTLTAVATALVSASASAEYQWGFANVSMNYLDWTKHTTQKTGQTSHKDDFAYLELEGGSEFSWGELYGFLDLENPFNSKTAQPR

SEQ ID NO: 10420 - protein, 117 aa, Xenorhabdus bovienii
  Peptide sequence Name=Xb4151_4152.C444.gene282.pep
  Homolog annotation: Query=1..117bp; Hit=144..260bp; Blast score=196; Percent Identity=87.0; E value=5e-50; Homolog= Pa|Phot5-472b02.p1k _g42| 22142 - 22924 3190 260 aa, chain +
LGYNTTLAGVWFKPFVALHYVDQTFYSGNNGYVVGWVAGYDFQLWQEKFSITNWNEIELNRNQRYGNGGREGINGAVGLWWTPHPSFTTGIQYRYADNKLGEDFLQDGIVYSVKYNF

SEQ ID NO: 10421 - protein, 318 aa, Xenorhabdus bovienii
  Peptide sequence Name=Xb4151_4152.C444.gene283.pep
  Gene classification: Gene name=CyoA; Function=Heme/copper-type cytochrome/quinol oxidases, subunit 2; Function class=C Energy production and conversion
  Homolog annotation: Query=2..313bp; Hit=5..315bp; Blast score=403; Percent Identity=64.0; E value=1e-112; Homolog= cyoA COG1622
MKYKKTIGLSSLLAATLMLSGCDMVLMNPKGAIGVEQKTLILTAFGLMLIVVIPAIVMAIIFALRYREANKSATYRPNWAHSNKIELVVWTVPILIIIVLATITWKTTQELDPYKPLDYEEKPVTIEVISLDWKWLFIYPEQGIATVNEIAFPTNVPVNFKITSDSVMNSFFIPQLGGQIYAMAGMQTKLHLIANTPDTYKGFSASYSGEGFSGMKFTATATPDRESFEQWVQKVKASPKTLDTVQAFNDLAEKSQNNPVEYFSSVKPKLFQETITKFMGDMKHGGMFGTAGHGKTEHGEAADHNMHMSQPAHAGVEE

SEQ ID NO: 10422 - protein, 660 aa, Xenorhabdus bovienii
  Peptide sequence Name=Xb4151_4152.C444.gene284.pep
  Gene classification: Gene name=CyoB; Function=Heme/copper-type cytochrome/quinol oxidases, subunit 1; Function class=C Energy production and conversion
  Homolog annotation: Query=1..660bp; Hit=1..660bp; Blast score=1027; Percent Identity=82.0; E value=0; Homolog= cyoB COG0843
MWGKLTLDAIPLHEPIIVVTLIAILLGGLAVVGTLTYFRKWKWLWSEWLTSVDHKKIGIMYIVVAMVMMVRGFADAIMMRGQQALASAGEAGFLPPHHYDQIFTAHGVIMIFFMAMPFVVGLMNIVVPLQIGARDVAFPFLNSLSFWLFVVGVVLINLSLGVGEFAQTGWLAYPPLSGKLYNPGVGVDYWIWSLQLSGIGTLLTGVNFFVTILRMRAPGMSMMKMPVFSWTVLCTNVLIIAAFPILTVTVALLTLDRYMGTHFFTNDMGGNMMMYINLIWAWGHPEVYILVLPVFGIFSEVTATFAKKRLFGYTSLVWATIVITILSFIVWLHHFFTMGSGANVNAFFGIATMIISIPTGVKIFNWLFTMYRGRIEFKTPMLWTVGFLVTFSIGGMTGVLLAVPGANFVLHNSLFLIAHFHNVIIGGVVFGCFAGTAYWFPKAFGFTLNEKWGIRAFWFWITGFFVAFMPLYALGFMGMTRRLSQDIDPAFHTMLVVAAGGVVLIALGILCQVIQFYVSIRDREQNRDLTGDPWGGRTLEWSTSSPPPFYNFAEVPHIQTRDAWWDMKEKDTAHKRPAKYEEIHMPKNTSAGIIISAFLLIFGFAMIWDIWWLAIASFAGTIITWIVKSFDEDVDYYVPVAEVEKTENQHYEELRKAGVK

SEQ ID NO: 10423 - protein, 203 aa, Xenorhabdus bovienii
  Peptide sequence Name=Xb4151_4152.C444.gene285.pep
  Gene classification: Gene name=CyoC; Function=Heme/copper-type cytochrome/quinol oxidase, subunit 3; Function class=C Energy production and conversion
  Homolog annotation: Query=1..203bp; Hit=1..204bp; Blast score=268; Percent Identity=74.0; E value=2e-72; Homolog= cyoC COG1845
MSTQTLNNTAAHEHHGHHDVGSMKIFGFWIYLMSDLVLFASLFATYAVLANGTAGGPSGKDIFELPFVLVETFLLLFSSITYGFAMLSMNKGKTGQVNLWLFITFLFGLGFVSMEIYEFHKLISEGFGPDRSAFLSSFFALVATHGIHVTCGLIWIIIMMVQVARRGLTEVNRTRLSCLSLFWHFLDVVWICVFTVVYLMGAM

SEQ ID NO: 10424 - protein, 125 aa, Xenorhabdus bovienii
  Peptide sequence Name=Xb4151_4152.C444.gene286.pep
  Gene classification: Gene name=CyoD; Function=Heme/copper-type cytochrome/quinol oxidase, subunit 4; Function class=C Energy production and conversion
  Homolog annotation: Query=16..124bp; Hit=1..108bp; Blast score=120; Percent Identity=68.0; E value=2e-28; Homolog= cyoD COG3125
MDLCIYCRLSDGSYVMSHPNTSHSGADHGSFKTYMIGFILSVILTVIPFWMVMDGSASQSTILLTVIGMAVIQIFVHFVCFLHMNTSSEERWNLVALIFTLLVIAIVVVGSLWIMYNLNINMMVD

SEQ ID NO: 10425 - protein, 294 aa, Xenorhabdus bovienii
  Peptide sequence Name=Xb4151_4152.C444.gene287.pep
  Gene classification: Gene name=CyoE; Function=Polyprenyltransferase (cytochrome oxidase assembly factor); Function class=H Coenzyme metabolism
  Homolog annotation: Query=1..281bp; Hit=2..282bp; Blast score=407; Percent Identity=82.0; E value=1e-114; Homolog= cyoE COG0109
MIKQYLQVTKPGIIFGNLISVVGGFLLASKGVIDYPLFFATMLGVSLVVASGCVFNNYIDRDIDRIMERTKNRVLVKGLIDPKISLIYASVLGIAGIVLLYIAANALAMQLALIGFLIYVGVYSLYMKRKSVYGTLVGSLSGAAPPVIGYCAVTGQFDTGALILLLIFSLWQMPHSYAIAIFRFKDYQAANIPVLPVIKGISVAKNHITLYILAFMVATLMLTISGYAGYKYLIVAAAVSIWWLGMALSGYKTANDRIWARKLFMFSIVAIMSLSVMMSVDSTASPETLLTYVR

SEQ ID NO: 10426 - protein, 455 aa, Xenorhabdus bovienii
  Peptide sequence Name=Xb4151_4152.C444.gene288.pep
  Gene classification: Gene name=ProP; Function=77 Permeases of the major facilitator superfamily; Function class=G Carbohydrate transport and metabolism
  Homolog annotation: Query=1..451bp; Hit=3..453bp; Blast score=552; Percent Identity=65.0; E value=1e-157; Homolog= yajR COG0477
MNDNKMTPLELRATWGLGSVFSLRMLGMFMVLPVLTTYGLELRGSSEALIGIAIGIYGLTQAIFQIPFGLLSDKIGRKPLIIGGLLIFVLGSITAALSDSIWGIIIGRALQGAGAISAAIMALLSDLTREQNRTKAMAFIGISFGITFAFAIVIGPIITHQIGLNGLFGAIAILASCGILITLFAVPPAHKHILNRESGIARGSFRRVLSDSQLLKLNFGILSLHTLLMSSFIALPLIMEKADFPPQQHWKVYLITTLISFIAVLPFIIYAEKKRRMKQVFLLCIGLLFIAELILWSVSSHLWGIFAGIQIFFLAFNIMEAILPSLISKEAPAGYKGTAMGIYSTSQFLGVALGGFLGGMLYELQGASLVFMGGIVLTALWFIISLTLHQPPYVSSIRIVLPDQLNNPDILEKKILSQAGVKDIVIALEELSAYVKVDTKQTNREQLEQLVLSHK

SEQ ID NO: 10427 - protein, 498 aa, Xenorhabdus bovienii
  Peptide sequence Name=Xb4151_4152.C444.gene289.pep
  Gene classification: Gene name=ChiA; Function=Chitinase; Function class=G Carbohydrate transport and metabolism
  Homolog annotation: Query=124..477bp; Hit=108..446bp; Blast score =132; Percent Identity=29.0; E value=1e-30; Homolog= BH0916 COG3325
MSKLTQLDPRSEESYRLDHFISATETTKFSYTSGRVALPVYNKYNVKNKPKVIGYYTDWSQYDSRLQGNQTPSARGRGIDLQHLLDNPFAYDKLIIGFCGIVGDQGEKKALISRAAPKFGRYNNGEVTFTDEWGDCQSYVNCTFPRWQDVQMPRDFKQDKSMGVLGGLAKIQDAARAQGHELVMSFSVGGWTMSNGFYNMVRNSQLKSKFISSLIDIFKRFPMFTEVDIDWEYPGAKGNDNPHDPKDGEYYISLIRDLSSAFKNAGRSDIKISIACSAVPDIMEKSKIPELLKVGLYGINVMTYDFFGTPWADKLRHHTNLRRYPGSENSVEKAVEYLLSVGVPSQAINIGYAGYSRNGKNTNITSYSPLSGSYSPEMGTTTGTFESGSTEWYDTIYNYLNLESRQDRNGFTLYTDEVADADYLYNQNSKLFISLDTPRTVKAKAKYALEKNLGGVFTWTADQDRGPLVNAAREGLGCPLLIKKIDMEPFYYKGKTNK

SEQ ID NO: 10428 - protein, 163 aa, Xenorhabdus bovienii
  Peptide sequence Name=Xb4151_4152.C444.gene290.pep
  Gene classification: Function=Uncharacterized BCR; Function class=S Function unknown
  Homolog annotation: Query=1..163bp; Hit=1..163bp; Blast score=216; Percent Identity=72.0; E value=8e-57; Homolog= PM1656 COG1666
MPSFDIVSEVDMQEVRNAVENAQRELTNRWDFRNVNASFELNEKNESVKIASESDFQVNQLVDILREKFAKRGVDGSVLNVAENMVHSGKTFSVEATLLQGIDTPLAKKIVKLIKDSKLKVQAQIQGEQVRVTGKARDDLQSVMTLVRGAELGQPFQFTNFRD

SEQ ID NO: 10429 - protein, 377 aa, Xenorhabdus bovienii
  Peptide sequence Name=Xb4151_4152.C444.gene291.pep
  Gene classification: Gene name=ApbA; Function=Ketopantoate reductase; Function class=H Coenzyme metabolism
  Homolog annotation: Query=74..373bp; Hit=1..300bp; Blast score=350; Percent Identity=55.0; E value=2e-96; Homolog= apbA COG1893
MMALPVTSSLSISWHDNRFPLLAKDLYSGGSAIFWHLRYFLSSFDLRSFDLRPFEISIVSRFSIKVPLISRKYMKITVLGCGAIGKLWLVALSQQNHDIQTWIRVPQPFVSVRIDNFNGKVFDQQFPANDEKHLTESELLLVCLKAWQVSDAINNLAPKLSPHCPILLLHNGMGSQEEFLPLPNPILLGVTTHGSYQENGIVYHKSQGITHIGSATANADKFSFLADVLHYALPDVAWHNEIHTISWLKLAVNCIINPLTVIYDCKNGNLLQHTAQIDLLCDEIHQVMERDNLHTTKQMLVDYVMNVIEQTSENYSSMLQDIRAQRHTEIDYITGFLLRRARAYGLPIKENTIIYQYIKRKEEEYERLRPHLPGSRQ

SEQ ID NO: 10430 - protein, 73 aa, Xenorhabdus bovienii
  Peptide sequence Name=Xb4151_4152.C444.gene292.pep
  Gene classification: Gene name=ThiJ; Function=Putative intracellular protease/amidase; Function class=R General function prediction only
  Homolog annotation: Query=1..58bp; Hit=3..60bp; Blast score=73; Percent Identity=67.0; E value=3e-14; Homolog= thiJ COG0693
MNASALICLAHGSEETEAVTTIDLLVRAEIDVTESGTATDGTLILTYSRSVKIVADTPKGSICCTASIATWCQ

SEQ ID NO: 10431 - protein, 482 aa, Xenorhabdus bovienii
  Peptide sequence Name=Xb4151_4152.C444.gene293.pep
  Gene classification: Gene name=ThiI; Function=Thiamine biosynthesis ATP pyrophosphatase; Function class=H Coenzyme metabolism
  Homolog annotation: Query=1..385bp; Hit=1..385bp; Blast score=637; Percent Identity=82.0; E value=0; Homolog= ZyajK_1 COG0301
MKFIIKLFPEITIKSQTVRLRFIKILASNIRNVLKTLSEEIAVVRHWDNIEVRAKNDNLGGEICDALTRIPGIHHILQVEERDFRDLHHIFEQAYEAYGHLLHGKTFCVRVKRRGKHSFTSNEVERYVGGGLNQHIESAKVKLTHPDVTVNLEIEQDKLILVKARHEGIGGFPIGTQEDVLSLISGGFDSGVSSYMLMRRGCRVHYCFFNLGGSAHEIGVKQVAHYLWNRFGSSHKVRFVAIDFEPVVAEILEKVDDGQMGVVLKRMMVRASSRIAERYGVQAIVTGEALGQVSSQTLTNLRLIDNASDTLILRPLISHDKEHIIKLAREIGTEDFARTMPEFCGVISKSPTVKAVKAKIEAEEANFDFEILDRVVSEAQNMDIRQIAMQACEQVVEVETVTEFSTSDVLLDIRAPDEQDDRPLSMDGIEIQSLPFYKLGTQFGDLPKEKNYLLYCERGVMSRLQALYLREQGFENVKIYRP

SEQ ID NO: 10432 - protein, 85 aa, Xenorhabdus bovienii
  Peptide sequence Name=Xb4151_4152.C444.gene294.pep
  Gene classification: Gene name=XseB; Function=Exonuclease VII small subunit; Function class=L DNA replication, recombination and repair
  Homolog annotation: Query=1..85bp; Hit=1..80bp; Blast score=74; Percent Identity=63.0; E value=2e-14; Homolog= xseB COG1722
MPKANQTSEIEQTPAFETSLKELEEIITRLESGKLPLESALNEFERGIQLARQGQKTLQQAEQRVQILLNHDAQSPLDEFSPDAE

SEQ ID NO: 10433 - protein, 322 aa, Xenorhabdus bovienii
  Peptide sequence Name=Xb4151_4152.C444.gene295.pep
  Gene classification: Gene name=IspA; Function=Geranylgeranyl pyrophosphate synthase; Function class=H Coenzyme metabolism
  Homolog annotation: Query=26..321bp; Hit=3..298bp; Blast score=362; Percent Identity=65.0; E value=1e-100; Homolog= ispA COG0142
MMHNRHLMNFRLTLSKFMSEQYKAPFEEHLSACQQHVNDKLMATFSSLPFLDSPLATAMLHGAVLGGKRLRPFLVYSVGEMFGLSRESLDAPALALECIHAYSLIHDDLPAMDNDDLRRGQPTCHIKFGESLAILAGDALQSLAFEILAKQDMPNIALSDRLAMVAELATASGLAGMCGGQSLDLEAEGKQIDLATLEQIHRHKTGALICTAVRLGAYSAGQRGREVLPLLDQYSQAIGLAFQVHDDILDVIGNTDVIGKRQGNDQQLGKSTYPALLGLEQAKKKARDLYEEALAALTELEKQSYNTVILKKLAGFIIERNS

SEQ ID NO: 10434 - protein, 621 aa, Xenorhabdus bovienii
  Peptide sequence Name=Xb4151_4152.C444.gene296.pep
  Gene classification: Gene name=Dxs; Function=Deoxyxylulose-5 -phosphate synthase; Function class=H Coenzyme metabolism
  Homolog annotation: Query=1..620bp; Hit=1..620bp; Blast score=1063; Percent Identity=81.0; E value=0; Homolog= dxs COG1154
MSIDIAKYPTLALAETPEELRLLPKDTLPKLCDELRQFLLNSVSRSSGHFASGLGTVELTVALHYVYKTPFDNLVWDVGHQAYPHKILTGRRDHINTIRQKNGLHPFPWRDESEYDTLCVGHSSTSISAGLGMAIAAKHEDKGRKTVCVIGDGAITAGMAFEAMNHAGDIDPDMLVILNDNEMSISENVGALNNHLAHLLSGKLYTTLREGGKKVFSNLPPIKELLKKTEEHLKGMVVPGTLFEELGFNYIGPVDGHDVLALTQTLKNMRELKGPQFLHIMTKKGRGYAPAEKDPIGWHAVPKFDPATGSLPKSSDTRPTFSKIFGDWLCEEAAHDKKLMAITPAMREGSGMVRFSREYPEQYFDVAIAEQHSVTFAAGLAIGGYKPIVAIYSTFLQRAYDQVIHDVAIQNLPVLFAIDRGGIVGADGQTHQGAFDLSFLRCIPNMVIMAPSDENECRQMLHTGHHYQGGPVVVRYPRGTGTGAELQPLEALPIGKGIVRRQGERIAILNFGTLLPDALQSAEALNATVVDMRFIKPLDNQLVLEIAASHDMLVTLEENAIMGGAGSGVNELLMQTSQPVPVLNLGLPDHFIPQGTQEEIRADLGLDARGIQHAIEKYLAK

SEQ ID NO: 10435 - protein, 244 aa, Xenorhabdus bovienii
  Peptide sequence Name=Xb4151_4152.C444.gene297.pep
  Gene classification: Gene name=KamA; Function=Lysine 2,3-aminomutase; Function class=E Amino acid transport and metabolism
  Homolog annotation: Query=32..244bp; Hit=138..358bp; Blast score=105; Percent Identity=32.0; E value=5e-23; Homolog= TM0121 COG1509
MLFAATHPFFFCSFLSQFKIFQKTNQLYQSSVEEVILSGGDPLMLTDNKLNESLASIREIRDDLLIRIHSRALTFNPYRITDALIETLKKYRINAFGVHVCHPFELSEEFQTAVRRIQSAVPIVFSNMPFLRGINDNEKTLHKLFIDLYRMGVKPYYLYHFMPFSPGSSEYKASINDAISIMSKLKRRISNIALPEYVLPHMKGKFTVPLFTHPQEMPYFETLNGKRYYRFINWQNEQCEWLDN

SEQ ID NO: 10436 - protein, 457 aa, Xenorhabdus bovienii
  Peptide sequence Name=Xb4151_4152.C444.gene298.pep
  Gene classification: Gene name=AccC; Function=Biotin carboxylase; Function class=I Lipid metabolism
  Homolog annotation: Query=28..325bp; Hit=21..282bp; Blast score=106; Percent Identity=28.0; E value=5e-23; Homolog= mlr6296 COG0439
MKPNAILFVDIDDAEITRYTYREPHFTAAKEMGLLCLTAALQGRQYAERLSADSDEVFYVESMTLNALRDLVHDLLDTYNLRAILCHAGHASASGQVGCIVAEICQEMELSHSSSNAIAVCNNKYLMRQILKKHDIRSVRYALCNNEEELSYQANMIGYPLIAKPPFGACSVFIKKCNNWAELQVHYQTFTAHYEHSNYTDFMGNQQEYVTPKGEKYISIPGKSLLLEEYIDGIEGTIECVINQHTIYPVLINEKLILTEKSNTVLENLLITPPVSFSPSEQEQIKNYAIACLNAVGLNNAIAHLEFRMTSEGPVIIEINPRLGGLFVNSAFRDLAGLNPYQLYLSILIQDQEVDFQLTQACKQVEQATQHYSMIVMYPDTNGHFKGIENLHYLKNQPCILECVSYANDCYINAEIEEHYLIKCWAKVEGASHAHTLHSNMLENVKPIIIPESDLIS

SEQ ID NO: 10437 - protein, 241 aa, Xenorhabdus bovienii
  Peptide sequence Name=Xb4151_4152.C444.gene299.pep
  Homolog annotation: Query=107..234bp; Hit=181..306bp; Blast score=63; Percent Identity=31.0; E value=3e-09; Homolog= gi|34498763|ref|NP _902978.1| conserved hypothetical protein [Chromobacterium violaceum ATCC 12472] gi|34104614|gb|AAQ60972.
MNITNISANLINEHYCHIPHFSKLISCDSKATKTFKNHWDNLVLDQNFKDYTHRERRILRYHYRPGIEIPFQLNQDTEYRSSVTYDIEYKKGANQLSYAEDTFINDPIMQHILSMDIAILGDRLIKGCHYSIDIHQFRVKAFAGKESPTTSGIHQDGQDWIFMHFIQGHNIAPVISEVHATTDETPPLLHTVMEQFLETLAINDRQPYHRASNIRQISPTITAFRDLLLVTFRQCPEQQES

SEQ ID NO: 10438 - protein, 408 aa, Xenorhabdus bovienii
  Peptide sequence Name=Xb4151_4152.C444.gene300.pep
  Gene classification: Gene name=ProP; Function=77 Permeases of the major facilitator superfamily; Function class=G Carbohydrate transport and metabolism
  Homolog annotation: Query=16..391bp; Hit=4..400bp; Blast score=65; Percent Identity=22.0; E value=1e-10; Homolog= PAB0724 COG0477
MSSQENSLNLRWSGLNALLIVSARFVSDFGAFLNMVALSTYVYLLSDSVMHVSIFLACRVAGGIIASLIGTPFFRRFAGRWPLVCFDLLRVILLSLLLVIPASQQLLILPMIAFGIGLGNSTFAIGLNSQLPYWVHASQRISTNSWLTSVAATGAVLGSLVSGLLVASSGYEIVFIVNIITYLLAAFLIMPLRFLTHPEQKTSRERGNEWRELIRGLRCAPMLAGMLFLSLADTLGSAAHNVGFPVISKLLTPDNASTTMGLLLATWAVGKFSGARLTSYLLRNRNLLKMEKLFFLGVALMSTGFILTFQQTSQLWLLVFAVWAGIGDGIAEVSLISRAQSEPESLRLPIFSLLTLLQMTGFGIGMLVVAPFYVWYPPSIVILIFHGLPLTVLVIILIWIRRFTTNKV

SEQ ID NO: 10439 - protein, 66 aa, Xenorhabdus bovienii
  Peptide sequence Name=Xb4151_4152.C444.gene301.pep
MIQVQHRYTKLEILHVFNNLYIRLGWPDMLSPLNQLVMASWRGCLSSLRKTSSEKQYRILRCWFLN

SEQ ID NO: 10440 - protein, 242 aa, Xenorhabdus bovienii
  Peptide sequence Name=Xb4151_4152.C444.gene302.pep
  Gene classification: Function=Predicted membrane protein; Function class=S Function unknown
  Homolog annotation: Query=10..232bp; Hit=6..226bp; Blast score=185; Percent Identity=45.0; E value=4e-47; Homolog= Cj0552 COG3819
MQQAINFWPLIGIAVIMIGFILRFNPVLVVTVAGLVTGLAAHMPITKILEKLGSGFLNTLNLPLTILLPLVIIGLLERHGLKERAQRSIAHIKTATTGRLLIVYLFIRETSAALGLTSLGGHPQMVRPLLAPMAEGAAENQYGHLPDHIRHRIRAMSAATDNTGLFFGEDIFVAFGAIIFMHNFMLESGGIQTEPLHIALWGIPTAICAFLIHSVRLYRLDYYLAREITSLNHMELTSKEAK

SEQ ID NO: 10441 - protein, 338 aa, Xenorhabdus bovienii
  Peptide sequence Name=Xb4151_4152.C444.gene303.pep
  Gene classification: Function=Predicted membrane protein; Function class=S Function unknown
  Homolog annotation: Query=1..337bp; Hit=1..316bp; Blast score=215; Percent Identity=42.0; E value=6e-56; Homolog= CC1199 COG3817
MFQLQYLYYLAGFILLVVAVMSWRDRANPRRLTTGLFWGLYGLIFLIGNWSYQLMAIWISDEDQAQKIVHISVGTLVIIIALLAGFGGVRLGNYHQPTTEQKQKSAERLGNRLFLPALLIPVVTIVGVLLFNHIPGLQQTVFGADNHSTLVTLFSIALGCLAGLIIALRMTRENIMQPIQETRRLLDSIGSVFILPQILATLGLLFTAAGVGTVISYLTENYLAVDNRFIAVIAYVLGMAVLTMIMGNAFAAFPIVTAGIGIPILILQHGGNPAVMAAIGMFSGYCGTLMTPMAANFNLVPAALLELPDRNAVIKAQIPTGCTLVLTNVFLLYFLMFL

SEQ ID NO: 10442 - protein, 215 aa, Xenorhabdus bovienii
  Peptide sequence Name=Xb4151_4152.C444.gene304.pep
  Gene classification: Gene name=Pcp (BS); Function=Pyrrolidone -carboxylate peptidase (N-terminal pyroglutamyl peptidase); Function class=O Posttranslational modification, protein turnover, chaperones
  Homolog annotation: Query=2..215bp; Hit=3..215bp; Blast score=225; Percent Identity=51.0; E value=3e-59; Homolog= BS_pcp COG2039
MKTILVTAFDPFGGEAINPSWEAIKPLQGSQVFGANIEICQIPCIFDTSLEHLYAAVDKYQPELVISVGQAGGRTNITVERVAININDARIPDNAGNQPIDTPVIVDGPAAYFSRLPIKTMVNALNTAGIPASVSQTAGTFVCNHVMYGLLHYLAQNTPSVRGGFIHVPYLPEQAVKDGNQSSMTLMLMTLALKIAIETAWKNTSDIAVTGGATH

SEQ ID NO: 10443 - protein, 163 aa, Xenorhabdus bovienii
  Peptide sequence Name=Xb4151_4152.C444.gene305.pep
  Gene classification: Gene name=PgpA; Function =Phosphatidlglycerophosphatase A and related proteins; Function class= I Lipid metabolism
  Homolog annotation: Query=2..158bp; Hit=9..165bp; Blast score=172; Percent Identity=61.0; E value=1e-43; Homolog= pgpA COG1267
MDDAKRRLRMRNPWHLLATGFGSGLSPIMPGTMGSLAAIPFWLLLVQLPEWGIWLVILLGTVIGCVICQKAADAMQVEDPGCVVWDEFIGIWITLMAIPVLNWQWVLVAFVVFRIFDMWKPWPIRWFDRYVKGGIGIMLDDIIAAIFAVIVIWLLNFYPLLPF

SEQ ID NO: 10444 - protein, 360 aa, Xenorhabdus bovienii
  Peptide sequence Name=Xb4151_4152.C444.gene306.pep
  Gene classification: Gene name=ThiL; Function=Thiamine monophosphate kinase; Function class=H Coenzyme metabolism
  Homolog annotation: Query=13..334bp; Hit=1..322bp; Blast score=470; Percent Identity=70.0; E value=1e-132; Homolog= ZthiL COG0611
MCSSLVTFWNSIMACGEFELIARYFNRHVIRRRDVNLGIGDDCALMTVAEKQELAVTTDTLVAGVHFLPDISPEDLAYKALAVNISDLAAVGADPAWASLALTLPDVNEDWLKRFSDSLFEQLNYYGMQLIGGDTTKGPMSLTLTVHGLVPAGRALRRAGAKNGDWIYVTGTLGDSAAGLALLQDRFTVEDTAIHNWLVKRHLRPQPRILQGQALRDLATSAIDLSDGLISDLNHILTTSQCGARINLDALPYSEAVQKYATPEQALTWALGGGEDYELCFTVPELNRGALNMALAHTGASFCCIGQIRPESEGIRFFNKNKEIELDLKGFDHFKPEKKPLAVCQVSQQTQNDQTEGTHG

SEQ ID NO: 10445 - protein, 138 aa, Xenorhabdus bovienii
  Peptide sequence Name=Xb4151_4152.C444.gene307.pep
  Gene classification: Gene name=NusB; Function=Transcription termination factor; Function class=K Transcription
  Homolog annotation: Query=1..138bp; Hit=1..138bp; Blast score=199; Percent Identity=78.0; E value=1e-51; Homolog= nusB COG0781
VKPAARRRARECAVQAIYSWQLSKNDIADVEFQFLSEQDVTGVDITYFRELLTGVAVNAAKLDALMAPYLSRQLEELGQVEKAILRVAMFELSFRDDVPYKVAINEGIELAKTFGAEDSHKFVNGVLDKAGPAARKKK

SEQ ID NO: 10446 - protein, 156 aa, Xenorhabdus bovienii
  Peptide sequence Name=Xb4151_4152.C444.gene308.pep
  Gene classification: Gene name=RibH; Function=Riboflavin synthase beta-chain; Function class=H Coenzyme metabolism
  Homolog annotation: Query=1..155bp; Hit=1..155bp; Blast score=219; Percent Identity=81.0; E value=6e-58; Homolog= ribH COG0054
MNVIKGVVAAPKARIAIAIARFNNFINDSLLEGALDALERIGQVSSDNITVVWVPGAYELPLTVKALTETQKYDAVIALGTVIRGGTAHFEYVAGECSSGLSSVAMSSDIPVAFGVLTTESIEQAIERAGTKAGNKGAEAALTALEMINVIKAIKG

SEQ ID NO: 10447 - protein, 396 aa, Xenorhabdus bovienii
  Peptide sequence Name=Xb4151_4152.C444.gene309.pep
  Gene classification: Gene name=RibD; Function=Pyrimidine reductase, riboflavin biosynthesis; Function class=H Coenzyme metabolism
  Homolog annotation: Query=172..392bp; Hit=1..221bp; Blast score=310; Percent Identity=66.0; E value=2e-84; Homolog= ZribD_2 COG1985
MFANLAKKLPDYKIEYAGFQKIRLSKTMTLDEKYMSRALELANQGRFTTSPNPNVGCVIVQGDHIVGEGFHVCAGEPHAEVHALRMAGGKAKGATAYVTLEPCSHHGKTPPCADALIAAGISRVVAAMQDPNPQVAGRGLYKLQQAGIAVEHGVLMAEAEALNKGFLKRMRTGFPYLQLKMGASLDGRTALASGESKWITSPEARQDVQQFRAQCSAILSSSATVLADDPSLTVRWHELDAEIQAIYPQEQVRQPIRIIVDSQNRVTPQHQVVQQVGQCWLARTHTDQQQWPDNVDHIVLPAHGGGVDLVLLMMQLGKRQINSVWAECGPVLAGALLSLGLVDELILYIAPKVLGNTARGLFAIPELQKLSDAPEFTLFDVRQIGSDVRLRLRPAS

SEQ ID NO: 10448 - protein, 149 aa, Xenorhabdus bovienii
  Peptide sequence Name=Xb4151_4152.C444.gene310.pep
  Gene classification: Function=Predicted transcriptional regulator, consists of a Zn-ribbon and ATP-cone domains; Function class=K Transcription
  Homolog annotation: Query=1..149bp; Hit=1..149bp; Blast score=238; Percent Identity=85.0; E value=2e-63; Homolog= ybaD COG1327
MHCPFCAAVDTKVIDSRLVGDGSQVRRRRQCLECHERFTTFEIAELVMPRVIKSDDIREPFDEEKLRRGMLKALEKRPVSSDDVETAIIHIKSQVRATGEREIPSKMIGNFVMDALKKLDKVAYIRFASVYRSFEDVREFGEEIARLQD

SEQ ID NO: 10449 - protein, 322 aa, Xenorhabdus bovienii
  Peptide sequence Name=Xb4151_4152.C444.gene311.pep
  Gene classification: Gene name=SecF; Function=Preprotein translocase subunit SecF; Function class=N Cell motility and secretion
  Homolog annotation: Query=1..322bp; Hit=1..323bp; Blast score=488; Percent Identity=78.0; E value=1e-138; Homolog= secF COG0341
VAQDYTVEQLNYGRKVIDFMRWDNVAFGISLLLLVASIITMGVRGFNWGLDFTGGTVIEINLSKPADLDKMRESLTKNGFADPLLQNFGSSRDVIVRMPPVTGNAGQELGNKIISVINANIDKDAVVKRVEFVGPSVGSELAQTGAMALLAALISILIYVGFRFEWRLALGAVIALAHDVIITLGVLSLFHIEVDLTIVASLMSVIGYSLNDSIVVSDRIRENFRKIRRGTPYEIMNVSLTQTLSRTIMTSATTLLVVLMLYIFGGEMLKGFSLAMLIGVSIGTISSIYVASALALKLGMKREHMIQQKVEKEGADQPSILP

SEQ ID NO: 10450 - protein, 604 aa, Xenorhabdus bovienii
  Peptide sequence Name=Xb4151_4152.C444.gene312.pep
  Gene classification: Gene name=SecD; Function=Preprotein translocase subunit SecD; Function class=N Cell motility and secretion
  Homolog annotation: Query=1..604bp; Hit=12..615bp; Blast score=922; Percent Identity=80.0; E value=0; Homolog= secD COG0342
MLIAAILIGLLYALPNLYGEDPAVQITGARGIAASEKTLDQVRNVLEKEQIKSKSIALENGAILARFNNSDVQLRAREALVSALGEQYVVALNLAPATPLWLSKVGAEPMKLGLDLRGGVHFLMEVDMETALSKLQEQNIDSLRSELRDQGILYSSVRKLDNYGVEVRFRDNDARSKAESYLEPRHRDLVFSTGANSTLKVVMSDDRLREARTYAVQQNITILRNRVNQLGVAEPLVQRQGADRIVVELPGIQDTARAKEILGATATLEFRLVNSNVDQSAAVSGRIPGDSELKYTRDSNPVVLYKRVILTGDHITDSTSSTDEYGNPQVNISLDGAGGSAMSNFTKDNLQKPMATLFVEYKDSGKKDANGRSVLVKQEEVINIATIQSRLGNSFRITGIGNLNEARQLALLLRAGALIAPIQIVEERTIGPTLGLQNIKQGLEACLWGLISSILFMVIYYRKFGLIASSALLANLVLIVGVMSLLPGATLTMPGIAGIVLTLAVAVDANVLINERIKEELRNGRTVQQAIHEGYKGAFSSIIDANLTTLITAVILYAVGTGSIKGFAITTSIGVATSMFTAIVGTRAVVNLLYGGKRINKLSI

SEQ ID NO: 10451 - protein, 112 aa, Xenorhabdus bovienii
  Peptide sequence Name=Xb4151_4152.C444.gene313.pep
  Gene classification: Gene name=YajC; Function=Preprotein translocase subunit YajC; Function class=N Cell motility and secretion
  Homolog annotation: Query=1..112bp; Hit=1..110bp; Blast score=172; Percent Identity=82.0; E value=5e-44; Homolog= yajC COG1862
MSFFISDAAASAGASAQSQGSPYSLIIMLVVFGLIFYFMILRPQQKRTKEHKKLMDSIAKGDEVLTSGGLVGRVSKVSETGYVVVALNDTTEITVKRDFVAAILPKGTMKAI

SEQ ID NO: 10452 - protein, 374 aa, Xenorhabdus bovienii
  Peptide sequence Name=Xb4151_4152.C444.gene314.pep
  Gene classification: Gene name=Tgt; Function=Queuine/archaeosine tRNA- ribosyltransferase; Function class=J Translation, ribosomal structure and biogenesis
  Homolog annotation: Query=1..374bp; Hit=1..374bp; Blast score=704; Percent Identity=87.0; E value=0; Homolog= tgt COG0343
VKFELQKTDGNARRGRLIFERGVVETPAFMPVGTYGTVKGMTPEEVKETGAQILLGNTFHLWLRPGQEIMKLHGDLHDFMQWHGPILTDSGGFQVFSLGAMRKIKEEGVHFRNPINGTPVFLSPEKSMEIQHDLGSDIVMIFDECTPYPADWDYAKRSMEMSLRWAARSRQRFNELGNKNALFGIIQGSVYEDLRDVSVKGLVEIGFDGYAVGGLAVGEPKEDMHRILEHVCPQIPQDKPRYLMGVGKPEDLVEGVRRGIDMFDCVMPTRNARNGHLFVTEGVIKIRNAKHKEDTSTLDEHCDCYTCRHYSRAYLHHLDRCNEILGARLNTIHNLRYYQRLMAGIRKAIEENKLEQFVEEFYQRIGKPVPSLNI

SEQ ID NO: 10453 - protein, 355 aa, Xenorhabdus bovienii
  Peptide sequence Name=Xb4151_4152.C444.gene315.pep
  Gene classification: Gene name=QueA; Function=S-adenosylmethionine; Function class=J Translation, ribosomal structure and biogenesis
  Homolog annotation: Query=1..354bp; Hit=1..354bp; Blast score=587; Percent Identity=82.0; E value=1e-168; Homolog= queA COG0809
MRVADFTFELPEELIAHYPQPQRSGCRLLALDGKTGGLTHGIFTDVLDKLEAGDLLVFNNTRVIPARLFGRKATGGKLEVLVERMLDNKRVLAHVRASKALKEGAELLLGEDESIRATMLARHDTLFEIRFDDDRDVLTILDEIGHMPLPPYIARPDEESDRELYQTVYSERPGAVAAPTAGLHFDEPLLAALREKGVDMAFVTLHVGAGTFQPVRVETIEDHIMHAEYAEVPQNVVDAVLACKARGNKVVAVGTTSVRSLESAARACQNGLIEPFFDDTQIFIYPGFEYQVVDALITNFHLPESTLIMLVSAFAGYQNTMNAYKEAVAEKYRFFSYGDAMFIHRNPMATKEKVS

SEQ ID NO: 10454 - protein, 207 aa, Xenorhabdus bovienii
  Peptide sequence Name=Xb4151_4152.C444.gene316.pep
  Gene classification: Function=Uncharacterized BCR; Function class=S Function unknown
  Homolog annotation: Query=1..193bp; Hit=1..193bp; Blast score=204; Percent Identity=60.0; E value=4e-53; Homolog= ZyajB COG3124
MNFLAHLHLAALSESSLLGNLMADFVRGSPKGLFSPDIVEGIRLHRRIDSLTDSHPWVTEACTLFRSEYRRVAPITLDIIWDHFLSLHWDKLEKNYSLPEFVHLARSQIEPHLSFTPEKFQALNKYLWSENLLIRYADMSCIANVLKGMAHRRPKLSALAGSYQDIEMHYLDFEALFWKFYPHMMALATNKRLLEQDISPEPCTFSK

SEQ ID NO: 10455 - protein, 200 aa, Xenorhabdus bovienii
  Peptide sequence Name=Xb4151_4152.C444.gene317.pep
  Gene classification: Gene name=AhpC; Function=Peroxiredoxin; Function class=O Posttranslational modification, protein turnover, chaperones
  Homolog annotation: Query=1..200bp; Hit=1..200bp; Blast score=352; Percent Identity=82.0; E value=1e-97; Homolog= PM0795 COG0450
MVLVTRQAPDFTAAAVLGNGEIVDNFNLKNHLNGRPAIIFFWPMDFTFVCPSELIAFDHRYEEFKKRGVEVIGISFDSEFVHNAWRKTPISEGGIGEVKYPMVADIKRDIMKSYGIEHPEAGVALRGSFLIDKNGVVRHQVVNDLPLGRNIDEMLRMVDALQFHEEHGEVCPAQWAKGQEGMGASPEGVAKYLTKNADKL

SEQ ID NO: 10456 - protein, 587 aa, Xenorhabdus bovienii
  Peptide sequence Name=Xb4151_4152.C444.gene318.pep
  Gene classification: Gene name=Ggt; Function=Gamma -glutamyltranspeptidase; Function class=E Amino acid transport and metabolism
  Homolog annotation: Query=10..587bp; Hit=15..579bp; Blast score=584; Percent Identity=52.0; E value=1e-167; Homolog= mlr5711 COG0405
MLKAWKMPFVAVSLLVSSSLYAAYEPAVEAKQGMVVSSQYLASQVGVDILKMGGNAIDAAVAVGYAQAVVNPCCGNIGGGGFMTIHLANGKDTFINFRETAPAAASANMYLDKDGSVIKGASLYGYKAIGVPGTVMGLDAALHKYGSMTREQVMAPAIKLAREGYILTRGDTDILDTTVKRFTQDPEAARIFLRKDGTPFQPGDKLVQTDLANTLELIAKKGPDIFYHGKIPQLVEESSKKSGGIITAADFANYNITETTPVTCSYRGYKFISSPPPSSGGVTLCEILNIVEGYDLKSMGFNSAAYIHTLTEAMRHAYMDRNTYLGDPQFIKNPLDRLLSKSYAESIRKEIEPNKATSSKNVQPGVGPHEKPETTHYSVVDKDGNAVSTTYTINGRFGAVVIAPGTGFFLNDEMDDFTTKVGEKNLYGLVQGATNSIAPGKRPLSSMSPTLVTKDNKIFLVLGSPGGSRIISITLQAALNILDFGMPPQEAVNSPRIHHQWLPDEVYYEQRGLSKDTLNMLEKMDYKMVEQTPWGAAELIMIGLPGAVGVSPTNSSGNDSAVSGVVREGYIYGSNDVRRPAGAAIGY

SEQ ID NO: 10457 - protein, 446 aa, Xenorhabdus bovienii
  Peptide sequence Name=Xb4151_4152.C444.gene319.pep
  Gene classification: Gene name=BrnQ; Function=Branched-chain amino acid permeases; Function class=E Amino acid transport and metabolism
  Homolog annotation: Query=1..432bp; Hit=1..431bp; Blast score=536; Percent Identity=70.0; E value=1e-152; Homolog= brnQ COG1114
MAYRLSSKDIWALGFMTFALFVGAGNIIFPPMVGLQAGENVWIAALGFLLTAVGLPVITVIALAKVGGGIEALSSPIGKTAGLILATVCYMAVGPLFAIPRTATVSFEVGIAPLMGSGKLPLFIYSIVYFSLVILVSLYPGKLLDSVGRVLAPIKILALGILGIAAVLWPASDPIPAIQTYKEIPFSNGFVNGYLTMDTLGAMVFGIVIVNAARSRGIESSSLLTRYTMWAGLIAGLGLVLVYLSLFKLGESSGTLVPKAENGAVILHAYVQNVFGGYGSFFLAVLIFVACMVTAVGLTCACAEFFSRYLPLSYRTLVFILGIFSMLVSNLGLDHLIKFSIPVLTAIYPPCIALILLSFTVRWWNNVTRILAPAMVVSLLFGVLDAAKSSEYLSHLLPAWAIHLPLADKGLAWLLPTILAVVVCALYDLIVGESKVPKREVQQDQG

SEQ ID NO: 10458 - protein, 70 aa, Xenorhabdus bovienii
  Peptide sequence Name=Xb4151_4152.C444.gene320.pep
MLAFWRYKSFTCGQLLAILAVITTIILYFPIISEYYVDHLLSKQNPVSPVKIQVFAILAIAHAILLTTIY

SEQ ID NO: 10459 - protein, 437 aa, Xenorhabdus bovienii
  Peptide sequence Name=Xb4151_4152.C444.gene321.pep
  Gene classification: Gene name=BaeS; Function=Signal transduction histidine kinase; Function class=T Signal transduction mechanisms
  Homolog annotation: Query=1..427bp; Hit=1..427bp; Blast score=540; Percent Identity=64.0; E value=1e-153; Homolog= ZphoR COG0642
VLERLSWKKLVLGLVLFCLPAVILSLFIGYLPWLLVIGLFLALVWHGYNLLKLSDWLWLDRSMLPPAGRGGWEPIFYGIYQLQQRNRKRRRELALLIKRFRSGAESLPDAIVMMTTEGNIFWCNRLAQHLLGFRWPEDNGQHIFNLLRYPDFSRYITASHFSRPLSIELNNGRMVEFRVMPYAERMLLMVARDITQKRLLENARRDFFSNVSHELRTPLTVLQGYLEMMQEQELNDRANQKVLSTMQEQVRRMDGLVKQLLHLSRIEAGPQVDMNEVVDVPDLLVLLQQEALALANNQQDIVFNIDEKLKVFGNEEQLRSAMSNLVYNAINHTPPGTRIEVSWSKSSQGAWFKVQDNGSGISAEHLPRLTERFYRVDRARSRQTGGSGLGLAIVKHALHHYNTHLEVSSTMGKGSTFSFLLAPGLIVSAKPNLIKKQ

SEQ ID NO: 10460 - protein, 229 aa, Xenorhabdus bovienii
  Peptide sequence Name=Xb4151_4152.C444.gene322.pep
  Gene classification: Gene name=OmpR; Function=Response regulators consisting of a CheY-like receiver domain and a winged-helix DNA -binding domain; Function class=T Signal transduction mechanisms
  Homolog annotation: Query=1..229bp; Hit=1..229bp; Blast score=375; Percent Identity=81.0; E value=1e-104; Homolog= phoB COG0745
MAKRILVVEDEVQIREMVCLVLEQNGYQTVEAEDYDVAVWRLSEPYPDLVLLDWMLPGGSGIQLIKQMKRDSSTRDIPVMMVTARGEEEDRVRGLDVGADDYITKPFSPKELVARIKAVLRRVSPMSAEDIINMDGLILDSSSHRVSSQGQNVEMGPTEFKLLHFFMTHPERVYSREQLLNYVWGTNVYVEDRTVDVHIRRLRKALEVGGHDRMVQTVRGTGYRFSTRY

SEQ ID NO: 10461 - protein, 404 aa, Xenorhabdus bovienii
  Peptide sequence Name=Xb4151_4152.C444.gene323.pep
  Gene classification: Gene name=SbcD; Function=DNA repair exonuclease; Function class=L DNA replication, recombination and repair
  Homolog annotation: Query=1..402bp; Hit=1..395bp; Blast score=473; Percent Identity=60.0; E value=1e-133; Homolog= sbcD COG0420
MRIIHTSDWHLGQYFFTKNRAAEHQHFLQWLIEQIIRHQVDALVIAGDIFDTGSPPSYARELYNQFVVELRPTGCQLVILGGNHDSVATLNESKALFSCLNTTVIASADADIQQQIKVLNNKNGEAGAILCAIPYLRPRDIMTSQAGQSATQKQQALQNAITEHYHQLYQQADALREKLGQPLPIIATGHLTTVGASTSDSVRDIYIGTLDAFPAQAFPPADYIALGHIHRPQIIAKSEHIRYSGSPIPLSFDEVGQEKSVCLVDFKEDKFDNVTLLPIPNYQPMQLIRGNLQQIEAQLQTFKAYQGERPVWLDIEVATQDYLPDIQKRIQTMTTDLPVEIILLRRRKAARQISLSETNKETLNELSVHEVFERRLALAEIEDQPQKQRLTTLFKQTLDDISQQ

SEQ ID NO: 10462 - protein, 1226 aa, Xenorhabdus bovienii
  Peptide sequence Name=Xb4151_4152.C444.gene324.pep
  Gene classification: Gene name=SbcC; Function=ATPase involved in DNA repair; Function class=L DNA replication, recombination and repair
  Homolog annotation: Query=1..1226bp; Hit=1..1046bp; Blast score=520; Percent Identity=39.0; E value=1e-147; Homolog= ZsbcC COG0419
MKILSLRLKNINSLQGEWKIDFTAEPFASNGLFAITGPTGAGKTTLLDAICLALYHETPRLGTISAIQNELITRHTAECLAEVEFEVKGVAYRAFWSQRRARNQADGKLQPPKGELVDKRTGKILADKIPDKKEKIAEITGLDFKRFTKSILLSQGDFAAFLNADDKDRADLLEELTGTEIYGILSQEIYQRHKQAQSELNIQQATASSIELLTPEQIENYQNEQQQLTAAETQLSQQIKAFRSAEQWLIRQNELQQSIAGNTLLLQQAEQAIQNAQPQLQQLTASEPAEKIRSLWDAQNRAFSEKQRITEQRIKIEHDRQQQLSLLQPAQQQLTDLEKTREEHQQQQIQQEKLISEQVIPLDHKIDTQSKDLLTLEKEITKQDRELTEISAQYQVAQSRKDTLHNEQKTLETYDDQHPYCRSLDSKLPEWKQLFSRQKEKQVQIAKLTQKTQQIGTELARITDHLNTLNAELAEQTEQNQPLHDNLILTEKQLIDLQKIHPLEQLQKQLSDYQEQLKSQNQLEILLPQIQQLQATISTNQTQLSQSQALLEPLPTQISTLDQQLTEKQQHHEDLADRIRLEQRITSLEQERSQLKEGEACPLCGATQHPLVTEYQNIALSQSEERLKSLRHQIDQLQTNRSALQQKQQIQQKNNQQLQQNTTQLTEKLTKITQQWKHHCQQLQSAELPMETDPVDNFIGQRQTAYQQYQRQYDALLHAEKVHQAAEKALSANREQHKASEQAIELEKVKLDSHQKQLAENTAELQQAETEYTTTTELLVSELQHTPFTLPSLQEVTIWLQQRETELKTYHDSRERWQQLQQEQAALQSQSNELEKQKTKLTILLHALNEKQQQQKQLLEQITQERHHLFGERSVSTVRQTLQQKTNELDIAYKQATSHLQQRQNVMNQLTGAVSEIERNSNTAETQCKLTASAFQSGLEQQGFADQSAFEQALLEPEQREKLQQLQEQLTQYHLQAKTRHHESETALQRHAETQPQLLEQYEPTQVSVILANISEELKRNNQQQGEVKTILNSDAMRRQKQQTLLTQISHLQQNYDDWSYLNNLIGSADGAKFRRFAQGLTLDHLVHLANIRLEKLHGRYDLQRKDDGGLELQIVDTWQADAVRDTKTLSGGESFLVSLALALALSDLVSNKTQIESLFLDEGFGTLDPETLDIALDALDHLNASGKTIGVISHVEAMKERIPVQIKVEKVNGLGVSRLASEFRV

SEQ ID NO: 10463 - protein, 43 aa, Xenorhabdus bovienii
  Peptide sequence Name=Xb4151_4152.C444.gene325.pep
MPLIDLINWNNRNVFNHHIKRLLIKLFIIHFTGFFNQMIKNFI

SEQ ID NO: 10464 - protein, 540 aa, Xenorhabdus bovienii
  Peptide sequence Name=Xb4151_4152.C444.gene326.pep
  Gene classification: Gene name=OppA; Function=ABC-type dipeptide/oligopeptide/nickel transport systems, periplasmic components; Function class=E Amino acid transport and metabolism
  Homolog annotation: Query=18..540bp; Hit=17..543bp; Blast score=525; Percent Identity=47.0; E value=1e-149; Homolog= oppA COG0747
MNKITINKKIKILSCAIAMMLGNIALSHAAVVLDGIKLASKQEVVRNNGAEPASLDVHKVSSDVEFNIIHDFFDGLVYTDRKGHIEPRLAERWETRDNKTWVFHLRKDIKWSDGAPITANDIVFSWRRLVDPDIVSPYGSYLENAAIVNANDVLRGKKKGEELGVKALDDVTLEVSLDKPMGDFLQILTHPVMVPLNEKVIKKYGNKWTRPESFVGSGPFKLSEWVVNEKVIGVRNPHYWDDKNTVINKVTYLPLSSDKADLNRYLAGEIDITNTIPLDSFESLKNTMNDQIYISPQTGVYFYEINNKKPPFDNMKVRQALNLAVDREVIVKKILGQGQKPAYTIVPPNVGGFKFTEPDYASWTQARRIEKAKTLLNEAGFNQNNPLRFNLIYNTSEAHKKIAIAVSSMWKKNLGVDAVLQNQEWKVMLDNMHQGKFDVIRRAWIADYNSPMTFLSMFMSGQVKNTSLYENNNYDALIKKAGETNDKLYYQQGLDVITTDSPVIPIYYYINAKMVKPYVGGFYVNPMGYISTKKIYIIQH

SEQ ID NO: 10465 - protein, 544 aa, Xenorhabdus bovienii
  Peptide sequence Name=Xb4151_4152.C444.gene327.pep
  Gene classification: Gene name=OppA; Function=ABC-type dipeptide/oligopeptide/nickel transport systems, periplasmic components; Function class=E Amino acid transport and metabolism
  Homolog annotation: Query=9..544bp; Hit=4..543bp; Blast score=534; Percent Identity=49.0; E value=1e-151; Homolog= oppA COG0747
MKKNKIELITKKIIKSLSCSIVIIMGNMTLSHAAVVPPGTQLADKQEIVRNNGSEPASLDVHKVESDTEFNIIHDFFDGLVYTDNKGDIIPKLATSWETKDNQTWIFHLRKGAKWSDGSPITAHDVVFSWQRLLNPQMGSPYGSYLVNATVVNANDILTGKKQAEDLGIKALDDFTLEVKLDRPVGDFLQMLAHPVMVIVSEKAIKKYGDKWTKPEYFVGSGPFKLSEWVVNEKVIGVRNPHYWDDKNTVINKVTYLPLSSDKADLNRYLAGEIDITLTIPLESFASLKKNSGEQIYISPRLGVYYYEFNIQKPPFNDVRVRQALSLAVDRDIIANKVLGQGQKPAYTLLPPKTGGFDFQQPDYASWTQNQRIEKAKSLLNEAGFNQNNPLRFNLLYNTSEAHKKIAIAVSSMWKKNLGVDAVLQNQEWKVMLDNKYQGKFDVARYGWVGDYNSPMSFLNIFMSDSTQNSSKYSNKDLDELVIKSGETNKKDYYQQAMDIFTNDSPVITVYYYINAKMVKPYLGGVYIDPRGYVSTKDLYIIKH

SEQ ID NO: 10466 - protein, 544 aa, Xenorhabdus bovienii
  Peptide sequence Name=Xb4151_4152.C444.gene328.pep
  Gene classification: Gene name=OppA; Function=ABC-type dipeptide/oligopeptide/nickel transport systems, periplasmic components; Function class=E Amino acid transport and metabolism
  Homolog annotation: Query=10..541bp; Hit=3..540bp; Blast score=527; Percent Identity=50.0; E value=1e-149; Homolog= VC1091 COG0747
MKDIMTKFIKNKTTKILTCSIAIILANIAQSHAAVVPPGTQLADKQEIVRNNGSFPASLDVHKVESNVELNIIHDFFDGLVYTDSTGNIVPRLAESWETKDNQTWIFHIRKGSKWSDGSPITAHDVVFSWQRLLDPEIGSPYSSYLGSAFVVNANDILSGKKKKQELGVKATDDFTLEVKLEKPVAYLLQMLTHPTLVPISEKAVKKYGDKWMQPDVFVSSGAFKLSEWKVNENVVGVRNPQYWDDKNTVINKVTYLSVVSEKADLNRYLAGEIDITQSIALDSFASLKKKLGDQVHIAPMLSTYYYVFNTKKPPFDDVRVRQALSLAVDRDVIADKVLGQGQRPAYDIIPPNTGGFNLVPPEAASWTQEQRIKKARELLNEAGFNQDNPLQFNLLYNTREAHKKIAIAVTSMWKKHLGVQANLQNQEWKVMLDNMHQNKFDVVRYAWTADYNSPMSFLDTFITGSSHNIPLYENSDFDQMVIKAGETNDIIYYQKAMNIFTNDMPIIPIYYYVSNKLVKPYVGGIYINPMDYISTKDLYIIKH

SEQ ID NO: 10467 - protein, 549 aa, Xenorhabdus bovienii
  Peptide sequence Name=Xb4151_4152.C444.gene329.pep
  Gene classification: Gene name=OppA; Function=ABC-type dipeptide/oligopeptide/nickel transport systems, periplasmic components; Function class=E Amino acid transport and metabolism
  Homolog annotation: Query=10..549bp; Hit=1..543bp; Blast score=488; Percent Identity=45.0; E value=1e-138; Homolog= oppA COG0747
MENINMQNFMVSLIKNKVAKALTCIVSLILGSVTYSYAAIIPSGTQLADKQEITRNNFSEPVSLDPHKSDSSSEFDILRDFFERMVAIDKEDKIIPALAERWETNDNKTWVFHLRKGIKWSDGSPITAHDVVFSWRRMVTPDIISPYGSYLVQATVVNAYDVLSGKKKPEELGVKALDDATIEVTLGRPKADLLQMIAHPVMSPISEKVVKKYGNKWTQPEFFVSNGPFKLSEWIVNEKIVGVRNPYYWDDKHTVINKVTYLPLSDYKADLNRYMAGELDISNGGPSDFFPTLKKKFGDQFHISPIMSVYYYLFNTQKPPFNDVRVRQALTLALDRAIITDKVLGNGQKPAFDVVYPGSGGIFLKHPDYASWTQEQRVAKAKALLNEAGFNENNPLKFTLLYNTSDTHKKIAIAASSMWKKNLGVEVVLQNQESKSLYDTMSQGNFEVVKYAWNADYNSPTSFLDIFTTGNTNNIPQYSNKKFDQWVLKADETNDKIYYQRALDILTQDSPAIPVYYYVRTKLVKPYVGGVHISPLGDVPTKDLYIIKH

SEQ ID NO: 10468 - protein, 222 aa, Xenorhabdus bovienii
  Peptide sequence Name=Xb4151_4152.C444.gene330.pep
  Gene classification: Gene name=UshA; Function=5'-nucleotidase/2',3' -cyclic phosphodiesterase and related esterases; Function class=F Nucleotide transport and metabolism
  Homolog annotation: Query=7..219bp; Hit=348..567bp; Blast score=136; Percent Identity=38.0; E value=1e-32; Homolog= DR0505 COG0737
MTSRALKLCPLLSAYEKIATPLANSVIGKLESSLTQQTTRGGESSLGKVIADAHLFTTAPKKAGGAQLAFVNSGGIRAPMDAGDVTYNAIYTVQPFSNILVTKTLTGEQIKRLLEQQWDRSRPQVLAISHSFEYAWDSSKPVGNRVMFSSMKINGKPVDLKAKYRVAANEYLATGGSNFSVFKEGTNSVYSVPDIEAIVNYFAKKSPIIYPKQDRIVDINRK

SEQ ID NO: 10469 - protein, 106 aa, Xenorhabdus bovienii
  Peptide sequence Name=Xb4151_4152.C444.gene331.pep
  Gene classification: Gene name=UshA; Function=5'-nucleotidase/2',3' -cyclic phosphodiesterase and related esterases; Function class=F Nucleotide transport and metabolism
  Homolog annotation: Query=6..101bp; Hit=5..121bp; Blast score=58; Percent Identity=36.0; E value=1e-09; Homolog= DR0505 COG0737
MRFFKLLPIVLALTAAGCATKPADDTANRVDVRVLALNDFHGALKAPGANQPGGIEHMATLLKELKQENPNNIVVAAGDMIGASPLLSSMFHDEPSIEALSLAVCL

SEQ ID NO: 10470 - protein, 650 aa, Xenorhabdus bovienii
  Peptide sequence Name=Xb4151_4152.C444.gene332.pep
  Gene classification: Gene name=UshA; Function=5'-nucleotidase/2',3' -cyclic phosphodiesterase and related esterases; Function class=F Nucleotide transport and metabolism
  Homolog annotation: Query=10..648bp; Hit=9..647bp; Blast score=910; Percent Identity=66.0; E value=0; Homolog= cpdB COG0737
MKNVLKISTLAMLVAFNVNAATVDLRVMETSDIHSNLIDFDYFKNKPTEQFGLVRTANLIKAAKAEATNAVLVDNGDLIQGSPLADYMAAKGLKKGDVHPAHKLMNTMGYTVGNFGNHEFNFGLDYLKQAIAGAKFPYINANIMDAKTGKNYFTPYIIVDTPVKDREGKEHTIKIGYIGFVPPQITIWDKANLDGKVVVNDITETAKKLVPQMKKEGADLIVAIPHSGFSQEPYKAMAENSVYYLSEVSGINAIMFGHSHGVFPSQEYAGIKGVDVANGTVNGIPAVMPGQWGDHLGVVDLVINNDSGEWKTESAKAEARPIYDKAHKKARVERDNKLAAIIEKEDEGTRKFVGKFIGKASADMYSYLALIQSDPTVQIVNDAQIDYTKRFIQGDPDLADLPVLAAAAPFKVGGRKNAPADFVEVEKGDQTFRNAADLYLYPNTLVVVKASGADVVQWLECSAGMYNQIDPNSAKPQNLLNWNGFRTYNFDTISGVDYKIDLTQPAKYDTDCQLLNKEANRIKDVTYQGKPIDPKATFLIATNNYRSYGGKFAGTGDNHIAFASPDENRTILASYISRITKEKGIVSTQAENNWSFLPIKTDKKLDVRFETSPTEKAAIFIKSHAQYPVKYLKNDDVGFAVYQIDLTEKK

SEQ ID NO: 10471 - protein, 130 aa, Xenorhabdus bovienii
  Peptide sequence Name=Xb4151_4152.C444.gene333.pep
MKNMKSLAALIGLLVIFGSVNSATVYNDKGTQMELNGQFRLKAQVTSQDRDIRMLDDGSRIGISGSHELTKAIKVFGKMKWGSDTQKTNSDNYETSFDMFNRVGYLGFSHRDYGQIQFGRTYKNRLIRLV

SEQ ID NO: 10472 - protein, 302 aa, Xenorhabdus bovienii
  Peptide sequence Name=Xb4151_4152.C444.gene334.pep
  Gene classification: Gene name=NagC; Function=Transcriptional regulators; Function class=K Transcription
  Homolog annotation: Query=1..302bp; Hit=47..348bp; Blast score=456; Percent Identity=71.0; E value=1e-128; Homolog= ZyajF COG1940
MRIGIDLGGTKIEVIALGDQGEELFRKRVDTPRNDYQQTLVAIAGLIADAEQTTGQRGTVGIGIPGAISPFTGKVKNANSVWMNGQILDKDLSALLGREVRVANDANCLAVSEATDGAAAGKPMVFAVIIGTGCGSGIAFDGKVHAGGNGLAGEWGHNPLPWMDEEDRAYQEEVRCFCGKPGCTEMFVSGTGFMTDYFRLSGVRKKGHEIMEALVQGDEIAELAIRRYERRLARALAQVINLLDPDVIVLGGGMSNVDRLYQTLPDLVQEWVFGGECATPIKKALHGDSSGVRGAAWLWPHK

SEQ ID NO: 10473 - protein, 303 aa, Xenorhabdus bovienii
  Peptide sequence Name=Xb4151_4152.C444.gene335.pep
  Gene classification: Gene name=RdgC; Function=DNA recombination -dependent growth factor C; Function class=L DNA replication, recombination and repair
  Homolog annotation: Query=1..303bp; Hit=1..303bp; Blast score=458; Percent Identity=74.0; E value=1e-129; Homolog= ZyaiD COG2974
MLWFKNLMIYRLNREISLSADELEEQLSSLAFTPCGSQDMMKTGWVPPMGAHGETLTHATGNQILICSRKEEKMLPSPVIKQELQAKIARLEGEQHRKLKKTEKDSLKDEVIHTLLPRAFSRFNQTYIWIDTVNNLIIVDAASAKRAEDNLALLRKTLGSLPVVPLTFTDPIELTLTEWVRSGDLPAGYALMDEAELKAILEEGGVIRCKKQALVSDEIATHIESGKFVTKLALDWEERIQFMLSDDGSFKRIKFSETLRDQNDDIDREDVAQRFDADFILMTGELSALIKNTIDALGGEAER

SEQ ID NO: 10474 - protein, 381 aa, Xenorhabdus bovienii
  Peptide sequence Name=Xb4151_4152.C444.gene336.pep
  Gene classification: Gene name=OmpC; Function=Outer membrane protein (porin); Function class=M Cell envelope biogenesis, outer membrane
  Homolog annotation: Query=14..364bp; Hit=35..368bp; Blast score=335; Percent Identity=55.0; E value=5e-92; Homolog= nmpC COG3203
MIKHNAMVMAIPVLLIAGTVNAAEIYNKDGNKIDLYGKADVQHYFAKSGNKKDGDNSVARLGIKGETQITDQLTGFGRWEYNMGASGSETEGAKNNRTRLAFAGLKFGKYGSLDYGRNYGVVYDTNAWTDELPFFGGDSIAATDNFWMGRSTGLLTYRNTDFFGLVDGLKFALQYQTKNDSNTINGRDDILRQNGDGFGLSSSYDFGNGISVAASYGNSNRTSAQKNGTDKTKVVAKGNNTEAWLMSVKYDKNNVYLAAMYGEGRNLTRFGKLDNYVLFANKTQNIELTAQYQFDFGLRPSIGYVYSKGKDLGGDSETNVLAAKSSEDLVNYVSVGAYYNFNKNMGTYAEYKINLMKDNDFTKKVNINTDNVLGVGLVYRF

SEQ ID NO: 10475 - protein, 212 aa, Xenorhabdus bovienii
  Peptide sequence Name=Xb4151_4152.C444.gene337.pep
  Homolog annotation: Query=7..205bp; Hit=7..203bp; Blast score=139; Percent Identity=41.0; E value=3e-32; Homolog= gi|22968297|ref|ZP _00015886.1| COG1309: Transcriptional regulator [Rhodospirillum rubrum]
MEKKYPRPRGRPTIPEQEIRQKIHDVTLSLLFTQGYITTTMDVVAQKAGIAKKTLYRFVKNREDLLEQIVLRWTDSCTPTFEKDASSFKQAIKLLEKYLREIAQKLLSTDSVGLFKLLQSDFPFREVLLKKYQKSVFERDKIILANWLENQYQKGLLRKFNYNIISELILSMVIAEPLRQMVLGIIPPLPETDITPHLAAAITLLELSLVKK

SEQ ID NO: 10476 - protein, 301 aa, Xenorhabdus bovienii
  Peptide sequence Name=Xb4151_4152.C444.gene338.pep
  Gene classification: Gene name=HypB; Function=Ni2+-binding GTPase involved in regulation of expression and maturation of urease and hydrogenase; Function class=O Posttranslational modification, protein turnover, chaperones
  Homolog annotation: Query=61..301bp; Hit=56..290bp; Blast score=284; Percent Identity=57.0; E value=1e-76; Homolog= hypB COG0378
MSIYGCGERSEPAHSYPEQGSDSQNGDYAAVAGKKNRQFHADIPQNSNQPIIIHHYYHHNGDVHHHYHGNEQMPEFDVPVSDRCQKQMLQIELDVLSQNNHIAECNRRYFILHHILALNLIASPGSGKTTLLMATLNRLRNKVTCAAIKGDQQTSHDADRIRAVGIQAVQVNKGKECYLDAEMVREAIRQLKPAEHSLLFIENVGNLVCPASFDLGEQHKIVMLSVTEGEDKPLKYPMMFAEAELMIINKVDLLPYLNIELEACIQAARCINPDIDVIALSASTGEGIDQWLSWLEARLSA

SEQ ID NO: 10477 - protein, 92 aa, Xenorhabdus bovienii; identical to SEQ ID NO: 6203
  Peptide sequence Name=Xb4151_4152.C444.gene339.pep

SEQ ID NO: 10478 - protein, 89 aa, Xenorhabdus bovienii
  Peptide sequence Name=Xb4151_4152.C444.gene340.pep
MNVCILAEAWSCIKWLVAVICFRLFKDEVWPKLMSIAVIATNQNRSKDMGKEMADILVIAVIAAVRSFSWRIPIRPANPALKNRLSISR

SEQ ID NO: 10479 - protein, 350 aa, Xenorhabdus bovienii
  Peptide sequence Name=Xb4151_4152.C444.gene341.pep
  Homolog annotation: Query=1..342bp; Hit=1..338bp; Blast score=318; Percent Identity=56.0; E value=6e-86; Homolog= gi|37525884|ref|NP _929228.1| hypothetical protein [Photorhabdus luminescens subsp. laumondii TTO1] gi|36785313|emb|CAE14254.1|
MSENIISKKETVYPEINIKALNQAVNNIWRLAQRQTSGIAIIEEKTKRISLYCRDFDEAVRSSLSQLEPTLKQLATQEYFQTITEIDEALAAPDLNDDDRNALLEEREQLIQHLAKDVDQVISNVRDETNQLTGKINDIRNMVISERLGDLLTQAQSQKTELQSAIEQKSAEQNKLDAARAKIIESQDVIRQNNIADMFKDFIPSASDIDKLDFTQPKKEAIKQAIKQGVEIARKILGKVSEGLKYAELADARVKLSDQIDQLTKESDTLKTTLRETEQRLAGITDTIQIDEERTTFLAEAVKLEQTWNLFANQLRNLSGNQINQEDLTSLINSQLDFLGNLASQYNMLK

SEQ ID NO: 10480 - protein, 404 aa, Xenorhabdus bovienii
  Peptide sequence Name=Xb4151_4152.C444.gene342.pep
  Homolog annotation: Query=1..400bp; Hit=5..404bp; Blast score=503; Percent Identity=67.0; E value=1e-141; Homolog= gi|37526963|ref|NP _930307.1| hypothetical protein [Photorhabdus luminescens subsp. laumondii TTO1] gi|36786396|emb|CAE15449.1
MSLSQFSAESTINGAELPAITLKLLASQIDGAARPGGIFTKEDLISIKLYVKHSLSLPFTLETVKRYIGYNDIDIAGLKPADITDLFKEIHNHALSWSGVEENVQQQSINLESAGKQITGTGEDIISIINEMPIIQRVKTKLGDLTEKQLAEITYTNDDKEISVELGNILNSMAKDIESQQVKTQQVKTAVSDFKRTLIGGTLSNGKNADGLQPQVNNKKKLMEDNNLSATIKDLNEKITEKNNEIEQLKKDYDKFVGLSFSGAPGGIIGLAITGGIFGDKAEKARKRKNALIDEVSGLQDQVEGKSALQKSIQKLVLQFGDIDIRMLDAEVALNHLDFMWSNMLTQINTSKDKFAEINDALKLTSFVTAFKQVISPWKEVQGSAAQLVKTFDEALAEYKKLNS

SEQ ID NO: 10481 - protein, 141 aa, Xenorhabdus bovienii
  Peptide sequence Name=Xb4151_4152.C444.gene343.pep
  Gene classification: Gene name=ExbD; Function=Biopolymer transport protein; Function class=N Cell motility and secretion
  Homolog annotation: Query=1..141bp; Hit=1..141bp; Blast score=184; Percent Identity=65.0; E value=3e-47; Homolog= exbD COG0848
MAIRLNEDLDDGGELHEINVTPFIDVMLVLLIIFMVAAPLATVDIKVDLPASSAKPQPRPEKPVFLTVKADHQLYVGEQLIERDNLSSVLDQTTQSNKETTIFFQADKTVDYETLMSVMDSLRKAGYLKVGLVGMEAVAAQ

SEQ ID NO: 10482 - protein, 330 aa, Xenorhabdus bovienii
  Peptide sequence Name=Xb4151_4152.C444.gene344.pep
  Gene classification: Gene name=TolQ; Function=Biopolymer transport proteins; Function class=N Cell motility and secretion
  Homolog annotation: Query=101..322bp; Hit=8..229bp; Blast score=290; Percent Identity=70.0; E value=2e-78; Homolog= exbB COG0811
MRNLTASILLALGLTGSAWADTVPVTTATSPENQAAVQVAAPATPAPASSGALQVDVPKTEAQQAGEPKAAAQKADAQPAAETKSTEPVDESESLSSGFATDLSVWGMYQNADAVVKTVMLGLVIASVITWALFFSKGTELLIARRRLRKEQWALADAANLDVAAKIASDFGKQSISRLLLSEAQSERALSAASTDKAGTKERTSFRMERAVAAISRHMGRGNGYLATIGAISPFVGLFGTVWGIMNSFIGIAHSQTTNLAVVAPGIAEALLATALGLVAAIPAVVIYNIFARVISSYRGQVGDMAAQAILLLGRDLDLADSKVEKAEAR

SEQ ID NO: 10483 - protein, 397 aa, Xenorhabdus bovienii
  Peptide sequence Name=Xb4151_4152.C444.gene345.pep
  Gene classification: Gene name=MetC; Function=Cystathionine beta -lyases/cystathionine gamma-synthases; Function class=E Amino acid transport and metabolism
  Homolog annotation: Query=1..394bp; Hit=1..394bp; Blast score=549; Percent Identity=62.0; E value=1e-156; Homolog= metC COG0626
MTEKKLETLLVSTGRKKKYTQGAVNPLIQRTSSIIFDTVEDLKHALKNRAKSELFYGRRGTLTHFAFQEAMTELEGGAGCALYPSGAAAITHSILAFVATGDHVLLTGSAYEPTQDFCNHILKKMGISTDYFDPMIGEGIASLIKPNTKVVFLESPGSLTMEVQDIPSIVRTIRQINPEIVIIIDNTWAAGILFKALDFGIDISIQSATKYIIGHSDGMLGTAVANARCWDQLRESSYLLGQIADPDTVYTATRGLRTLAIRLKHHEESSLHIAKWLAQRPEVAEVYHPALPSCPGHHYFQRDFTGASGLFSFLLKVELTPQQFAEYLDNLHHFKMAFSWGGFESLILGIQPDMLTSLRRYDPLKKTGTLFRVHIGLENPQDLIDDLAAGFARIAPL

SEQ ID NO: 10484 - protein, 222 aa, Xenorhabdus bovienii
  Peptide sequence Name=Xb4151_4152.C444.gene346.pep
  Gene classification: Gene name=DedA; Function=Uncharacterized membrane-associated protein; Function class=S Function unknown
  Homolog annotation: Query=1..197bp; Hit=1..197bp; Blast score=255; Percent Identity=67.0; E value=2e-68; Homolog= yghB COG0586
MEILSEIVHALWQHDFTQLANPEVIWIIYGVLFVTLVLENGLLPAAFLPGDTLLVLSGALIAKGVMSFIPTVILLTIAASLGCWLGYLQGRWLGHTRIVKNWLAQLPVQYRERAHVLFAKHGLSALLVGRFLAFVRTLLPTFAGISGLNNKRFQFFNWLSGFLWVMIIVSFGYILNQIPFVKAHQDLVMNILMILPIILLFSGLFASLLMYWRHKKTSSKKK

SEQ ID NO: 10485 - protein, 279 aa, Xenorhabdus bovienii
  Peptide sequence Name=Xb4151_4152.C444.gene347.pep
  Gene classification: Gene name=ARA1; Function=Aldo/keto reductases, related to diketogulonate reductase; Function class=R General function prediction only
  Homolog annotation: Query=40..275bp; Hit=1..236bp; Blast score=347; Percent Identity=70.0; E value=7e-96; Homolog= yqhE COG0656
MDQQTIIKLVDGNLMPQLGLGVWQTSNEQVVKAIHTALEVGYRSIDTAAIYHNESGVGKALKEIDIPREEIFVTTKLWNDRHQDAKAALEESLDKLQLDYINLYLLHWPVPHQDQYVEAWKQLIELKESGLARSIGVCNFHIEHLQNLMSETSVIPAINQIELHPLMQQRQLHSWNATHHITTESWSPLSQGGKGVFDNPLVQHLAIKYEKTPAQIVIRWHLDCGMIVIPKSVTPSRIKENFDVFDFRLEKEDLTAMAELDIGKRIGPNPDIYTGDHVK

SEQ ID NO: 10486 - protein, 99 aa, Xenorhabdus bovienii
  Peptide sequence Name=Xb4151_4152.C444.gene348.pep
MTYIMISLLMLIPFFFLVKRFLLSNHVHQNVSGIMLTVVAIAVHMYIFRFDRVPIVSVSIPNIVAYGSIVIALLHGMIYSICFRLYFGRESYDDHSRID

SEQ ID NO: 10487 - protein, 1074 aa, Xenorhabdus bovienii
  Peptide sequence Name=Xb4151_4152.C444.gene349.pep
  Gene classification: Gene name=CarB; Function=Carbamoylphosphate synthase large subunit (split gene in MJ); Function class=E Amino acid transport and metabolism
  Homolog annotation: Query=1..1072bp; Hit=1..1072bp; Blast score=1977; Percent Identity=91.0; E value=0; Homolog= carB COG0458
MAKRTDIKSILILGAGPIVIGQACEFDYSGAQACKALREEGYRVILVNSNPATIMTDPEMADATYIEPIHWEVVRKIIEKERPDAILPTMGGQTALNCALELERQGVLTEFSVTMIGATADAIDKAEDRQRFDKAMKKIGLDTARSGIAHTMEEALAVAEDVGFPCIIRPSFTMGGSGGGIAYNREEFEEICERGLDLSPTNELLIDESLIGWKEYEMEVVRDKNDNCIIICSIENFDPMGIHTGDSITVAPAQTLTDKEYQIMRNASMAVLREIGVETGGSNVQFSVNPKNGRLIVIEMNPRVSRSSALASKATGFPIAKIAAKLAVGYTLDELMNDITGGRTPASFEPSIDYVVTKIPRFNFEKFAGSNDRLTTQMKSVGEVMAIGRTFQESMQKALRGLEVGVTGFDPKVNLDDPQSLTKIRSELKSAGAERIWYVADAFRAGMSIDGVFNLTNIDRWFLVQIEELVRLEEQVEEQGINGLTFDFLRHLKRKGFADAHLAKLVGVSGKEIRKLRHDYNLYPVYKRVDTCAAEFSTDTAYMYSTYEDECESNPNHDKPKIMVLGGGPNRIGQGIEFDYCCVHASLALREDGYETIMVNCNPETVSTDYDTSDRLYFEPVTLEDVLEIVRVEKPTGVIVQYGGQTPLKLARELEAAGVPIIGTSPDAIDRAEDRERFQQAVNRLGLKQPANATVSTIEQAVEKGNGLGYPLVVRPSYVLGGRAMEIVYDETDLRRYFQNAVSVSNDAPVLLDRFLDDAVEVDVDAICDGERVLIGGIMEHIEQAGVHSGDSACSLPAYTLSQEIQDVMRQQVEKLAFELRVRGLMNVQFAVKNNEVYLIEVNPRAARTVPFVSKATGLPLAKVAARVMAGQSLLKQGVTKEIIPPYYSVKEVVLPFNKFLGVDPILGPEMRSTGEVMGVGRTFAEAFSKAMLGSSSTMGKHGRALLSVREEDKERVVDLAAKLLKQGFELDATHGTAIVLGEAGINPRLVNKVHEGRPHIQDRIKNGEYNYIVNTTAGRQAIEDSKLLRRSALQYKVHYDTTLNGGFATTMALSADPTEQVISVQEMHAKITG

SEQ ID NO: 10488 - protein, 424 aa, Xenorhabdus bovienii
  Peptide sequence Name=Xb4151_4152.C444.gene350.pep
  Gene classification: Gene name=CarA; Function=Carbamoylphosphate synthase small subunit; Function class=E Amino acid transport and metabolism
  Homolog annotation: Query=39..417bp; Hit=1..379bp; Blast score=676; Percent Identity=84.0; E value=0; Homolog= carA COG0505
MRAICQNFDKNHQLALIQRIISELICIGCDLLFILEGVLIKSAILVLEDGTQFHGRAIGVEGVAVGEVVFNTSITGYQEILTDPSYSRQIVTLTYPHIGNTGINAADEESPAIQAQGLVIRDLPLVTSNFRSEENLSDYLKRHNIVAIADIDTRKLTRLLREKGAQNGCIIAGNEADAQVALEKAKAFPGLKGMDLAKEVTTEQSYPWLQGSWTLADGLPEVCKEQELPYHIVAYDFGVKRNILRMLVDRGCRVTVVPAQTPADEVLKMAPDGIFLSNGPGDPEPCDYAIEAIQAFLNTEIPVFGICLGHQLLALASGAKTVKMKFGHHGGNHPVKDLENNVVMITAQNHGFAVDESTLPTNLRVTHKSLFDGTLQGIHRTDKPAFSFQGHPEASPGPHEAASLFDHFIELIEQHRQNHVQNTK

SEQ ID NO: 10489 - protein, 273 aa, Xenorhabdus bovienii
  Peptide sequence Name=Xb4151_4152.C444.gene351.pep
  Gene classification: Gene name=DapB; Function=Dihydrodipicolinate reductase; Function class=E Amino acid transport and metabolism
  Homolog annotation: Query=1..273bp; Hit=1..273bp; Blast score=374; Percent Identity=75.0; E value=1e-104; Homolog= ZdapB COG0289
MADTDIRVAVVGAGGRMGRHLIQAAQQLDGATLGAALERSGSSLVGTDAGELAGIGKNGITVSDDLHDVIEHFDVLIDFTRPEGTLAYLAICRQYRKAIVIGTTGFDDAGKQAIEDASRDIPIVFAANFSVGVNLVLKLLEKAATVMGEYTDIEIIEAHHRHKVDAPSGTALAMGESIAHALGRDLKTCGVYAREGHTGERDPKSIGFATVRAGDIVGEHTAIFADIGERVEISHKASSRMTFANGAIKAAIWLNAKNNDLYDMKDVLNLKNL

SEQ ID NO: 10490 - protein, 317 aa, Xenorhabdus bovienii
  Peptide sequence Name=Xb4151_4152.C444.gene352.pep
  Gene classification: Gene name=LytB; Function=Penicillin tolerance protein; Function class=I Lipid metabolism
  Homolog annotation: Query=1..317bp; Hit=1..316bp; Blast score=506; Percent Identity=81.0; E value=1e-143; Homolog= lytB COG0761
MQILLANPRGFCAGVDRAISIVERALELYGAPIYVRHEVVHNRYVVDNLRERGAIFIENIAEVPDGAILIFSAHGVSQAIRAEARSRNLTMLFDATCPLVTKVHMEVARASRKGKEAILIGHAGHPEVEGTMGQYNNPEGGMYLVESPADVWKLQVKDENNLCFMTQTTLSVDDTSEVIDALNARFPNIVGPRKDDICYATTNRQEAVRDLASGADVVLVVGSKNSSNSNRLAELAQRVGKPAYLIDSADDIKSEWIKGVDAIGVTAGASAPDILVQQVIERLRAFGADIVTELHGREENIVFEVPKELRVEVKEVN

SEQ ID NO: 10491 - protein, 156 aa, Xenorhabdus bovienii
  Peptide sequence Name=Xb4151_4152.C444.gene353.pep
  Gene classification: Gene name=SlpA; Function=FKBP-type peptidyl -prolyl cis-trans isomerases 2; Function class=O Posttranslational modification, protein turnover, chaperones
  Homolog annotation: Query=1..148bp; Hit=1..148bp; Blast score=198; Percent Identity=68.0; E value=2e-51; Homolog= slpA COG1047
MSTQVQVHSAVLLHFTLKLDDGSTADSTYSQGKPALFRLGDGSLSAPLEQQLLGLNVGDKHQFTLAGEAIFGKPNPDLVQYFTPRDFADAGIPEVGTIMLFTAMNGSEMPGLVKEVAEGSIIVDFNHPLADQNITFDIEVLEIDPQLEENHANIAG

SEQ ID NO: 10492 - protein, 169 aa, Xenorhabdus bovienii
  Peptide sequence Name=Xb4151_4152.C444.gene354.pep
  Gene classification: Gene name=LspA; Function=Lipoprotein signal peptidase; Function class=N Cell motility and secretion
  Homolog annotation: Query=1..163bp; Hit=1..163bp; Blast score=224; Percent Identity=71.0; E value=4e-59; Homolog= ZlspA COG0597
MNKPICSTGLRWLWLVVVVLILDLGSKQLVLQNFTLYESTPLIPYFNLTYAQNPGAAFSFLADKGGWQRWFFALVAIIISAVLLVMMYRSSAKQKLSNAAYALVIGGALGNLFDRLVHGFVVDFIDFYVGEWHWPTFNIADSAICIGAAFIIIESFISPDDKKTASKSQ

SEQ ID NO: 10493 - protein, 937 aa, Xenorhabdus bovienii
  Peptide sequence Name=Xb4151_4152.C444.gene355.pep
  Gene classification: Gene name=IleS; Function=Isoleucyl-tRNA synthetase; Function class=J Translation, ribosomal structure and biogenesis
  Homolog annotation: Query=1..937bp; Hit=1..938bp; Blast score=1575; Percent Identity=79.0; E value=0; Homolog= ileS COG0060
MSDYKDTLNLPETGFPMRGDLAKREPDMLKRWYKEGLYQAIRKAKSGKKTFILHDGPPYANGDIHIGHSVNKILKDIVIKSKGLSGYDSPYIPGWDCHGLPIELKVEQIIGKPGEKFSAAEFRAECRKYAMSQVEVQRAGFMRLGVLGDWDKPYLTMDFKTEADIIRALGRIIGNGHLLKGVKPVHWCTDCGSSLAEAEVEYYDRTSPSIDVRFKAVDADAVYAKFDIQSPGLPVSLVIWTTTPWTLPANRAISLNAEITYQLVKIEDECLILAAELVESVMQRAGMTSWQVLSDCTGADLELLRFNHPFMGFDVPAILGDHVTLEAGTGAVHTAGGHGPDDYSISLKYGLEIANPVGPNGCYISGTYPSLDGVFVFKANDIIVELLQEKGALLNVAKLQHSYPCCWRHKKPIIFRATPQWFISMDQNGLREQSLKEIKGVEWIPGWGQARIESMVENRPDWCISRQRTWGVPMSLFLHKETQELHPRTQELIEEVAKRVEVGGIQAWWDLDTAELLGADAADYVKAPDTLDVWFDSGSTHSSVVDARPEFHGNSADIYLEGSDQHRGWFMSSLMLSTAIKGKAPYRQVLTHGFTVDEQGRKMSKSIGNTVSPQDVMNKLGADILRLWVASTDYSGEIAVSDEILKRSADAYRRIRNTARFLLANLNGFDPEQHMVKAEDMVALDRWAVGRAQAAQADILKCYDEYDFHSVVQRLMQFCSVEMGSFYLDIIKDRQYTAKSDGLARRSCQSALFHIAEALVRWIAPILSFTADEVWNELPGNRAQYVFTEEWYDGLFGLADGEDMNDTFWAELLEVRGEVNKVLEQARADKHIRSSLEAAVTLYADESLVEKLNKLSDELRFVLLTSQVEVATYTTAGDDAQQSELKGLKIAFRKADGEKCPRCWHYAKNVGLVAEHAELCGRCVTNVAGNGEERKFA

SEQ ID NO: 10494 - protein, 314 aa, Xenorhabdus bovienii
  Peptide sequence Name=Xb4151_4152.C444.gene356.pep
  Gene classification: Gene name=RibF; Function=FAD synthase; Function class=H Coenzyme metabolism
  Homolog annotation: Query=1..304bp; Hit=1..305bp; Blast score=441; Percent Identity=71.0; E value=1e-124; Homolog= ribF COG0196
MELIRGVHNIRARHHGCVLTIGNFDGVHRGHQALLKHLKQEGLRSGLPTMVMIFEPQPLEVFAVDKAPARLTRLRDKIRYLSQYGVDYLLCVKFDRNFAANSPEAFVSRLLVEKLGVKFLAIGDDFRFGKNRLGDFHYLQQAGKQYCFDVASTDSFCDSGLRISSTAIRQALQDDDLALAETLLGHPYSISGRVVHGKRLGRTIGFPTANLPLKRLVAPVKGVYAVEVYGLGDKPLPGVANIGNRPTVAGLGQQLEVHLIDTQMDLYGRHIDVVLRKKLRDEQRFASLDALKQQIANDVVAARDCLLQRSESCI

SEQ ID NO: 10495 - protein, 60 aa, Xenorhabdus bovienii
  Peptide sequence Name=Xb4151_4152.C444.gene357.pep
  Gene classification: Gene name=RpsT; Function=Ribosomal protein S20; Function class=J Translation, ribosomal structure and biogenesis
  Homolog annotation: Query=1..60bp; Hit=27..86bp; Blast score=64; Percent Identity=75.0; E value=2e-11; Homolog= rpsT COG0268
MVRTFIKKVYVAIASGDKEAAQKAFNDMQPIVDRHSCKGLIHKNKAARHKSALAAQIKAM

SEQ ID NO: 10496 - protein, 302 aa, Xenorhabdus bovienii
  Peptide sequence Name=Xb4151_4152.C444.gene358.pep
  Gene classification: Gene name=LysR; Function=Transcriptional regulator; Function class=K Transcription
  Homolog annotation: Query=1..301bp; Hit=1..301bp; Blast score=492; Percent Identity=77.0; E value=1e-139; Homolog= nhaR COG0583
MRVSHLNFNHLYYFWHVCKEGSVVGAAEALYLTPQTITGQIKALEERLAGKLFKRQGRGLVPSELGQLVFRYADKMFMLSHEMLDIVTYSRESNLLFDVGVADALSKRLVSKVLETTVVEHEKIHLRCFESTHEMLLEQLSQHKLDMILSDCPVDSSQQEGLFSVKLGECNVSFYCRQPIPEKPFPECLEERRLLIPGRRSMLGRKLLTWIRNKNLQVEVLGEFDDAALMKAFGMYHNAIFIAPSFYASDIFVDSDIVEIGQLDAVQEEYYVIFAERMIQHPAVQRVCNKDFSALFSTPLKK

SEQ ID NO: 10497 - protein, 398 aa, Xenorhabdus bovienii
  Peptide sequence Name=Xb4151_4152.C444.gene359.pep
  Gene classification: Gene name=NhaA; Function=Na+/H+ antiporter; Function class=P Inorganic ion transport and metabolism
  Homolog annotation: Query=1..388bp; Hit=1..381bp; Blast score=394; Percent Identity=64.0; E value=1e-110; Homolog= VC1627 COG3004
MTAIIRQFLKLEAAGGIILIIAAIVALVLANTPLQGIYHQFLNLPVAVQFAALEIKKPLLLWINDGLMAVFFLIVGLEVKRELMEGSLAGRDKAVFPAIAAVGGMIAPALVYLLFNGGDEIARQGWAIPAATDIAFALGVMALLGKRVPTALKVFLLALAIIDDLGVIIIIALFYTKTVSLTALGLAGAMIALLIWMNWRGIAKTSVYLMVGAVLWICILKSGVHATLAGVIVGFMIPLRCKKGHSPSEALEHGLHPWVAYLILPLFAFANAGVSLQGVTLNGLTGMLPVGIALGLFIGKPLGIFLFSWISVKLGIAKLPEEIGLRQIFAVSVLCGIGFTMSIFISGLAFEGLNEAFSTYSRLGILIGSTAAAVIGYGLLNILLPKRKHRQTQMNRLI

SEQ ID NO: 10498 - protein, 281 aa, Xenorhabdus bovienii
  Peptide sequence Name=Xb4151_4152.C444.gene360.pep
  Gene classification: Gene name=RhaT; Function=7 Permeases of the drug/metabolite transporter (DMT) superfamily; Function class=G Carbohydrate transport and metabolism
  Homolog annotation: Query=1..280bp; Hit=1..280bp; Blast score=156; Percent Identity=40.0; E value=3e-38; Homolog= mll3062 COG0697
MSTLLLLSVLAAALLHASWNALVKINADRFLSISILVFFAGLISTSGLFWVGLPTPASLSWLILSSILHIGYCLFLSRSYATGDLSQVYPIARGCAPLITVLLSWIILQEVLPPFAMLGVGLIIAGVILIAFPHGKKSIRIDRRTLIAALTTSIFTACYTLSDGIGSRASDSALTYILWLFAIHGWSMGVIIYFKYRKTAGQNVRQYWKQGLIGGLMQLLSYGIVIWVMSHASIVLVAALRETSVLFAVLLSVFILREPFSKMRLLACVVIVAGIFCTKLE

SEQ ID NO: 10499 - protein, 71 aa, Xenorhabdus bovienii; identical to SEQ ID NO: 6562
  Peptide sequence Name=Xb4151_4152.C444.gene361.pep

SEQ ID NO: 10500 - protein, 92 aa, Xenorhabdus bovienii
  Peptide sequence Name=Xb4151_4152.C444.gene362.pep
MSHYSLQAGFPSIPKPALVFLIADKRPLLVDFTDNLDVTFRKGKCRYVSGSEVFNVFMTVAVATFRIRAVSRIPPLFIAISTICSLTPGLQA

SEQ ID NO: 10501 - protein, 395 aa, Xenorhabdus bovienii
  Peptide sequence Name=Xb4151_4152.C444.gene363.pep
  Gene classification: Gene name=AraJ; Function=Arabinose efflux permease; Function class=G Carbohydrate transport and metabolism
  Homolog annotation: Query=7..394bp; Hit=40..424bp; Blast score=140; Percent Identity=25.0; E value=2e-33; Homolog= BS_ydhL COG2814
MHSNSSFSVYLIAIGAFALGMASYVTAGLIPLIETSFSVSVAMAAQLVTAFTLAYGLGSPLIVAVLPMNKQRQGLLLALVIFFVANVASALSSNFQMLLIFRAIAGIGAGVYLAMGIAASAALSERNNQGKSIAIIMGGMASGVVLGVPLSLILANYAGWQAALWLISLLGLASFIGLALKLPALPDTSHIPLKRKIAILADGNVLMILSVSLLAAISSLGMYTFIAPLISEPSYNVNVSVTTYLWVWGIGGVIGSFLIGPIIDRIKGPLLTLIIMVLLAISLLLLPLFAEINQWLVMLPIALWGAVGWALQVPQNNELISTREKQGDGNLAVALNESALYLGSAIGAAIGGLLLSLSIPIWILAVAAGGIAVIGGIIQIFYLLRASQRTTNSSQ

SEQ ID NO: 10502 - protein, 135 aa, Xenorhabdus bovienii
  Peptide sequence Name=Xb4151_4152.C444.gene364.pep
  Gene classification: Gene name=AsnB; Function=Asparagine synthase (glutamine-hydrolyzing); Function class=E Amino acid transport and metabolism
  Homolog annotation: Query=1..134bp; Hit=473..609bp; Blast score=112; Percent Identity=43.0; E value=1e-25; Homolog= PA2084 COG0367
MSMAVGLEVRVPFCDHRLVEYAFNIPWNMKSFDGREKSILRAATRDILPASISERVKSPYPSTQDPAYENALRNTMSEIMLDNQAPVRPLFDQKLVNEKLSFSVGSNSPMYSRMGMELAVGLNSWLNEYKVELNF

SEQ ID NO: 10503 - protein, 48 aa, Xenorhabdus bovienii
  Peptide sequence Name=Xb4151_4152.C444.gene365.pep
MHIQLNDGHKMVLLLLNQQPYSFDLFDPAMSAQNESYFYNDIFIDSIS

SEQ ID NO: 10504 - protein, 122 aa, Xenorhabdus bovienii
  Peptide sequence Name=Xb4151_4152.C444.gene366.pep
  Homolog annotation: Query=5..100bp; Hit=4..99bp; Blast score=92; Percent Identity=45.0; E value=2e-18; Homolog= gi|15890229|ref|NP _355901.1| AGR_L_237p [Agrobacterium tumefaciens] gi|17938453|ref|NP _535242.1| acetyltransferase [Agrobacteriu
MFSEDNSLLFFTSRLILRQFEIKDFSKYQSYHSLPEVYTFLYSYPPADENMHAQFNRVMSPAFNNNGDEVRLAVILRENNDLAGEIMLRLTNKESQQGEIYPSSLKMLDFSFVSDHDCAHEN

SEQ ID NO: 10505 - protein, 349 aa, Xenorhabdus bovienii; identical to SEQ ID NO: 5796
  Peptide sequence Name=Xb4151_4152.C444.gene367.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 10506 - protein, 118 aa, Xenorhabdus bovienii
  Peptide sequence Name=Xb4151_4152.C444.gene368.pep
  Homolog annotation: Query=4..107bp; Hit=1..105bp; Blast score=148; Percent Identity=69.0; E value=1e-35; Homolog= gi|37524307|ref|NP _927651.1| hypothetical protein [Photorhabdus luminescens subsp. laumondii TTO1] gi|36783730|emb|CAE12584.1|
METMKNHKMLLLLCTTLGWSLITGCSSIMTHSGPYQGYYSGAKASIGMLKDDSTGWVMKPLLAVDLPFSAFLDTLLFPYDYTRSSKDQAEHSPKHRLEKLEQRSTATATAPENTNSET

SEQ ID NO: 10507 - protein, 433 aa, Xenorhabdus bovienii
  Peptide sequence Name=Xb4151_4152.C444.gene369.pep
  Homolog annotation: Query=1..428bp; Hit=1..428bp; Blast score=671; Percent Identity=73.0; E value=0; Homolog= Pa|Phot2-74c01.p1k_g193| 124808 - 126097 2024 429 aa, chain -
MVFKERQITFDNRSHQITNINIWTPDSQWLVYDVRPSGASFTGLTIEKIHVGSRQVKVIYQAQDDAHVGVVTVNPQEPVRYAFIHGPEKPDTQWQYDFHHRRGVIVSDAQPNVAVNIEALDITPPYTSGALRGGTHVHVFSPDGNRLSFTYNDHVMHERDPALDLRNVAVAIPLRAVIPPKKHPREYDGSYFSVIVSRTTPQPRSGSDEINRAYEEGWIGQRGYPKENGQWQRWALAFIGDTCAENGEKIPEIYLVDLPDNNEDYAIEGKQPLAGTETTLPAPPAGVKQRRLTFTHQNRWPGVVNVPRHWLRTSPDGSKIGFLMKDEAGIVQLWYISPNGGVPVQITHSTHHIQSAFNWDRRGRFIAFVCDNSIMLCDSQNGEMHRLTARTDDAPSADAIVISPDDRYVAFMRDIDGYRQILVVETGITDVGE

SEQ ID NO: 10508 - protein, 205 aa, Xenorhabdus bovienii
  Peptide sequence Name=Xb4151_4152.C444.gene370.pep
  Gene classification: Function=Predicted membrane protein; Function class=S Function unknown
  Homolog annotation: Query=1..205bp; Hit=19..223bp; Blast score=228; Percent Identity=68.0; E value=3e-60; Homolog= yicG COG2860
MLLSVLYIIGITAEAMTGALAAGRRKMDVFGVIIIASVTAIGGGSVRDIILGHYPLGWVENPAYIVTVACAAVITIWVAPMMKHLRRLFLILDAIGLIVFSIIGAQIALDMNHSPIIAAIAAVITGVFGGVLRDMFCNTIPLVFQKEIYAGVSFAAAWLYIGLLHTPLHPNSVVLITLTAGLAARLIAIRYRLGLPIFNYEGSEH

SEQ ID NO: 10509 - protein, 619 aa, Xenorhabdus bovienii
  Peptide sequence Name=Xb4151_4152.C444.gene371.pep
  Gene classification: Gene name=Lig; Function=NAD-dependent DNA ligase (contains BRCT domain type II); Function class=L DNA replication, recombination and repair
  Homolog annotation: Query=43..532bp; Hit=22..513bp; Blast score=397; Percent Identity=42.0; E value=1e-110; Homolog= yicF COG0272
MLNFLIMILALLFGIPVALAGMAEQVPAEFTESVETGSTGNMADCPVWPQEKIQREMQHLTRQMAEWDQLYRQQGISEIDDEFYDQLLEILTLWRTCLHQTSDSTFSVAVPREGKQPHPVQHTGLNKLKGVKEIHQWLQGRSVVWLQPKVDGVAVTLVYEKGRLVGLISRGNGSEGTNWMDKSSFITDIPKQIKNAPERLVLQGELFWQQDNHRQSVAGGQGARSKVAGLMMRKSSAPELGQIGIFIWGWPDGPNEMAVKLERLASMGFPTAQQYSHRIFSAEDAEKRWSSYFIQPLPFATDGVVLRQETEPTGRQWRAGSNSWAIAWKYPLQQQLTTVRDVNFKIGRTGRISVLLELEKVKLDDRQVRRVNLGSVSRWRQWNVYPGDKVTVALAGHGVPKLDKVVWRIAERPDIQPPNAQDFHSLSCLVSHDSCQQQFIARLTWLGENLNMQGIGQGTWAALVKHGLVTHLTDWLALDIAQLTEVPNIGIKRAELIFAQFQQARLQPLSSWREAIGLPYANRFTDEMGWQQDLLLSKTGAKNSLTTKQTAKIAAFLQHPEIKTLVHALTVHGIGEKQESEENTVGEKKEVESVSYSEAREQEHASDALNNVSAQNPHN

SEQ ID NO: 10510 - protein, 207 aa, Xenorhabdus bovienii
  Peptide sequence Name=Xb4151_4152.C444.gene372.pep
  Gene classification: Gene name=Gmk; Function=Guanylate kinase; Function class=F Nucleotide transport and metabolism
  Homolog annotation: Query=1..206bp; Hit=1..206bp; Blast score=331; Percent Identity=82.0; E value=3e-91; Homolog= gmk COG0194
MNQGTLYIVSAPSGAGKSSLIQALLKTQPLYDTQVSVSHTTRPTRPGENHGEHYFFVTVDEFQNMISHDEFLEYAGVFGNYYGTSRKIIEDTLASGVDVFLDIDWQGAQQVRQKMPAARSIFILPPSKEELLRRLRGRGQDSDEVIDKRMSQAVAEMEHYGEYDYVIINDDFNTALADLQSIIRSERIRLDRQAQRHDALISKLLAG

SEQ ID NO: 10511 - protein, 91 aa, Xenorhabdus bovienii
  Peptide sequence Name=Xb4151_4152.C444.gene373.pep
  Gene classification: Gene name=RpoZ; Function=DNA-directed RNA polymerase subunit K/omega; Function class=K Transcription
  Homolog annotation: Query=1..91bp; Hit=1..91bp; Blast score=101; Percent Identity=86.0; E value=2e-22; Homolog= rpoZ COG1758
MARVTVQDAVEKIGNRFDLVLVAARRARQLQSGGKDPLVAEENDKMTVIALREIEQGLINNKILDVRDRQEQQEQDAAEIKAVSVIAEGRR

SEQ ID NO: 10512 - protein, 702 aa, Xenorhabdus bovienii
  Peptide sequence Name=Xb4151_4152.C444.gene374.pep
  Gene classification: Gene name=SpoT; Function=Guanosine polyphosphate pyrophosphohydrolases/synthetases; Function class=T Signal transduction mechanisms
  Homolog annotation: Query=1..702bp; Hit=1..702bp; Blast score=1250; Percent Identity=88.0; E value=0; Homolog= spoT COG0317
LYLFESLNQLVLKYLPEDQIVLLKQAYVVARDAHEGQTRSSGEPYITHPVAVSCILAEMRLDHETLMAALLHDVIEDTPATFQDIEQLFGTAVAGLVEGVSKLDKLNFRNKKEAQAENFRKMIMAMVQDIRVILIKLADRTHNMRTLGSLRPDKRRRIARETLEIYSPLAHRLGIHHLKTELEELGFEALHPNRYRVIKEVVKAARGNRKEMIQKILSEIEGRLTDAGIQCTVSGREKHLYSIYRKMHLKEQRFHSIMDIYAFRVIVNNLDTCYRVLGQMHSLYKPRPGRVKDYIAIPKANGYQSLHTSLIGPHGVPVEVQIRTEDMDQMAEMGVAAHWAYKEQGESGTTAQIRAQRWMQSLLELQQSAGSSFEFIESVKSDLFPDEIYVFTPEGRIVELPAGASPVDFAYAVHTDIGHACVGARVDRQPYPLSQTLSSGQTVEIITAPGARPNAAWLNFVVSSKARAKIRQLLKNLKRDDSVGLGRRLLNHALGNGKKITDIPQESITKELVRMKLATLDDLLAEIGLGNAMSVVVARNLLGATEKIPNNNNSTRKLPIKGADGILITFAKCCRPIPGDPIISHISPGKGLVIHHESCRNIRGYQKEPEKFMPVEWDKDVNSDFIAEIKVDMFNHQGALANLTAAINDANSSIQSMNTEEKDGRVYCAFIRLTTQDRIQLANIMRKIRVMPDVMRVSRNRN

SEQ ID NO: 10513 - protein, 693 aa, Xenorhabdus bovienii
  Peptide sequence Name=Xb4151_4152.C444.gene375.pep
  Gene classification: Gene name=RecG; Function=RecG-like helicases; Function class=L DNA replication, recombination and repair
  Homolog annotation: Query=1..693bp; Hit=12..704bp; Blast score=1042; Percent Identity=77.0; E value=0; Homolog= ZrecG COG1200
MKGRLLDAIPLTTLRGVGASQVTKLAKLGLVNLQDLLLHLPLRYEDQTRLYSINDLLPGVYATVTGEVLRTHVTFGRRRIMTCQISDGTGVLTLRFFNFTAAMKNNLAEGKHVIAYGEIRRGNQGPEIIHPEYKTQQHAERIQLQDTLTPIYPTTEGVRQTTLRKLIEQALELLDTCVINELLPEEFSRKLISLPNALHTLHRPPPDVSLTDLDNRRHPAQRRLILEELLAHHLSMLAVRAGAQRFHAQQLTADNSLKQQLISQLPFVPTGAQVRVVAEIEQDLEKNVPMMRLIQGDVGSGKTLVAALAALRALVHGKQVALMAPTELLAEQHANTFRQWFEPLGIQVGWLAGKQKGKARQAQQEAIANGQVSMVVGTHAMFQEQVRFSGLALVIIDEQHRFGVHQRLALWEKGCEQGFHPHQLIMTATPIPRTLAMTAYADLDTSIIDELPPGRTPVTTVAIPDTRRNEIIQRIKSACLDEGRQAYWVCTLIEDSEVLEAQAAQATSEELALILPDLKIGLVHGRMKPAEKQTIMDAFKRGELQLLVATTVIEVGVDVPNASLMIIDNPERLGLAQLHQLRGRVGRGAVASHCVLLYKTPLTNTAKIRLQVLRDSNDGFVIAQKDLEIRGPGELLGTRQTGNAEFRIADLLRDQGMLSEVQRISSYIHQHYPEHAKALIERWLPDRSQYSHA

SEQ ID NO: 10514 - protein, 404 aa, Xenorhabdus bovienii
  Peptide sequence Name=Xb4151_4152.C444.gene376.pep
  Gene classification: Gene name=GltS; Function=Na+/glutamate symporter; Function class=E Amino acid transport and metabolism
  Homolog annotation: Query=1..399bp; Hit=1..399bp; Blast score=480; Percent Identity=76.0; E value=1e-135; Homolog= gltS COG0786
MYQMDIYGTLVAATLVLLLGRKLVQSIPFLEKYTIPEPVAGGLLVAIVLLAVKQSTDWEISFDLSLKDPLMLMFFATIGLNANLASLKAGGKFLVLFVFVVIGLLLVQNTVGIALAKMLGLDPLMGLLAGSITLSGGHGTGAAWGKVFSERYGFDNATEVAMACATFGLILGGLIGGPVARFLVKNTKAPGLGVDDAEIPTAFEKPYTGRMITPLVMLETIALISICLLAGSYIEKQLEHTMFELPTFVCVLFVGVILSNGLSLLGFYRVFDRAVSVLGNVSLSLFLAMALMSLKLWQLASLALPMLVILVVQSIVMALYAIFVTYRVMGKNYDASILSAGHCGFGLGATPTAIANMQAITDRCGPSHMAFLLVPMVGAFFIDIVNAAVIKIYLLLPIFPSIAG

SEQ ID NO: 10515 - protein, 461 aa, Xenorhabdus bovienii
  Peptide sequence Name=Xb4151_4152.C444.gene377.pep
  Gene classification: Gene name=UraA; Function=Xanthine/uracil permeases; Function class=F Nucleotide transport and metabolism
  Homolog annotation: Query=2..461bp; Hit=3..462bp; Blast score=638; Percent Identity=80.0; E value=0; Homolog= yicE COG2233
MVTSSREHSTSEAPEASGSELIYRLEDKPPLLHALFAASQHLLAMFVAVITPAMLICQALGLPELDTQRIISMSLFASGVASLIQIRSWGPVGSGLLSIQGTSFNFVAPLIMGGLALKNGGADIPTMMAALFGTLMMAAITEVLLSRVLHLARKIITPLVSGIVVMIIGLSLIQVGLTSIGGGYSAIQNGTFGVPENLLLAGAVLAVIVLLNRQRNPYLRVASLVIAMAVGYLLAWYMGMLPHATPRTDTPVITVPSPFYYGLSFDWNLLIPLILIFMVTSLETIGDITATSDVSEQPISGPLYMKRIKGGVLANGLNSIVSAVFNTFPNSCFGQNNGVIQLTGVASRHVGYIIASMLILLGLFPAVAGFVQHIPEPVLGGATIVMFGTIAASGVRIVSREPLNRRAIMIIALSLAVGLGVSQQPLILQFAPEWMKNLLSSGIAAGGLTAILLNLIFPQEK

SEQ ID NO: 10516 - protein, 603 aa, Xenorhabdus bovienii
  Peptide sequence Name=Xb4151_4152.C444.gene378.pep
  Homolog annotation: Query=1..561bp; Hit=1..560bp; Blast score=584; Percent Identity=52.0; E value=1e-165; Homolog= gi|37524264|ref|NP _927608.1| hypothetical protein [Photorhabdus luminescens subsp. laumondii TTO1] gi|36783687|emb|CAE12540.1
MKWLGKFFVTLLLLLILAIIVIYIVVQTHWGTKQLNQWLNRQGHYEISIDSISHNWLQPATLTLNNVNIHDKQSAFSLNVSTVNLDLKWQHLLTPRNLHRLTLQQGKLILAGDQLPPLLQADILQLNQMNIQLENPHTQIKGENITGGITPWMPAAGNPFGNGQYQFSASTMSFNGIPFEKVIMQGSYQNKTLTIDTFGAAFLQGAISGDGRQLSDGSWRWNNLLISNIRWQSPMTLSTLQEKTRHLPAIHVKDLNITNAKLQGKNWSVDYLDTTIKNLGLVNGSWEAKDGLIDFNVMNMAFNNAQFSNTLGQLHFSGDTFTVAHLTTHYQKGLFNIQSEWDRKNRQLTFNNSSVTGLVYDLPPTWRNDIKNAAPGWISGLTLNDISVNNTLLIDVNPDFPFQLTTLSGHVDTMNILKNGRWGLWEGQASLQAASGTFNKIEITRPYLQLHATDDRLTIDKLNAFNGHGLLQASGSAEQQTAQKPFELNFKGMNADLGILPRWGWIPLTMQGEGNFSLALTGNLSADDIKGTINGTLTAEDKSSNKDSQSIVQGLILSSNCSPAGTVDGAAIAPSTEAHTAEAGNTRAESETAESKTCLKIKL

SEQ ID NO: 10517 - protein, 305 aa, Xenorhabdus bovienii
  Peptide sequence Name=Xb4151_4152.C444.gene379.pep
  Gene classification: Gene name=WecD; Function=Histone acetyltransferase HPA2 and related acetyltransferases; Function class=K Transcription
  Homolog annotation: Query=1..300bp; Hit=17..316bp; Blast score=466; Percent Identity=74.0; E value=1e-131; Homolog= yiiD COG0454
MYHLRVPQTEQELETYYQFRWEMLRKPLHQPIGSEKDGYDSMAHHQMVVDEHGNPVAVGRLYINADSEGAIRFLAVHPNVQQKGLGTLIAMALESVARQEGVKRIVCSAREDAVDFFNKLGFKNRGLINGARTSPINHFLMIKPIMSLDDILHRPDWCAELQQAWYQQIPLSEKMGLRITQYTGQRFITTMPEAGNQNPHHTIFAGSLFSQATLTAWGLIWLLLQERQLGGNIILVDANIRYRQSITGRPSAIADFNNMSGDLARLARGNKARVKLEVQVSGEQGVGSVFTGTYLVLPVERSVTV

SEQ ID NO: 10518 - protein, 151 aa, Xenorhabdus bovienii
  Peptide sequence Name=Xb4151_4152.C444.gene380.pep
  Gene classification: Gene name=Dtd; Function=D-Tyr-tRNAtyr deacylase; Function class=J Translation, ribosomal structure and biogenesis
  Homolog annotation: Query=7..151bp; Hit=1..145bp; Blast score=209; Percent Identity=72.0; E value=1e-54; Homolog= dtd COG1490
MDNRQKMIALIQRVTQAKVVVEDETIGEIEQGLLVLLGVEKEDNQQKAQRLCEKVMGYRVFSDEQGKMNLNVQQANGSLLVVSQFTLAADTQKGLRPSFSGGAEPQKADEFYRYFVEQCRVTGVKTETGQFAADMKVSLINDGPVTFWLQV

SEQ ID NO: 10519 - protein, 219 aa, Xenorhabdus bovienii
  Peptide sequence Name=Xb4151_4152.C444.gene381.pep
  Gene classification: Function=Predicted hydrolases of the HAD superfamily; Function class=R General function prediction only
  Homolog annotation: Query=15..208bp; Hit=8..201bp; Blast score=255; Percent Identity=61.0; E value=2e-68; Homolog= ZyihX COG1011
MIKVQNDNRQSGGIMLYIFDMGNVIIDIDFKRVLAVWSNLSGTPLATLTTRFSMGEAFEQHECGQITDTAFAEALCDEMEVSLSFEQFTEGWHALFIDVRQDVIELMNKLREQGHRVVVLSNTNRLHFDYWPHHYPEIAASTDFLYLSQDLGMRKPNSDIFKYVLGAEGVTAVQAVFFDDVLVNVEAARKIGINAIHVTDRSVIPDYFKAHDFSLPSET

SEQ ID NO: 10520 - protein, 607 aa, Xenorhabdus bovienii
  Peptide sequence Name=Xb4151_4152.C444.gene382.pep
  Gene classification: Gene name=TypA; Function=Predicted membrane GTPase involved in stress response; Function class=N Cell motility and secretion
  Homolog annotation: Query=3..603bp; Hit=2..602bp; Blast score=1065; Percent Identity=87.0; E value=0; Homolog= ZyihK COG1217
LSINNLRNIAIIAHVDHGKTTLVDKLLQQSGTFGERAATTERVMDSNDLEKERGITILAKNTAIKWNDYRINIVDTPGHADFGGEVERVMSMVDSVLLLVDAMDGPMPQTRFVTQKAFAHGLKPIVVINKVDRPGARPDWVVDQVFDLFVNLGATDEQLDFPIVYASALMGIAGNEHTDMAEDMTPLYQAIVDHVEPPKVDLDGPFQMQISQLDYNNYVGVIGIGSIKRGTVKPNQTITIIDSEGKTRNGKVGKVFSHLGLDRIESAQAEAGDIIAITGLGELSISDTLCDTSAVEALPALAVDEPTVSMYFCVNTSPFCGREGKYVTSRQILDRLRKELVHNVALRVEETEDPDAFRVAGRGELHLSVLIENMRREGFEMGVSRPKVIYREIDGRKQEPFEQVTLDIEEQHQGDVMQALGERKGEMRDMLPDGKGRVRLDYSIPSRGLIGFRTEFMTMTSGTGLLYATFSHYDDIRPGEIGRRQNGVMISNGQGKAVAYALYSLQDRGKLFLGHGTEVYEGQIIGIHSRSNDLTVNCLTGKKLTNVRASGTDEATTLSPYLKKTLEQALEFIDDDELVEVTPQSIRLRKRHLTENDRRRANRGKEM

SEQ ID NO: 10521 - protein, 369 aa, Xenorhabdus bovienii
  Peptide sequence Name=Xb4151_4152.C444.gene383.pep
LRIDSINFKPLPIDFEIESIEVTNFTSQHSLPGDGNSAYEYRAKIINKTNGKKISNYSFDPKQVNWSREPKRSPKLVDEKDLVLFDPEFTTNSEGYLTIKLKSLVGIKNIEVNLNITSPHGDVSKNAKLVDFEVSPQPAGLFMYREGKKDTINLFTKEQERPYNAVGTLHNGELRTKDNKLLSNSENGKLVKVHDYEYDDPDGILSYNNKHDPNFAFENVGKATVKALVQTLNRDNEVVYERLYAYNFNILRLFTAIDQMNDPYVPGISNISCESDNKMGGKTPKLSDVIGPKTLSDEFRNAFSWGLFHRVQLPHDIDKKDFAKFAIIDENAPPNNPYAPYSIYDAVHGNIIDPTNSNVLLICLWKQGG

SEQ ID NO: 10522 - protein, 349 aa, Xenorhabdus bovienii; identical to SEQ ID NO: 5796
  Peptide sequence Name=Xb4151_4152.C444.gene384.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 10523 - protein, 554 aa, Xenorhabdus bovienii
  Peptide sequence Name=Xb4151_4152.C444.gene385.pep
  Gene classification: Gene name=AmyA; Function=Glycosidases; Function class=G Carbohydrate transport and metabolism
  Homolog annotation: Query=1..549bp; Hit=1..547bp; Blast score=787; Percent Identity=68.0; E value=0; Homolog= ZtreC COG0366
MTEQQPWWLDSVIYQIYPKSFQDSTGSGTGDINGITQRLDYLQHLGVEAIWITPFYPSPQVDNGYDVADYCAINPDYGSMEDFDNLVENAHRRGIRIILDMVFNHTSTEHPWFQAAQDINSPSRQFYIWREGSSDSLPNNWKSKFGGNAWQWHAESQQYYLHLFAIKQADLNWEHEPVRAELKKICEFWADRGVDGLRLDVVNLVSKQQDYPSDDHGDGRRFYTDGPRIHEFLQEMSRDVFQPKGLMTVGEMSSTGLEHCLRYSALDSSALSMTFNFHHLKVDYPNGEKWTLAKPDYIALKKIFSTWQQGMHQKAWNALFWCNHDQPRIVSRFGDEHQHHRTSAKMLAMVLHGMQGTPYIYQGEELGMTNPHFERIEEYRDIESLNMYQERIEQGMAPEEILAILAQKSRDNSRTPMQWDGSANAGFTSGTPWIASCDNYPELNAEAALQDKDSVFYCYHELIKLRKQQPILTYGDYLDLLPDHPSLWCYLRRWQNQVMLVIANLSDENQLWSPEPSLTDKEWQVLISNYPSPSSIEKEMSIKPYESIYLIAEK

SEQ ID NO: 10524 - protein, 477 aa, Xenorhabdus bovienii
  Peptide sequence Name=Xb4151_4152.C444.gene386.pep
  Gene classification: Gene name=PtsG; Function=Phosphotransferase system IIC components, glucose/maltose/N-acetylglucosamine-specific; Function class=G Carbohydrate transport and metabolism
  Homolog annotation: Query=97..471bp; Hit=1..375bp; Blast score=563; Percent Identity=80.0; E value=1e-160; Homolog= ZtreB_2 COG1263
MKKNQVNQKDLEKLITLIGGKENIASVSHCITRLRFVLYSPENANAKAIEELSMVKGCFTNAGQFQVVIGTNVDIYYKALLENTGKQSVNKEEVKQAARQNMKWHENAISHFAEIFFPLLPALISGGLILGFRNIIGDIPFSEGKTLAQLYPIWQTIYSFLWLIGEAIFLYLPVGICWSAVKKMGGTPILGIVLGITLVSPQLMNAYLLGQQAPEVWDFGWFTISKVGYQAQVIPSLLAGLTLGWIETRLKKWVPDYLYLVIVPVVSLLLAVFLAHTLIGPMGRAIGDGVAWVVKSLMTGSFAPIGAALFGFFYAPLVITGVHQTTLAIDLQMIQSTGGTPIWPIIALSNIAQGSAVAGIIWASKKQKEREVSIPAAISAYLGVTEPAMYGINLKYRYPMFCAMIGAGLAGLVCGLNHVIANGIGVGGLPGILSIKPQFWMVYLIAMIIAIVVPMLLTVLAYRRNERKTTLINELTN

SEQ ID NO: 10525 - protein, 46 aa, Xenorhabdus bovienii
  Peptide sequence Name=Xb4151_4152.C444.gene387.pep
MTEGLEDNINLFHINICQIGMNYINKLIYIRIIIIKHNILITTKTP

SEQ ID NO: 10526 - protein, 151 aa, Xenorhabdus bovienii
  Peptide sequence Name=Xb4151_4152.C444.gene388.pep
  Gene classification: Function=Uncharacterized BCR; Function class=S Function unknown
  Homolog annotation: Query=1..149bp; Hit=41..189bp; Blast score=219; Percent Identity=75.0; E value=6e-58; Homolog= yaiI COG1671
MSIWVDADACPKVIKEVLYRAAEREKIQVTFVANQRLSVPASAFLRTLQVPAGFDVADNEIVRRSEIGDLVITADIPLAAEVIEKGAIALNPRGERYSEATIRERLTMRDFMDTMRASGIHTGGPATLNQRDRQQFANELDKWLLQQKKVS

SEQ ID NO: 10527 - protein, 178 aa, Xenorhabdus bovienii
  Peptide sequence Name=Xb4151_4152.C444.gene389.pep
  Gene classification: Gene name=FolA; Function=Dihydrofolate reductase; Function class=H Coenzyme metabolism
  Homolog annotation: Query=7..150bp; Hit=6..145bp; Blast score=95; Percent Identity=36.0; E value=2e-20; Homolog= L18647 COG0262
MSKLIYYVAATMDGYIATEDHGLGWLEAFTLGDDATPYDEFYQGIGAAIMGAGTYEWIMKNTSGDWPYQDIPSFILSSRNISIPPGISAVVTHTSTNDIAAEARAAAKGKNVWMIGGGKTAASFADAGELQQLFITTIPIFLGSGIRVLPVNKPIHVTSDKRRFLRSGAIETIMDIKW

SEQ ID NO: 10528 - protein, 280 aa, Xenorhabdus bovienii
  Peptide sequence Name=Xb4151_4152.C444.gene390.pep
MSRFIISRNNKSLLNETVFYLTKGNMLTLKIDGLNSNTKRHLKFQSNNTLVSIFQRDNYLFREQSLQITALNMGVSVVRAVDTDIDYCPYFAAGVAEDCFPPLTIHVLSKISIPTDLTAEQKAILMVLLAETTTPETPGIKYDEKKAKDVMQYMHDVLLNRVRSPKAHELDVPSQGNKLIGLISGARTIEGFSQYPNIKSDIKDRINGMIIAANEGSNSNFLAYRRLIKNAIDIAKSNKISNTEIIAWRTKSTDSPGSNFIKLFSLQGQDFYKLSDSYLK

SEQ ID NO: 10529 - protein, 176 aa, Xenorhabdus bovienii
  Peptide sequence Name=Xb4151_4152.C444.gene391.pep
MKYLIGLCVIFFSLTVFSKQDELDFKAWEKKGSWGIYSEKPNSHFKPLKIKSYKEGYLPAFSYLIKRFNLQNVNNQYCLIGYKWNKTKNSDERENIIVFWKTANYLINWNLPDSEDDDSYKAIIFSKPFIDMSESVVPYKESEGAQALWAKEGVIQMMNDCELNGQKITITPSGVR

SEQ ID NO: 10530 - protein, 197 aa, Xenorhabdus bovienii
  Peptide sequence Name=Xb4151_4152.C444.gene392.pep
  Homolog annotation: Query=3..197bp; Hit=44..239bp; Blast score=180; Percent Identity=45.0; E value=1e-44; Homolog= gi|13471743|ref|NP _103310.1| unknown protein [Mesorhizobium loti] gi|14022487|dbj|BAB49096.1| unknown protein [Mesorhizobium
MKVPYFSQWESFHLANDIIHHQLPLSHDPLWEQSGADSPEEYAKWANHICGMACLKMLLAARSGKIYPLLKLTKMATEYGAYQIEDEHIKGMIYAPVVSMLSEQFGIISQIVTGMTAEKIHEVFTQDSLYIASVHPSIRWPTRLPEKKGGHLVLVTNATPEEITFHNPSGANTQSQIDVKMSVDIFGRFYAERGILI

SEQ ID NO: 10531 - protein, 274 aa, Xenorhabdus bovienii
  Peptide sequence Name=Xb4151_4152.C444.gene393.pep
LITVLTTLRTLALKKVAERVSPENTAFIIGAGTFLTCLSLLPVAITTGISTPSDFFNLAGISAGLMKGVLLGIMLIAQQNLINKSLSSATYVFPISLGFIALIDILIFGSNLTFSSILSINILFVAGILFTMIGHIKSMHKRSKLMFFIMIFCVIGFAIMDRTGIPMSGWFTYLLFTGVGNISVIFFYQKNKFSFVPLKFWLSISIIWFLPELFFNYAIATYLPVSYGYLAITLRIPLLMLISVLVYREGKLSEQMLFSFVAVIAILLMFMERL

SEQ ID NO: 10532 - protein, 243 aa, Xenorhabdus bovienii
  Peptide sequence Name=Xb4151_4152.C444.gene394.pep
  Gene classification: Gene name=RacX (BS); Function=Aspartate racemase; Function class=M Cell envelope biogenesis, outer membrane
  Homolog annotation: Query=4..231bp; Hit=2..224bp; Blast score=166; Percent Identity=39.0; E value=3e-41; Homolog= AF1422 COG1794
MERIGLIGGVSWASTMEYYKRLNMAVQNTGKDFESADLAIISLNFSKILAAQKRDDNETEFNILSKAVHQLAQAEVKKILICSNTTSNTCDRLSKLVNIPIINIIDATANKLLSMKVSNVGLIGTQYVMERDFYKKRLEAKGINVLIPRSRTRQIIHDSIYQDLCRYALTDTSRGIMYRAIDELAELGAEAVILGCTEIPLVVSDRVYQNSIKIIDSIDAHIEAALSLTPENNNTSSMLRYLN

SEQ ID NO: 10533 - protein, 365 aa, Xenorhabdus bovienii
  Peptide sequence Name=Xb4151_4152.C444.gene395.pep
  Gene classification: Gene name=DdlA; Function=D-alanine-D-alanine ligase and related ATP-grasp enzymes; Function class=M Cell envelope biogenesis, outer membrane
  Homolog annotation: Query=101..333bp; Hit=60..276bp; Blast score=94; Percent Identity=30.0; E value=2e-19; Homolog= aq_521 COG1181
MVYFPSDTKTTIPLSIIFGGISPEHPASVSSFDNLIKSFRELNFDRNLNSIYFFDKDGSVLYNAYTPYISPYDFTHSGDKIDLYTAIKRMSKQSEFHINLLHGNLGEDGHIQGVAKYFKIKGTFGSVLPSSLSMSKYHMSHYINSLLPSLRSPKTLLLTEGNLEKAFSLISDNFPEEKIVIKPNSLGASLFTNKYVNLENEKKSILDNLKNIFEYDRFALVQAFIKGKEYSVGCIRIEGKAIALNVVEIITKNGFFGHDEKHRINKAEEILLIQDSEITRTLKDLSIKIFESTGYEFMCRFDFIVTESEEIYFLESNPIPGMMKNSIFPKMLKGHKLSIPGLFIHLSCSSQNISEKKSIFNYIIE

SEQ ID NO: 10534 - protein, 50 aa, Xenorhabdus bovienii
  Peptide sequence Name=Xb4151_4152.C444.gene396.pep
MNNRFTHINKGITEYYSFITMIVLTIRQIPINQIISRFNKFTKTRSSVFI

SEQ ID NO: 10535 - protein, 49 aa, Xenorhabdus bovienii
  Peptide sequence Name=Xb4151_4152.C444.gene397.pep
MSKSVIHDKETEDAQALWTKEVVIQMINDCELNGKKITITPYFKGVVAL

SEQ ID NO: 10536 - protein, 208 aa, Xenorhabdus bovienii
  Peptide sequence Name=Xb4151_4152.C444.gene398.pep
  Gene classification: Gene name=WbbJ; Function=Acetyltransferases (the isoleucine patch superfamily); Function class=R General function prediction only
  Homolog annotation: Query=3..208bp; Hit=2..206bp; Blast score=292; Percent Identity=66.0; E value=1e-79; Homolog= VCA0300 COG0110
MENYFDSPFKGKTLAEQVTNPNIQIGRFSYYSGYYHGHSFDDCARYLHPDLVDVDKLIIGSFCSIGTGVAFMMAGNQGHRLDWVSSFPFFYMSEEPAFADAQNGYQPMGDTVIGNDVWMGAEAIIMPGVNIGDGAVIGTRALVTKDVEPYTIIGGNPAKVIRKRFSDEQIAMLLEMQWWNWPLEQLKAAMKMLTSADIEGLYRWWQNQ

SEQ ID NO: 10537 - protein, 51 aa, Xenorhabdus bovienii
  Peptide sequence Name=Xb4151_4152.C444.gene399.pep
MIWLYWSYNELLPSQDLVTRCKKTLREVEPLAEMEQGRKRLTFSQDFIPKN

SEQ ID NO: 10538 - protein, 102 aa, Xenorhabdus bovienii
  Peptide sequence Name=Xb4151_4152.C444.gene400.pep
MRMFCSISRFASATAAFAIKLFKLAYPDNDSAISSNSLVSEFTLVVILSFDNVAIVKTPPYCGYWFNIRSNLTFSLTKINIRAKMTPKTKWEKNDMAILELQ

SEQ ID NO: 10539 - protein, 65 aa, Xenorhabdus bovienii
  Peptide sequence Name=Xb4151_4152.C444.gene401.pep
  Homolog annotation: Query=1..65bp; Hit=33..98bp; Blast score=85; Percent Identity=80.0; E value=2e-16; Homolog= gi|37524949|ref|NP _928293.1| hypothetical protein [Photorhabdus luminescens subsp. laumondii TTO1] gi|36784375|emb|CAE13254.1| u
LNSFIANAAVAEAKRLIEQNMRIKLCQEDAVAFVHALEEPTQINERFLRAARRHKDLLDEDRVSK

SEQ ID NO: 10540 - protein, 170 aa, Xenorhabdus bovienii
  Peptide sequence Name=Xb4151_4152.C444.gene402.pep
  Gene classification: Gene name=WecD; Function=Histone acetyltransferase HPA2 and related acetyltransferases; Function class=K Transcription
  Homolog annotation: Query=1..155bp; Hit=2..155bp; Blast score=144; Percent Identity=47.0; E value=4e-35; Homolog= VCA0318 COG0454
MKIECLNKNKHDRNNFDCGEPALNNYLKAVSGQHDKKDLSRTFVLTSSQNESQIKGYYSLALCTVELDEIPEKISKKYPSSLYCALIGRLAINKLFQRQGLGEILLIDAIRKSIESSESIPTPMIIVDAKHDIAKKFYINMGFQEFPKMKFRLFMPMNAAVNIIEQIDAI

SEQ ID NO: 10541 - protein, 83 aa, Xenorhabdus bovienii
  Peptide sequence Name=Xb4151_4152.C444.gene403.pep
  Homolog annotation: Query=35..80bp; Hit=220..265bp; Blast score=65; Percent Identity=67.0; E value=2e-10; Homolog= gi|21233682|ref|NP _639980.1| transposase [Proteus vulgaris] gi|21202866|dbj|BAB93582.1| transposase [Proteus vulgaris]
MKRKSPQKFTDNFKREAVNLVVEQSYTVPQAAETKTHHENQAEMKKDVLGYLHYYNLTRLHTANNDLTPVEYEMAFVKVSDFS

SEQ ID NO: 10542 - protein, 308 aa, Xenorhabdus bovienii
  Peptide sequence Name=Xb4151_4152.C444.gene404.pep
  Gene classification: Gene name=PaaX; Function=Phenylacetic acid -responsive transcriptional repressor; Function class=K Transcription
  Homolog annotation: Query=7..308bp; Hit=3..303bp; Blast score=342; Percent Identity=55.0; E value=3e-94; Homolog= paaX COG3327
MEKMAHKLDDFIRHALDAQPISGTSLIISLFGDALSHRGGEVWLGSLSLLLEPMGFSDRFVRTSVFRLQKEGWLAVEKIGRRSYYRITERGMNQFRHAESKIYLSEQPEWDGKWDLLLLEGTTKEERNRLKKELSWLGFGQLNSTLMAAPSSAQSDIPALLGELNASDSVIYFRADYPYPRSEQSLKERVSASWSLDQVVKHYHEFIVSFRPLMKLLQDCSEADLTPERSFQLRLLLIHFYRRVVLRDPLLPDALLPAQWEGQVARNLCTNIYHRIDLTATHYVSERCETTIGTLPPPAAAYYRRFGG

SEQ ID NO: 10543 - protein, 435 aa, Xenorhabdus bovienii
  Peptide sequence Name=Xb4151_4152.C444.gene405.pep
  Gene classification: Gene name=PaaK; Function=Coenzyme F390 synthetase; Function class=H Coenzyme metabolism
  Homolog annotation: Query=8..432bp; Hit=7..432bp; Blast score=692; Percent Identity=76.0; E value=0; Homolog= paaK COG1541
MSNNVQHLDSIEFASRDEIQAHQFEQIKWTLHHAYNNVPMYRRKFDTAGIHPSDFRQLADITKFPYTTKQDLRDHYPFDTFAVPMEQIVRIHASSGTTGHPTVVGYTQRDIDHWANLVARCLRFAGASAKDKVHVAYGYGLFTGGLGAHYGAERLGATVIPMSGGQTEKQAQLILDFKPDVIMMTPSYCLTLLDALEQRMGGDASKCSLRVGIFGAEPWTEALRSEIETRMGIKALDIYGLSEVMGPGIAMESVEHANGSTIWEDHFYPEVIEPDNLNVLPDGESGELVFTTLTKEAMPVIRYRTRDLTRLLPGTARHMRRMDRIAGRSDDMLIIRGINVFPSQVEEQIIRFKELSPHYQLEVNRTGNYDCLSVKVELKEPERLDAQQRCDICHQLRHHIKSMIGLSTEVSIVNCGDIPRSEGKAVRVIDHRQHE

SEQ ID NO: 10544 - protein, 404 aa, Xenorhabdus bovienii
  Peptide sequence Name=Xb4151_4152.C444.gene406.pep
  Gene classification: Gene name=PaaJ; Function=Acetyl-CoA acetyltransferases; Function class=I Lipid metabolism
  Homolog annotation: Query=1..403bp; Hit=1..401bp; Blast score=584; Percent Identity=76.0; E value=1e-167; Homolog= paaJ COG0183
MTHAFICDGIRTPIGRYGGALSGLRADDLAALPLQALLARYPSLDWQQIDDVILGCANQAGEDNRNVARMAVLLAGLPYSVSATTLNRLCGSGLDALAFAARGIKAGEAQLMLAGGVESMTRAPFVMGKTDSPFSRQAQIFDTTLGWRFINPLMQQQFGTDSMPETAENVAAQFQISRDDQDAFALRSQQRTANAEQRGIFAEEITPITLPSTDKKGTPTIVSRDEHPRPETTFEQLQRLKTPFRVDGTITAGNASGVNDGAAALIIASETAALQQGLTPRARIIATATCGVEPRMMGIGPLPATRKVLELTGLSLNQMDVIELNEAFAAQSLAVMRQLGLPDDAEQVNPNGGAIALGHPLGMSGARLALTATLELERRTGRYALCTMCIGVGQGIAMIIERIS

SEQ ID NO: 10545 - protein, 183 aa, Xenorhabdus bovienii
  Peptide sequence Name=Xb4151_4152.C444.gene407.pep
MAETMGMTTKKGHDFAVLIDNSDVIQARGFSLMLHKSGGCQAVTAEGRADKINATTGCHRRQPFAVAGIGEGSIGQTEQDATMTALMAVEHVWFNGHAYLGDPCINMVDVHSHILGAGIFGIHGFYAALSQLAGSVSGHGCVPYFDFDLAGDAALHSLPPVGATKVQVGNGVRHKIAVSFPVC

SEQ ID NO: 10546 - protein, 534 aa, Xenorhabdus bovienii
  Peptide sequence Name=Xb4151_4152.C444.gene408.pep
  Gene classification: Gene name=FadB; Function=3-Hydroxyacyl-CoA dehydrogenase; Function class=I Lipid metabolism
  Homolog annotation: Query=15..515bp; Hit=8..473bp; Blast score=440; Percent Identity=48.0; E value=1e-123; Homolog= ydbU COG1250
MNTPAHHHPILHGPIAVIGAGTMGIGIAQVAAQAGYSVLLFDVNNEAAQRALETLHTRLHQRVEAGKAAAGATQALLQRITRVDSLQALAPSALVIEAIIEQLEVKQNLFRQLEPLCSAGTIFASNTSSLSITAIARVLASPQRMAGLHFFNPAPLMKLVEIIQGLETSSQTITTLKSLVTDWQKQPVVCRSTPGFIVNRIARPFYAETLRALEENVASPATLDAVMKESGGFAMGALQLTDLIGHDVNYAVTESLFHAFHGDPRFQPSLRQKELVEADHLGRKRGQGFYVYDSKEKHQPLPRLETLQEQIRPARIQATGDWGTLPHFAALLKPLLQQYGIAPEESKNTDSQPPALQLDDVILTLTQGKTSAQLADEIRAPVVQFDLAANHQTASIITLSSACQNTRPQTAKVISFLQSLGKQVILLPDYPALLTMRTVAMLCNEALDAINKSIASAADIDLAMCYGVNYPIGPLAWGEQLGWRHILSTLENLQQFYGEPRYRPAPLLRQLAAGYVTLHLQRDQNQNKERNHVR

SEQ ID NO: 10547 - protein, 265 aa, Xenorhabdus bovienii
  Peptide sequence Name=Xb4151_4152.C444.gene409.pep
  Gene classification: Gene name=CaiD; Function=Enoyl-CoA hydratase/carnithine racemase; Function class=I Lipid metabolism
  Homolog annotation: Query=4..265bp; Hit=2..262bp; Blast score=334; Percent Identity=65.0; E value=4e-92; Homolog= paaG COG1024
MENMSMILTDIEAGVLSITLNRPERINSFNEEMHQQLSEALKIAEQDESVRCVLLSGAGRGFCAGQDLNDRNAIISEGDVPDLGQSVERFYNPLIRRLTSLPKPVICAVNGVAAGAGVSVALACDIVIASRTASFIQAFCRIGLTPDAGGSWFLPHKIGHARAMGMALLGDKISAEQALEWGMIWQVVEPEALEDKTRELAQHLATQPTVALSCIKKATYAAAANSLDQQLNLERDLQRLCGRSEDFREGVSAFIDKRQPQFKGR

SEQ ID NO: 10548 - protein, 257 aa, Xenorhabdus bovienii
  Peptide sequence Name=Xb4151_4152.C444.gene410.pep
  Gene classification: Gene name=CaiD; Function=Enoyl-CoA hydratase/carnithine racemase; Function class=I Lipid metabolism
  Homolog annotation: Query=6..256bp; Hit=4..254bp; Blast score=279; Percent Identity=62.0; E value=3e-75; Homolog= ydbS COG1024
MSHEWILCHQQQRVRTLTLNRPEVRNALSNDCLEQLVQQLEQADADTGTGAIVITGASRYFAAGADLRELQQQTVATAMTDRRPQLWQRLHNISKPLIAAVNGYALGAGCELVLACDLVICGESARFGLPEITLGLMPGAGGTQRLIRCVGKALANQMILTGEAINAQKAQQAGLVSEVCIDALTLERAEQIAQRISEFSPLALRAAKAALKTAHETSLSQGLLAERQQFVALAGTADRQEGITAFLEKRKPTFKGF

SEQ ID NO: 10549 - protein, 361 aa, Xenorhabdus bovienii
  Peptide sequence Name=Xb4151_4152.C444.gene411.pep
  Gene classification: Gene name=Hmp; Function=Flavodoxin reductases (ferredoxin-NADPH reductases) family 1; Function class=C Energy production and conversion
  Homolog annotation: Query=8..360bp; Hit=3..351bp; Blast score=411; Percent Identity=57.0; E value=1e-115; Homolog= paaE COG1018
MATFHRPTFHRLSIAAIERETPDAVTVTLHVPDELKALFCYQPGQHLTLKARVDGAELRRCYSICSSPLDDGLQIGVKATYQGRFSTFINQRLKVGDELDVMQPQGNFGHHPDGNNAGNYLAIAAGSGITPILSIIKSTLALEPDSTFTLIYGNRTSRSVMFKEALADLKNRYLHRFQVLYLFSQEITDSPMFNGRIDSEHLQHLGKILLNFSQFGQAFLCGPAAMLDDAKSALEQAGMASERIHTERFNTGRNPSSTAARPANLAERSETRVEIHLDGRTLNIAMNTEDDSILDAALRQGADLPYACKGGVCATCKCRLKSGEVDMNVNYSLEPDQLAAGYILSCQSWPKGDGVVVDFDV

SEQ ID NO: 10550 - protein, 169 aa, Xenorhabdus bovienii
  Peptide sequence Name=Xb4151_4152.C444.gene412.pep
  Gene classification: Gene name=PaaD; Function=Predicted metal-sulfur cluster biosynthetic enzyme; Function class=R General function prediction only
  Homolog annotation: Query=13..169bp; Hit=12..167bp; Blast score=196; Percent Identity=61.0; E value=1e-50; Homolog= paaD COG2151
MEQHVNTLQLQNPAIHQIWQCLHQIADPELPVLSITDLGMVRAVTPQLTGWRVTFTPTYSGCPATEYLINEIQQTLARAGFTSVTVEISLRPAWTTDWMNADAKQRLREFGIAPPQGLACEKPTETETITCPRCGSHETEKISEFGSTACKAIYRCQQCLEPFDYFKCI

SEQ ID NO: 10551 - protein, 258 aa, Xenorhabdus bovienii
  Peptide sequence Name=Xb4151_4152.C444.gene413.pep
  Gene classification: Function=Uncharacterized BCR; Function class=S Function unknown
  Homolog annotation: Query=11..258bp; Hit=2..248bp; Blast score=323; Percent Identity=65.0; E value=9e-89; Homolog= ydbP COG3396
MNTHSVDPSNHDLLNYVLRQGDTPLILAQRLCEWCGHAPELEIDLALSNIGLDLLGQARHFLSYAATLYGMDFDEDRLAFGRDEREYRNLLLVEQPNGGFNDTLVRQFFIDAYHVLLHQALGQSRDPQLAAISTKSLKEVEYHLRFSRGWMIRLGDGTELSREKIRQSVNQLWRFTGELFYCDEVEQRLAEEGIAVDPRTLYEPWRQIINETFAQATLEIPQETPYRQGGKQGLHTEHLGYMLAEMQYLQRTYPNCNW

SEQ ID NO: 10552 - protein, 95 aa, Xenorhabdus bovienii
  Peptide sequence Name=Xb4151_4152.C444.gene414.pep
  Gene classification: Function=Uncharacterized enzyme of phenylacetate metabolism; Function class=Q Secondary metabolites biosynthesis, transport and catabolism
  Homolog annotation: Query=1..95bp; Hit=1..95bp; Blast score=164; Percent Identity=78.0; E value=2e-41; Homolog= ynbF COG3460
MSDTDWPLYEVFIRSKQGLAHRHVGSLHAADDQMALENARDVYTRRNEGCSIWVVKSIHLVASQPEERGAFFDPSEDKIYRHPTFYTIPDGIKNM

SEQ ID NO: 10553 - protein, 313 aa, Xenorhabdus bovienii
  Peptide sequence Name=Xb4151_4152.C444.gene415.pep
  Gene classification: Function=Uncharacterized BCR; Function class=S Function unknown
  Homolog annotation: Query=7..312bp; Hit=4..309bp; Blast score=504; Percent Identity=76.0; E value=1e-143; Homolog= ydbO COG3396
MTTNSLQAHFDAKIAADLSIEAKDWMPDAYRQNLIRQIGQHAHSEIVGMLPEANWITRAPTLRRKAVLLAKVQDEAGHGLYLYSAAETLGCTRQDIYQKLLNGKMKYSSIFNYPTLNWADVGVIGWLVDGAAIINQVALCRASYGPYARAMVKICKEESFHQRQGYEAVMVLAAGNDAQRKMLQDAINRFWWPTLMMFGPNDNDSPNSAQSMAWKIKRFSNDELRQKFIDSTVPQLEALGMTAPDPELVWDATTEHYRFGEIDWDEFYQVLKGQGICNHERLEAKRRAWETGSWVREAASIHAKKMATRKNAA

SEQ ID NO: 10554 - protein, 695 aa, Xenorhabdus bovienii
  Peptide sequence Name=Xb4151_4152.C444.gene416.pep
  Gene classification: Gene name=PutA; Function=NAD-dependent aldehyde dehydrogenases; Function class=C Energy production and conversion
  Homolog annotation: Query=1..507bp; Hit=1..500bp; Blast score=646; Percent Identity=68.0; E value=0; Homolog= maoC_1 COG1012
MQQLTSYICGAWVYGQGNARTLHHAVSGEALYQVCSDGLPLADSLGYAREKGGKSLSAMTFQQRAQMMKAVAKHLLANKETLYAISAETGATRADGWVDIEGGIATLFSYAGLAGRELPDDTLWPEDEMIPLSKQSQFVARHVLTSRPGVALHINAFNFPCWGMLEKLAPTWMAGMPAIIKPATASAQLTQAMVKMIIDSGLVPEGALQLICGGIGDLFDHLDYQDAVTFTGSAQTGQKLRVHPRLIEKSIPFTMEADSLNCCMLGEDVTPEMPEFGVFIKEVVREMTAKAGQKCTAIRRIIVPVSQLEAVKQALLKRLSGVTVGDPALPEVRMGALISLEQRDEVQAKVDELLRHGCEPLCGGALDQLVLTGNSSNEGAFYPPTLLYCADPVAHQAVHGTEAFGPVSTLMPYQGTEQAIALVLMGQGSLAGSLVTADEQIAVQVIRATACAHGRMLVLDEAASAESTGHGSPLPMLVHGGPGRAGGGEELGGLRAVKHYMQRTAIQGSPNMLAAIGREWVRGAKVKTDPVHPFRKYFEQLEIGESLLTARRTVTEADIVNFACLSGDHFYAHMDKLGAAESLFGERVAHGYFVVSAAAGLFVDAAVGPVLANYGMENLRFIEPVKIGDTIQVRLTCKKKIKKVQKTPDDKPQGVVVWDVQVLNQEQQPVALYSILTLVERQQGDFTASESVRLR

SEQ ID NO: 10555 - protein, 364 aa, Xenorhabdus bovienii
  Peptide sequence Name=Xb4151_4152.C444.gene417.pep
  Homolog annotation: Query=1..357bp; Hit=2..358bp; Blast score=510; Percent Identity=71.0; E value=1e-143; Homolog= Pa|Phot5-385h12.p1k _g11| 9245 - 10345 449 366 aa, chain -
MKTYPLQSMTMAQAQQQQFKLVDIICRHFPGADFLSQGDLGLVPDLHQPRMTHRIEAVIAEHFGAEAAAFVNGAGTGALRAGLAALVSPNATLLVHDAPIYPTTKISIEQMGLHVVYADFNHTEQIAAAIRQYQPAASLIQHTRQKIDDSYALQDVLAILHQYQIPSLVDDNYAAMKVAHIGCEYGATLSSFSCFKLLGPQGVGLVIGKQTMIETLRRSMYSGGCQIQGYQAMEALRGLVSAPVIHAVQAEVNETLVTRLNQGELPQVKQAFLANAQSKVLLVEFHDPIAEAVLTAAHGLGALPYPVGAESKFEIPPLFYRISGTFRQADPTLEKRMIRINPNRSGAETVMRILRESIFQKSGQ

SEQ ID NO: 10556 - protein, 455 aa, Xenorhabdus bovienii
  Peptide sequence Name=Xb4151_4152.C444.gene418.pep
  Homolog annotation: Query=11..455bp; Hit=3..451bp; Blast score=611; Percent Identity=77.0; E value=1e-174; Homolog= Pa|Phot5-385h12.p1k _g12| 10538 - 11893 936 451 aa, chain -
MSDINAIQHLHSFLMSLMEVDPFKAGLLAAIGAIAAMMANRGIAVFHDGLRPLLPEYLEGRMSRKALAATSFALSIGLVVGFGIPFSLAAPIVLVHSLLLGTDMIGIWCANSRRGFIASGIIGALYAIALLAGLRSVVELFAMLPVNFTDDLKKVGDPIVACFALFPAIVVGYQYGYRKGLWVMLTALIGYLATKAVGPLSFGGMIEKPVSFDPNGAALLLSMIAMFYFAMRERPAQSAEQKGANEVLVGLFSTRIERIQKNKWLLILCGGLTASAATMSFSLLAEGPVSLQLMAQGEQTNALLVALARAISFIPLVGTTAIATGVYSPNGMKFVFVAGLATNNPWIAFIAGGITMFIEIQLLAKIAIWLDKYPGVKACSGHIRTAITKMLEVALLVGGMIASNAILPGIGFMIVAGIYLLNRTSRRPLVEMAIGPIATIAVGILANVLYLLGIK

SEQ ID NO: 10557 - protein, 120 aa, Xenorhabdus bovienii
  Peptide sequence Name=Xb4151_4152.C444.gene419.pep
  Homolog annotation: Query=1..118bp; Hit=1..117bp; Blast score=156; Percent Identity=73.0; E value=5e-38; Homolog= gi|37525917|ref|NP _929261.1| hypothetical protein [Photorhabdus luminescens subsp. laumondii TTO1] gi|36785346|emb|CAE14291.1|
MKFVIGGQIEKERIAESIRQLAGDKATAITIMNDIEAAMAIKNGDADYYLGACNTGGGGALAIAIALIGLNQCATISMPGKILSDDEIIAHVKAGKKAFGFTGQDIDVVLPVIINTIVSQ

SEQ ID NO: 10558 - protein, 362 aa, Xenorhabdus bovienii
  Peptide sequence Name=Xb4151_4152.C444.gene420.pep
  Gene classification: Gene name=Php; Function=Predicted metal -dependent hydrolase with the TIM-barrel fold; Function class=R General function prediction only
  Homolog annotation: Query=68..356bp; Hit=4..292bp; Blast score=384; Percent Identity=63.0; E value=1e-107; Homolog= php COG1735
MGYQKQTGNTPTHSATYSSSRIDEAEDALKQADYQEYQVKRRGETLLYSSNKQLNNPHLGTQQNTCIDTSGYTYVHEHLHIDLSGAKGSLDCRLDQYDLIVDELRHLYTLGLRNIAEMTNRYMGRNANFLLDLMRDSHINIIASTGYYKEPFFPAHFSELSVQAIADDMIAEIETGIDGTGLKAGVIAEIGSSLDQITADEKKVFAAAALAHHATGCPISTHTTLSTMGREQLALLKEFGVSAEHVAIGHCDLKDNLDTIIPLLEEGAWIQFDTIGKNNYYPDSGRIAMLREVAKRGLLGQVMLSQDITRRSHLKSNGGIGFDYLLTVFVPMLLAAGFSQTQIDLMLRDNPAQFFRHGFSKT

SEQ ID NO: 10559 - protein, 391 aa, Xenorhabdus bovienii
  Peptide sequence Name=Xb4151_4152.C444.gene421.pep
  Gene classification: Function=Predicted amino acid racemase; Function class=E Amino acid transport and metabolism
  Homolog annotation: Query=1..383bp; Hit=1..383bp; Blast score=456; Percent Identity=55.0; E value=1e-128; Homolog= yhfX COG3457
MFINALKKQNPKLIEIAKDLWQQGAILPDTYIIDVDQVLDNGRHLLQAAEQYGIELYLMTKQIGRNPWLAQKLIELGYPGVVAVDFREAYALSQHGIPLCHIGHLVQTPAHLIETMLKQHPGIITVFSIEKAQAISDAAEKLGRIQPIMLKVFDKRDITLPSQEAGIFFDELDTTVDVLKTMPGIKLSGLTHFPCLEWNARYQTTLPTINLQTLLRARNRLEQLGIELSQINAPSASSCNTIPLLAKYGATHLEPGHALTGTIPANISGQEPEKISMVYITEVSHHYDGNSYCYGGGYYKRGHMKYALVFPEHARSPKTVRVLSLGDPCIDYHIPISGIHPIGSPVIMCFRTQIFVTRSDVALVSGIQSGSPKLQGIYDSQGNWKNRGYFQ

SEQ ID NO: 10560 - protein, 120 aa, Xenorhabdus bovienii
  Peptide sequence Name=Xb4151_4152.C444.gene422.pep
  Homolog annotation: Query=2..116bp; Hit=15..129bp; Blast score=109; Percent Identity=48.0; E value=7e-24; Homolog= gi|16131260|ref|NP _417841.1| hypothetical protein [Escherichia coli K12] gi|7465914|pir||A65133 hypothetical 15.2 kD protein
MVEQRLTILLQGGVIDQDIYDNMLDIVHDLEDIWLIPVHHPQGEMALTHMASAFMRSRRGEIVLPLEKNILTKIEQSEHCAQLFKIHRALLEKFTITLHPNEEGYLLVNLYGLILATKIP

SEQ ID NO: 10561 - protein, 302 aa, Xenorhabdus bovienii
  Peptide sequence Name=Xb4151_4152.C444.gene423.pep
  Homolog annotation: Query=2..302bp; Hit=1..301bp; Blast score=355; Percent Identity=60.0; E value=7e-97; Homolog= gi|24114646|ref|NP _709156.1| orf, conserved hypothetical protein [Shigella flexneri 2a str. 301] gi|24053850|gb|AAN44863.1|AE0
MMSQTFIKKEGIAQSFLARYLLSEQCGNRLKTIELLAKECGLSVGLMQAALKSLEQAQAVGIKRRGRNGSFLSQINHKLLLEYADIGNVVCAMPLPYTRAYEGLASGLKALCAEIPFYFAHMRGSDIRIECLLNGVYDLAVTSRLAAEQHPENKDLYIALSLGTQSYTDRHRLIFRHGEMDSIRRVGLDSTSADQKIMTNQYFEGKEIEVVEVSYHECLNQIMKGHIDAAIWNVGQGHELVAQGLMTQLPDDSECFIKASEAVILARKDNIPIQQLLYTMVDREALLTHQQNVVAGTIEPVY

SEQ ID NO: 10562 - protein, 169 aa, Xenorhabdus bovienii
  Peptide sequence Name=Xb4151_4152.C444.gene424.pep
MLTIREATIKDAVLLSQLIEESYRFHFSYLWHNKTELEEYVAEEGSPEKISNSLNTTNHKWFIAETHHSVGFAKIVFYEPLPDSDLTGVYLHKLHLMPHQTGQKYGEQLFDHIVKLGQEQGLQWLWLEVLEQNTLAIKFYERKGMKWYKNIIFSRSKQKSTLHIMTKPI

SEQ ID NO: 10563 - protein, 501 aa, Xenorhabdus bovienii
  Peptide sequence Name=Xb4151_4152.C444.gene425.pep
  Gene classification: Gene name=GlpA; Function=Glycerol-3-phosphate dehydrogenase; Function class=C Energy production and conversion
  Homolog annotation: Query=1..495bp; Hit=1..494bp; Blast score=744; Percent Identity=76.0; E value=0; Homolog= ZglpD COG0578
METKDLIVIGGGINGAGIAADAAGRGLSVLLLEGQDLASATSSASSKLIHGGLRYLEHYEFRLVSEALAEREVLLKLAPHIAFPMRFRLPHQPHLRPAWMIRIGLFLYDNLGKRVSLPSSKGLKFGANSVLKPSIRRGFEYSDCWVDDARLVVLNAQEVQKHGGEVRTRTQVTRAWREKGYWMVEAKDLTTGKTDTWRAKGLVNATGPWVKNFFDDGLKLKSPYGIRLIKGSHIVVPRAHDEPQAYILQNEDNRIVFVIPWNDEFSIIGTTDVEYKGDPKEVKIDDQEIGYLLKVYNNHFKKQLNRSDVVWTYSGVRPLCDDESDSPQAITRDYTLDVQDEQGQMPLLSVFGGKLTTYRKLAEHALEKLVQYYPNAGKAWTKNGKLPGGELEGHDRDGYARLLRQRHNWLPEGVAQRYARTYGSNCQIILKGAEALTDLGEFFGHGLYEAELRYLVEHEWVTQLDDAIWRRTKLGMWLTDEQKQRVADWLAQNVQSSQAQS

SEQ ID NO: 10564 - protein, 252 aa, Xenorhabdus bovienii
  Peptide sequence Name=Xb4151_4152.C444.gene426.pep
  Gene classification: Gene name=GlpR; Function=Transcriptional regulators of sugar metabolism; Function class=K Transcription
  Homolog annotation: Query=1..252bp; Hit=1..252bp; Blast score=393; Percent Identity=77.0; E value=1e-110; Homolog= ZglpR COG1349
VKQTQRHDAIIELVRLQGYVSTEELVEHFDVSPQTIRRDLNDLADKNKIQRHHGGAALPSSSVNTAYHDRKIMWSDEKARIARQVATQIPNGATLFIDIGTTPEAVAHALLNHRDLRIVTNNLNVASLFMGKEDFRLIMAGGEVRSRDGGIIGEATLDFISQFRLDFGILGISGIDSDGSLLEFDYHEVRAKRAIIENSRCVMLVADHSKFGRSAMVNLGNMNLIDFLFTDKVPPASIQKIIEQHSVKLELC

SEQ ID NO: 10565 - protein, 277 aa, Xenorhabdus bovienii
  Peptide sequence Name=Xb4151_4152.C444.gene427.pep
  Gene classification: Gene name=GlpG; Function=Uncharacterized membrane protein (homolog of Drosophila rhomboid); Function class=R General function prediction only
  Homolog annotation: Query=1..276bp; Hit=1..274bp; Blast score=251; Percent Identity=46.0; E value=5e-67; Homolog= ZglpG COG0705
MIHVTSISNPRLAQAFIDYMVTQGIHLTMRPTHEPALVELWLEDENQLSFVEQELNQFSRDPFNERYQTASWQAGKSGYSFKYHNSLNLSTLKSQSGPLTISVTALCILVYLWMQVAGDSDVMRWLAWPNGEQYLELWRWVSPALLHFSLTHLLFNLALWWYLGSQVERHMGAGKLFEITIVSAVFTDWAQSLFSGSHFGGLSGVVYALISYVWLTGEMSPKRGISVPRGLIAISVIWLLVGYFDMFSLNIANAAHFSGLIIGLLMGLWDNLRKQKN

SEQ ID NO: 10566 - protein, 107 aa, Xenorhabdus bovienii
  Peptide sequence Name=Xb4151_4152.C444.gene428.pep
  Gene classification: Gene name=PspE; Function=Rhodanese-related sulfurtransferases; Function class=P Inorganic ion transport and metabolism
  Homolog annotation: Query=1..104bp; Hit=1..104bp; Blast score=134; Percent Identity=58.0; E value=2e-32; Homolog= glpE COG0607
MDRFQTINPEQAYQHWLNKTAVMVDIRDPQSFRAGHTTGAFHLTNETLNNLLQETDFDQPVMVMCYHGHSSQGAAQYLVNMGFETVYSVNGGFDVWQRSYPEAVNTL

SEQ ID NO: 10567 - protein, 191 aa, Xenorhabdus bovienii
  Peptide sequence Name=Xb4151_4152.C444.gene429.pep
  Gene classification: Function=Thioredoxin-like proteins and domains; Function class=O Posttranslational modification, protein turnover, chaperones
  Homolog annotation: Query=97..191bp; Hit=1..95bp; Blast score=187; Percent Identity=92.0; E value=7e-48; Homolog= yhgI_2 COG0694
MINITEAAQAHFAKLLASQEPGTQIRVFVINPGTPTAECGVSYCPPDAVEATDTELKFDQISAYVDEISAPFLAEAVIDFVTDQLGSQLTLKAPNAKMRKVTDDAPLIERVEYVLQSQINPQLAGHGGRVSLMEITDAGYAILQFGGGCNGCSMVDVTLKEGIEKELLNMFPELKGVRDLTEHQRGEHSYY

SEQ ID NO: 10568 - protein, 332 aa, Xenorhabdus bovienii
  Peptide sequence Name=Xb4151_4152.C444.gene430.pep
  Gene classification: Gene name=ComFC (BS); Function=Predicted amidophosphoribosyltransferases; Function class=R General function prediction only
  Homolog annotation: Query=95..332bp; Hit=6..243bp; Blast score=205; Percent Identity=46.0; E value=5e-53; Homolog= ZyhgH COG1040
MQYGWQPILPATSPATTHSPVPAAIQYPPFLPESLPDTAGCDHAPANPPDVSGNAKTVAFPRNARPQNSIPIRAASQDRVEPHPLSAKTTYSLLFSSYLSSRKEPMLTMVGYCWLCHQSLYFAHHGICHICHQQLKRLKHVCPRCALPAESRDFPCGRCLKNPPPWQHLIAITDYAPPLSRLIRRYKYHGTPQLATVLARLFLLHWLQGYRDGRWNKPDCILGIPLHSKKRWRRGFDQIELIAKPLSRWLQCHYQPDLLWRSRATLTQRGLSATQRKTNLKHAFQLRGDFTDQNVAIFDDVITTGTTLHEASQLLIRAGAHSVQAWAICRTL

SEQ ID NO: 10569 - protein, 258 aa, Xenorhabdus bovienii
  Peptide sequence Name=Xb4151_4152.C444.gene431.pep
  Gene classification: Gene name=MhpC; Function=Predicted hydrolases or acyltransferases (alpha/beta hydrolase superfamily); Function class=R General function prediction only
  Homolog annotation: Query=1..245bp; Hit=1..245bp; Blast score=325; Percent Identity=64.0; E value=2e-89; Homolog= bioH COG0596
MNKLFWQIMGEAPRDLVMLHGWGLNSEVWRSVETRLSSHFRLHLVDLPGHGRSQPYPAMTLAEMADTVWQQAPENALWLGWSLGGLVASRIALDHPAEVAGLITVASSPKFSAEGDWPGIKPTVLRAFEHQLSEDFQKTVERFLSLQTLGTDSARQDARLLKSVILNQPMPTVEVLNAGLETLRTDDLRAELAQLQLPFLRLYGYLDGLVPRKIAAQLDNEWPHTHSVIMRNAAHAPFVSHPDEFVDAVMEFVANAGL

SEQ ID NO: 10570 - protein, 147 aa, Xenorhabdus bovienii
  Peptide sequence Name=Xb4151_4152.C444.gene432.pep
  Homolog annotation: Query=1..144bp; Hit=1..144bp; Blast score=211; Percent Identity=67.0; E value=2e-54; Homolog= Pa|Phot2-44g08.q1ka _g15| 7888 - 8328 846 146 aa, chain -
MPKELFTAEIESSGHLKMQCSTRGFSFHVDEPKNLGGTDEAMNPVEALLSAFGACQCIVAKSFARKHKINLIDIQVKMEGELDTDGFTGRNKNTKMGFSKITSKFYIKADNTEQEIRDFIDFVESNCPVLDTILNAPEIVTEVYPSR

SEQ ID NO: 10571 - protein, 93 aa, Xenorhabdus bovienii
  Peptide sequence Name=Xb4151_4152.C444.gene433.pep
MGDDLFPFRIKSIPKPMTLFFIAYKKPLLIQFTDKCDIVISDLSRCYFFWREFFNVRITVLIPRPNTRPVSLTPEPFIAISTIFSFIPGLWPL

SEQ ID NO: 10572 - protein, 129 aa, Xenorhabdus bovienii
  Peptide sequence Name=Xb4151_4152.C444.gene434.pep
  Gene classification: Gene name=InsB; Function=Insertion element IS1 protein InsB, putative transposase; Function class=L DNA replication, recombination and repair
  Homolog annotation: Query=1..113bp; Hit=7..119bp; Blast score=135; Percent Identity=60.0; E value=8e-33; Homolog= Z1562 COG1662
LDEQWFFIGNKKQRHWLWYAFDTKRKQVIAHVFDPRTDATCRKLLNLLVPFNIRFITTDNGGSYAREVVPEKHRVGKIFTQRIERHNLNLRIHIKRLARRTICYSRSMEIHEKLIGAYIEKHHYNPLES

SEQ ID NO: 10573 - protein, 46 aa, Xenorhabdus bovienii
  Peptide sequence Name=Xb4151_4152.C444.gene435.pep
MSSQANSSGITVISFDFSAVFCCLSTFLFSVANALTIWMVERRSSR

SEQ ID NO: 10574 - protein, 55 aa, Xenorhabdus bovienii
  Peptide sequence Name=Xb4151_4152.C444.gene436.pep
MISKERAAQSRYPCAWHYLPGSLLVLNLVNSSNASWMQTVNQLTESSLIAIDGKT

SEQ ID NO: 10575 - protein, 52 aa, Xenorhabdus bovienii
  Peptide sequence Name=Xb4151_4152.C444.gene437.pep
MISYAPFRDNPYEYRRIFTAFRSNSRQSFKIQYPLFDILFLTVCAVIAGAEG

SEQ ID NO: 10576 - protein, 35 aa, Xenorhabdus bovienii
  Peptide sequence Name=Xb4151_4152.C444.gene438.pep
MVPPPRTPHSSHGDIQHVDVLLALNGQGANKAADV

SEQ ID NO: 10577 - protein, 111 aa, Xenorhabdus bovienii
  Peptide sequence Name=Xb4151_4152.C444.gene439.pep
  Gene classification: Function=Predicted transposase; Function class=L DNA replication, recombination and repair
  Homolog annotation: Query=1..97bp; Hit=34..131bp; Blast score=68; Percent Identity=41.0; E value=1e-12; Homolog= mll8100 COG3293
MNGVFWVGAPWHDLPERYGPWKTVYNRFNRGSKSGIIDKIFNRLLSVLDEKGLIDWSEICLDGSNIRISKDAAGAKKNISILLAIMCWVAHVVVMIQKSIWQLTERAFHLT

SEQ ID NO: 10578 - protein, 129 aa, Xenorhabdus bovienii
  Peptide sequence Name=Xb4151_4152.C444.gene440.pep
  Gene classification: Function=Predicted transposase; Function class=L DNA replication, recombination and repair
  Homolog annotation: Query=2..125bp; Hit=139..248bp; Blast score=66; Percent Identity=38.0; E value=6e-12; Homolog= mll8100 COG3293
MLTVGQAHESQSAIPLLDGVGVQRKNGFMKWRGKAVLADKGYSGGKPRSYLRKLRLKSIILYKVNEKGSSDGCTQFDEPICRNRNVVERCFGFLEGNRRITTRYEKTARNYLSMVKLGSIRLFCRRLYN

SEQ ID NO: 10579 - protein, 242 aa, Xenorhabdus bovienii
  Peptide sequence Name=Xb4151_4152.C444.gene441.pep
  Homolog annotation: Query=103..241bp; Hit=4..144bp; Blast score=81; Percent Identity=38.0; E value=1e-14; Homolog= gi|23018467|ref|ZP _00058183.1| hypothetical protein [Thermobifida fusca]
MNIRNRTPNFDDVANIVKILGITSNNGESFDRDLHLYSLIEKPWGFEYRVYCDSIFDVWKLHISPQEKTSMHCHIQKDTVLICLNGSGVTKFLDGDEFNISVGQVVYIERGVFHQTISTGNDYLELIEVENPRNKFDLLRLSDDYGRAAQSYENVSLNHDLLSPLKLISPGAYIRNVDINSKFSFFLEKLNIDILDDENILFIVSLSIDSHLSGKINIFLKEDVKCRSYIGQQVLLISRKNK

SEQ ID NO: 10580 - protein, 191 aa, Xenorhabdus bovienii
  Peptide sequence Name=Xb4151_4152.C444.gene442.pep
  Gene classification: Gene name=ThiJ; Function=Putative intracellular protease/amidase; Function class=R General function prediction only
  Homolog annotation: Query=6..177bp; Hit=2..166bp; Blast score=129; Percent Identity=38.0; E value=2e-30; Homolog= PH1704 COG0693
MLDKFKLVIITGPGFQDHDLVYTYYRSIEEGYDVSIATKDGESVIGKYGISVPMDKRAKQNITFDDLNEEKFDLVILTGGHEAPDRVRQDQRVKDFVSNMSKQEKVVAGLCHGPWIMISAGVMKGKLACAYVGLKDDMENSGANVIEADVVVDKNIITCSYYSECGKFMKETFAAVKRWNKGEKLTEPLVV

SEQ ID NO: 10581 - protein, 245 aa, Xenorhabdus bovienii
  Peptide sequence Name=Xb4151_4152.C444.gene443.pep
  Homolog annotation: Query=2..238bp; Hit=97..334bp; Blast score=124; Percent Identity=29.0; E value=1e-27; Homolog= gi|23018465|ref|ZP _00058181.1| COG0546: Predicted phosphatases [Thermobifida fusca]
MIIALDFDGVVVDAIDECLLVSWNTFNGKGYQQFNKNTLESIPRSFREKFLNYRSYVRHDGHFIVPYYLNDEVFVNKDSFENVYSRISTSDKDRFRNSFIEYRIKVRNTYPKVWTSLHKFLMDIETLLNSGNEFIIVSGKDSSSIHFLLCMIGVEFPISKIYGRMTNKSETLKSINNKAYMKGEKFIFIDDNLDNVKEAINNDIPSVWAEWGYNTKEQFCEAKQLKIPSLKQKDLSDLIKSLHQY

SEQ ID NO: 10582 - protein, 237 aa, Xenorhabdus bovienii
  Peptide sequence Name=Xb4151_4152.C444.gene444.pep
  Gene classification: Gene name=ThiJ; Function=Putative intracellular protease/amidase; Function class=R General function prediction only
  Homolog annotation: Query=1..219bp; Hit=1..214bp; Blast score=168; Percent Identity=41.0; E value=4e-42; Homolog= XF1137 COG0693
MINNVKRALIIVTSHAILGKTGRQTGFYYEELATPYWEFVDAGYTVDIASINGGTAPADPSSVKSSDQQPKSVRRFLNDKSCMNKVNTTKSILNIDPNSYQIVFLPGGHGTMWDFAQSMSLATLLSKLYQNGAVLGSVCHGAAGLLNVKTADGIPLVENRKINSFTEAEEQASGLDNVVPFILETELKKLGAHFECAANFEPYVVSDGRLITGQNPASSGLVAAAILKAANHLYNKE

SEQ ID NO: 10583 - protein, 291 aa, Xenorhabdus bovienii
  Peptide sequence Name=Xb4151_4152.C444.gene445.pep
  Gene classification: Gene name=CDA1; Function=Predicted xylanase/chitin deacetylase; Function class=G Carbohydrate transport and metabolism
  Homolog annotation: Query=1..291bp; Hit=1..291bp; Blast score=422; Percent Identity=67.0; E value=1e-118; Homolog= jhp0295 COG0726
MTKEILCGFGVGVDAVAGWLSSYGGEDSPSDISRGMFAGEIGVPRLLNLFKKFDIPTTWFIPGHSIETFPEQMKMVVDAGHEIGVHNYSHENPIDMTPEQERIVLQKSIDMVTKLSGKKPTGYVAPWWEFSPSTTDLLLEHGIKYDHSLMHNDHLPYYVRKGDYWTKIDYTKHPDEWMKPLIRGKETDLVELPASWTVDDIPPFMFMKNKANSQGFMNPRDIEQLWRDQFDWVYREMEYGIFTFTIHPDVSGRPHVLMMLERLLVHMLGHPGVKFMTLNDIADDFKKRNPR

SEQ ID NO: 10584 - protein, 299 aa, Xenorhabdus bovienii
  Peptide sequence Name=Xb4151_4152.C444.gene446.pep
  Gene classification: Gene name=LysR; Function=Transcriptional regulator; Function class=K Transcription
  Homolog annotation: Query=8..167bp; Hit=9..169bp; Blast score=72; Percent Identity=29.0; E value=5e-13; Homolog= MJ0300 COG0583
VSYLIQLRSFLDVYRSGSISKAATRLGVSQPAVSAHVHSLESFMGSVLFTRRSHGVIPTAEADDLVLQIGTHLDAIETKLSLIRGKSKKIEGVVKIIAPADFLWAKSANILSSIINKQLRFKLLIGDRKKIYSSLNDGDSDLAFTTSCPDENKFGFEIIGKEKLIIVTSASIAAELKNKSISPEILEKYPLISYDNQLPLIRDYYKLVFGVEADILPSITISDLRVIGRIISDNNGWTVMPEYLCEDGFKSRKVFKINHNTNIPENNFYLVWNKSALRHPRVLYVKNHIINLAQQGYFG

SEQ ID NO: 10585 - protein, 393 aa, Xenorhabdus bovienii
  Peptide sequence Name=Xb4151_4152.C444.gene447.pep
  Gene classification: Gene name=AraJ; Function=Arabinose efflux permease; Function class=G Carbohydrate transport and metabolism
  Homolog annotation: Query=9..370bp; Hit=16..375bp; Blast score=183; Percent Identity=35.0; E value=3e-46; Homolog= BS_ytbD COG2814
MPFVIYIFSLCAFALGLTEFLVIGLVSAISTDFHTSVESVGLTVTAYAVGATIGAPFLTAVTTRWSRKGVMLTTMMIFSIGSLAATFSSSVEMMIVSRFVAGLAHGLFLAVSASVATDLVPPEKSGAAVACVFTGLTLALALGVPIGTYLGSVVSWKFSFSLVTIFGLIGLIGLIFLMPANTGNKNDVIAHPVKSLSYIFSPTLLLGALVTVLGYTGAFTLYTYISPFLYQVTKVSIQTASYMMLIYGGFAAAGNIIGGKMTDAIGADRSVMIILLSLSADLLLMYFFGQSLIIMGILIAIIGAISYAAVPAMQARVISIAKYNVPEAIPVASGLNIAGFNAGIALGSVVGGIIISYLSIAYLALGGVVISLAGICVMIFLPRPTKILISQDE

SEQ ID NO: 10586 - protein, 47 aa, Xenorhabdus bovienii
  Peptide sequence Name=Xb4151_4152.C444.gene448.pep
MTGKATITLVTPFPLPYFFTAFVWLQKRHFTSTVATQVLPIKMVIIT

SEQ ID NO: 10587 - protein, 167 aa, Xenorhabdus bovienii
  Peptide sequence Name=Xb4151_4152.C444.gene449.pep
  Gene classification: Gene name=InsB; Function=Insertion element IS1 protein InsB, putative transposase; Function class=L DNA replication, recombination and repair
  Homolog annotation: Query=40..166bp; Hit=38..166bp; Blast score=120; Percent Identity=45.0; E value=6e-28; Homolog= insB_g4 COG1662
MNNSGIRDTARALHISINAVVRTLKNSAKMGNLDNLEIQLICEVDEMWSFVGNKKQQRWLYYAWEPRLKRIIAHTFGRRNKKTLKKLLKKLARFNVAFWCTDNLNAYNMLQTNKHLIGKSFTQRIERENLTIRNRIKRLNRKTLGYSKSPEMHDKVIGTFIEREYYI

SEQ ID NO: 10588 - protein, 172 aa, Xenorhabdus bovienii
  Peptide sequence Name=Xb4151_4152.C444.gene450.pep
  Gene classification: Gene name=Tra5; Function=Putative transposase; Function class=L DNA replication, recombination and repair
  Homolog annotation: Query=4..170bp; Hit=121..288bp; Blast score=175; Percent Identity=51.0; E value=2e-44; Homolog= VC1478 COG2801
MHNPSIQWSGDITSIRIKEGWRYLAVVIDLFSRRVVGMAISSSPNAELVCRALNNALETRYIEGRLIFHSDQGSQYSSKKFRRLLWRNQVIQSMSRRGNCDDNFPMERVFRSLKSEWIPPEGYLDIHDAIRDITQYLGGYYNHQRPHRFNGGMSSVEYERGWEEAKNMSDIF

SEQ ID NO: 10589 - protein, 79 aa, Xenorhabdus bovienii
  Peptide sequence Name=Xb4151_4152.C444.gene451.pep
  Homolog annotation: Query=1..75bp; Hit=1..75bp; Blast score=102; Percent Identity=68.0; E value=2e-21; Homolog= Pa|Phot5-395f12.p1k _g32| 21671 - 21910 556 79 aa, chain +
MISLLKIRDAVALNGRTDARSLSHQFSTPLPMVEAMLKQLVTMGKLEEVDTSSCLSGGCKQCPETQKCTIKVYQLMVKN

SEQ ID NO: 10590 - protein, 770 aa, Xenorhabdus bovienii
  Peptide sequence Name=Xb4151_4152.C444.gene452.pep
  Gene classification: Gene name=FeoB; Function=Fe2+ transport system; Function class=P Inorganic ion transport and metabolism
  Homolog annotation: Query=1..770bp; Hit=1..773bp; Blast score=1068; Percent Identity=71.0; E value=0; Homolog= feoB COG0370
MKQLTIGLIGNPNAGKTTLFNQLTGSRQRVGNWAGVTVERKTGRFTTDEQQIELVDLPGTYSLTTISEQTSIDEQIACHYILSGEADMLINVVDASNLERNLYLSLQLIELGIPCIVALNMLDIAKNQHINIDIAALEQRLGCPVIPLVSTRATGIDTLKKAIDHYQPSSQPVRIEYPDSLLQEVNHLASQITQNFNPQQRRWLTLQVLEGDIYSRERAGLTQSQLAESKMRLQQQQLDEPELVIADSRYQAINALCLAVIDTHAATPHKLTQVMDKVILNRWLGVPIFLFVMYLMFVLAINLGGALQPIFDGASTAIFIDGMRWLGHTLHFPDWLTVFLAQGVGGGINTVLPLVPQIGLMYLFLSFLEDSGYMARAAFVMDRLMQSLGLPGKSFVPLIVGFGCNVPSVMGSRTLDAPRERLITIMMAPFMSCGARLAIFAVFAAAFFGKSGASIVFSLYILGITVAVLTGLLLKHTLMRGEASPFVMELPVYHVPHAKTLLLQSWQRLKGFVIRAGKVIVAASILIGALNSFSFSGKAVDNINESALASVSKVITPLLYPIGVHSDNWQATVGLITGAMAKEVVVGTLNTLYTAENLNQAPFNPDEFHLLNELKGAVAETWDSLKETFTLSALSNPIEASKGDGNMDSGAMGTMSAKFGSAISAYSYLIFVLLYVPCVSVMGAIARETSRGWMLFSILWGLDVAYSLAAVFYQVTTFSAHPQSSLITILAVIVFNVLVFIGLRRARSRVTMTFNNTAGRSCECSNGSCH

SEQ ID NO: 10591 - protein, 76 aa, Xenorhabdus bovienii
  Peptide sequence Name=Xb4151_4152.C444.gene453.pep
  Gene classification: Gene name=FeoA; Function=Fe2+ transport system; Function class=P Inorganic ion transport and metabolism
  Homolog annotation: Query=1..71bp; Hit=1..71bp; Blast score=100; Percent Identity=69.0; E value=3e-22; Homolog= feoA COG1918
MSLLPNRSYKILGFSAQISPAYRQKLLSLGMLPGSTFQVIRVAPLGDPVQIETRRVNLILRKKDLAFITLDNTPLE

SEQ ID NO: 10592 - protein, 175 aa, Xenorhabdus bovienii
  Peptide sequence Name=Xb4151_4152.C444.gene454.pep
MNKYAKSSFDLLSNIRFFSLATHHPDSGSPWSASLLYVPRYDPLRLIWYSKLITRHSHEISINPLVSGSLYHNRVNPDTSLDLAGAQFIGQAHEIPDNELQETYDYYFNFLFPDENIRKKKARPLSEFHGHGRRRFYELDVQEWWVYDSELWHNQQDDGRVFVPLSELTHPPENQ

SEQ ID NO: 10593 - protein, 36 aa, Xenorhabdus bovienii
  Peptide sequence Name=Xb4151_4152.C444.gene455.pep
MKIMTFLLMGCVGRPFIFLLPILAFLNQIVSDDIGV

SEQ ID NO: 10594 - protein, 67 aa, Xenorhabdus bovienii
  Peptide sequence Name=Xb4151_4152.C444.gene456.pep
MGLGQYFLDHQCVDINHAVLNQVQRQHADLMSFARITRHLTTACKEYKISYTIPLFGYIQFFVNFPT

SEQ ID NO: 10595 - protein, 52 aa, Xenorhabdus bovienii
  Peptide sequence Name=Xb4151_4152.C444.gene457.pep
MVNSSVKSEGKLAVMMIFCFQLLSVTQTDMIKMRVSDGRELVLKFEENKVNH

SEQ ID NO: 10596 - protein, 256 aa, Xenorhabdus bovienii
  Peptide sequence Name=Xb4151_4152.C444.gene458.pep
MEFDSNSHENAIQEAQRILKEAQTDLALRLEKAVEGVREVAQETMHTIGQGGQRALWRTSYFFDSYEDVYQRINREDARVFLAAWSVARGGLFENNVIKKIVDIYIDKLLEPHERDQAFLNELYEKLVRSSTIMMHLVAKFKTSGLAKNAVVSAITEAIYVAVIKKAFIREGFKKFGMSITLAFQFYGYFDKAAVSASKLKRECPVLYWSFYANEIEMLYFIFEPLFKHGISTIKKGKGSNVDDVYLAIMEIVGYN

SEQ ID NO: 10597 - protein, 70 aa, Xenorhabdus bovienii
  Peptide sequence Name=Xb4151_4152.C444.gene459.pep
MFSKGWLRREIMSWLKGIYSYIIWSFIPTLCVFSWSLFAFVIFPNHWGLLTVVGIIIVLLFTAYFAFKSN

SEQ ID NO: 10598 - protein, 159 aa, Xenorhabdus bovienii
  Peptide sequence Name=Xb4151_4152.C444.gene460.pep
  Gene classification: Gene name=Hcp; Function=Hemolysin-coregulated protein (uncharacterized); Function class=R General function prediction only
  Homolog annotation: Query=1..159bp; Hit=1..159bp; Blast score=159; Percent Identity=50.0; E value=2e-39; Homolog= Z0248 COG3157
MSYMIYLTLNGKKQGLISAGCSTLDSIGNRYQKGHEDQIQVLSLDHSMTRDQNVSHHPIQFIKPIDKSSPLLSIAIDSNESLNGGFIFYRTSSSGQLELFYELKITEATIVDISCVYPNSINSNDKMPYEKVQLKYKSIAWSHITAGTSAYSIWDERIY

SEQ ID NO: 10599 - protein, 106 aa, Xenorhabdus bovienii
  Peptide sequence Name=Xb4151_4152.C444.gene461.pep
  Gene classification: Function=Putative transposase; Function class=L DNA replication, recombination and repair
  Homolog annotation: Query=25..92bp; Hit=160..227bp; Blast score=69; Percent Identity=54.0; E value=5e-13; Homolog= mll9070 COG3316
MQQQPCVFSVKRYLLNAEESPQQVIEIRQNKYLNNLVEQDHRHVKRRVHSMLGFKSFRRAQTLLIGIELVIMPRKGQCLQNEGENLSPAELFYRLNCVKNNHTGCD

SEQ ID NO: 10600 - protein, 113 aa, Xenorhabdus bovienii
  Peptide sequence Name=Xb4151_4152.C444.gene462.pep
  Gene classification: Function=Putative transposase; Function class=L DNA replication, recombination and repair
  Homolog annotation: Query=3..99bp; Hit=23..119bp; Blast score=159; Percent Identity=78.0; E value=5e-40; Homolog= XF2303 COG3316
MSLIRKAFKRLHYPVDIIAQCVRWYLAYALSLRNLEEMMAERGIEVDHATIHRWVLRLVPLLGKAFRPRKKPIGSRWRMDETYIKVKGQWKYLYRAVDTDSPPRCNSSPAFFP

SEQ ID NO: 10601 - protein, 59 aa, Xenorhabdus bovienii
  Peptide sequence Name=Xb4151_4152.C444.gene463.pep
MQTFERFSDKGHRSGLAQKQGCLPDDRLMRQNQIYCGRTPIETLLEGKSIWAEKNLTRI

SEQ ID NO: 10602 - protein, 260 aa, Xenorhabdus bovienii
  Peptide sequence Name=Xb4151_4152.C444.gene464.pep
MKFLCNKRVLSPLLAVFFIQGCAQSGSFSPPINGENVHFMATIPDELDALPISAMYRSKICRKERRTANMKSYSVPGFHHATYPLSIGQSNQVEVSVPKEGGGKCDWKLSNLTFEVKLKDTSTIAPLIDDNFGFKTTFVIDGNAPQEFDGGYIKKTGNLNEEITLFPLLRERFLGGHSQSFYLVGEHDVMTYKMDNGRKIHLNVLYEKKFLTHWNGGKNKDADTSMTYPDGTIIYNGDVIPDFDKLMRILESRNSKQTKM

SEQ ID NO: 10603 - protein, 254 aa, Xenorhabdus bovienii
  Peptide sequence Name=Xb4151_4152.C444.gene465.pep
MKFLCNKSAFSSLLAVFFIQGCAQSDSFSPPMNGENIHFTATMPDELDALPISAMYRSEICRKERRTANMKSYSVPGFHRATYPLSIGQPNQVEVSVPKEGGGKCDWKLSNLTFEVKLKDTSTIAPLIKNNFGFKTTFVIDGNAPQEFDGGYLKINGNLHEKIILFPLLTKLFLSVNETSFYLIGKGDPLTYKVGATKNINLSYIYIKKMLSVWTDRKNNDRPFMTYPNGDIVYGEVRPEYEILMRILESRNSK

SEQ ID NO: 10604 - protein, 254 aa, Xenorhabdus bovienii
  Peptide sequence Name=Xb4151_4152.C444.gene466.pep
MKFLCNKNVLSSLLAVLFIQGCAQSDSFSPPINGEHVHFIATIPDELDALPISAMYRSEICRKERRTANMKSYSVPGFHHATYPLSIGQSNQVEVSVPKEGGGKCDWKLSNITFEVKLKDTSTIAPLIDDNIGFKTTFVTDGNAPAVFDGGYLKINGDLHEKIILFPLLTKSFLNGNENTFYLIGKGSPLTYKIGTAKKININYIYIKQMLSVWTGRKNNDMPFMTYPNGDIVSGEVRPEYKKLMGILESRNSK

SEQ ID NO: 10605 - protein, 648 aa, Xenorhabdus bovienii
  Peptide sequence Name=Xb4151_4152.C444.gene467.pep
  Gene classification: Function=Predicted lipase; Function class=I Lipid metabolism
  Homolog annotation: Query=8..417bp; Hit=6..431bp; Blast score=85; Percent Identity=26.0; E value=2e-16; Homolog= VC1418 COG3675
MSNANSVYCHNCPGMLKNKIEIQLVDEHNKPISKMDYILKNSKVERPGKTDENGMIRADKLPASPIRLFLRGQKLADEMETRPLRTLRGESHSTVKPDAESKGYFYRYAVIGELCDKAPNIAKWEQAKFGLPYYHFPKENEFKGLEFYGEDFNQRHVIEVCPFRAWSLILKHTPNYDIVNAYNLGLMSLLVYKNEVMVNPDSPDINMRKFINTPDTTTSFFYQQCFDLSKTPVINDHSVYPAIVNDVPFKERYRPAIFLDVEQVETPETFEHDTQMFFVENETQIIAAWRGTASSRDALTDGTYRPIPCPENILPGGKAKVHKGFLEAYQCMEKYFINEIKQIKESSQHINLKKLFICGHSLGGALALLHATELRNNNPLLYTYGMPRVLTGSGVKALTSLNHFRHVNDADSVTSVPFDTNMDNWLFEVYGPLGTIFGFSWTLATLPTIPIQKSLPEMGEVYYHQGNTVSFFQARQMGEERIPSKNGVGFTGKKRWRMNGIYKFYLVPSIANSLDKGLENEQQEYVDSLKGDKSVLDEIFPQWNNPDLDTIITTATDHFMGSKYQAIINNQLLSFLEPTKTPKLIASKEKFDELIHHQDASPLNAKRNTTFMALENNLHDIFKQDVNQDELLKHALERYKEGANEISM

SEQ ID NO: 10606 - protein, 264 aa, Xenorhabdus bovienii
  Peptide sequence Name=Xb4151_4152.C444.gene468.pep
  Homolog annotation: Query=14..263bp; Hit=5..254bp; Blast score=265; Percent Identity=52.0; E value=6e-70; Homolog= gi|27479679|gb|AAO17206.1| Orf42 [Photorhabdus luminescens]
MENAIPAEDTESPVSWQEWLNKSNDAPVFFILNSLAKPDPVAHFYLNDWVEEAFPLYSGTPMRKMLKQSPWLVQAKVNHLFQIGAVLDKHELSDNSWGWAYRSHKSWQEQLTHWQRRQLVTLNGEQVIFRMMDTRVFGAMVSAFTPSDWSLMLTPVTELMIDLSQTTHFHRPKECGQGNDDIPFTLGEHLQLVWLHSPYGLKVLSSSLYNDLWENHGVMAKKLDQPEGSLEPRIEQWLRQKLEAGQRIENMSGQNYLLAMEQEK

SEQ ID NO: 10607 - protein, 640 aa, Xenorhabdus bovienii
  Peptide sequence Name=Xb4151_4152.C444.gene469.pep
  Gene classification: Gene name=VgrG; Function=Uncharacterized BCR; Function class=S Function unknown
  Homolog annotation: Query=12..636bp; Hit=4..671bp; Blast score=390; Percent Identity=37.0; E value=1e-108; Homolog= VCA0018 COG3501
MMNMLSSAKSGLRFTFQVAGLPEDTFSVGEFSLQEGLSELFTLNLTLVKTHTLNPFKPQTEVDLTALLMQEAVLQIFNGELAQRKITGIISHADWAGTDGNKTLYTLTVRPALWRLTLNQDREYVTQKRESDYAFFNRLAAEEGISFWFEDETAFFSDSHLGMTAGLPLTYSPQPETAHGIDTIYQVRLGVGMSPQRSLHKDFNYDNPRYHLSHMESSEGFRDFGTQTPYTVFESYGRFQKDAAAKPFLKYRHEALDNQKKTGSGNSNCIKLMPGKIFEIKNHPHAPLNARWQIVGISHHGRCPQALGHDGGDGTTLSNQFSFIDGLADWRPPFYYKPLADGDETAIVVGPEGEEIFVNKDGAIKIHFHWNRYDNADDGASCWVRVAQGWNGHGFGFMAIPRIGQEVIISYLNGDIDRPIVTGSVYNGLNRPPLDLPAQKTRTTFKTKTHKGKGFNELRFEDAKGSEEVYIHGQKDFTAHIENDAYWHIKHDQKQRIDNNRYHDIRADDHHQVAGSRKITTEGDVSHRIAGSQHIQTGDATVIDSGQEIHLKSGGKMVLEAASEITLKVGGSFLKVTPGGILSSPINVGQGSGGSGRGVNLQLPEGVEPLPEVEMVFPAHPYCPELAQQDVSPVIKPAKE

SEQ ID NO: 10608 - protein, 585 aa, Xenorhabdus bovienii
  Peptide sequence Name=Xb4151_4152.C444.gene470.pep
  Gene classification: Function=Uncharacterized BCR; Function class=S Function unknown
  Homolog annotation: Query=6..563bp; Hit=3..568bp; Blast score=176; Percent Identity=27.0; E value=4e-44; Homolog= VCA0110 COG3519
MKNNKESMYLRERAYMRELAQRVAKESPHLADFLLASHDPDIERVFEAFALLIAHLRDKLEDDFPEITHGILSRIWPLALSPIPPTTVMQFHPTDGEHQGAVDIPAGTPVSAHVNGQLLTFKTCRSLHIEPLIVLDRAVKKTGTHSEIVLTLCQTGIPSPVWQSGSLSFFLGTDSEQAALLSLWLDQHISDVSLRVRGEQRELSCFPYGWHNLFDTPILPMEKHTYAGLQSLIEYYALPQLYNFMTVDISDYCREVPLNADGTFELIFRFEGELPLEDVDDAFMLGCVPAIHLENLTSLPIPLTPENHRYPLPLGESVRLFRLRDIQVIQQPDEKQQRGTPYRYLPIDQFTPAMGWLAEDGEADTFYYLLQTARDLPGRLTHQLHFFDLTGRPAVNLPEIAVACHSWGYHEQAIALEKGTLTVMQEGSPSHLNVHNITPVATDYPSMLQDNSGWPLLSCLSSPPMLLFTTESLKHFLRLFDPYAELNRPLSRHIRRHIDGIVRVEERLTDRMYKGRPVRGHLLSLTLNPDGYANPGEMYRFCRLINQAMACFVGQSTFVKLNVYTPNCHKALWEFWEVYGLRRDM

SEQ ID NO: 10609 - protein, 48 aa, Xenorhabdus bovienii
  Peptide sequence Name=Xb4151_4152.C444.gene471.pep
MVERVLRPDSRVVWLDAPERFYRINRESLYGGGDDDYLWSQSIKHLCR

SEQ ID NO: 10610 - protein, 90 aa, Xenorhabdus bovienii
  Peptide sequence Name=Xb4151_4152.C444.gene472.pep
MESIDKTSLPVTMSYLRVVSIALYAASKRVLSPLKSFVRGGIGPTFIDSHDGGSAVLAYCFTEKTQGCRCIAAGCQYQPPRKGLSSNWLR

SEQ ID NO: 10611 - protein, 780 aa, Xenorhabdus bovienii
  Peptide sequence Name=Xb4151_4152.C444.gene473.pep
  Gene classification: Function=Predicted RNA binding protein, contains S1 domain; Function class=R General function prediction only
  Homolog annotation: Query=33..780bp; Hit=1..740bp; Blast score=1173; Percent Identity=80.0; E value=0; Homolog= ZyhgF COG2183
MNESLSRIIAGELQAQPQQVLAAITLFDEGNTVPFVARYRKEATGGLDDTQLRQLESRLGYLRELSDRRQTILKSIEEQGKLTVELAEAINTTQSKTELEDLYLPYKPKRRTRGQIAIEAGLEPLADLLWQDPQQTPELAAAAYVDADKGVTDTKAALDGARYILMERFAEDAALLVKVREYLWKNAHLAAKVVEGKEEEGAKFSDYFDHHEPIATVPSHRALAMFRGRNEGILQLALNADPQFEEAPKESYCEQIITDHLNLRLNNAPADSWRKAVVSWTWRIKVLLHLETELMGTLREKAEDEAINVFARNLNALMMAAPAGMRATMGLDPGLRTGVKVAVVDSTGKLIATDTVYPHTGQEVKAAAAVAALCTKYQVELVAIGNGTASRETERFFANIQKQYPDVKAQAVIVSEAGASVYSASELAALEFPDLDVSLRGAVSIARRLQDPLAELVKIDPKSIGVGQYQHDVSQTQLAKKLDTVVEDCVNGVGVDLNTASVALLTRVAGLSKSVAQNIVNWRDENGRFDNRNQLLKVNRLGPKAFLQCAGFLRINQGDNPLDASTVHPETYQVVEKILATTEQSLSELMGNPGALRGLQAQDFTTDKFGIPTVTDILKELEKPGRDPRPEFKTATFTDGVETMKDLRAGMILEGTVTNVTNFGAFVDIGVHQDGLVHISSLSDRFVENPHTVVKTGDIVKVKVMDIDLNRKRIGLTMRLDEQPGEAPARRSGSQSSNPRNSNERNGNGRNRQTSRSPGSTALSNSAMSDALAAAFGKKR

SEQ ID NO: 10612 - protein, 160 aa, Xenorhabdus bovienii
  Peptide sequence Name=Xb4151_4152.C444.gene474.pep
  Gene classification: Gene name=GreA; Function=Transcription elongation factor; Function class=K Transcription
  Homolog annotation: Query=1..157bp; Hit=1..157bp; Blast score=237; Percent Identity=76.0; E value=4e-63; Homolog= PM1450 COG0782
MAKSNYITREGWHALDQELKYLWKVERPNVTQAVSDAAALGDRSENAEYIYGKKRLREIDRRVRFLSKRLDALQIVDPDPRQEGKVFFGAWVKVENEKAEEHIFRLVGPDEFEPAKKWISIDSPVARALLGKQVDDEITVMTPNGMAIYWILEIGYQPLG

SEQ ID NO: 10613 - protein, 32 aa, Xenorhabdus bovienii
  Peptide sequence Name=Xb4151_4152.C444.gene475.pep
MKLVSTEVWGFCESNGYGGHGASWELKHAREL

SEQ ID NO: 10614 - protein, 239 aa, Xenorhabdus bovienii
  Peptide sequence Name=Xb4151_4152.C444.gene476.pep
  Gene classification: Gene name=OmpR; Function=Response regulators consisting of a CheY-like receiver domain and a winged-helix DNA -binding domain; Function class=T Signal transduction mechanisms
  Homolog annotation: Query=1..238bp; Hit=1..238bp; Blast score=394; Percent Identity=86.0; E value=1e-110; Homolog= ompR COG0745
MQESYKILVVDDDMRLRALLERYLSEQGFQVRSVANAEQMDRLLTRESIQLIILDLMLPGEDGLSICRRLRSQHNPIPIIMVSAKGEEVDRIVGLEIGADDYLVKPFNPRELLARMRAVMRRQSHELPGAPTPDNAVVKFGKFKLDLGTREMFHEDEQLSLTSGEFSVLKVLVSHPREPLSRDKLMSLARGREYGAMERSIDVQVSRLRRLIEEDPAHPRYIQTVWGLGYVFVPDGSKV

SEQ ID NO: 10615 - protein, 333 aa, Xenorhabdus bovienii
  Peptide sequence Name=Xb4151_4152.C444.gene477.pep
  Gene classification: Gene name=BaeS; Function=Signal transduction histidine kinase; Function class=T Signal transduction mechanisms
  Homolog annotation: Query=37..329bp; Hit=149..437bp; Blast score=280; Percent Identity=48.0; E value=1e-75; Homolog= envZ COG0642
MKRLWLSLRALFSHVIYLTLVIVLGSLMISYLAAQRLVEMEKLSFAIVFFYVFASVFTAASAVSITFWFYLRAQRQPLRTMQKAVREMEKGKIAAPLPEAGAPAIRSLIRAFNQMSTAHKALETDRASLIAGVSHDLRTPLTRIRLALELIEGKDNFLRESINRDIEECNAMIDQFIDYQRSGQNMPMLCCELNGLLDEAITVENDGVGNIENHLSANPVVIMANPLSIKRVLSNMFTNAHRYGQGWIRVSSGVTEKFGWFQVEDNGTGMTEEESATLFQPFTQGQRVHNNGGAGLGLAIIRRIVDIHDGYIEVGRSEKGGLSMRVYIPRVTK

SEQ ID NO: 10616 - protein, 343 aa, Xenorhabdus bovienii
  Peptide sequence Name=Xb4151_4152.C444.gene478.pep
  Gene classification: Gene name=PstS; Function=ABC-type phosphate transport system, periplasmic component; Function class=P Inorganic ion transport and metabolism
  Homolog annotation: Query=1..343bp; Hit=4..346bp; Blast score=525; Percent Identity=80.0; E value=1e-149; Homolog= pstS COG0226
MRTTVASIMAAALAMTSLSSFAASSLTGAGATFPAPVYTKWADSYQKETGNKINYQGIGSSGGVKQIIAHTVDFGASDAPLSHEKLEADGLFQFPTVIGGIVLAVNISGIKSGQLVLDGKTLGDIYLGNIKKWNDPAITKLNPGLRLPDQNIAVIRRADGSGTSFVFTSYLSKVNSLWKEKVGVGSTVKWPAGLGGKGNDGIAAFVQRLPGSIGYVEYAYAKQNNLAYTKLISADGKVVAPTEANFSAAAKGADWSKSFAQDLTAQKGDNVWPITSTTFILIHKQQKNAANGIEVLKFFDWAYEQGGKQAKDLDYSVLPQDVIGQIRAAWKRDIKDSSGNPLY

SEQ ID NO: 10617 - protein, 318 aa, Xenorhabdus bovienii
  Peptide sequence Name=Xb4151_4152.C444.gene479.pep
  Gene classification: Gene name=PstC; Function=ABC-type phosphate transport system, permease component; Function class=P Inorganic ion transport and metabolism
  Homolog annotation: Query=1..317bp; Hit=1..317bp; Blast score=459; Percent Identity=84.0; E value=1e-129; Homolog= pstC COG0573
MAERKTALKAPSKNGDIIFSALVRLAALMTLFLLGGIIISLIIAAWPSIKTFGFGFLWNKDWDAPAEQFGALVPIYGTLVTSLIALIIAVPVSFGIALFLTELAPNWLKRPLGVAVELLAAIPSIVYGMWGLFVFAPLFATYFQQPVGDVLSSIPIVGELFSGPAFGIGILTAGIILAIMIIPYIASVMRDVFEQTPVMMKESAYGIGCTTWEVIWRIVLPYTKNGVIGGVMLGLGRALGETMAVTFIIGNTYQLDSLSLYMPGNSITSALANEFAEAESGLHTAALMELGLILFVITFIVLALSKLMILRLAKNEGR

SEQ ID NO: 10618 - protein, 302 aa, Xenorhabdus bovienii
  Peptide sequence Name=Xb4151_4152.C444.gene480.pep
  Gene classification: Gene name=PstA; Function=ABC-type phosphate transport system, permease component; Function class=P Inorganic ion transport and metabolism
  Homolog annotation: Query=22..302bp; Hit=15..295bp; Blast score=441; Percent Identity=86.0; E value=1e-124; Homolog= ZpstA COG0581
MTTGNNPQPRAVGAINTAEMNNRRRMQAWRRQKNRIALLLSMATMVFGLFWLIWILFSTVTKGIDGMSLALFTEMTPPPNTEGGGLANAIVGSGLLIFWATVFGTPLGIMAGIYLEEYGRRSWLAEVTRFINDILLSAPSIVVGLFVYSVIVTKMQHFSGWAGVIALALLQIPIVIRTTENMLKLVPDNLREAAYALGTPKWKMISAITLKASISGIMTGVLLAIARIAGETAPLLFTSLSNQFWSTDLSQPIANLPVTIFKFAMSPFSDWQQLAWAGVLLITLCVLLINIVARVLFKNKKH

SEQ ID NO: 10619 - protein, 258 aa, Xenorhabdus bovienii
  Peptide sequence Name=Xb4151_4152.C444.gene481.pep
  Gene classification: Gene name=PstB; Function=ABC-type phosphate transport system, ATPase component; Function class=P Inorganic ion transport and metabolism
  Homolog annotation: Query=6..258bp; Hit=5..257bp; Blast score=475; Percent Identity=90.0; E value=1e-134; Homolog= pstB COG1117
MNKANDIAGSKIQVRDLNFYYGKFHALKNITLDIEQNKVTAFIGPSGCGKSTLLRTFNKMYELYGEQRAEGEIILDDTNILTDKQDIALLRAKVGMVFQKPTPFPMSIYDNIAFGVRLFEKLPRAEMDERVQWALTKAALWNETKDKLHQSGYSLSGGQQQRLCIARGIAIRPEVLLLDEPCSALDPISTGRIEELISELKSEYTVVIVTHNMQQAARCSDHTAFMYLGELIEFSDTDTLFTTPRKKQTEDYITGRYG

SEQ ID NO: 10620 - protein, 238 aa, Xenorhabdus bovienii
  Peptide sequence Name=Xb4151_4152.C444.gene482.pep
  Gene classification: Gene name=PhoU; Function=Phosphate uptake regulator; Function class=P Inorganic ion transport and metabolism
  Homolog annotation: Query=1..234bp; Hit=1..234bp; Blast score=382; Percent Identity=86.0; E value=1e-106; Homolog= ZphoU COG0704
MDNLNHSKHISGQFNAELEHIRTELMTMGGLVEEQLSKAILAMHNQDGELARQVIEDDQKVNMMEVTIDEACVRIIAKRQPTASDLRLIMVISKTIAELERIGDVANKICQTALEKFSHQQQPLLVSLESLGRHAIQMLHDVLDAFARMDLEEAIRIYHEDKKVDQEYEGIVRQLMTYMMEDPRTIPSVMTALFCARSIERIGDRCQNICEFIFYYVKGQDFRHVGGDQLEKLLTKDQ

SEQ ID NO: 10621 - protein, 282 aa, Xenorhabdus bovienii
  Peptide sequence Name=Xb4151_4152.C444.gene483.pep
  Gene classification: Gene name=ArtI; Function=ABC-type amino acid transport system, periplasmic component; Function class=E Amino acid transport and metabolism
  Homolog annotation: Query=17..268bp; Hit=11..260bp; Blast score=295; Percent Identity=58.0; E value=5e-80; Homolog= PA2204 COG0834
MKFRNQSRVATVALLTSLALVSGVAKADKLDDIKKTGTVRIAVFDSNPPFGFIDPQTKKLAGYDVDIANAVASDLGVKLELRPTNPANRIPLLSSKKIDLIAANFTITDERAKQVNFSIPYFATGQKFIARKGVLKTPDDIAKLRIGADKGTVQEITLRERYPTAKVISYDDTPLAFAALRNGNVQAITQDDAKLVGLLANVPEAQKADFEISPFSITREYQAVAATKGEDRLINAVNQTLLKLEKDGDAEKIYNRWFGAETKSAQPRGDFKFAPLDSQAKP

SEQ ID NO: 10622 - protein, 245 aa, Xenorhabdus bovienii
  Peptide sequence Name=Xb4151_4152.C444.gene484.pep
  Gene classification: Gene name=ArtM; Function=ABC-type amino acid transport system, permease component; Function class=E Amino acid transport and metabolism
  Homolog annotation: Query=10..238bp; Hit=5..229bp; Blast score=221; Percent Identity=60.0; E value=8e-58; Homolog= PA2203 COG0765
MFEQFITEHLLAPEYLRWLWQGFLITLWLSVCTIISSTLLGFMITAARDSQIKPLRWLVTAYTTVFRNTPLLVQLFFWYFASGQILPQAAMIWLNTSHEIPIAGLTLAWPSFEFLAGFIGLTLYSAPFVAEELRAGIQGIGRGQKYAAHALGLTDWQAMRYVVLPQALKIAMPPLLGQYMNIVKNSSLTMAIGVAELSYASRQVETQSLQTFEAFGVATVLYIAVIAIMEGWGQWRQQRILVRGY

SEQ ID NO: 10623 - protein, 249 aa, Xenorhabdus bovienii
  Peptide sequence Name=Xb4151_4152.C444.gene485.pep
  Gene classification: Gene name=ArtM; Function=ABC-type amino acid transport system, permease component; Function class=E Amino acid transport and metabolism
  Homolog annotation: Query=1..213bp; Hit=1..213bp; Blast score=211; Percent Identity=62.0; E value=6e-55; Homolog= PA2202 COG0765
MDFTVITENWRYLLLGTFPDGPLEGAALTLVISIMAGVISIVLGTVAGVALAMLRGFWVNLLAAILGFFRAIPVIMLIFWTYFLLPVVLGMEIPEITTVVCALALITSAYLAHGVKAGILAIGEGQWRAGLSLGFNRWEVLWYIVLPQALRMMVPSFINQWIALIKDTSLAYIVGVAELSFLATQVNNRSMVYPMEVFLFVALVYFVMCLSLELIANSVARRFSMQRQRTTLFGFWRKKTLIMIPKINI

SEQ ID NO: 10624 - protein, 1261 aa, Xenorhabdus bovienii
  Peptide sequence Name=Xb4151_4152.C444.gene486.pep
  Homolog annotation: Query=73..1034bp; Hit=132..1060bp; Blast score =488; Percent Identity=36.0; E value=1e-136; Homolog= Pa|Phot2 -7h01.p1k_g13| 14750 - 20632 4013 1960 aa, chain -
MFSYFSKIIRFVIVLYVLILPSTMMNAFADGNVLIEKTDNHHVSNKTSDIDFSVNDSSKKFLNSTTNKKDTIQKNEDISEPDTPNSIARHLQTAGNMLSSSPSQLAEQAKSYALGKLNSTVNNEAQKWLSQFGTARINFALDKKGKLENSAFDILFPLYDNKADWLLFSQVGYRNKDSRNTLNFGLGGRYFQNNWMYGLNTFFDHDFTGKNRRLGLGGEIWGDYLKLSANAYYRLSDWQHSRDHKDYYERPANGYDINGEFFLPAYPNLGAKLTYEQYFGDNVTLFNRDTKQKNPSLAKLGLTYTPIPLVTIGVDYKQGGSGHTETQFLANFNYRLGVPLSVQLSSDNVASMRTLAGSRYDLVERNYNIVLDHQKKQNLQLSLPGEIVGYSHEQKTVTAKFHDSSIKKVEWISNGTFTDNKGQLSDNKDHTATITFPKYSPDGNNNYPILAIGMLENNQKLPPVQMHVIVRPFVVKKAEEGTSYITPAGPLPASGKDKDAYTITPVITFDTPVGAPVKNATIDDVKWITEPPADGKSGLKLSWEKQETTKTDENGKLQAVTLTSTKPQQNVKVYLQMGDADKEKQLVGTVSFGEDTARFHVNSIQVEPKETLTADGIQAYTYTALVLDGNNQPVKRQKIDKVHWDHDKEDKTGLKWKSRGDTTDEEGKLTAELISSDPVKDVMVTLSIEGNTDKSAKADKSVSFDAANVNLGLSKVSPILVRDTYTLKVTAKDASDNPETNKKVTWPQSQSLPQGVILTPASSITDGNGEATATLTSTEEQTVDVTVSVEGVGEKKTSVEFKWPTITFQPASPKNGVVADGKKGYQFIAKVVGADGQTPYTDKVFQFKWHLQLSQDAVQGKTYLLHEVTDNQNKTWTAQLASTQTQPKPVEGAKVCLAIEGGPSTSMACSEPVSFVPLPANVEIKSIEVNFDPQKPLKGNWSDSYLYKALVFDKNTKEKLANYKFKPSEIHWSRDPDSGKVDDQSLALFDQDLETDPDGYLTVKLKSYVGIKGVKVKLMISTLYGNEPGAAETAVDFEVAPQLAGLYLFKKSDPTNVNKFFPEQERPYNAIGGDMRGELRTLDNKPLDNPEYTWEPKSTDTILPGENKGTFMINNFGKVTINAQVKTSYGNNLFYERWYVYKINMLRLFNRAGQRDSLYDLFDEKIRCENIASSKAYTPNLKNIKGSGKGEALSEEFPNAYSWGLFDGLDFPNTREKEYFARFRVDKGESPSNGYELYNAAYDKMMDSSITSAFLICVTGH

SEQ ID NO: 10625 - protein, 50 aa, Xenorhabdus bovienii
  Peptide sequence Name=Xb4151_4152.C444.gene487.pep
MKNSYHMITIFYHIFIEQYYKKQHHKQFTLLIFTFINIINKYYFSSNICE

SEQ ID NO: 10626 - protein, 487 aa, Xenorhabdus bovienii
  Peptide sequence Name=Xb4151_4152.C444.gene488.pep
MASNITTSPASKSKIIVGQLLTANITFESDIAMSTNISFELTNPVNLTISNTDFSVLDNSKSFTVTTKFHISENINEGDTVSFLIKPNDHAIALGFKKQTISYFPHDVDRHSLNIHFDQTVVDALTTDKPNIPPNGQSYSLATALVTDRKGKPLAGETITIIGGFAANLDKVRIFSSNKNVQSEIKKNSLYGQSSIDINTDKYGKLEFYVYPSDKSQFVFDLQARITDATQFVYSEDRLYILNDDQGDPFNADQQTLAPPDILERQGDKLTESDGSSTFTALIDNYEGESENDSILFFVDGKYAHQQFLTSKKKYNHGYTFQLPYSILPLNKYAGFSYIIVTVDGNLKFSAGMDIMYNGGSKNQPLDNVPRVYDMCTVYSSFGYSNASDLVLYNDMVNCFTISRHLKTKLKAGLYVAITGTNDPTDKTKVPFGTEVTLTLYIDSYKKKTNQIFKIKMPTQPDEGSKNIATYIIPIPYKYVNEVGDIF

SEQ ID NO: 10627 - DNA, 60 bp, Xenorhabdus bovienii
  Promoter sequence Name=Xb4151_4152.C1.promoter1; Position on contig =688..747bp; Strand=-
ggcgcatgttattggcagttgtgccagaagttcgatttctggcatgttacaatgcgtcgg

SEQ ID NO: 10628 - DNA, 60 bp, Xenorhabdus bovienii
  unsure (1)..(60): unsure at all n locations
  Promoter sequence Name=Xb4151_4152.C3.promoter1; Position on contig =506..565bp; Strand=-
agagagaactgtatagagtggctgtactcctgaactgacngcgtttttaaaatccgcatt

SEQ ID NO: 10629 - DNA, 60 bp, Xenorhabdus bovienii
  unsure (1)..(60): unsure at all n locations
  Promoter sequence Name=Xb4151_4152.C6.promoter1; Position on contig =370..429bp; Strand=+
gnttacnaggggtntggcccccgggggtttttttaccggttcaaacccaaaataaatcgn

SEQ ID NO: 10630 - DNA, 60 bp, Xenorhabdus bovienii
  unsure (1)..(60): unsure at all n locations
  Promoter sequence Name=Xb4151_4152.C11.promoter1; Position on contig =559..618bp; Strand=-
ccccaacccccaaaaaaaattgggggggggggtccccccaaccggggaaaaatttncncc

SEQ ID NO: 10631 - DNA, 60 bp, Xenorhabdus bovienii
  unsure (1)..(60): unsure at all n locations
  Promoter sequence Name=Xb4151_4152.C20.promoter1; Position on contig =810..869bp; Strand=-
ggggggaaaaaaatatttttttttttttcngcggcccccaaaaaaaaaaaaancccnccc

SEQ ID NO: 10632 - DNA, 60 bp, Xenorhabdus bovienii
  unsure (1)..(60): unsure at all n locations
  Promoter sequence Name=Xb4151_4152.C25.promoter1; Position on contig =407..466bp; Strand=-
ccttttnnccccttaaaaataccccgggggggaaaaaacccccctttttttttggggggc

SEQ ID NO: 10633 - DNA, 60 bp, Xenorhabdus bovienii
  unsure (1)..(60): unsure at all n locations
  Promoter sequence Name=Xb4151_4152.C26.promoter1; Position on contig =674..733bp; Strand=-
tttttttttttttnnttttttttttggggggggggggggggggggggggggnaattattt

SEQ ID NO: 10634 - DNA, 60 bp, Xenorhabdus bovienii
  unsure (1)..(60): unsure at all n locations
  Promoter sequence Name=Xb4151_4152.C44.promoter1; Position on contig =791..850bp; Strand=-
tttttttttttaaaaaaaggggggggggggnccccnncacaccaaaaaaaaaaaattatt

SEQ ID NO: 10635 - DNA, 60 bp, Xenorhabdus bovienii
  Promoter sequence Name=Xb4151_4152.C50.promoter1; Position on contig =521..580bp; Strand=+; Gene name=CheW
tgatccggctagtaccgacgtaggactttgagacgctaatcattgatataaaaatatttt

SEQ ID NO: 10636 - DNA, 60 bp, Xenorhabdus bovienii
  unsure (1)..(60): unsure at all n locations
  Promoter sequence Name=Xb4151_4152.C52.promoter1; Position on contig =430..489bp; Strand=-
ggccccaaaaagggggntttttanaaaaaaaattttgggggcccttttttttnnnncccg

SEQ ID NO: 10637 - DNA, 60 bp, Xenorhabdus bovienii
  unsure (1)..(60): unsure at all n locations
  Promoter sequence Name=Xb4151_4152.C65.promoter1; Position on contig =729..788bp; Strand=-
ttttaaaaaaatacccttctttttttnnnccccccccggggggggggtttttttttttaa

SEQ ID NO: 10638 - DNA, 60 bp, Xenorhabdus bovienii
  unsure (1)..(60): unsure at all n locations
  Promoter sequence Name=Xb4151_4152.C67.promoter1; Position on contig =913..972bp; Strand=-
cttgatgccgcancggnaaaannngnnnggnncgccccccggcaangtattttgngtaaa

SEQ ID NO: 10639 - DNA, 60 bp, Xenorhabdus bovienii
  unsure (1)..(60): unsure at all n locations
  Promoter sequence Name=Xb4151_4152.C73.promoter1; Position on contig =2..61bp; Strand=+
nnnnnnnnnnnnnnnnnnnnnnnnnnnnnnnnnnnnnnnnnnnnnnnnnnnnnnnnnnnn

SEQ ID NO: 10640 - DNA, 60 bp, Xenorhabdus bovienii
  unsure (1)..(60): unsure at all n locations
  Promoter sequence Name=Xb4151_4152.C89.promoter1; Position on contig =96..155bp; Strand=+
aaattnngggcagctgcnnnnnnnnnnnnnnnnnnnnnnnnnnnnnttcaaatcgtagna

SEQ ID NO: 10641 - DNA, 60 bp, Xenorhabdus bovienii
  unsure (1)..(60): unsure at all n locations
  Promoter sequence Name=Xb4151_4152.C98.promoter1; Position on contig =501..560bp; Strand=-
aaaaaattatttccccccccccccccctctttttnttttttattttttaaaaaaaaaaga

SEQ ID NO: 10642 - DNA, 60 bp, Xenorhabdus bovienii
  unsure (1)..(60): unsure at all n locations
  Promoter sequence Name=Xb4151_4152.C104.promoter1; Position on contig= 2..61bp; Strand=+
nnnnnnnnnnnnnnnnnnnnnnnnnnnnnnnnnnnnnnnnnnnnnnnnnnnnnnnngggg

SEQ ID NO: 10643 - DNA, 60 bp, Xenorhabdus bovienii
  unsure (1)..(60): unsure at all n locations
  Promoter sequence Name=Xb4151_4152.C108.promoter1; Position on contig= 693..752bp; Strand=-
nttaacacnatannnnnnnnnnnttccncccctccccgnggggnggnnnaaanaannnnn

SEQ ID NO: 10644 - DNA, 60 bp, Xenorhabdus bovienii
  unsure (1)..(60): unsure at all n locations
  Promoter sequence Name=Xb4151_4152.C117.promoter1; Position on contig= 964..1023bp; Strand=-
ccctccctttttttttttttttttnnnggagaaggagagaggggtggtgttttttttttt

SEQ ID NO: 10645 - DNA, 60 bp, Xenorhabdus bovienii
  unsure (1)..(60): unsure at all n locations
  Promoter sequence Name=Xb4151_4152.C123.promoter1; Position on contig= 646..705bp; Strand=-
cataatatagtgataaaagaaaaaaagaaaacaaaaagttcctactctataanacaaaat

SEQ ID NO: 10646 - DNA, 60 bp, Xenorhabdus bovienii
  Promoter sequence Name=Xb4151_4152.C130.promoter1; Position on contig= 421..480bp; Strand=-
ctccttttattttatatataaaaaacaaaaactatttcctccaactctatactctaccta

SEQ ID NO: 10647 - DNA, 60 bp, Xenorhabdus bovienii
  unsure (1)..(60): unsure at all n locations
  Promoter sequence Name=Xb4151_4152.C142.promoter1; Position on contig= 308..367bp; Strand=-
cttccggggggttaatccnnnaacaaaacccccccttacccccccgnnnnaangggnnnt

SEQ ID NO: 10648 - DNA, 60 bp, Xenorhabdus bovienii
  unsure (1)..(60): unsure at all n locations
  Promoter sequence Name=Xb4151_4152.C162.promoter1; Position on contig= 875..934bp; Strand=-
ggggggggttgtgggtggttgttgttgngggggggngggnngtttttnntttttttnnta

SEQ ID NO: 10649 - DNA, 60 bp, Xenorhabdus bovienii
  unsure (1)..(60): unsure at all n locations
  Promoter sequence Name=Xb4151_4152.C173.promoter1; Position on contig= 551..610bp; Strand=-
tgggggnnnnnnnnnnnncnccccgncccgccggggggggggggnggaaaaaaaaaaggn

SEQ ID NO: 10650 - DNA, 60 bp, Xenorhabdus bovienii
  unsure (1)..(60): unsure at all n locations
  Promoter sequence Name=Xb4151_4152.C174.promoter1; Position on contig= 854..913bp; Strand=-
gttggttgnnctccctttttatttttaggggcggggtaaatannntttaaaaacttgagg

SEQ ID NO: 10651 - DNA, 60 bp, Xenorhabdus bovienii
  unsure (1)..(60): unsure at all n locations
  Promoter sequence Name=Xb4151_4152.C174.promoter2; Position on contig= 1116..1175bp; Strand=-
gggcgngagttatattatatattatanccccnttatatttcncccaatatgtttgttggt

SEQ ID NO: 10652 - DNA, 60 bp, Xenorhabdus bovienii
  Promoter sequence Name=Xb4151_4152.C175.promoter1; Position on contig= 197..256bp; Strand=+
ggaggaggattttcattaatgattgatattaatagtgctattattcttataatggctacc

SEQ ID NO: 10653 - DNA, 60 bp, Xenorhabdus bovienii
  unsure (1)..(60): unsure at all n locations
  Promoter sequence Name=Xb4151_4152.C200.promoter1; Position on contig= 174..233bp; Strand=+
tantttncttttttttcttttaaaaaccttttattttattttttanttaaattttnnnnc

SEQ ID NO: 10654 - DNA, 60 bp, Xenorhabdus bovienii
  unsure (1)..(60): unsure at all n locations
  Promoter sequence Name=Xb4151_4152.C207.promoter1; Position on contig= 740..799bp; Strand=-
gnngngnnnnnnnnnnnngnnngnnggngnggggngggggnnnnngnnnnnnnnnnnnnn

SEQ ID NO: 10655 - DNA, 60 bp, Xenorhabdus bovienii
  unsure (1)..(60): unsure at all n locations
  Promoter sequence Name=Xb4151_4152.C220.promoter1; Position on contig= 901..960bp; Strand=-
cccctttttttttttttttgtttcccccccgcccgganaaanaaaaaaaaantttttttt

SEQ ID NO: 10656 - DNA, 60 bp, Xenorhabdus bovienii
  unsure (1)..(60): unsure at all n locations
  Promoter sequence Name=Xb4151_4152.C226.promoter1; Position on contig= 594..653bp; Strand=-
tatttttttgttaatttttttnnnncccccccccccccnctcctttnaattatttataaa

SEQ ID NO: 10657 - DNA, 60 bp, Xenorhabdus bovienii
  unsure (1)..(60): unsure at all n locations
  Promoter sequence Name=Xb4151_4152.C226.promoter2; Position on contig= 895..954bp; Strand=-
gggggaggggaggaggaaacaaccgcctctctcttcttttntttgttnaagaaaagaaaa

SEQ ID NO: 10658 - DNA, 60 bp, Xenorhabdus bovienii
  Promoter sequence Name=Xb4151_4152.C232.promoter1; Position on contig= 333..392bp; Strand=-
aaaaaccccaaggtcctgggttaatttgggcccaaagggtttttttttattgtaaagccc

SEQ ID NO: 10659 - DNA, 60 bp, Xenorhabdus bovienii
  Promoter sequence Name=Xb4151_4152.C236.promoter1; Position on contig= 791..850bp; Strand=-
cgttgttgtatcagagatccgtagtgtaaaccctgggttcaggctgggaaactcgcaaga

SEQ ID NO: 10660 - DNA, 60 bp, Xenorhabdus bovienii
  unsure (1)..(60): unsure at all n locations
  Promoter sequence Name=Xb4151_4152.C246.promoter1; Position on contig= 1011..1070bp; Strand=-
nnnggggggggggggggggggttgttgttttngnnnnnnnnnnnnnnnanaaagaaaaaa

SEQ ID NO: 10661 - DNA, 60 bp, Xenorhabdus bovienii
  unsure (1)..(60): unsure at all n locations
  Promoter sequence Name=Xb4151_4152.C251.promoter1; Position on contig= 455..514bp; Strand=-
cgcgnncgccgcgcccctctccccncaacaacacnccccaattttgtttttgtttctttc

SEQ ID NO: 10662 - DNA, 60 bp, Xenorhabdus bovienii
  unsure (1)..(60): unsure at all n locations
  Promoter sequence Name=Xb4151_4152.C256.promoter1; Position on contig= 244..303bp; Strand=-
naaacccccccctttgggttttnccccccccaaacccacaaaaaaaaaaaatatattttt

SEQ ID NO: 10663 - DNA, 60 bp, Xenorhabdus bovienii
  unsure (1)..(60): unsure at all n locations
  Promoter sequence Name=Xb4151_4152.C256.promoter2; Position on contig= 890..949bp; Strand=-
ggggggtggtttttttttttttttnncccccccccccccacgacaaaaaaaaaaagagga

SEQ ID NO: 10664 - DNA, 60 bp, Xenorhabdus bovienii
  unsure (1)..(60): unsure at all n locations
  Promoter sequence Name=Xb4151_4152.C261.promoter1; Position on contig= 9..68bp; Strand=+
ttacagttggagcacctaacatcanttccagggggccanctggcctctatttttttctcg

SEQ ID NO: 10665 - DNA, 60 bp, Xenorhabdus bovienii
  unsure (1)..(60): unsure at all n locations
  Promoter sequence Name=Xb4151_4152.C271.promoter1; Position on contig= 995..1054bp; Strand=-
taatntataaannccanaaaatnattaacctctctgtcggagacaantatactnataana

SEQ ID NO: 10666 - DNA, 60 bp, Xenorhabdus bovienii
  unsure (1)..(60): unsure at all n locations
  Promoter sequence Name=Xb4151_4152.C271.promoter2; Position on contig= 1350..1409bp; Strand=-
gggggggggaaaatataaattttttccccacacccccggggaggaattanattggttttc

SEQ ID NO: 10667 - DNA, 60 bp, Xenorhabdus bovienii
  Promoter sequence Name=Xb4151_4152.C317.promoter1; Position on contig= 319..378bp; Strand=-
tactgtataggatatgactgtgtataggcgttctaatgttcctcgagtatgctcatccgc

SEQ ID NO: 10668 - DNA, 60 bp, Xenorhabdus bovienii
  Promoter sequence Name=Xb4151_4152.C323.promoter1; Position on contig= 131..190bp; Strand=+
gaccagtttcaaaaacagattcttgtccataaagacgactacgccggtattttcatccaa

SEQ ID NO: 10669 - DNA, 60 bp, Xenorhabdus bovienii
  Promoter sequence Name=Xb4151_4152.C346.promoter1; Position on contig= 409..468bp; Strand=+
tgattaaagactaagatttaaagcatcgaatcatcattactgactgttattagacgacta

SEQ ID NO: 10670 - DNA, 60 bp, Xenorhabdus bovienii
  Promoter sequence Name=Xb4151_4152.C348.promoter1; Position on contig= 459..518bp; Strand=-
aacccccgcgcttttgttttttttttttttttttcccccccccctttttttttttttggg

SEQ ID NO: 10671 - DNA, 60 bp, Xenorhabdus bovienii
  Promoter sequence Name=Xb4151_4152.C353.promoter1; Position on contig= 813..872bp; Strand=-
cactcgcctctggtctgtgaccaatttacggggcgccactctcaatatatgctggacatt

SEQ ID NO: 10672 - DNA, 60 bp, Xenorhabdus bovienii
  Promoter sequence Name=Xb4151_4152.C356.promoter1; Position on contig= 159..218bp; Strand=+
ttctatataaacctgttagagtctactccccatgtccgctggtgagggagaatcaattta

SEQ ID NO: 10673 - DNA, 60 bp, Xenorhabdus bovienii
  Promoter sequence Name=Xb4151_4152.C359.promoter1; Position on contig= 394..453bp; Strand=+
ggagctccatggaccctgggaagagggcccatgaagcctctttacgctatactctattag

SEQ ID NO: 10674 - DNA, 60 bp, Xenorhabdus bovienii
  Promoter sequence Name=Xb4151_4152.C361.promoter1; Position on contig= 307..366bp; Strand=+
tcacccgcaaggggattattgatgacgagatcaatgtctgcgctttttattgtaatcaag

SEQ ID NO: 10675 - DNA, 60 bp, Xenorhabdus bovienii
  Promoter sequence Name=Xb4151_4152.C383.promoter1; Position on contig= 413..472bp; Strand=+
cccacgcagacggcatggcattagtcggcggccagatccagaatgggtaaagtacagctg

SEQ ID NO: 10676 - DNA, 60 bp, Xenorhabdus bovienii
  Promoter sequence Name=Xb4151_4152.C387.promoter1; Position on contig= 1603..1662bp; Strand=-
tattcgaattcagctcggtctgtaatcccctaatgattttggtaaaatataagtaaggtg

SEQ ID NO: 10677 - DNA, 60 bp, Xenorhabdus bovienii
  Promoter sequence Name=Xb4151_4152.C389.promoter1; Position on contig= 176..235bp; Strand=+; Gene name=FolD
gtgcatactgggttgagtcaatgggctttttgttcatatgctcattttatgattatcaat

SEQ ID NO: 10678 - DNA, 60 bp, Xenorhabdus bovienii
  Promoter sequence Name=Xb4151_4152.C389.promoter2; Position on contig= 1766..1825bp; Strand=+
tttttcatgtattaaatcacattcccatacggattagcgattttgggtgcattaaaagga

SEQ ID NO: 10679 - DNA, 60 bp, Xenorhabdus bovienii
  Promoter sequence Name=Xb4151_4152.C390.promoter1; Position on contig= 80..139bp; Strand=+
ttggaaaaaatttaaggcgctcctttctgtgggttggtgtaccataatattattttccaa

SEQ ID NO: 10680 - DNA, 60 bp, Xenorhabdus bovienii
  Promoter sequence Name=Xb4151_4152.C390.promoter2; Position on contig= 3233..3292bp; Strand=-
gtgtaattattcatcaacctcacttttacacagactttctctgttaatacgatagagccg

SEQ ID NO: 10681 - DNA, 60 bp, Xenorhabdus bovienii
  Promoter sequence Name=Xb4151_4152.C390.promoter3; Position on contig= 3942..4001bp; Strand=-; Gene name=ArgS
gtcgttatgccaacttcaatgagtcgcttactgagtgatatttcggcaaaaatagacaat

SEQ ID NO: 10682 - DNA, 60 bp, Xenorhabdus bovienii
  Promoter sequence Name=Xb4151_4152.C390.promoter4; Position on contig= 3884..3943bp; Strand=+; Gene name=ArgS
tcttccccattaaataaaccgtaaaaattgcgttccattaatgtgatataaatcacaaat

SEQ ID NO: 10683 - DNA, 60 bp, Xenorhabdus bovienii
  Promoter sequence Name=Xb4151_4152.C391.promoter1; Position on contig= 168..227bp; Strand=+; Gene name=TufB
gcgggcatcgtataatggctattacctcagccttccaagctgatgatgcgggttcgattc

SEQ ID NO: 10684 - DNA, 60 bp, Xenorhabdus bovienii
  Promoter sequence Name=Xb4151_4152.C391.promoter2; Position on contig= 1680..1739bp; Strand=+
accggaaacggtggttaatgagatggtccccaccaccctgtgagcggtatgctggcaggg

SEQ ID NO: 10685 - DNA, 60 bp, Xenorhabdus bovienii
  Promoter sequence Name=Xb4151_4152.C391.promoter3; Position on contig= 3498..3557bp; Strand=+
tgaatttatcttggctagatggggttccccgtacgcttacagatgttcacacttaatatc

SEQ ID NO: 10686 - DNA, 60 bp, Xenorhabdus bovienii
  Promoter sequence Name=Xb4151_4152.C392.promoter1; Position on contig= 78..137bp; Strand=+
ccggtttatgaccgttgtaacgatagttgagttgaaaggttctttggcagcctttggggg

SEQ ID NO: 10687 - DNA, 60 bp, Xenorhabdus bovienii
  Promoter sequence Name=Xb4151_4152.C392.promoter2; Position on contig= 1827..1886bp; Strand=-; Gene name=Tra8
aagttttatcattaattatcaatacgttaattaatcccgtacaatcccataatttttcta

SEQ ID NO: 10688 - DNA, 60 bp, Xenorhabdus bovienii
  Promoter sequence Name=Xb4151_4152.C392.promoter3; Position on contig= 1676..1735bp; Strand=+; Gene name=Tra8
aaaaatacagcaaataatgtttgggatttttttttcataatcattcttattattaaaaat

SEQ ID NO: 10689 - DNA, 60 bp, Xenorhabdus bovienii
  Promoter sequence Name=Xb4151_4152.C395.promoter1; Position on contig= 99..158bp; Strand=+
attgttcaatttttttacaattttgtatttcctatcaaaaaaatcactaaaatcataaaa

SEQ ID NO: 10690 - DNA, 60 bp, Xenorhabdus bovienii
  Promoter sequence Name=Xb4151_4152.C395.promoter2; Position on contig= 3321..3380bp; Strand=-
gtcaaaaggccactcatttgagtggccttttgcgtttcttagttttttattatcatatcc

SEQ ID NO: 10691 - DNA, 60 bp, Xenorhabdus bovienii
  Promoter sequence Name=Xb4151_4152.C395.promoter3; Position on contig= 3615..3674bp; Strand=+
tatcagcatgagctattttcggtcactataaatgtgattccgaatgctgaaataaaaatt

SEQ ID NO: 10692 - DNA, 60 bp, Xenorhabdus bovienii
  Promoter sequence Name=Xb4151_4152.C396.promoter1; Position on contig= 2328..2387bp; Strand=+
tatcaaatttagtcactagaaaaggtaaaaacttctttaatttttcacacattacgtgta

SEQ ID NO: 10693 - DNA, 60 bp, Xenorhabdus bovienii
  Promoter sequence Name=Xb4151_4152.C396.promoter2; Position on contig= 2955..3014bp; Strand=+
attatgtagcacgggggcaggaaataatttcttgcccccgtgctatttagtatgtattta

SEQ ID NO: 10694 - DNA, 60 bp, Xenorhabdus bovienii
  Promoter sequence Name=Xb4151_4152.C396.promoter3; Position on contig= 4695..4754bp; Strand=+
cgttcagcagaccccaaaagccttttttcacgttggaagaaggcttttattttattgatt

SEQ ID NO: 10695 - DNA, 60 bp, Xenorhabdus bovienii
  Promoter sequence Name=Xb4151_4152.C397.promoter1; Position on contig= 3763..3822bp; Strand=-
agaaaatattggaaaaacacccgaaataaaccccatcggcgtcgttttaaaatgactcaa

SEQ ID NO: 10696 - DNA, 60 bp, Xenorhabdus bovienii
  Promoter sequence Name=Xb4151_4152.C398.promoter1; Position on contig= 556..615bp; Strand=-; Gene name=AlaS
ttatattttagctatcctatagatataggaatgtgttcaaaactgcttatactttaagta

SEQ ID NO: 10697 - DNA, 60 bp, Xenorhabdus bovienii
  Promoter sequence Name=Xb4151_4152.C398.promoter2; Position on contig= 3432..3491bp; Strand=-; Gene name=RecA
aaagcggatgaatttatatgggattttacttcttatggaagacattctatcttaacccta

SEQ ID NO: 10698 - DNA, 60 bp, Xenorhabdus bovienii
  Promoter sequence Name=Xb4151_4152.C398.promoter3; Position on contig= 8195..8254bp; Strand=-
gataacgaggatgtccgccatttcctttcccatgtcctttgacctgttctgatttgtggc

SEQ ID NO: 10699 - DNA, 60 bp, Xenorhabdus bovienii
  Promoter sequence Name=Xb4151_4152.C398.promoter4; Position on contig= 7929..7988bp; Strand=+
taggtaataaaagtccaacccgttcatttttttgagtaaactgttctaaaatccggctga

SEQ ID NO: 10700 - DNA, 60 bp, Xenorhabdus bovienii
  Promoter sequence Name=Xb4151_4152.C399.promoter1; Position on contig= 10797..10856bp; Strand=-; Gene name=XerC
caataaattagcgtaatttttgcagggaaggaaaaaattaactacggttaaaataagcct

SEQ ID NO: 10701 - DNA, 60 bp, Xenorhabdus bovienii
  Promoter sequence Name=Xb4151_4152.C399.promoter2; Position on contig= 11699..11758bp; Strand=-
cgggctgacattgcactccgtaaataatcagcaacactgatcaatgttacatttaattat

SEQ ID NO: 10702 - DNA, 60 bp, Xenorhabdus bovienii
  Promoter sequence Name=Xb4151_4152.C399.promoter3; Position on contig= 11663..11722bp; Strand=+
acatggcattcgccccatagcgtgattaatcagacaataattaaatgtaacattgatcag

SEQ ID NO: 10703 - DNA, 60 bp, Xenorhabdus bovienii
  Promoter sequence Name=Xb4151_4152.C399.promoter4; Position on contig= 12908..12967bp; Strand=-
taaacatttagtctgtataataacatccgaacattagatagagtaattaatctaattttt

SEQ ID NO: 10704 - DNA, 60 bp, Xenorhabdus bovienii
  Promoter sequence Name=Xb4151_4152.C400.promoter1; Position on contig= 132..191bp; Strand=+
ggtgctggcacagttagcctggttttatctcaacgaacagaccgggataaaatagtcagg

SEQ ID NO: 10705 - DNA, 60 bp, Xenorhabdus bovienii
  Promoter sequence Name=Xb4151_4152.C400.promoter2; Position on contig= 1281..1340bp; Strand=+
gccttaccgcttggcgataccccacctgaaaacaacacactaaaacttaaactgttattt

SEQ ID NO: 10706 - DNA, 60 bp, Xenorhabdus bovienii
  Promoter sequence Name=Xb4151_4152.C400.promoter3; Position on contig= 5166..5225bp; Strand=-; Gene name=PtsG
ctttttgttaattcatgatctgatgacatcacttatgtatttcttgttaaaacatttttt

SEQ ID NO: 10707 - DNA, 60 bp, Xenorhabdus bovienii
  Promoter sequence Name=Xb4151_4152.C400.promoter4; Position on contig= 5113..5172bp; Strand=+; Gene name=PtsG
ttatcacatatcagaaggatttaatttgcgatacaaaataatctttttagactaaaaaat

SEQ ID NO: 10708 - DNA, 60 bp, Xenorhabdus bovienii
  Promoter sequence Name=Xb4151_4152.C400.promoter5; Position on contig= 10464..10523bp; Strand=-; Gene name=LexA
tgagtttctttttcataaaattattttatgttcctgtgttttgctgttattttataaata

SEQ ID NO: 10709 - DNA, 60 bp, Xenorhabdus bovienii
  Promoter sequence Name=Xb4151_4152.C400.promoter6; Position on contig= 10410..10469bp; Strand=+; Gene name=LexA
aagcactagaacaatacacagcataacatcataatatatttttgatttataatatattta

SEQ ID NO: 10710 - DNA, 60 bp, Xenorhabdus bovienii
  Promoter sequence Name=Xb4151_4152.C401.promoter1; Position on contig= 1773..1832bp; Strand=-; Gene name=CaiC
gatgcaggggtatacatattttgataaattgagatatttacttatgtacactatctatgg

SEQ ID NO: 10711 - DNA, 60 bp, Xenorhabdus bovienii
  Promoter sequence Name=Xb4151_4152.C401.promoter2; Position on contig= 7621..7680bp; Strand=-
aagataaagaaatcgtttttacgggtattacgataaagaaagccttatataatgtgctct

SEQ ID NO: 10712 - DNA, 60 bp, Xenorhabdus bovienii
  Promoter sequence Name=Xb4151_4152.C401.promoter3; Position on contig= 11994..12053bp; Strand=-; Gene name=FimA
taatcatgattgattggagaaacgactgtgcagtgtcatcgtttgttgataatgatgttt

SEQ ID NO: 10713 - DNA, 60 bp, Xenorhabdus bovienii
  Promoter sequence Name=Xb4151_4152.C401.promoter4; Position on contig= 12678..12737bp; Strand=-
catgctgcatgagtatctattaagttaatgaactaacttccctatcgtattgtatcagtc

SEQ ID NO: 10714 - DNA, 60 bp, Xenorhabdus bovienii
  Promoter sequence Name=Xb4151_4152.C401.promoter5; Position on contig= 13861..13920bp; Strand=-
ccgcaactttctgcgggttcatatcaatcatgcaaatcacacatcgataatataactaac

SEQ ID NO: 10715 - DNA, 60 bp, Xenorhabdus bovienii
  Promoter sequence Name=Xb4151_4152.C401.promoter6; Position on contig= 14484..14543bp; Strand=-
aataagcaatatcaatgagttaagttaaaggggaggattgtcccctttaaactcatagtt

SEQ ID NO: 10716 - DNA, 60 bp, Xenorhabdus bovienii
  Promoter sequence Name=Xb4151_4152.C401.promoter7; Position on contig= 14414..14473bp; Strand=+
agagaacttctgattaggatggcatggaatggctgtttggaaattaataaaatccatatc

SEQ ID NO: 10717 - DNA, 60 bp, Xenorhabdus bovienii
  Promoter sequence Name=Xb4151_4152.C401.promoter8; Position on contig= 15573..15632bp; Strand=+
atagagtgatttatttatgattgtaaaaaaaacagcaaagtatattttatattttatgct

SEQ ID NO: 10718 - DNA, 60 bp, Xenorhabdus bovienii
  Promoter sequence Name=Xb4151_4152.C402.promoter1; Position on contig= 2866..2925bp; Strand=-
aattaactctttcagagtaccttgaatatttaaggaatgaccttatctagtttccagtag

SEQ ID NO: 10719 - DNA, 60 bp, Xenorhabdus bovienii
  Promoter sequence Name=Xb4151_4152.C402.promoter2; Position on contig= 4686..4745bp; Strand=+; Gene name=NrfG
taaattctgtattttacgttgagttttgacggcaaagccgtttcatttaaaataatatgc

SEQ ID NO: 10720 - DNA, 60 bp, Xenorhabdus bovienii
  Promoter sequence Name=Xb4151_4152.C402.promoter3; Position on contig= 6408..6467bp; Strand=+; Gene name=PheA
tttcttctttttcttttttaccttctcatgaggaggttttttcgttttaaaaaggataaa

SEQ ID NO: 10721 - DNA, 60 bp, Xenorhabdus bovienii
  Promoter sequence Name=Xb4151_4152.C402.promoter4; Position on contig= 10078..10137bp; Strand=-; Gene name=RplS
accgatagtatacttactcttgatgtaaataattatttacgataatagtaaattatttac

SEQ ID NO: 10722 - DNA, 60 bp, Xenorhabdus bovienii
  Promoter sequence Name=Xb4151_4152.C402.promoter5; Position on contig= 13200..13259bp; Strand=-; Gene name=Ffh
gtcgagaaagaaagtactctttggattgctttttgcgccaaagtgagtaaaattttcgag

SEQ ID NO: 10723 - DNA, 60 bp, Xenorhabdus bovienii
  Promoter sequence Name=Xb4151_4152.C402.promoter6; Position on contig= 14676..14735bp; Strand=-; Gene name=CcmC
taatcatacttggtaatctctttgcagagattggatcatcatcgtgttataattcgctaa

SEQ ID NO: 10724 - DNA, 60 bp, Xenorhabdus bovienii
  Promoter sequence Name=Xb4151_4152.C402.promoter7; Position on contig= 14719..14778bp; Strand=+; Gene name=CcmC
attaccaagtatgattaacaacggttggaggctacctcagctagcgttatacttaaattt

SEQ ID NO: 10725 - DNA, 60 bp, Xenorhabdus bovienii
  Promoter sequence Name=Xb4151_4152.C403.promoter1; Position on contig= 3658..3717bp; Strand=-; Gene name=BioA
gtaaacctttcttggttcattttggttgacatgatagcggcgttatttaaactgacaaca

SEQ ID NO: 10726 - DNA, 60 bp, Xenorhabdus bovienii
  Promoter sequence Name=Xb4151_4152.C403.promoter2; Position on contig= 3635..3694bp; Strand=+; Gene name=BioA
taacatcctccaatgtggaaaaatgttgtcagtttaaataacgccgctatcatgtcaacc

SEQ ID NO: 10727 - DNA, 60 bp, Xenorhabdus bovienii
  Promoter sequence Name=Xb4151_4152.C403.promoter3; Position on contig= 5126..5185bp; Strand=+
tttaccgccgacaagtatattctatgacttacaggtaaatttcctgatatattccaatca

SEQ ID NO: 10728 - DNA, 60 bp, Xenorhabdus bovienii
  Promoter sequence Name=Xb4151_4152.C403.promoter4; Position on contig= 7010..7069bp; Strand=-; Gene name=Cof
cgcgatatgacatggtaggcctctaaattgtcgatgatataagcaaatattatacggtaa

SEQ ID NO: 10729 - DNA, 60 bp, Xenorhabdus bovienii
  Promoter sequence Name=Xb4151_4152.C403.promoter5; Position on contig= 6969..7028bp; Strand=+; Gene name=Cof
tgtttgttaaactgatcgcatgacggtttaattatattttgttaccgtataatatttgct

SEQ ID NO: 10730 - DNA, 60 bp, Xenorhabdus bovienii
  Promoter sequence Name=Xb4151_4152.C403.promoter6; Position on contig= 10643..10702bp; Strand=-
ggttctgccgggtaatttctttttcccctcattacctgtccatctgattgaattcccgct

SEQ ID NO: 10731 - DNA, 60 bp, Xenorhabdus bovienii
  Promoter sequence Name=Xb4151_4152.C403.promoter7; Position on contig= 10984..11043bp; Strand=-
ccgtaagaatcgcacgtttcgtcggttactgttacttttttattgtctagaatagtgaga

SEQ ID NO: 10732 - DNA, 60 bp, Xenorhabdus bovienii
  Promoter sequence Name=Xb4151_4152.C403.promoter8; Position on contig= 11907..11966bp; Strand=+; Gene name=ModF
tgtcagggggaatgacaactcatctgatgcattctgtaaccaccttccaaaatgagccac

SEQ ID NO: 10733 - DNA, 60 bp, Xenorhabdus bovienii
  Promoter sequence Name=Xb4151_4152.C403.promoter9; Position on contig= 13638..13697bp; Strand=+
aaaatccccctccgcaatgaaaaaatgactactttttaaattttttttataatgacccag

SEQ ID NO: 10734 - DNA, 60 bp, Xenorhabdus bovienii
  Promoter sequence Name=Xb4151_4152.C403.promoter10; Position on contig=14651..14710bp; Strand=+; Gene name=GpmA
ttgccgtttcggtctatcgcgccatataatgcccgcagcgaccattttattttgtattaa

SEQ ID NO: 10735 - DNA, 60 bp, Xenorhabdus bovienii
  Promoter sequence Name=Xb4151_4152.C403.promoter11; Position on contig=16654..16713bp; Strand=-; Gene name=PnuC
tctcttttttactcataaagattatttacagcacaacgcctaacagttagattgagatca

SEQ ID NO: 10736 - DNA, 60 bp, Xenorhabdus bovienii
  Promoter sequence Name=Xb4151_4152.C403.promoter12; Position on contig=17714..17773bp; Strand=-
gactcagaaaatgagtcatttattatccattatcattttaaaaacgttaaaataattaaa

SEQ ID NO: 10737 - DNA, 60 bp, Xenorhabdus bovienii
  Promoter sequence Name=Xb4151_4152.C404.promoter1; Position on contig= 624..683bp; Strand=+; Gene name=BaeS
cgtatttttttactgtttgctcaatcttcgatctgtaatggtctttttattctctaacct

SEQ ID NO: 10738 - DNA, 60 bp, Xenorhabdus bovienii
  Promoter sequence Name=Xb4151_4152.C404.promoter2; Position on contig= 7064..7123bp; Strand=-; Gene name=GyrA
aatgctgctttgtattccctgctacactagtatatgctgttaatagttattattaatcat

SEQ ID NO: 10739 - DNA, 60 bp, Xenorhabdus bovienii
  Promoter sequence Name=Xb4151_4152.C404.promoter3; Position on contig= 10206..10265bp; Strand=-; Gene name=UbiG
cccaacatccagcacttttttgccgaaaagacctccggcacgttgcaggatataattcaa

SEQ ID NO: 10740 - DNA, 60 bp, Xenorhabdus bovienii
  Promoter sequence Name=Xb4151_4152.C404.promoter4; Position on contig= 9923..9982bp; Strand=+; Gene name=UbiG
gacagttttataaaaaccagatgcgggtatttcaagattaaggcatgtataataccctct

SEQ ID NO: 10741 - DNA, 60 bp, Xenorhabdus bovienii
  Promoter sequence Name=Xb4151_4152.C404.promoter5; Position on contig= 10961..11020bp; Strand=+; Gene name=NrdA
tgtgcacttgaaaaaatgcggatttaacattatcttgttattaccgttttaattaccccc

SEQ ID NO: 10742 - DNA, 60 bp, Xenorhabdus bovienii
  Promoter sequence Name=Xb4151_4152.C404.promoter6; Position on contig= 15450..15509bp; Strand=-
ttctcattcttccaaaaaaataaatcctgccaaatatacaagagacatattataaattca

SEQ ID NO: 10743 - DNA, 60 bp, Xenorhabdus bovienii
  Promoter sequence Name=Xb4151_4152.C404.promoter7; Position on contig= 15425..15484bp; Strand=+
ggtgttgatgtttttattttattgttgaatttataatatgtctcttgtatatttggcagg

SEQ ID NO: 10744 - DNA, 60 bp, Xenorhabdus bovienii
  Promoter sequence Name=Xb4151_4152.C404.promoter8; Position on contig= 17531..17590bp; Strand=-
aaaaaataagtgctagctgcttgctagcacatttagctaaatcaatttaaaatattaact

SEQ ID NO: 10745 - DNA, 60 bp, Xenorhabdus bovienii
  Promoter sequence Name=Xb4151_4152.C404.promoter9; Position on contig= 19074..19133bp; Strand=+; Gene name=CspC
gaaagtgcctgtttatatgtacagtaattggcggtagtgtaaaaaaataaaattaaagct

SEQ ID NO: 10746 - DNA, 60 bp, Xenorhabdus bovienii
  Promoter sequence Name=Xb4151_4152.C404.promoter10; Position on contig=20473..20532bp; Strand=-
gtgctggcacagttagccctggttttatctcaacgaacagaccgggataaaatagtcagg

SEQ ID NO: 10747 - DNA, 60 bp, Xenorhabdus bovienii
  Promoter sequence Name=Xb4151_4152.C405.promoter1; Position on contig= 7863..7922bp; Strand=-
tcaaaaaataaccaaaatagcaatttgtctataaaaatgtggataagtataaataatgaa

SEQ ID NO: 10748 - DNA, 60 bp, Xenorhabdus bovienii
  Promoter sequence Name=Xb4151_4152.C405.promoter2; Position on contig= 7866..7925bp; Strand=+
attatttatacttatccacatttttatagacaaattgctattttggttattttttgatag

SEQ ID NO: 10749 - DNA, 60 bp, Xenorhabdus bovienii
  Promoter sequence Name=Xb4151_4152.C405.promoter3; Position on contig= 9873..9932bp; Strand=-
caactgatattaaaacaccagaatttgatgaaaatggttttgcaacgtctaatggctgag

SEQ ID NO: 10750 - DNA, 60 bp, Xenorhabdus bovienii
  Promoter sequence Name=Xb4151_4152.C405.promoter4; Position on contig= 10414..10473bp; Strand=-
taagtagtgcagaaccactttcagcttgaatgtctgagaatatcttttcttcttcataaa

SEQ ID NO: 10751 - DNA, 60 bp, Xenorhabdus bovienii
  Promoter sequence Name=Xb4151_4152.C405.promoter5; Position on contig= 10300..10359bp; Strand=+
agactgtccggcagcaccagacattgactggcctaaagcgccagagtgattattaggggc

SEQ ID NO: 10752 - DNA, 60 bp, Xenorhabdus bovienii
  Promoter sequence Name=Xb4151_4152.C405.promoter6; Position on contig= 12248..12307bp; Strand=-
ccatttctttaaattgagataattatgaataccagcattaaacatgataaaataaaacca

SEQ ID NO: 10753 - DNA, 60 bp, Xenorhabdus bovienii; identical to SEQ ID NO: 10748
  Promoter sequence Name=Xb4151_4152.C405.promoter7; Position on contig= 15233..15292bp; Strand=-

SEQ ID NO: 10754 - DNA, 60 bp, Xenorhabdus bovienii
  Promoter sequence Name=Xb4151_4152.C406.promoter1; Position on contig= 2602..2661bp; Strand=-; Gene name=SppA
ttaaagcctgatccttacatcaggctttttttattccatatactccctataatccggctg

SEQ ID NO: 10755 - DNA, 60 bp, Xenorhabdus bovienii
  Promoter sequence Name=Xb4151_4152.C406.promoter2; Position on contig= 4757..4816bp; Strand=-; Gene name=NfnB
gtcaaacgtgaagctgaacgacgatttaataaaagttccaaagcattcataattttctcc

SEQ ID NO: 10756 - DNA, 60 bp, Xenorhabdus bovienii
  Promoter sequence Name=Xb4151_4152.C406.promoter3; Position on contig= 9308..9367bp; Strand=+
aagtttgatttagcggttacctgatgagaaggccatttcaaggaaattattttagccaca

SEQ ID NO: 10757 - DNA, 60 bp, Xenorhabdus bovienii
  Promoter sequence Name=Xb4151_4152.C406.promoter4; Position on contig= 12297..12356bp; Strand=-; Gene name=CheY
aataggtcattactatttgtactcttacatatctttgcagtatcggtcatattaacagca

SEQ ID NO: 10758 - DNA, 60 bp, Xenorhabdus bovienii
  Promoter sequence Name=Xb4151_4152.C406.promoter5; Position on contig= 12241..12300bp; Strand=+; Gene name=CheY
gagtcgctgccacaagggcatatttttgtcaaaataactccagttgtttaaatagttgct

SEQ ID NO: 10759 - DNA, 60 bp, Xenorhabdus bovienii
  Promoter sequence Name=Xb4151_4152.C406.promoter6; Position on contig= 13504..13563bp; Strand=+; Gene name=GalU
aatgtgattaaacgccagcgtgctgtatatctagctgagttagctggtatacttgagcgc

SEQ ID NO: 10760 - DNA, 60 bp, Xenorhabdus bovienii
  Promoter sequence Name=Xb4151_4152.C406.promoter7; Position on contig= 17656..17715bp; Strand=-; Gene name=Tdk
tcactattgcagaaaataaaatagcattctattattatccgtacatcggctatcatcatt

SEQ ID NO: 10761 - DNA, 60 bp, Xenorhabdus bovienii
  Promoter sequence Name=Xb4151_4152.C406.promoter8; Position on contig= 21763..21822bp; Strand=-; Gene name=Tra8
ttaaatttcaggcaaggtgcataattaatatatcaactcattaatttaggtaattttttt

SEQ ID NO: 10762 - DNA, 60 bp, Xenorhabdus bovienii
  Promoter sequence Name=Xb4151_4152.C407.promoter1; Position on contig= 381..440bp; Strand=+
tttacaaaaagcgccaaaagctataagttgtatttaaaatgcatgttataaatttcaacg

SEQ ID NO: 10763 - DNA, 60 bp, Xenorhabdus bovienii
  Promoter sequence Name=Xb4151_4152.C407.promoter2; Position on contig= 3763..3822bp; Strand=-; Gene name=AtoC
ttctgccactccagaagttcttacactggatataaattatatagagatacactgtcttga

SEQ ID NO: 10764 - DNA, 60 bp, Xenorhabdus bovienii
  Promoter sequence Name=Xb4151_4152.C407.promoter3; Position on contig= 7547..7606bp; Strand=-
atagctctcaataatccactattttcaaaaacgagaaaaagtaacaatagaattcatcat

SEQ ID NO: 10765 - DNA, 60 bp, Xenorhabdus bovienii
  Promoter sequence Name=Xb4151_4152.C407.promoter4; Position on contig= 8295..8354bp; Strand=-; Gene name=PurL
cattctccctttatataagtccctgaagatttattagggtcttaagttaaaaaccacaaa

SEQ ID NO: 10766 - DNA, 60 bp, Xenorhabdus bovienii
  Promoter sequence Name=Xb4151_4152.C407.promoter5; Position on contig= 12383..12442bp; Strand=-; Gene name=MltE
attttgcgtaacaaaactgggatgtgcaaccttattgaatcaatttttaaattctactaa

SEQ ID NO: 10767 - DNA, 60 bp, Xenorhabdus bovienii
  Promoter sequence Name=Xb4151_4152.C407.promoter6; Position on contig= 12340..12399bp; Strand=+; Gene name=MltE
gacgaaaccgtttgcgtgactgttattcaatcgaataatacaattagtagaatttaaaaa

SEQ ID NO: 10768 - DNA, 60 bp, Xenorhabdus bovienii
  Promoter sequence Name=Xb4151_4152.C407.promoter7; Position on contig= 15314..15373bp; Strand=-; Gene name=AlkA
ttatgctcaagatttgaggttgctagtgtcagatggttaaggcctgtcaacatggatagt

SEQ ID NO: 10769 - DNA, 60 bp, Xenorhabdus bovienii
  Promoter sequence Name=Xb4151_4152.C407.promoter8; Position on contig= 16483..16542bp; Strand=-
ataattataggctttcttccaactaagttgttgtgaatgattgtgataatatctttcgat

SEQ ID NO: 10770 - DNA, 60 bp, Xenorhabdus bovienii
  Promoter sequence Name=Xb4151_4152.C407.promoter9; Position on contig= 18316..18375bp; Strand=-
ttttctcacgcccactattattcaggatattacttcaggatgagatataaaatgagtcta

SEQ ID NO: 10771 - DNA, 60 bp, Xenorhabdus bovienii
  Promoter sequence Name=Xb4151_4152.C407.promoter10; Position on contig=19495..19554bp; Strand=+
ttggctgctgtagtcaattttttggcgtacacctagtactacagtcgtatgcttcattgt

SEQ ID NO: 10772 - DNA, 60 bp, Xenorhabdus bovienii
  Promoter sequence Name=Xb4151_4152.C407.promoter11; Position on contig=21375..21434bp; Strand=-
aatcccccacacaaccccaatcaattcattcaactataagcattggttactatattcggg

SEQ ID NO: 10773 - DNA, 60 bp, Xenorhabdus bovienii
  Promoter sequence Name=Xb4151_4152.C407.promoter12; Position on contig=24432..24491bp; Strand=-; Gene name=InsB
gcgccattctcgaaaataccttcgtcaccttaagcttatttaccgggaatattaatgccg

SEQ ID NO: 10774 - DNA, 60 bp, Xenorhabdus bovienii
  Promoter sequence Name=Xb4151_4152.C407.promoter13; Position on contig=25306..25365bp; Strand=-
accaaaagacattccccagacaattaatccgaaccacacaaaaaggctattataactcga

SEQ ID NO: 10775 - DNA, 60 bp, Xenorhabdus bovienii
  Promoter sequence Name=Xb4151_4152.C408.promoter1; Position on contig= 814..873bp; Strand=-
agagactgatttttaccactattatttaaatgagaaattcattcatttataaaaataata

SEQ ID NO: 10776 - DNA, 60 bp, Xenorhabdus bovienii
  Promoter sequence Name=Xb4151_4152.C408.promoter2; Position on contig= 768..827bp; Strand=+
aagatcggggaacaactttatatctttttgactgttaataataatttattatttttataa

SEQ ID NO: 10777 - DNA, 60 bp, Xenorhabdus bovienii
  Promoter sequence Name=Xb4151_4152.C408.promoter3; Position on contig= 1535..1594bp; Strand=+; Gene name=GlpF
tctttaacggataatggttattttttaacattaattttcaccaggttgacaataaaaccg

SEQ ID NO: 10778 - DNA, 60 bp, Xenorhabdus bovienii
  Promoter sequence Name=Xb4151_4152.C408.promoter4; Position on contig= 2443..2502bp; Strand=+; Gene name=WecD
tatcattttgaacagccatgctattgcgtggctttttatcatatttatggtaaatttttc

SEQ ID NO: 10779 - DNA, 60 bp, Xenorhabdus bovienii
  Promoter sequence Name=Xb4151_4152.C408.promoter5; Position on contig= 3656..3715bp; Strand=+; Gene name=DIT1
accctcaatatgttcagtttaatttatatattaggttggttataccttatattttttgat

SEQ ID NO: 10780 - DNA, 60 bp, Xenorhabdus bovienii
  Promoter sequence Name=Xb4151_4152.C408.promoter6; Position on contig= 8454..8513bp; Strand=-; Gene name=Tra8
cttaaacaaattatttatcgaaaattcgtaaaaataaagtagcgttttaatatactataa

SEQ ID NO: 10781 - DNA, 60 bp, Xenorhabdus bovienii
  Promoter sequence Name=Xb4151_4152.C408.promoter7; Position on contig= 9743..9802bp; Strand=-; Gene name=Gst
attattattcacttaattaatgcttttaaaacaaaaataaatatagaaaaaatacaacta

SEQ ID NO: 10782 - DNA, 60 bp, Xenorhabdus bovienii
  Promoter sequence Name=Xb4151_4152.C408.promoter8; Position on contig= 16664..16723bp; Strand=-; Gene name=PspF
tgtacaattatcatgcaacacgcataaatggcgctatttcattaatttaaaataaaaaat

SEQ ID NO: 10783 - DNA, 60 bp, Xenorhabdus bovienii
  Promoter sequence Name=Xb4151_4152.C408.promoter9; Position on contig= 16694..16753bp; Strand=+; Gene name=PspF
catttatgcgtgttgcatgataattgtacatctattgagcataatgtatacttgtttcat

SEQ ID NO: 10784 - DNA, 60 bp, Xenorhabdus bovienii
  Promoter sequence Name=Xb4151_4152.C408.promoter10; Position on contig=19478..19537bp; Strand=-
atccacacagcgcctgtttcagggttttacattatgcaattatctgatacattcaagtaa

SEQ ID NO: 10785 - DNA, 60 bp, Xenorhabdus bovienii
  Promoter sequence Name=Xb4151_4152.C408.promoter11; Position on contig=21107..21166bp; Strand=-
taatctattgtttttactggcttgccttgcttcttccacagcttgagcaaaattctcaac

SEQ ID NO: 10786 - DNA, 60 bp, Xenorhabdus bovienii
  Promoter sequence Name=Xb4151_4152.C408.promoter12; Position on contig=20883..20942bp; Strand=+
aagtgcattgaacacctccccgtatttcaggaaaaaatgtcaggcgttatcatgccacaa

SEQ ID NO: 10787 - DNA, 60 bp, Xenorhabdus bovienii
  Promoter sequence Name=Xb4151_4152.C409.promoter1; Position on contig= 1469..1528bp; Strand=+; Gene name=PheS
aaaagaaacgaaaaaaagcgcttgagcctccaatgtggaggcttttttatttttatgacc

SEQ ID NO: 10788 - DNA, 60 bp, Xenorhabdus bovienii
  Promoter sequence Name=Xb4151_4152.C409.promoter2; Position on contig= 5290..5349bp; Strand=+; Gene name=BtuC
acatataaaaaaggccgcatttttgtgcggtctttttcttacctttaatatcctgttgta

SEQ ID NO: 10789 - DNA, 60 bp, Xenorhabdus bovienii
  Promoter sequence Name=Xb4151_4152.C409.promoter3; Position on contig= 7244..7303bp; Strand=+; Gene name=WecE
accctgattttgtctatccgttgatgtttcgttgaacaaacgtcatttaaaatttttggg

SEQ ID NO: 10790 - DNA, 60 bp, Xenorhabdus bovienii
  Promoter sequence Name=Xb4151_4152.C409.promoter4; Position on contig= 14339..14398bp; Strand=-
gttagtccccaaagataacctctcattgatttagactcatcaataaaattccgaacataa

SEQ ID NO: 10791 - DNA, 60 bp, Xenorhabdus bovienii
  Promoter sequence Name=Xb4151_4152.C409.promoter5; Position on contig= 15444..15503bp; Strand=-
tgcaaatacaagttgctggtcacttttattataaaaatgaagagcaatatattgaattta

SEQ ID NO: 10792 - DNA, 60 bp, Xenorhabdus bovienii
  Promoter sequence Name=Xb4151_4152.C409.promoter6; Position on contig= 15424..15483bp; Strand=+
agagaaaaaaaaaggggcaataaattcaatatattgctcttcatttttataataaaagtg

SEQ ID NO: 10793 - DNA, 60 bp, Xenorhabdus bovienii
  Promoter sequence Name=Xb4151_4152.C409.promoter7; Position on contig= 16507..16566bp; Strand=+; Gene name=Spr
tagtaagcaatggcgggggcttcgcgtgagatttaggtatttatttttatcatttaatct

SEQ ID NO: 10794 - DNA, 60 bp, Xenorhabdus bovienii
  Promoter sequence Name=Xb4151_4152.C409.promoter8; Position on contig= 18682..18741bp; Strand=-
ttaaattgaaatcgcacattttgcgtatacgattcaaaagaaattcttaaaatgtcccac

SEQ ID NO: 10795 - DNA, 60 bp, Xenorhabdus bovienii
  Promoter sequence Name=Xb4151_4152.C409.promoter9; Position on contig= 19358..19417bp; Strand=+
cttactcatctgtttatctttgatgtatagcagtaaaaataattctttataatctaaagt

SEQ ID NO: 10796 - DNA, 60 bp, Xenorhabdus bovienii
  Promoter sequence Name=Xb4151_4152.C409.promoter10; Position on contig=27610..27669bp; Strand=-
ctcgggcaaatgtcattattacttgttgaatttaccgggtgttgagttattgtgatttca

SEQ ID NO: 10797 - DNA, 60 bp, Xenorhabdus bovienii
  Promoter sequence Name=Xb4151_4152.C409.promoter11; Position on contig=28690..28749bp; Strand=-; Gene name=PpsA
tatggaaaggtgaatcgatcaacccagcaatattatttttttgcgggtataatcgggaat

SEQ ID NO: 10798 - DNA, 60 bp, Xenorhabdus bovienii
  Promoter sequence Name=Xb4151_4152.C409.promoter12; Position on contig=28727..28786bp; Strand=+; Gene name=PpsA
gttgatcgattcacctttccatatatgacaaaacaatgtgctaggctattttacgctgta

SEQ ID NO: 10799 - DNA, 60 bp, Xenorhabdus bovienii
  Promoter sequence Name=Xb4151_4152.C409.promoter13; Position on contig=32851..32910bp; Strand=-; Gene name=GlcD
acgatatcacaatctttatcaattttgagcaatctgtgaaataacgttatatttacttac

SEQ ID NO: 10800 - DNA, 60 bp, Xenorhabdus bovienii
  Promoter sequence Name=Xb4151_4152.C409.promoter14; Position on contig=32772..32831bp; Strand=+; Gene name=GlcD
gtaaatcctggcgtgattgcgatttttccatgaaattatttctcttttgcaattgaaagt

SEQ ID NO: 10801 - DNA, 60 bp, Xenorhabdus bovienii
  Promoter sequence Name=Xb4151_4152.C410.promoter1; Position on contig= 3..62bp; Strand=+
aatttaatacagttcttccattgcatggtggtctattactcaataacatcgctgataatt

SEQ ID NO: 10802 - DNA, 60 bp, Xenorhabdus bovienii
  Promoter sequence Name=Xb4151_4152.C410.promoter2; Position on contig= 2452..2511bp; Strand=-; Gene name=Smf
ccccaatgtcaacaaggaaaattattccagcgtaagtcacgttttggtaaaacatttcat

SEQ ID NO: 10803 - DNA, 60 bp, Xenorhabdus bovienii
  Promoter sequence Name=Xb4151_4152.C410.promoter3; Position on contig= 4095..4154bp; Strand=-; Gene name=Def
ggctttgcaattgtgcgaagtcgctcgtctgggtaatgtaatacttgtaaaactgacata

SEQ ID NO: 10804 - DNA, 60 bp, Xenorhabdus bovienii
  Promoter sequence Name=Xb4151_4152.C410.promoter4; Position on contig= 3998..4057bp; Strand=+; Gene name=Def
ccttgattaatttatggtcgatactgtcaatctaaataggaaatgtctagaataggcaca

SEQ ID NO: 10805 - DNA, 60 bp, Xenorhabdus bovienii
  Promoter sequence Name=Xb4151_4152.C410.promoter5; Position on contig= 5583..5642bp; Strand=+; Gene name=Sun
ttaatttgcctgtatactctgagcatacgggcgtcttcctttttataatgctgacaaccg

SEQ ID NO: 10806 - DNA, 60 bp, Xenorhabdus bovienii
  Promoter sequence Name=Xb4151_4152.C410.promoter6; Position on contig= 6954..7013bp; Strand=+; Gene name=TrkA
atcttcctcgtcaaaatatcggatcagcagggattttgtgactttactaaaatatcaaaa

SEQ ID NO: 10807 - DNA, 60 bp, Xenorhabdus bovienii
  Promoter sequence Name=Xb4151_4152.C410.promoter7; Position on contig= 9277..9336bp; Strand=-; Gene name=RplQ
gtagaagcataaaaaaccgggataacacccggttttttattgctctttatttttccttcc

SEQ ID NO: 10808 - DNA, 60 bp, Xenorhabdus bovienii
  Promoter sequence Name=Xb4151_4152.C410.promoter8; Position on contig= 12310..12369bp; Strand=-; Gene name=SecY
ggctaatttaatcgcatatttttcttgcaaagttgggttgagctggctaaattagccagc

SEQ ID NO: 10809 - DNA, 60 bp, Xenorhabdus bovienii
  Promoter sequence Name=Xb4151_4152.C410.promoter9; Position on contig= 17978..18037bp; Strand=-; Gene name=RpsQ
aaagtaacgggccgtttatttttctgtccatagcgtggatgtggtgttataatgccgcgc

SEQ ID NO: 10810 - DNA, 60 bp, Xenorhabdus bovienii
  Promoter sequence Name=Xb4151_4152.C410.promoter10; Position on contig=23219..23278bp; Strand=-; Gene name=Bfr
cttttgaatagctttcacccttatcttgcattgtcagcaaattcacgtataataagcgag

SEQ ID NO: 10811 - DNA, 60 bp, Xenorhabdus bovienii
  Promoter sequence Name=Xb4151_4152.C410.promoter11; Position on contig=24273..24332bp; Strand=-
ctataaacaaaataaaaacaataattgaaatgagagttatttctatttactatttggcag

SEQ ID NO: 10812 - DNA, 60 bp, Xenorhabdus bovienii
  Promoter sequence Name=Xb4151_4152.C411.promoter1; Position on contig= 16247..16306bp; Strand=-; Gene name=PurR
ctaaattttttttctaagaatatactttccatcatcgttaatttatttaaaattatcata

SEQ ID NO: 10813 - DNA, 60 bp, Xenorhabdus bovienii
  Promoter sequence Name=Xb4151_4152.C411.promoter2; Position on contig= 17743..17802bp; Strand=-; Gene name=IlvH
aatcgcaatctgcgggttaatatacagatctttaacgaaccctactgtaaagtagggttt

SEQ ID NO: 10814 - DNA, 60 bp, Xenorhabdus bovienii
  Promoter sequence Name=Xb4151_4152.C411.promoter3; Position on contig= 20109..20168bp; Strand=-; Gene name=FAA1
ttaattaatctggtgttatcgaatgagttaacactagattgactttatataaataaaaag

SEQ ID NO: 10815 - DNA, 60 bp, Xenorhabdus bovienii
  Promoter sequence Name=Xb4151_4152.C411.promoter4; Position on contig= 23539..23598bp; Strand=-; Gene name=LeuA
taagtgactaatgtaattcgagttatttctattcatacataaaaaattaatattcatgct

SEQ ID NO: 10816 - DNA, 60 bp, Xenorhabdus bovienii
  Promoter sequence Name=Xb4151_4152.C411.promoter5; Position on contig= 24223..24282bp; Strand=+; Gene name=LeuA
gaaaaaaaccgcgctgggcgcggtttttttataccggctcggcgctcaagaatcaaacac

SEQ ID NO: 10817 - DNA, 60 bp, Xenorhabdus bovienii
  Promoter sequence Name=Xb4151_4152.C411.promoter6; Position on contig= 27730..27789bp; Strand=+; Gene name=MutH
tatttttaatacggtaaacaccaattaaaaaatcttgtatatcatgctattatcaaggta

SEQ ID NO: 10818 - DNA, 60 bp, Xenorhabdus bovienii
  Promoter sequence Name=Xb4151_4152.C411.promoter7; Position on contig= 29170..29229bp; Strand=-; Gene name=Def
cttaactcaatgttttaattttatatatcagcattatttaaatcattaataataaataaa

SEQ ID NO: 10819 - DNA, 60 bp, Xenorhabdus bovienii
  Promoter sequence Name=Xb4151_4152.C411.promoter8; Position on contig= 29571..29630bp; Strand=-
cgagtcgtatcatgcatcaattcgagggcgtctttttgggcatctgttagattaattttc

SEQ ID NO: 10820 - DNA, 60 bp, Xenorhabdus bovienii
  Promoter sequence Name=Xb4151_4152.C411.promoter9; Position on contig= 29449..29508bp; Strand=+
gatccaatgcttccactttcactttttcaaacctttctacatccgcgtaatatcccggta

SEQ ID NO: 10821 - DNA, 60 bp, Xenorhabdus bovienii
  Promoter sequence Name=Xb4151_4152.C412.promoter1; Position on contig= 2819..2878bp; Strand=-; Gene name=TolA
tttggcagttaaaaatacgaataatttatatatacaaacaaaattattagattttattta

SEQ ID NO: 10822 - DNA, 60 bp, Xenorhabdus bovienii
  Promoter sequence Name=Xb4151_4152.C412.promoter2; Position on contig= 3925..3984bp; Strand=-; Gene name=ExbD
acaaacgagcaaaataataggctgaatcgcgccattatcatttcggttatacttcacatt

SEQ ID NO: 10823 - DNA, 60 bp, Xenorhabdus bovienii
  Promoter sequence Name=Xb4151_4152.C412.promoter3; Position on contig= 5706..5765bp; Strand=-
ttttttttcatccattgcctgcacttttgattcttctctttggcttatatcattttttta

SEQ ID NO: 10824 - DNA, 60 bp, Xenorhabdus bovienii
  Promoter sequence Name=Xb4151_4152.C412.promoter4; Position on contig= 9087..9146bp; Strand=-; Gene name=SucD
tcaatttattactatggtatgtattcgctaggtttgcttaaattgatctaaaataattag

SEQ ID NO: 10825 - DNA, 60 bp, Xenorhabdus bovienii
  Promoter sequence Name=Xb4151_4152.C412.promoter5; Position on contig= 11621..11680bp; Strand=-; Gene name=AceF
cggagggtgttaaattccgcccagtctgaagtaaagcaatgttgatgtaaaaaatgtata

SEQ ID NO: 10826 - DNA, 60 bp, Xenorhabdus bovienii
  Promoter sequence Name=Xb4151_4152.C412.promoter6; Position on contig= 19476..19535bp; Strand=-; Gene name=GltA
gttaataatcatattgtgtgggaattgtaataagtatgtgaagtacttatactgccgtaa

SEQ ID NO: 10827 - DNA, 60 bp, Xenorhabdus bovienii
  Promoter sequence Name=Xb4151_4152.C412.promoter7; Position on contig= 22156..22215bp; Strand=-; Gene name=ProP
tgagctatttatagcccgaaagattagcattctgctgaatgtctttttatgataataaag

SEQ ID NO: 10828 - DNA, 60 bp, Xenorhabdus bovienii
  Promoter sequence Name=Xb4151_4152.C412.promoter8; Position on contig= 22099..22158bp; Strand=+; Gene name=ProP
gcagccaggccatattaataccctttaactttatgtccgattacataaataaatcgcctt

SEQ ID NO: 10829 - DNA, 60 bp, Xenorhabdus bovienii
  Promoter sequence Name=Xb4151_4152.C412.promoter9; Position on contig= 24270..24329bp; Strand=-
ttatgctggcgaggtgttttgcttttatcgctgtttattgctattgatacgattcttgat

SEQ ID NO: 10830 - DNA, 60 bp, Xenorhabdus bovienii
  Promoter sequence Name=Xb4151_4152.C412.promoter10; Position on contig=24760..24819bp; Strand=-; Gene name=KdpA
ttttttgttttcaatgtatttatcttgtttttatttaggtattaatttgtaattaaatta

SEQ ID NO: 10831 - DNA, 60 bp, Xenorhabdus bovienii
  Promoter sequence Name=Xb4151_4152.C412.promoter11; Position on contig=24836..24895bp; Strand=+; Gene name=KdpA
gctagactttccttggataccttattaattaatccctcttatatttttatacttttttta

SEQ ID NO: 10832 - DNA, 60 bp, Xenorhabdus bovienii
  Promoter sequence Name=Xb4151_4152.C412.promoter12; Position on contig=38322..38381bp; Strand=-; Gene name=MhpC
tttaagttattgaaagtttaattgttttgttttgctgtattatatcttataatctcagaa

SEQ ID NO: 10833 - DNA, 60 bp, Xenorhabdus bovienii
  Promoter sequence Name=Xb4151_4152.C412.promoter13; Position on contig=38447..38506bp; Strand=+; Gene name=MhpC
taccgtcatttgatgccatttagtttgtcactgccgacctgtcatggtattaaacatcac

SEQ ID NO: 10834 - DNA, 60 bp, Xenorhabdus bovienii
  Promoter sequence Name=Xb4151_4152.C412.promoter14; Position on contig=39627..39686bp; Strand=-
agtgattattttatctgttactgttatttaattaaactaaataattttataatgcttttt

SEQ ID NO: 10835 - DNA, 60 bp, Xenorhabdus bovienii
  Promoter sequence Name=Xb4151_4152.C412.promoter15; Position on contig=40932..40991bp; Strand=-; Gene name=Tra8
aaatttaatattctaaaaatggaattaatgataaaaatgagcctatttaatatatatttt

SEQ ID NO: 10836 - DNA, 60 bp, Xenorhabdus bovienii
  Promoter sequence Name=Xb4151_4152.C412.promoter16; Position on contig=40930..40989bp; Strand=+; Gene name=Tra8
taaaaatatatattaaataggctcatttttatcattaattccatttttagaatattaaat

SEQ ID NO: 10837 - DNA, 60 bp, Xenorhabdus bovienii
  Promoter sequence Name=Xb4151_4152.C412.promoter17; Position on contig=41656..41715bp; Strand=+; Gene name=Tra8
ttagttgaacgaaaatcgttatttactatcataattaaacttaaagataaaacagcagaa

SEQ ID NO: 10838 - DNA, 60 bp, Xenorhabdus bovienii
  Promoter sequence Name=Xb4151_4152.C413.promoter1; Position on contig= 1549..1608bp; Strand=-
aaccacaaccatgcaggctgtacagttcactccctctatcaaaggagtatgttgttatgt

SEQ ID NO: 10839 - DNA, 60 bp, Xenorhabdus bovienii
  Promoter sequence Name=Xb4151_4152.C413.promoter2; Position on contig= 7275..7334bp; Strand=-
cacccgcgttgttcacgtctttttttactgatcttcctagataattttctaatcctgtac

SEQ ID NO: 10840 - DNA, 60 bp, Xenorhabdus bovienii
  Promoter sequence Name=Xb4151_4152.C413.promoter3; Position on contig= 7021..7080bp; Strand=+
tgttgtccactgcttgcgttgttttttaagcatcttcaatcaaccttcagaatcaacatt

SEQ ID NO: 10841 - DNA, 60 bp, Xenorhabdus bovienii
  Promoter sequence Name=Xb4151_4152.C413.promoter4; Position on contig= 9186..9245bp; Strand=-; Gene name=SunT (BS)
tatcacgatagagaattcattgaagacatgaaacttgtttcggcttaaaattaatttctt

SEQ ID NO: 10842 - DNA, 60 bp, Xenorhabdus bovienii
  Promoter sequence Name=Xb4151_4152.C413.promoter5; Position on contig= 15051..15110bp; Strand=-
caaatgatttatcgactgcttgaacgaaaatatatctatttgctttttaaaatcaacata

SEQ ID NO: 10843 - DNA, 60 bp, Xenorhabdus bovienii
  Promoter sequence Name=Xb4151_4152.C413.promoter6; Position on contig= 15279..15338bp; Strand=+
gtttttaatcatttaatttaatatatttgcaacattaagtttgaatttaatatatttgca

SEQ ID NO: 10844 - DNA, 60 bp, Xenorhabdus bovienii
  Promoter sequence Name=Xb4151_4152.C413.promoter7; Position on contig= 30659..30718bp; Strand=+
ttattttttttactaaataaagaataattccaatatcaaattacgttaaattatattata

SEQ ID NO: 10845 - DNA, 60 bp, Xenorhabdus bovienii
  Promoter sequence Name=Xb4151_4152.C414.promoter1; Position on contig= 935..994bp; Strand=+
cggctttatttttatctattccgatttatctcttaaaaacattgagctattcttgttcct

SEQ ID NO: 10846 - DNA, 60 bp, Xenorhabdus bovienii
  Promoter sequence Name=Xb4151_4152.C414.promoter2; Position on contig= 2939..2998bp; Strand=-; Gene name=Alr
ccgaaatttggaataatgcctgtatttttttataacatcagcaaaattaatattcagata

SEQ ID NO: 10847 - DNA, 60 bp, Xenorhabdus bovienii
  Promoter sequence Name=Xb4151_4152.C414.promoter3; Position on contig= 5474..5533bp; Strand=-; Gene name=FadR
ataaaaatgtgattcaaatcctaaaattaaattaatggtgttgtagtctattattctata

SEQ ID NO: 10848 - DNA, 60 bp, Xenorhabdus bovienii
  Promoter sequence Name=Xb4151_4152.C414.promoter4; Position on contig= 6711..6770bp; Strand=-; Gene name=NhaB
ttcgctgtttatttactatgtaactatgtcgttcagacgcgttctggtatgatcgatgat

SEQ ID NO: 10849 - DNA, 60 bp, Xenorhabdus bovienii
  Promoter sequence Name=Xb4151_4152.C414.promoter5; Position on contig= 6784..6843bp; Strand=+; Gene name=NhaB
tcataaaaaatggaattattcgctgattaattatgttctgatacccttaaattgctatcg

SEQ ID NO: 10850 - DNA, 60 bp, Xenorhabdus bovienii
  Promoter sequence Name=Xb4151_4152.C414.promoter6; Position on contig= 8508..8567bp; Strand=+; Gene name=DsbB
gtccggttttttattgcccctttttaaaaagataatgtgattaattttatttttttatgg

SEQ ID NO: 10851 - DNA, 60 bp, Xenorhabdus bovienii
  Promoter sequence Name=Xb4151_4152.C414.promoter7; Position on contig= 9785..9844bp; Strand=-; Gene name=MesJ
ggtgattccgcttctgatggattatacaaatatttattaaatatttgtataataaccaca

SEQ ID NO: 10852 - DNA, 60 bp, Xenorhabdus bovienii
  Promoter sequence Name=Xb4151_4152.C414.promoter8; Position on contig= 10044..10103bp; Strand=+; Gene name=MesJ
cccttttcatcctctatcattgtttccttttttatgttatccgccataataaactgattt

SEQ ID NO: 10853 - DNA, 60 bp, Xenorhabdus bovienii
  Promoter sequence Name=Xb4151_4152.C414.promoter9; Position on contig= 14007..14066bp; Strand=-; Gene name=Tpx
gacgcgatattcagaaatactctgccttcctttagttaacaatgttttataatttattct

SEQ ID NO: 10854 - DNA, 60 bp, Xenorhabdus bovienii
  Promoter sequence Name=Xb4151_4152.C414.promoter10; Position on contig=13953..14012bp; Strand=+; Gene name=Tpx
agcaacttaaaattatgcatgaatttttgccttgtgagtctaaaaattatcctaagaata

SEQ ID NO: 10855 - DNA, 60 bp, Xenorhabdus bovienii
  Promoter sequence Name=Xb4151_4152.C414.promoter11; Position on contig=15355..15414bp; Strand=+; Gene name=SPS1
aggtcgggctacataattttatgcatgaagcccatttgatgtcctgttttaatcacccct

SEQ ID NO: 10856 - DNA, 60 bp, Xenorhabdus bovienii
  Promoter sequence Name=Xb4151_4152.C414.promoter12; Position on contig=17821..17880bp; Strand=-
tcgtcaacttttactgacaggggcttcatctattgcaccgtaacgggtaacatttcagac

SEQ ID NO: 10857 - DNA, 60 bp, Xenorhabdus bovienii
  Promoter sequence Name=Xb4151_4152.C414.promoter13; Position on contig=20420..20479bp; Strand=-; Gene name=PspC
gatgccaaattttggcaataattctgttgatgttaccaggccggatataaattgagtcac

SEQ ID NO: 10858 - DNA, 60 bp, Xenorhabdus bovienii
  Promoter sequence Name=Xb4151_4152.C414.promoter14; Position on contig=21920..21979bp; Strand=-; Gene name=PspF
tatatcaaataattcaattggataagcaaggtatgaaagttggcatgtatcttgtattta

SEQ ID NO: 10859 - DNA, 60 bp, Xenorhabdus bovienii
  Promoter sequence Name=Xb4151_4152.C414.promoter15; Position on contig=21929..21988bp; Strand=+; Gene name=PspF
gatacatgccaactttcataccttgcttatccaattgaattatttgatataatttctctt

SEQ ID NO: 10860 - DNA, 60 bp, Xenorhabdus bovienii
  Promoter sequence Name=Xb4151_4152.C414.promoter16; Position on contig=23273..23332bp; Strand=+; Gene name=OppA
attatagtgatctacccgttgtttttgagcagaaagcgttaattaagttacaatgcacaa

SEQ ID NO: 10861 - DNA, 60 bp, Xenorhabdus bovienii
  Promoter sequence Name=Xb4151_4152.C414.promoter17; Position on contig=28785..28844bp; Strand=+; Gene name=FabI
ccagcgtggtagaatcattcccgtttattaacaacaaataccctagttatagtaattata

SEQ ID NO: 10862 - DNA, 60 bp, Xenorhabdus bovienii
  Promoter sequence Name=Xb4151_4152.C414.promoter18; Position on contig=31142..31201bp; Strand=-; Gene name=TyrS
caaagttaagggcaacagcaatgttgcccttaaaaaattcgacttgttaataagccgctc

SEQ ID NO: 10863 - DNA, 60 bp, Xenorhabdus bovienii
  Promoter sequence Name=Xb4151_4152.C414.promoter19; Position on contig=32584..32643bp; Strand=-; Gene name=PdxH
agattaattactgtttttaatactggtacttaaattactggcgttttatgctatagcacg

SEQ ID NO: 10864 - DNA, 60 bp, Xenorhabdus bovienii
  Promoter sequence Name=Xb4151_4152.C414.promoter20; Position on contig=34618..34677bp; Strand=-; Gene name=SlyB
gcgcatttctcgataaataataaatactgaagacgaactcctaaaggaataattcctgac

SEQ ID NO: 10865 - DNA, 60 bp, Xenorhabdus bovienii
  Promoter sequence Name=Xb4151_4152.C414.promoter21; Position on contig=34609..34668bp; Strand=+; Gene name=SlyB
aaacttttggtcaggaattattcctttaggagttcgtcttcagtatttattatttatcga

SEQ ID NO: 10866 - DNA, 60 bp, Xenorhabdus bovienii
  Promoter sequence Name=Xb4151_4152.C414.promoter22; Position on contig=36818..36877bp; Strand=+; Gene name=GloA
tatatgaaagttgaaaggacaaattgaattattttatctatacaagttatagttatagct

SEQ ID NO: 10867 - DNA, 60 bp, Xenorhabdus bovienii
  Promoter sequence Name=Xb4151_4152.C414.promoter23; Position on contig=37436..37495bp; Strand=+; Gene name=DnaQ
ttctaaattggataggcattacttctgcaatacatgccaaattttgtcataatatccact

SEQ ID NO: 10868 - DNA, 60 bp, Xenorhabdus bovienii
  Promoter sequence Name=Xb4151_4152.C414.promoter24; Position on contig=38823..38882bp; Strand=+; Gene name=SodA
gcagttaagtcgtatctttttccctgttatttagctgaaaagttgttaagataattatca

SEQ ID NO: 10869 - DNA, 60 bp, Xenorhabdus bovienii
  Promoter sequence Name=Xb4151_4152.C414.promoter25; Position on contig=39928..39987bp; Strand=+; Gene name=PurR
attcaaggtttaccgctaaattattgccagccttcatcctatataaatatactggcaaac

SEQ ID NO: 10870 - DNA, 60 bp, Xenorhabdus bovienii
  Promoter sequence Name=Xb4151_4152.C414.promoter26; Position on contig=42008..42067bp; Strand=-; Gene name=ProP
agatacaaggcttattctatatggcatgatttttacttgtgaaacggtaatatttgcatc

SEQ ID NO: 10871 - DNA, 60 bp, Xenorhabdus bovienii
  Promoter sequence Name=Xb4151_4152.C414.promoter27; Position on contig=41955..42014bp; Strand=+; Gene name=ProP
tccagcgagtattcagaccacatatttattcctttcaatttttttcataacatgatgcaa

SEQ ID NO: 10872 - DNA, 60 bp, Xenorhabdus bovienii
  Promoter sequence Name=Xb4151_4152.C414.promoter28; Position on contig=43488..43547bp; Strand=+; Gene name=Cfa
ttttacttaatgttctatattatttccgaataaaacctttttggttttaacataataagt

SEQ ID NO: 10873 - DNA, 60 bp, Xenorhabdus bovienii
  Promoter sequence Name=Xb4151_4152.C414.promoter29; Position on contig=45507..45566bp; Strand=-; Gene name=NorM
tgagagcgcgtacttatcgaaatagtgtttaaaaatgatgggtgggttaaactaattcat

SEQ ID NO: 10874 - DNA, 60 bp, Xenorhabdus bovienii
  Promoter sequence Name=Xb4151_4152.C414.promoter30; Position on contig=45603..45662bp; Strand=+; Gene name=NorM
aacgagtcctatacaatatccgcgttaataagcgattaatttttcaataaaatcgtttac

SEQ ID NO: 10875 - DNA, 60 bp, Xenorhabdus bovienii
  Promoter sequence Name=Xb4151_4152.C414.promoter31; Position on contig=47631..47690bp; Strand=+; Gene name=PykF
tatcttcaagaatcatttttttgattcatttcacagaaattagcctctataatacgctcc

SEQ ID NO: 10876 - DNA, 60 bp, Xenorhabdus bovienii
  Promoter sequence Name=Xb4151_4152.C414.promoter32; Position on contig=49739..49798bp; Strand=+
ttgcagttatctaaaaattattggcttactttacgattaaagaacagtagaatttttttc

SEQ ID NO: 10877 - DNA, 60 bp, Xenorhabdus bovienii
  Promoter sequence Name=Xb4151_4152.C415.promoter1; Position on contig= 7015..7074bp; Strand=+
atgagttaagttaaaagggaggattgtcccctttaaatgctaagttttatcaatcagcca

SEQ ID NO: 10878 - DNA, 60 bp, Xenorhabdus bovienii
  Promoter sequence Name=Xb4151_4152.C415.promoter2; Position on contig= 10122..10181bp; Strand=+; Gene name=DnaQ
agtctctttaatcaagatcaataataacgaacaagataatgcgtatgtacaataacctat

SEQ ID NO: 10879 - DNA, 60 bp, Xenorhabdus bovienii
  Promoter sequence Name=Xb4151_4152.C415.promoter3; Position on contig= 11105..11164bp; Strand=+
ttgttcagtaatctatgtataaatatttgtataaacaaattaaaaaataaaataaatata

SEQ ID NO: 10880 - DNA, 60 bp, Xenorhabdus bovienii
  Promoter sequence Name=Xb4151_4152.C415.promoter4; Position on contig= 12110..12169bp; Strand=+
taaaacatgtaatgattttaattcacttattccagctctgagcattatatgatggcagaa

SEQ ID NO: 10881 - DNA, 60 bp, Xenorhabdus bovienii
  Promoter sequence Name=Xb4151_4152.C415.promoter5; Position on contig= 13625..13684bp; Strand=-; Gene name=AroK
tatagacgtaaaattttatatctcagactgcttataccaattatagtatcattttactaa

SEQ ID NO: 10882 - DNA, 60 bp, Xenorhabdus bovienii
  Promoter sequence Name=Xb4151_4152.C415.promoter6; Position on contig= 14305..14364bp; Strand=-; Gene name=ProA
cacactttatcgtaagtgtggctctttgcttgatgaaaagtattttttatattgatgtaa

SEQ ID NO: 10883 - DNA, 60 bp, Xenorhabdus bovienii
  Promoter sequence Name=Xb4151_4152.C415.promoter7; Position on contig= 16843..16902bp; Strand=-
tttttttaattttgcgttatgtcggttggcataacgctcctctcctgttaaaactgagca

SEQ ID NO: 10884 - DNA, 60 bp, Xenorhabdus bovienii
  Promoter sequence Name=Xb4151_4152.C415.promoter8; Position on contig= 19273..19332bp; Strand=-; Gene name=PepD
gacgcatcgggggcttttgtcatcttgagctgtcccaatgcccatgccatgctcgaggat

SEQ ID NO: 10885 - DNA, 60 bp, Xenorhabdus bovienii
  Promoter sequence Name=Xb4151_4152.C415.promoter9; Position on contig= 19073..19132bp; Strand=+; Gene name=PepD
ggcatgcatttgcaacatatcccacgttacaacatatttttcgctcatatgatttgatcc

SEQ ID NO: 10886 - DNA, 60 bp, Xenorhabdus bovienii
  Promoter sequence Name=Xb4151_4152.C415.promoter10; Position on contig=23371..23430bp; Strand=-
ataaatcaattaataaaacattaaattgatttattgaatgataatgttgtaatttacttt

SEQ ID NO: 10887 - DNA, 60 bp, Xenorhabdus bovienii
  Promoter sequence Name=Xb4151_4152.C415.promoter11; Position on contig=23341..23400bp; Strand=+
tggaaatattgatcatcgaacaattgactaaaagtaaattacaacattatcattcaataa

SEQ ID NO: 10888 - DNA, 60 bp, Xenorhabdus bovienii
  Promoter sequence Name=Xb4151_4152.C415.promoter12; Position on contig=26073..26132bp; Strand=-; Gene name=AcrR
ttcgaggtaacataatttttgttttttattcaaatagttagttgttttattcttttttgt

SEQ ID NO: 10889 - DNA, 60 bp, Xenorhabdus bovienii
  Promoter sequence Name=Xb4151_4152.C415.promoter13; Position on contig=26037..26096bp; Strand=+; Gene name=AcrR
tcataggcagttcctgaagttaatgaaaataaaaagacaaaaaagaataaaacaactaac

SEQ ID NO: 10890 - DNA, 60 bp, Xenorhabdus bovienii
  Promoter sequence Name=Xb4151_4152.C415.promoter14; Position on contig=31591..31650bp; Strand=-; Gene name=CirA
gttataagtcacctaagaaattaaatcgggcaaataaaaatgagaattatttttatttgt

SEQ ID NO: 10891 - DNA, 60 bp, Xenorhabdus bovienii
  Promoter sequence Name=Xb4151_4152.C415.promoter15; Position on contig=31579..31638bp; Strand=+; Gene name=CirA
ttctcaaaacacacaaataaaaataattctcatttttatttgcccgatttaatttcttag

SEQ ID NO: 10892 - DNA, 60 bp, Xenorhabdus bovienii
  Promoter sequence Name=Xb4151_4152.C415.promoter16; Position on contig=35306..35365bp; Strand=-
cgtgatatgaaaccagtcgagtacgtgctgggattcggggtacaagttaaattgcagatc

SEQ ID NO: 10893 - DNA, 60 bp, Xenorhabdus bovienii; identical to SEQ ID NO: 10698
  Promoter sequence Name=Xb4151_4152.C415.promoter17; Position on contig=35146..35205bp; Strand=+

SEQ ID NO: 10894 - DNA, 60 bp, Xenorhabdus bovienii
  Promoter sequence Name=Xb4151_4152.C415.promoter18; Position on contig=36165..36224bp; Strand=+
agtcctcaataatgcagaaaaattaaagaaaaaataactaagtacgataaaatataaaaa

SEQ ID NO: 10895 - DNA, 60 bp, Xenorhabdus bovienii
  Promoter sequence Name=Xb4151_4152.C415.promoter19; Position on contig=38046..38105bp; Strand=-
taaataaataaaaatggcgatttagttcgccattttttgaaaaaattttaaattacttaa

SEQ ID NO: 10896 - DNA, 60 bp, Xenorhabdus bovienii
  Promoter sequence Name=Xb4151_4152.C415.promoter20; Position on contig=37981..38040bp; Strand=+
gtttttttatgctgtttctaatgaatattttaaataaattaattttttataatgaaaatt

SEQ ID NO: 10897 - DNA, 60 bp, Xenorhabdus bovienii
  Promoter sequence Name=Xb4151_4152.C416.promoter1; Position on contig= 2916..2975bp; Strand=-; Gene name=TrmA
atggaccttttccatcaattgattttcataatcttccgttggcaagacattctgcattat

SEQ ID NO: 10898 - DNA, 60 bp, Xenorhabdus bovienii
  Promoter sequence Name=Xb4151_4152.C416.promoter2; Position on contig= 2821..2880bp; Strand=+; Gene name=TrmA
aaaagaggctcatgtgccagaaaactggacatccttttcactttccctacaatgccgctc

SEQ ID NO: 10899 - DNA, 60 bp, Xenorhabdus bovienii
  Promoter sequence Name=Xb4151_4152.C416.promoter3; Position on contig= 5323..5382bp; Strand=-; Gene name=Lpd
ttgcatagaggaaagacctgtttttacacaaaataacaactctatcttaacattacttga

SEQ ID NO: 10900 - DNA, 60 bp, Xenorhabdus bovienii
  Promoter sequence Name=Xb4151_4152.C416.promoter4; Position on contig= 5205..5264bp; Strand=+; Gene name=Lpd
aaatatatcagattctgctgtgtttgctgtgattgttctcttaaagctattatcccatat

SEQ ID NO: 10901 - DNA, 60 bp, Xenorhabdus bovienii
  Promoter sequence Name=Xb4151_4152.C416.promoter5; Position on contig= 7725..7784bp; Strand=-; Gene name=ArgH
taatagtaatttttttgatgaatttgatagttttattccctcgtgcatataatgatttat

SEQ ID NO: 10902 - DNA, 60 bp, Xenorhabdus bovienii
  Promoter sequence Name=Xb4151_4152.C416.promoter6; Position on contig= 12490..12549bp; Strand=-; Gene name=ArgE
ttcactgttgacagcccttactcatgatagtatcaatattcatgcattataattgaatat

SEQ ID NO: 10903 - DNA, 60 bp, Xenorhabdus bovienii
  Promoter sequence Name=Xb4151_4152.C416.promoter7; Position on contig= 12452..12511bp; Strand=+; Gene name=ArgE
tcaccttgtagtagtaacccaatcacattattgcatttatattcaattataatgcatgaa

SEQ ID NO: 10904 - DNA, 60 bp, Xenorhabdus bovienii
  Promoter sequence Name=Xb4151_4152.C416.promoter8; Position on contig= 13921..13980bp; Strand=+; Gene name=MetF
catttcggataagtcactttgctgttgactaaacataatgcttagcccattctatttaga

SEQ ID NO: 10905 - DNA, 60 bp, Xenorhabdus bovienii
  Promoter sequence Name=Xb4151_4152.C416.promoter9; Position on contig= 15592..15651bp; Strand=-; Gene name=Ppc
gctttattcgcagattctattgtttttttctatgtgtcacaattatatataatattcaat

SEQ ID NO: 10906 - DNA, 60 bp, Xenorhabdus bovienii
  Promoter sequence Name=Xb4151_4152.C416.promoter10; Position on contig=18525..18584bp; Strand=-; Gene name=LysC
caggcaatcagagccgcttataaaaaagaatccgctattaaatttcataaaattcgccca

SEQ ID NO: 10907 - DNA, 60 bp, Xenorhabdus bovienii
  Promoter sequence Name=Xb4151_4152.C416.promoter11; Position on contig=22392..22451bp; Strand=-; Gene name=MetJ
aatgattttagatgtctagatgtattgacgtctatctttccagtcgttattctttggtga

SEQ ID NO: 10908 - DNA, 60 bp, Xenorhabdus bovienii
  Promoter sequence Name=Xb4151_4152.C416.promoter12; Position on contig=22445..22504bp; Strand=+; Gene name=MetJ
aatcatttaaggtttaattgcacaattggctcattgtccccattttttatgttagctccg

SEQ ID NO: 10909 - DNA, 60 bp, Xenorhabdus bovienii
  Promoter sequence Name=Xb4151_4152.C416.promoter13; Position on contig=23371..23430bp; Strand=-; Gene name=PriA
atcatagcaaatcagcagatttcattgcgcaataaaccgatattctgtatgatccgccgc

SEQ ID NO: 10910 - DNA, 60 bp, Xenorhabdus bovienii
  Promoter sequence Name=Xb4151_4152.C416.promoter14; Position on contig=23378..23437bp; Strand=+; Gene name=PriA
atcatacagaatatcggtttattgcgcaatgaaatctgctgatttgctatgataccctta

SEQ ID NO: 10911 - DNA, 60 bp, Xenorhabdus bovienii
  Promoter sequence Name=Xb4151_4152.C416.promoter15; Position on contig=25815..25874bp; Strand=+; Gene name=PurR
cacattttttatgcaaacaaagtaacagattgatctgttactttgtttaaaatgcactta

SEQ ID NO: 10912 - DNA, 60 bp, Xenorhabdus bovienii
  Promoter sequence Name=Xb4151_4152.C416.promoter16; Position on contig=27924..27983bp; Strand=+; Gene name=HslV
gtgcttttccagcaatacagcttgcaattgtggcataacaagccaaagtaccgtgtgtaa

SEQ ID NO: 10913 - DNA, 60 bp, Xenorhabdus bovienii
  Promoter sequence Name=Xb4151_4152.C416.promoter17; Position on contig=29917..29976bp; Strand=+; Gene name=MenA
atgaagaaatgggaggcttgcctcccatttcttcattttcattgcaataaaatttatcat

SEQ ID NO: 10914 - DNA, 60 bp, Xenorhabdus bovienii
  Promoter sequence Name=Xb4151_4152.C416.promoter18; Position on contig=30939..30998bp; Strand=+; Gene name=MenG
cataagttttaagattgatgattttgccaacactagcttgaaaaggatatactgtctgtc

SEQ ID NO: 10915 - DNA, 60 bp, Xenorhabdus bovienii
  Promoter sequence Name=Xb4151_4152.C416.promoter19; Position on contig=31932..31991bp; Strand=-; Gene name=GlpF
ttgttcatcatggaaatgtgatctcgcttgcatttcggattagtcactatatttctcgtt

SEQ ID NO: 10916 - DNA, 60 bp, Xenorhabdus bovienii
  Promoter sequence Name=Xb4151_4152.C416.promoter20; Position on contig=32072..32131bp; Strand=+; Gene name=GlpF
ttaacgataaattcacagtcatctttcttttaagaaaagaaagcactaataattaatttc

SEQ ID NO: 10917 - DNA, 60 bp, Xenorhabdus bovienii
  Promoter sequence Name=Xb4151_4152.C416.promoter21; Position on contig=35974..36033bp; Strand=-; Gene name=Hmp
ctgttattttttcttcatgtgaaattgtatcctgtctggaaagaatataaatttgttaag

SEQ ID NO: 10918 - DNA, 60 bp, Xenorhabdus bovienii
  Promoter sequence Name=Xb4151_4152.C416.promoter22; Position on contig=35958..36017bp; Strand=+; Gene name=Hmp
cgttagatgtgattgacttaacaaatttatattctttccagacaggatacaatttcacat

SEQ ID NO: 10919 - DNA, 60 bp, Xenorhabdus bovienii
  Promoter sequence Name=Xb4151_4152.C416.promoter23; Position on contig=37756..37815bp; Strand=-
gcaggcttttaattttttcgctgcctcgttccagtactgccgaagaataaattttttcgt

SEQ ID NO: 10920 - DNA, 60 bp, Xenorhabdus bovienii
  Promoter sequence Name=Xb4151_4152.C416.promoter24; Position on contig=37191..37250bp; Strand=+
agtaacatccatccaccacgtttatttcggtcatgcagacgtttcgctataatcgctgct

SEQ ID NO: 10921 - DNA, 60 bp, Xenorhabdus bovienii
  Promoter sequence Name=Xb4151_4152.C417.promoter1; Position on contig= 796..855bp; Strand=-
ataagtctcattagatcatgtcgtttgccttcatacaagagatgttaaaaaagtatgccc

SEQ ID NO: 10922 - DNA, 60 bp, Xenorhabdus bovienii
  Promoter sequence Name=Xb4151_4152.C417.promoter2; Position on contig= 635..694bp; Strand=+
tgcactgttgtaactgaggtgtgcattttccctgtggtttcggtcgttttacttcttcaa

SEQ ID NO: 10923 - DNA, 60 bp, Xenorhabdus bovienii
  Promoter sequence Name=Xb4151_4152.C417.promoter3; Position on contig= 1037..1096bp; Strand=+
tggttacaggaataccgggctttttcccatggaataccccgtcgacataccattgcgaga

SEQ ID NO: 10924 - DNA, 60 bp, Xenorhabdus bovienii
  Promoter sequence Name=Xb4151_4152.C417.promoter4; Position on contig= 9567..9626bp; Strand=-
tgacaggatactgattttatataaactttatgcatagcatgccgattaattattcatctg

SEQ ID NO: 10925 - DNA, 60 bp, Xenorhabdus bovienii
  Promoter sequence Name=Xb4151_4152.C417.promoter5; Position on contig= 9561..9620bp; Strand=+
aatgtacagatgaataattaatcggcatgctatgcataaagtttatataaaatcagtatc

SEQ ID NO: 10926 - DNA, 60 bp, Xenorhabdus bovienii
  Promoter sequence Name=Xb4151_4152.C417.promoter6; Position on contig= 14986..15045bp; Strand=+
ccgatttaatttaattttttcgctattgaattcaatataaaaaggattaaattggaacgc

SEQ ID NO: 10927 - DNA, 60 bp, Xenorhabdus bovienii
  Promoter sequence Name=Xb4151_4152.C417.promoter7; Position on contig= 16214..16273bp; Strand=+
acgcaccacggaacggtgaacctgaaccgacacgcagggatttgtttaaaaataaataaa

SEQ ID NO: 10928 - DNA, 60 bp, Xenorhabdus bovienii
  Promoter sequence Name=Xb4151_4152.C417.promoter8; Position on contig= 17684..17743bp; Strand=-; Gene name=AtoC
acgacgagataaataaccttattgcagatttgtctgctggcatagagtattatataaata

SEQ ID NO: 10929 - DNA, 60 bp, Xenorhabdus bovienii
  Promoter sequence Name=Xb4151_4152.C417.promoter9; Position on contig= 17715..17774bp; Strand=+; Gene name=AtoC
atctgcaataaggttatttatctcgtcgttaagtgcaatgagtttattagaattttagac

SEQ ID NO: 10930 - DNA, 60 bp, Xenorhabdus bovienii
  Promoter sequence Name=Xb4151_4152.C417.promoter10; Position on contig=19386..19445bp; Strand=+
atttagaataatatcggtaaaaaattttactttgcggtaattttatttatttttattttc

SEQ ID NO: 10931 - DNA, 60 bp, Xenorhabdus bovienii
  Promoter sequence Name=Xb4151_4152.C417.promoter11; Position on contig=29901..29960bp; Strand=+
ggttaatcgttaattaaagcagttcccaatctggttttgcgaagactgattattgatgac

SEQ ID NO: 10932 - DNA, 60 bp, Xenorhabdus bovienii
  Promoter sequence Name=Xb4151_4152.C417.promoter12; Position on contig=30800..30859bp; Strand=+
atcgcgcaataaaaacagaggggttttactgagctttctgttgtcgttacaatggcattt

SEQ ID NO: 10933 - DNA, 60 bp, Xenorhabdus bovienii
  Promoter sequence Name=Xb4151_4152.C417.promoter13; Position on contig=45972..46031bp; Strand=+
aaataaaagtgtttacttctttttatatatttaaatcgatatatatgtataatttatgtt

SEQ ID NO: 10934 - DNA, 60 bp, Xenorhabdus bovienii
  Promoter sequence Name=Xb4151_4152.C417.promoter14; Position on contig=47005..47064bp; Strand=-
ttttttaaaaaaataaattatcatttagcctacacagtattttaagtgtatattgatttt

SEQ ID NO: 10935 - DNA, 60 bp, Xenorhabdus bovienii
  Promoter sequence Name=Xb4151_4152.C417.promoter15; Position on contig=47742..47801bp; Strand=-
aaaaaatagaatatttattcttattggaattaatttaattttcaagttaaaataatcaca

SEQ ID NO: 10936 - DNA, 60 bp, Xenorhabdus bovienii
  Promoter sequence Name=Xb4151_4152.C417.promoter16; Position on contig=47773..47832bp; Strand=+
ttccaataagaataaatattctattttttgaattaattaataattgatattatatcttga

SEQ ID NO: 10937 - DNA, 60 bp, Xenorhabdus bovienii
  Promoter sequence Name=Xb4151_4152.C418.promoter1; Position on contig= 539..598bp; Strand=+; Gene name=GshA
atccatagctcagctggatagagtactcggctacgaaccgagcggtcggaggttcgaatc

SEQ ID NO: 10938 - DNA, 60 bp, Xenorhabdus bovienii
  Promoter sequence Name=Xb4151_4152.C418.promoter2; Position on contig= 2373..2432bp; Strand=+; Gene name=LuxS
aaaatggccaccagtggtggccgaaataaaatctcttagaaaatagggatgataacaatt

SEQ ID NO: 10939 - DNA, 60 bp, Xenorhabdus bovienii
  Promoter sequence Name=Xb4151_4152.C418.promoter3; Position on contig= 3494..3553bp; Strand=+
cttattaggaaaaaataagaaaactgaattcttgtttaggatacgtttattatttttttt

SEQ ID NO: 10940 - DNA, 60 bp, Xenorhabdus bovienii
  Promoter sequence Name=Xb4151_4152.C418.promoter4; Position on contig= 3938..3997bp; Strand=+
caacgtaacttattagtcaatttgatacgttacgttaatttggtttttataaataaattt

SEQ ID NO: 10941 - DNA, 60 bp, Xenorhabdus bovienii
  Promoter sequence Name=Xb4151_4152.C418.promoter5; Position on contig= 4510..4569bp; Strand=+
aaatatacaatttagacttagagtgtatcccaataggagatatttgatattatagtcagc

SEQ ID NO: 10942 - DNA, 60 bp, Xenorhabdus bovienii
  Promoter sequence Name=Xb4151_4152.C418.promoter6; Position on contig= 5445..5504bp; Strand=+; Gene name=FabG
tagtttgtacatattagtgtgcatactttatttcacttggattattatataatcatatgt

SEQ ID NO: 10943 - DNA, 60 bp, Xenorhabdus bovienii
  Promoter sequence Name=Xb4151_4152.C418.promoter7; Position on contig= 17651..17710bp; Strand=-; Gene name=FliE
gggctgacatggcaattttccacgctgccaccgtaacatagccctttcaaactaaagcgc

SEQ ID NO: 10944 - DNA, 60 bp, Xenorhabdus bovienii
  Promoter sequence Name=Xb4151_4152.C418.promoter8; Position on contig= 17669..17728bp; Strand=+; Gene name=FliE
gctatgttacggtggcagcgtggaaaattgccatgtcagcccaaggctaatatggcactt

SEQ ID NO: 10945 - DNA, 60 bp, Xenorhabdus bovienii
  Promoter sequence Name=Xb4151_4152.C418.promoter9; Position on contig= 19057..19116bp; Strand=+
taatgatttttatttaaataatattttttgttatataaaaagagatctacagtcattaat

SEQ ID NO: 10946 - DNA, 60 bp, Xenorhabdus bovienii
  Promoter sequence Name=Xb4151_4152.C418.promoter10; Position on contig=20723..20782bp; Strand=+; Gene name=EntF
ccggctgacaggtttctatcgcctgatgttcgcctgtaacgtcaggtcacaatgagattt

SEQ ID NO: 10947 - DNA, 60 bp, Xenorhabdus bovienii
  Promoter sequence Name=Xb4151_4152.C418.promoter11; Position on contig=63496..63555bp; Strand=-
aatcaacttctactttagccatgttccaccacgaaataccggaagattatcataacaact

SEQ ID NO: 10948 - DNA, 60 bp, Xenorhabdus bovienii
  Promoter sequence Name=Xb4151_4152.C418.promoter12; Position on contig=63455..63514bp; Strand=+
ccctcaaagcagcccaaaatacggtcatgtattaaatagttagttgttatgataatcttc

SEQ ID NO: 10949 - DNA, 60 bp, Xenorhabdus bovienii
  Promoter sequence Name=Xb4151_4152.C418.promoter13; Position on contig=65878..65937bp; Strand=-; Gene name=CitB
ctttggtgttgtcaataccatatcgtatggacacccaaataccgatttaggatcctgaaa

SEQ ID NO: 10950 - DNA, 60 bp, Xenorhabdus bovienii
  Promoter sequence Name=Xb4151_4152.C418.promoter14; Position on contig=66128..66187bp; Strand=+; Gene name=CitB
aggggaattattccctcatattttttgatataaatatatgttttagaataagatatttta

SEQ ID NO: 10951 - DNA, 60 bp, Xenorhabdus bovienii
  Promoter sequence Name=Xb4151_4152.C418.promoter15; Position on contig=68918..68977bp; Strand=+; Gene name=PgsA
ttgatgcaccatactgataaactttacatggccagatagttacgaagcattatgcaatta

SEQ ID NO: 10952 - DNA, 60 bp, Xenorhabdus bovienii
  Promoter sequence Name=Xb4151_4152.C419.promoter1; Position on contig= 1399..1458bp; Strand=+; Gene name=IlvE
tttatgaagagcctcaacatttgttgaggcttttttattcctgattttatgatttttttg

SEQ ID NO: 10953 - DNA, 60 bp, Xenorhabdus bovienii
  Promoter sequence Name=Xb4151_4152.C419.promoter2; Position on contig= 9008..9067bp; Strand=+; Gene name=Ndh
ccttgttttatcaaatcaaactttatatttacacagcattaacattgtaaatttttattg

SEQ ID NO: 10954 - DNA, 60 bp, Xenorhabdus bovienii
  Promoter sequence Name=Xb4151_4152.C419.promoter3; Position on contig= 10687..10746bp; Strand=+
acacctatcataattattcttatctaatttaattctgaattatttattataatcaacaag

SEQ ID NO: 10955 - DNA, 60 bp, Xenorhabdus bovienii
  Promoter sequence Name=Xb4151_4152.C419.promoter4; Position on contig= 15206..15265bp; Strand=+
tcggtgtagcctttttctgtatcaagccaaaattttcgagggttgagtataatagctgct

SEQ ID NO: 10956 - DNA, 60 bp, Xenorhabdus bovienii
  Promoter sequence Name=Xb4151_4152.C419.promoter5; Position on contig= 18798..18857bp; Strand=+; Gene name=SIR2
ttaaacgattgcggtgtcagcgattaaatagaaaaaatttttacagggacattcgattgg

SEQ ID NO: 10957 - DNA, 60 bp, Xenorhabdus bovienii
  Promoter sequence Name=Xb4151_4152.C419.promoter6; Position on contig= 20920..20979bp; Strand=-; Gene name=BaeS
agctcgaaatatttcaaccaaaactgatatcgtgattgactattcgttataatggcctga

SEQ ID NO: 10958 - DNA, 60 bp, Xenorhabdus bovienii
  Promoter sequence Name=Xb4151_4152.C419.promoter7; Position on contig= 23202..23261bp; Strand=-
ttgtccaaaatagttactatacttaattcaatcataataatgatatatataattttattt

SEQ ID NO: 10959 - DNA, 60 bp, Xenorhabdus bovienii
  Promoter sequence Name=Xb4151_4152.C419.promoter8; Position on contig= 23179..23238bp; Strand=+
agtcaatttcgtcaacaggtattaaataaaattatatatatcattattatgattgaatta

SEQ ID NO: 10960 - DNA, 60 bp, Xenorhabdus bovienii
  Promoter sequence Name=Xb4151_4152.C419.promoter9; Position on contig= 26575..26634bp; Strand=-; Gene name=MutT
taagaaagcgcgcgaagacgtttggtgcaccttatctaccgacgtgttaaagtattgcgc

SEQ ID NO: 10961 - DNA, 60 bp, Xenorhabdus bovienii
  Promoter sequence Name=Xb4151_4152.C419.promoter10; Position on contig=27902..27961bp; Strand=-; Gene name=Icd
gattatcgggttattcggaacatttaatttacctttggcatcaatagtaatttttttacc

SEQ ID NO: 10962 - DNA, 60 bp, Xenorhabdus bovienii
  Promoter sequence Name=Xb4151_4152.C419.promoter11; Position on contig=27650..27709bp; Strand=+; Gene name=Icd
tgttaatttttttagagtatctttattttttctttggctgaatcggttaagtttacgttt

SEQ ID NO: 10963 - DNA, 60 bp, Xenorhabdus bovienii
  Promoter sequence Name=Xb4151_4152.C419.promoter12; Position on contig=29708..29767bp; Strand=-
tccccattagtaagttttggggcgcagttaataactgagaggttgtttaaaatttgcagt

SEQ ID NO: 10964 - DNA, 60 bp, Xenorhabdus bovienii
  Promoter sequence Name=Xb4151_4152.C419.promoter13; Position on contig=29665..29724bp; Strand=+
ggatagacacagagctgtggagtttgcctgcttcatttagtggactgcaaattttaaaca

SEQ ID NO: 10965 - DNA, 60 bp, Xenorhabdus bovienii
  Promoter sequence Name=Xb4151_4152.C419.promoter14; Position on contig=30366..30425bp; Strand=+
caaaccaacaacctttttccatttatttctatccatagattaaattttattctcattata

SEQ ID NO: 10966 - DNA, 60 bp, Xenorhabdus bovienii
  Promoter sequence Name=Xb4151_4152.C419.promoter15; Position on contig=30756..30815bp; Strand=+; Gene name=XerC
aatctatacccattatttagccgcaaagctataaaatatattggcgctatcgtcaccctg

SEQ ID NO: 10967 - DNA, 60 bp, Xenorhabdus bovienii
  Promoter sequence Name=Xb4151_4152.C419.promoter16; Position on contig=32174..32233bp; Strand=-
taaaacaacgtgttatttaagtgattttatatacataaaaatgatgttgtagttattaaa

SEQ ID NO: 10968 - DNA, 60 bp, Xenorhabdus bovienii
  Promoter sequence Name=Xb4151_4152.C419.promoter17; Position on contig=32853..32912bp; Strand=-
tttaaaggggggcaatcctcccctttaacccaacccattgatttaattaaattcccgccc

SEQ ID NO: 10969 - DNA, 60 bp, Xenorhabdus bovienii
  Promoter sequence Name=Xb4151_4152.C419.promoter18; Position on contig=33172..33231bp; Strand=+
tagacgataacaatcttgtgatcgttacaacaccggattaggtcatgtattaaatggtta

SEQ ID NO: 10970 - DNA, 60 bp, Xenorhabdus bovienii
  Promoter sequence Name=Xb4151_4152.C419.promoter19; Position on contig=33969..34028bp; Strand=+; Gene name=WcaA
taatctaatcatttaatacatgacccgctgcctcatggaaataaacctaatatttcggac

SEQ ID NO: 10971 - DNA, 60 bp, Xenorhabdus bovienii
  Promoter sequence Name=Xb4151_4152.C419.promoter20; Position on contig=36258..36317bp; Strand=-
tagtacgtaaaaatacgtttaatcatgcctttcacatttccatagaatatactggaatag

SEQ ID NO: 10972 - DNA, 60 bp, Xenorhabdus bovienii
  Promoter sequence Name=Xb4151_4152.C419.promoter21; Position on contig=39333..39392bp; Strand=-
tcataaattggcaggatcacaatttaactcaaaaaaaccatgcagggtaatacctgctaa

SEQ ID NO: 10973 - DNA, 60 bp, Xenorhabdus bovienii
  Promoter sequence Name=Xb4151_4152.C419.promoter22; Position on contig=39725..39784bp; Strand=+
ccgaccccgatcaattatccggtattgataaattaatcatcgaggattaaattagtgagg

SEQ ID NO: 10974 - DNA, 60 bp, Xenorhabdus bovienii
  Promoter sequence Name=Xb4151_4152.C419.promoter23; Position on contig=40719..40778bp; Strand=-
gggtaaaacaacaacacacagtattgccggaggtgagatgaaaaagggagattttacgga

SEQ ID NO: 10975 - DNA, 60 bp, Xenorhabdus bovienii
  Promoter sequence Name=Xb4151_4152.C419.promoter24; Position on contig=42999..43058bp; Strand=-
gaatgtgacagcgacgattttttggcgataaatgggatccgcccctgtaattttgtagag

SEQ ID NO: 10976 - DNA, 60 bp, Xenorhabdus bovienii
  Promoter sequence Name=Xb4151_4152.C419.promoter25; Position on contig=47006..47065bp; Strand=-
accataagtacgatgataatccacttgaaaaaactttcagttcaatcataatgtgtactg

SEQ ID NO: 10977 - DNA, 60 bp, Xenorhabdus bovienii
  Promoter sequence Name=Xb4151_4152.C419.promoter26; Position on contig=46969..47028bp; Strand=+
caaagatcgcatagtcactcctttattttcgtactttcagtacacattatgattgaactg

SEQ ID NO: 10978 - DNA, 60 bp, Xenorhabdus bovienii
  Promoter sequence Name=Xb4151_4152.C419.promoter27; Position on contig=47605..47664bp; Strand=+
caaattagacaattttcgatcaaaaggttaacaggattgtgtagggtaaaatggttaagc

SEQ ID NO: 10979 - DNA, 60 bp, Xenorhabdus bovienii
  Promoter sequence Name=Xb4151_4152.C420.promoter1; Position on contig= 3465..3524bp; Strand=+; Gene name=LasT
tcgggtcgtactatagcagtagttcggcaaaataactaatgctgtgttaagatattcgac

SEQ ID NO: 10980 - DNA, 60 bp, Xenorhabdus bovienii
  Promoter sequence Name=Xb4151_4152.C420.promoter2; Position on contig= 7273..7332bp; Strand=-; Gene name=DjlA
tggtatgctgctcgccggacaaattgaacccttgctgagacagcatatattctgcacgtt

SEQ ID NO: 10981 - DNA, 60 bp, Xenorhabdus bovienii
  Promoter sequence Name=Xb4151_4152.C420.promoter3; Position on contig= 6954..7013bp; Strand=+; Gene name=DjlA
gcttcaaattcaataaccccaatgtttccagcgagtgcggttgtggggaaagttttcacg

SEQ ID NO: 10982 - DNA, 60 bp, Xenorhabdus bovienii
  Promoter sequence Name=Xb4151_4152.C420.promoter4; Position on contig= 10139..10198bp; Strand=-; Gene name=PepB
acttcttatcttattttcactgttttcacagtaagggtttattaatgtaaaaaaactggc

SEQ ID NO: 10983 - DNA, 60 bp, Xenorhabdus bovienii
  Promoter sequence Name=Xb4151_4152.C420.promoter5; Position on contig= 10079..10138bp; Strand=+; Gene name=PepB
gttcacctatcattgctcaatagcttggcataacctgcatttaatggaaaactggcaatc

SEQ ID NO: 10984 - DNA, 60 bp, Xenorhabdus bovienii
  Promoter sequence Name=Xb4151_4152.C420.promoter6; Position on contig= 11787..11846bp; Strand=-
agcccaattaatagattgggtttctcatccagatttttgtcgtgagccataatcagaaaa

SEQ ID NO: 10985 - DNA, 60 bp, Xenorhabdus bovienii
  Promoter sequence Name=Xb4151_4152.C420.promoter7; Position on contig= 11533..11592bp; Strand=+
agatttaagattacctttattcatagtctcccttaaaaagggaagactatgattgaacct

SEQ ID NO: 10986 - DNA, 60 bp, Xenorhabdus bovienii
  Promoter sequence Name=Xb4151_4152.C420.promoter8; Position on contig= 12179..12238bp; Strand=-
accattgccaagattgacgttgagacataacaataacccttgtagtttgccggatattta

SEQ ID NO: 10987 - DNA, 60 bp, Xenorhabdus bovienii
  Promoter sequence Name=Xb4151_4152.C420.promoter9; Position on contig= 12098..12157bp; Strand=+
gaaagttcagttattttttctgtgctttggttatgcaaaataggaagtatcataataact

SEQ ID NO: 10988 - DNA, 60 bp, Xenorhabdus bovienii
  Promoter sequence Name=Xb4151_4152.C420.promoter10; Position on contig=19755..19814bp; Strand=+
tttatcgtaaaacaataaaaaattattgttttacgataatttaaagctataatttgatca

SEQ ID NO: 10989 - DNA, 60 bp, Xenorhabdus bovienii
  Promoter sequence Name=Xb4151_4152.C420.promoter11; Position on contig=20525..20584bp; Strand=+
aattaaagggattcgattctctactcttgatgccatctgccaatatctagattgtcagcc

SEQ ID NO: 10990 - DNA, 60 bp, Xenorhabdus bovienii
  Promoter sequence Name=Xb4151_4152.C420.promoter12; Position on contig=21310..21369bp; Strand=-; Gene name=Ndk
cattttaattttttattctccctttgctaaaacagggagacgagatttatcctgtacctg

SEQ ID NO: 10991 - DNA, 60 bp, Xenorhabdus bovienii
  Promoter sequence Name=Xb4151_4152.C420.promoter13; Position on contig=21235..21294bp; Strand=+; Gene name=Ndk
tttaataaaatgttatgttttttgtaggcaagcagaaagtctcctcctataatcaacgcc

SEQ ID NO: 10992 - DNA, 60 bp, Xenorhabdus bovienii
  Promoter sequence Name=Xb4151_4152.C420.promoter14; Position on contig=22120..22179bp; Strand=-
aggcttttcccccatatcgataaaaaattgacgcatttgtttacggttaagatcaagcag

SEQ ID NO: 10993 - DNA, 60 bp, Xenorhabdus bovienii
  Promoter sequence Name=Xb4151_4152.C420.promoter15; Position on contig=21862..21921bp; Strand=+
aagtttgtacaatgtcgcgcctcactgatttgatttagtggggtgtttattattttatct

SEQ ID NO: 10994 - DNA, 60 bp, Xenorhabdus bovienii
  Promoter sequence Name=Xb4151_4152.C420.promoter16; Position on contig=26289..26348bp; Strand=-; Gene name=HisS
acatcggtgacttcgccaattgcgcgtttaaataacggggtctgctctacaatcggtgtt

SEQ ID NO: 10995 - DNA, 60 bp, Xenorhabdus bovienii
  Promoter sequence Name=Xb4151_4152.C420.promoter17; Position on contig=26075..26134bp; Strand=+; Gene name=HisS
ccagtattgtttctgattgctgattgaaccccgcgagctttcgcttttataatcgacgct

SEQ ID NO: 10996 - DNA, 60 bp, Xenorhabdus bovienii
  Promoter sequence Name=Xb4151_4152.C420.promoter18; Position on contig=31381..31440bp; Strand=-
tacaataaatttacatttctaccagtgactaatatgattattttagctaatatctaagta

SEQ ID NO: 10997 - DNA, 60 bp, Xenorhabdus bovienii
  Promoter sequence Name=Xb4151_4152.C420.promoter19; Position on contig=31053..31112bp; Strand=+
gaaatttgttatcaatttacagccaaaactaattcaatttattaatgtataattattttt

SEQ ID NO: 10998 - DNA, 60 bp, Xenorhabdus bovienii
  Promoter sequence Name=Xb4151_4152.C420.promoter20; Position on contig=32731..32790bp; Strand=-
cataaaaaatcaatatttaccctagtgactaactcaactattatagttagtattcaaacg

SEQ ID NO: 10999 - DNA, 60 bp, Xenorhabdus bovienii
  Promoter sequence Name=Xb4151_4152.C420.promoter21; Position on contig=33903..33962bp; Strand=-
ctcaaattcattcttatgctttcttttcttccacattgttcttatcttatgttttgttta

SEQ ID NO: 11000 - DNA, 60 bp, Xenorhabdus bovienii
  Promoter sequence Name=Xb4151_4152.C420.promoter22; Position on contig=35372..35431bp; Strand=-; Gene name=VacJ
tatctcaagcaaaaaggagttaagttaaaggggacaattatctcctttaaactctaagtt

SEQ ID NO: 11001 - DNA, 60 bp, Xenorhabdus bovienii
  Promoter sequence Name=Xb4151_4152.C420.promoter23; Position on contig=35343..35402bp; Strand=+; Gene name=VacJ
aattaataaaatccatatcccactgataaaacttagagtttaaaggagataattgtcccc

SEQ ID NO: 11002 - DNA, 60 bp, Xenorhabdus bovienii
  Promoter sequence Name=Xb4151_4152.C420.promoter24; Position on contig=37761..37820bp; Strand=-
ctatacttcctgcactggtctgatttgtcattatgataaaccgactctacaatcccgcgc

SEQ ID NO: 11003 - DNA, 60 bp, Xenorhabdus bovienii
  Promoter sequence Name=Xb4151_4152.C420.promoter25; Position on contig=37682..37741bp; Strand=+
gtgtaaacaggtttttttggctcataaccaaaacctcattatttaattattatttaacat

SEQ ID NO: 11004 - DNA, 60 bp, Xenorhabdus bovienii
  Promoter sequence Name=Xb4151_4152.C420.promoter26; Position on contig=38515..38574bp; Strand=-; Gene name=PaaJ
tccttttgctgtgccacttttgttgaagaacgacccatagcaactcctgacaataattat

SEQ ID NO: 11005 - DNA, 60 bp, Xenorhabdus bovienii
  Promoter sequence Name=Xb4151_4152.C420.promoter27; Position on contig=38444..38503bp; Strand=+; Gene name=PaaJ
aacaatgctccatcaggtctgacctcttgtgaggtgagcaaatgtttttaatcaatcaat

SEQ ID NO: 11006 - DNA, 60 bp, Xenorhabdus bovienii
  Promoter sequence Name=Xb4151_4152.C420.promoter28; Position on contig=42291..42350bp; Strand=-; Gene name=SixA
acataatccaccgtttagttaatttcagaacctgtcttaatccaatatataattaaatat

SEQ ID NO: 11007 - DNA, 60 bp, Xenorhabdus bovienii
  Promoter sequence Name=Xb4151_4152.C420.promoter29; Position on contig=42041..42100bp; Strand=+; Gene name=SixA
caaaatcagttatatcggctcttgtcatcggagccgatttttttatgaaaaataattgat

SEQ ID NO: 11008 - DNA, 60 bp, Xenorhabdus bovienii
  Promoter sequence Name=Xb4151_4152.C420.promoter30; Position on contig=43414..43473bp; Strand=-
tattaatcttatgcaatagcttctaagcaaaatcgcaaaaaatcgggtacaattaccaaa

SEQ ID NO: 11009 - DNA, 60 bp, Xenorhabdus bovienii
  Promoter sequence Name=Xb4151_4152.C420.promoter31; Position on contig=43795..43854bp; Strand=-; Gene name=HutI (BS)
tccacatcaataatgtgacaatggtgagttggcatgctagccgtcggaataatcgccaat

SEQ ID NO: 11010 - DNA, 60 bp, Xenorhabdus bovienii
  Promoter sequence Name=Xb4151_4152.C420.promoter32; Position on contig=43543..43602bp; Strand=+; Gene name=HutI (BS)
gatattcatccctgcccataaaattatttgacaatcttggctggttataaaataaatgta

SEQ ID NO: 11011 - DNA, 60 bp, Xenorhabdus bovienii
  Promoter sequence Name=Xb4151_4152.C420.promoter33; Position on contig=46666..46725bp; Strand=+; Gene name=HutU (BS)
atagggagattttttcacaaacaattgtgaccatcatgtaaatccgatgtgatgtaaaac

SEQ ID NO: 11012 - DNA, 60 bp, Xenorhabdus bovienii
  Promoter sequence Name=Xb4151_4152.C420.promoter34; Position on contig=50174..50233bp; Strand=+; Gene name=AnsP
taaataagtcgtctaaggccggtttctgcccggccttatcgttgtatttatctttcatat

SEQ ID NO: 11013 - DNA, 60 bp, Xenorhabdus bovienii
  Promoter sequence Name=Xb4151_4152.C420.promoter35; Position on contig=51676..51735bp; Strand=+; Gene name=HemK
accctctccagaaaataattgcgctttattgaactctcccagtaggccattctatttgct

SEQ ID NO: 11014 - DNA, 60 bp, Xenorhabdus bovienii
  Promoter sequence Name=Xb4151_4152.C420.promoter36; Position on contig=52879..52938bp; Strand=+; Gene name=AroC
caaataaaagtgccggaataagataggttttaatcattgagtgagttattgttaattaat

SEQ ID NO: 11015 - DNA, 60 bp, Xenorhabdus bovienii
  Promoter sequence Name=Xb4151_4152.C420.promoter37; Position on contig=54172..54231bp; Strand=-
tagaatcgataaacccagcaactatcgcaaccaaaaacaggaaaccgtaaatttccggac

SEQ ID NO: 11016 - DNA, 60 bp, Xenorhabdus bovienii
  Promoter sequence Name=Xb4151_4152.C420.promoter38; Position on contig=55912..55971bp; Strand=+; Gene name=WecD
aatatataaatgttaatttattttttaaggttaaataaaataggatattaaatttatcag

SEQ ID NO: 11017 - DNA, 60 bp, Xenorhabdus bovienii
  Promoter sequence Name=Xb4151_4152.C420.promoter39; Position on contig=58658..58717bp; Strand=+
tgcgctgctgatagcactctttttcacaataatgcctgtatggttgataaaaataatatg

SEQ ID NO: 11018 - DNA, 60 bp, Xenorhabdus bovienii
  Promoter sequence Name=Xb4151_4152.C420.promoter40; Position on contig=60121..60180bp; Strand=+
atcagttaaaatgaaagccaatccattgattagatgggttggttttttattatattgttg

SEQ ID NO: 11019 - DNA, 60 bp, Xenorhabdus bovienii
  Promoter sequence Name=Xb4151_4152.C420.promoter41; Position on contig=61264..61323bp; Strand=+
aatgtattggtacaggcaagtaaagtagcaacagctaataccttgattaatattgtttcc

SEQ ID NO: 11020 - DNA, 60 bp, Xenorhabdus bovienii
  Promoter sequence Name=Xb4151_4152.C420.promoter42; Position on contig=64668..64727bp; Strand=-
cacagcaactaaccatttaatacatgacccaaaaaacgggtcattgttacactaaataca

SEQ ID NO: 11021 - DNA, 60 bp, Xenorhabdus bovienii
  Promoter sequence Name=Xb4151_4152.C420.promoter43; Position on contig=64633..64692bp; Strand=+
tatcattgaattaatttattcatgtaagtgcatagtgtatttagtgtaacaatgacccgt

SEQ ID NO: 11022 - DNA, 60 bp, Xenorhabdus bovienii
  Promoter sequence Name=Xb4151_4152.C421.promoter1; Position on contig= 1455..1514bp; Strand=-; Gene name=InsB
taggtattaaaaataatgttcacgttcaataaaggttcctatcactttatcgtgcatttc

SEQ ID NO: 11023 - DNA, 60 bp, Xenorhabdus bovienii
  Promoter sequence Name=Xb4151_4152.C421.promoter2; Position on contig= 2987..3046bp; Strand=-
ccggtgggatttgtatcagaatgcagttttacagtaggtagccatattattatcaacaga

SEQ ID NO: 11024 - DNA, 60 bp, Xenorhabdus bovienii
  Promoter sequence Name=Xb4151_4152.C421.promoter3; Position on contig= 2585..2644bp; Strand=+
gcaaaattttggttggccgatttttcaaaccattcgatggctgtctgtatgttttcaggc

SEQ ID NO: 11025 - DNA, 60 bp, Xenorhabdus bovienii
  Promoter sequence Name=Xb4151_4152.C421.promoter4; Position on contig= 3594..3653bp; Strand=-
acattccataaatcgaaagtcattttgccctgaatattgtttcgcattatgcttatgtta

SEQ ID NO: 11026 - DNA, 60 bp, Xenorhabdus bovienii
  Promoter sequence Name=Xb4151_4152.C421.promoter5; Position on contig= 3333..3392bp; Strand=+
agttgacaactgccaacacttgtttgccgattaattgttcttctgtgtagttttggcata

SEQ ID NO: 11027 - DNA, 60 bp, Xenorhabdus bovienii
  Promoter sequence Name=Xb4151_4152.C421.promoter6; Position on contig= 7097..7156bp; Strand=+; Gene name=CobB
tctgttttatttgataaatatcaatgagagagatcggatattccagttttaatagcaggt

SEQ ID NO: 11028 - DNA, 60 bp, Xenorhabdus bovienii
  Promoter sequence Name=Xb4151_4152.C421.promoter7; Position on contig= 23379..23438bp; Strand=-; Gene name=CobT
gtgacattcttgggtgagattgccacaccttcgtcatataccccatgatcggcacacatg

SEQ ID NO: 11029 - DNA, 60 bp, Xenorhabdus bovienii
  Promoter sequence Name=Xb4151_4152.C421.promoter8; Position on contig= 22938..22997bp; Strand=+; Gene name=CobT
aatcatccaatgcggctttttctcgttcgacacgggcaaacggaagccaatattaacaac

SEQ ID NO: 11030 - DNA, 60 bp, Xenorhabdus bovienii
  Promoter sequence Name=Xb4151_4152.C421.promoter9; Position on contig= 24671..24730bp; Strand=+
gttgtgcatagtattggtgtcgccgccgccagtatgaccaatgtaaaatctgttcgactg

SEQ ID NO: 11031 - DNA, 60 bp, Xenorhabdus bovienii
  Promoter sequence Name=Xb4151_4152.C421.promoter10; Position on contig=27137..27196bp; Strand=-
ggcctaaaatcaggcccactaaatcaaaaatagtaatctaattaacttatattggtatat

SEQ ID NO: 11032 - DNA, 60 bp, Xenorhabdus bovienii
  Promoter sequence Name=Xb4151_4152.C421.promoter11; Position on contig=29266..29325bp; Strand=+; Gene name=UvrD
taaccaagggacgagggtcgttcctgtcagtgcaataaatatacggatataatagaggac

SEQ ID NO: 11033 - DNA, 60 bp, Xenorhabdus bovienii
  Promoter sequence Name=Xb4151_4152.C421.promoter12; Position on contig=32234..32293bp; Strand=-; Gene name=AcyP
tccctcctgacaagataatacgaacgttggcacgtcaaacctacttttagtattgtattt

SEQ ID NO: 11034 - DNA, 60 bp, Xenorhabdus bovienii
  Promoter sequence Name=Xb4151_4152.C421.promoter13; Position on contig=31960..32019bp; Strand=+; Gene name=AcyP
atatcattttcctgtggctgttctaaagaatattcagcatcaatatctacaataacacct

SEQ ID NO: 11035 - DNA, 60 bp, Xenorhabdus bovienii
  Promoter sequence Name=Xb4151_4152.C421.promoter14; Position on contig=33142..33201bp; Strand=-; Gene name=XerC
ggcggaggaggagagattcgaactctcggatggtttcccatcggcggttttcaagaccgc

SEQ ID NO: 11036 - DNA, 60 bp, Xenorhabdus bovienii
  Promoter sequence Name=Xb4151_4152.C421.promoter15; Position on contig=33117..33176bp; Strand=+; Gene name=XerC
aggggtggccgagcggctgaaggcagcggtcttgaaaaccgccgatgggaaaccatccga

SEQ ID NO: 11037 - DNA, 60 bp, Xenorhabdus bovienii
  Promoter sequence Name=Xb4151_4152.C421.promoter16; Position on contig=34596..34655bp; Strand=+
acaaatagacagttataattgtctttagtagactatccaagacattaaagaataaagcta

SEQ ID NO: 11038 - DNA, 60 bp, Xenorhabdus bovienii
  Promoter sequence Name=Xb4151_4152.C421.promoter17; Position on contig=36172..36231bp; Strand=-
ccagccattatattactcctttcaaagattaaggtttattaataacttataattgacttt

SEQ ID NO: 11039 - DNA, 60 bp, Xenorhabdus bovienii; identical to SEQ ID NO: 10819
  Promoter sequence Name=Xb4151_4152.C421.promoter18; Position on contig=35982..36041bp; Strand=+

SEQ ID NO: 11040 - DNA, 60 bp, Xenorhabdus bovienii
  Promoter sequence Name=Xb4151_4152.C421.promoter19; Position on contig=37743..37802bp; Strand=+
atttaacatgctgatagccactgttattagcatgtcccccttatcaataaaatggtttgt

SEQ ID NO: 11041 - DNA, 60 bp, Xenorhabdus bovienii
  Promoter sequence Name=Xb4151_4152.C421.promoter20; Position on contig=43871..43930bp; Strand=-
tgttattagactttttatgacttgttaacaataataaagctgatttgtctactttttctg

SEQ ID NO: 11042 - DNA, 60 bp, Xenorhabdus bovienii
  Promoter sequence Name=Xb4151_4152.C421.promoter21; Position on contig=44159..44218bp; Strand=-
ttcttaaacaaatctcaggtttattaatgcgacagaaccagtacacgtaaaaccgtcaat

SEQ ID NO: 11043 - DNA, 60 bp, Xenorhabdus bovienii
  Promoter sequence Name=Xb4151_4152.C421.promoter22; Position on contig=45140..45199bp; Strand=-
tataaaaacagtatattaagtcattgaaacctaacttcaacatcttaccaaaattacacc

SEQ ID NO: 11044 - DNA, 60 bp, Xenorhabdus bovienii
  Promoter sequence Name=Xb4151_4152.C421.promoter23; Position on contig=45138..45197bp; Strand=+
gtggtgtaattttggtaagatgttgaagttaggtttcaatgacttaatatactgttttta

SEQ ID NO: 11045 - DNA, 60 bp, Xenorhabdus bovienii
  Promoter sequence Name=Xb4151_4152.C421.promoter24; Position on contig=46279..46338bp; Strand=-; Gene name=SmtA
gcattgataagacataacattccgatgaatagggaaatttagaggcttactataacatat

SEQ ID NO: 11046 - DNA, 60 bp, Xenorhabdus bovienii
  Promoter sequence Name=Xb4151_4152.C421.promoter25; Position on contig=46143..46202bp; Strand=+; Gene name=SmtA
agcagtcgttcggtttccaagttgtcaaatcgcataatcattatttttgtaatcacaatg

SEQ ID NO: 11047 - DNA, 60 bp, Xenorhabdus bovienii
  Promoter sequence Name=Xb4151_4152.C421.promoter26; Position on contig=47983..48042bp; Strand=-
cttttaatatataactaaatattttttgccttttattttaaatctggtattgtcactttc

SEQ ID NO: 11048 - DNA, 60 bp, Xenorhabdus bovienii
  Promoter sequence Name=Xb4151_4152.C421.promoter27; Position on contig=50308..50367bp; Strand=-
caacttttgttgatattcatcgttgcctgtattgcaggcatggattccattcttgatgaa

SEQ ID NO: 11049 - DNA, 60 bp, Xenorhabdus bovienii
  Promoter sequence Name=Xb4151_4152.C421.promoter28; Position on contig=51617..51676bp; Strand=-
ctgactgatagcaattttcttaaatgcttcaaatgataatctaacgatatattttcttat

SEQ ID NO: 11050 - DNA, 60 bp, Xenorhabdus bovienii
  Promoter sequence Name=Xb4151_4152.C421.promoter29; Position on contig=53381..53440bp; Strand=-
ctcctttatcaacgctactaaataacagtaaagtagcgcgctttaatataaataactata

SEQ ID NO: 11051 - DNA, 60 bp, Xenorhabdus bovienii
  Promoter sequence Name=Xb4151_4152.C421.promoter30; Position on contig=55777..55836bp; Strand=-
tgagttttgttaaaaatgcgttgcggttatttctcgtcatcctcaaataaaatatgaatc

SEQ ID NO: 11052 - DNA, 60 bp, Xenorhabdus bovienii
  Promoter sequence Name=Xb4151_4152.C421.promoter31; Position on contig=55479..55538bp; Strand=+
cgttgggtaattcgaataaataacttattaactggtggagattatcacagaatctcactc

SEQ ID NO: 11053 - DNA, 60 bp, Xenorhabdus bovienii
  Promoter sequence Name=Xb4151_4152.C421.promoter32; Position on contig=55813..55872bp; Strand=+
gcaacgcatttttaacaaaactcacataattactttctattacatgttagtttaccccaa

SEQ ID NO: 11054 - DNA, 60 bp, Xenorhabdus bovienii
  Promoter sequence Name=Xb4151_4152.C421.promoter33; Position on contig=57732..57791bp; Strand=+; Gene name=Ftn
ctatttattttttcaattagatatttaattaaataaaagtgattcttattttcttatatt

SEQ ID NO: 11055 - DNA, 60 bp, Xenorhabdus bovienii
  Promoter sequence Name=Xb4151_4152.C421.promoter34; Position on contig=60795..60854bp; Strand=-
tcctgaattagaattttctttaattatttttaccagtactcacttataaaattcaggtaa

SEQ ID NO: 11056 - DNA, 60 bp, Xenorhabdus bovienii
  Promoter sequence Name=Xb4151_4152.C421.promoter35; Position on contig=60776..60835bp; Strand=+
ttaatataaattgtgatatttacctgaattttataagtgagtactggtaaaaataattaa

SEQ ID NO: 11057 - DNA, 60 bp, Xenorhabdus bovienii
  Promoter sequence Name=Xb4151_4152.C421.promoter36; Position on contig=61700..61759bp; Strand=-; Gene name=ProQ
aagttgtgttttacttaaacattcttcactctgaatacgttcaacgatatcctgaaagat

SEQ ID NO: 11058 - DNA, 60 bp, Xenorhabdus bovienii
  Promoter sequence Name=Xb4151_4152.C421.promoter37; Position on contig=64577..64636bp; Strand=-; Gene name=HtpX
aacaccaccatgaccgcgaggttagtgagaaggaacaaggctattcgcatcatataaatt

SEQ ID NO: 11059 - DNA, 60 bp, Xenorhabdus bovienii
  Promoter sequence Name=Xb4151_4152.C421.promoter38; Position on contig=64448..64507bp; Strand=+; Gene name=HtpX
ttttttgtgacactgtaaagttatgttgattctatcgcttagcatcttaaaaaaattgaa

SEQ ID NO: 11060 - DNA, 60 bp, Xenorhabdus bovienii
  Promoter sequence Name=Xb4151_4152.C421.promoter39; Position on contig=67182..67241bp; Strand=-
agaaatcattatatttaattccatttaattataagtaaggcttttcttatgctgataaca

SEQ ID NO: 11061 - DNA, 60 bp, Xenorhabdus bovienii
  Promoter sequence Name=Xb4151_4152.C421.promoter40; Position on contig=67270..67329bp; Strand=+
cttatattattatatttgattttcgtctgatatttgctgattattgatataatttgtgga

SEQ ID NO: 11062 - DNA, 60 bp, Xenorhabdus bovienii
  Promoter sequence Name=Xb4151_4152.C421.promoter41; Position on contig=68064..68123bp; Strand=-
aacagatttatcttatttaccccctatcatacttgtgaaaaaccctctatactgcctcac

SEQ ID NO: 11063 - DNA, 60 bp, Xenorhabdus bovienii
  Promoter sequence Name=Xb4151_4152.C421.promoter42; Position on contig=68403..68462bp; Strand=-
gaagctactatcactatccaacttgaggttaaccctattaattgccttatactggaagat

SEQ ID NO: 11064 - DNA, 60 bp, Xenorhabdus bovienii
  Promoter sequence Name=Xb4151_4152.C421.promoter43; Position on contig=68124..68183bp; Strand=+
atttattaatatagaacactaagatttaattgatttttacctagagcagctaggataaag

SEQ ID NO: 11065 - DNA, 60 bp, Xenorhabdus bovienii
  Promoter sequence Name=Xb4151_4152.C421.promoter44; Position on contig=68929..68988bp; Strand=-; Gene name=ThrS
aataatttccagaccgttttcatccttgctggtaataattgcaaggttagcatcggtttc

SEQ ID NO: 11066 - DNA, 60 bp, Xenorhabdus bovienii
  Promoter sequence Name=Xb4151_4152.C421.promoter45; Position on contig=68563..68622bp; Strand=+; Gene name=ThrS
agatgattgataatttatcaacatagtcagatagtaactctgtgtgttaatatggatttt

SEQ ID NO: 11067 - DNA, 60 bp, Xenorhabdus bovienii
  Promoter sequence Name=Xb4151_4152.C422.promoter1; Position on contig= 5611..5670bp; Strand=-
ttaatttctctcaaacacgccgcattaattgatcattccatgaaatgcattctctttaat

SEQ ID NO: 11068 - DNA, 60 bp, Xenorhabdus bovienii
  Promoter sequence Name=Xb4151_4152.C422.promoter2; Position on contig= 5958..6017bp; Strand=-; Gene name=SodA
ttccaacgctgtattcgtgttagtcacgtaggtttgatggtgtttggtataatgaatttc

SEQ ID NO: 11069 - DNA, 60 bp, Xenorhabdus bovienii
  Promoter sequence Name=Xb4151_4152.C422.promoter3; Position on contig= 5776..5835bp; Strand=+; Gene name=SodA
agttataatatggaattgataatcattttcattgctgtttaagtcattataataactatg

SEQ ID NO: 11070 - DNA, 60 bp, Xenorhabdus bovienii
  Promoter sequence Name=Xb4151_4152.C422.promoter4; Position on contig= 11111..11170bp; Strand=-; Gene name=AroB
tccttctgggaataaaagcttgaataatgaatcattttctagctgttatgctaaaaaata

SEQ ID NO: 11071 - DNA, 60 bp, Xenorhabdus bovienii
  Promoter sequence Name=Xb4151_4152.C422.promoter5; Position on contig= 12971..13030bp; Strand=-
cggttcgtgccagatatatatagttgcaatacaggttgatgtactgagataattttccca

SEQ ID NO: 11072 - DNA, 60 bp, Xenorhabdus bovienii
  Promoter sequence Name=Xb4151_4152.C422.promoter6; Position on contig= 15333..15392bp; Strand=-
cggaaatgggggctattgctttgcctgcaattaatactctgcatatctgtactaacgttt

SEQ ID NO: 11073 - DNA, 60 bp, Xenorhabdus bovienii
  Promoter sequence Name=Xb4151_4152.C422.promoter7; Position on contig= 16308..16367bp; Strand=+; Gene name=MrcA
catatccatagtgctgtatagcctttatactacgtactaatcgtttataaactgcccgat

SEQ ID NO: 11074 - DNA, 60 bp, Xenorhabdus bovienii
  Promoter sequence Name=Xb4151_4152.C422.promoter8; Position on contig= 20495..20554bp; Strand=+; Gene name=FabB
ataaggtgtgaccatattctcagctttaatgacagggatataagagttttaatttatcct

SEQ ID NO: 11075 - DNA, 60 bp, Xenorhabdus bovienii
  Promoter sequence Name=Xb4151_4152.C422.promoter9; Position on contig= 22278..22337bp; Strand=+
tagggaatagccaagtacagtgcagtattcaagcgttattttatggctttactgcctgcc

SEQ ID NO: 11076 - DNA, 60 bp, Xenorhabdus bovienii
  Promoter sequence Name=Xb4151_4152.C422.promoter10; Position on contig=25860..25919bp; Strand=-; Gene name=FabH
ctagtatgtattaaaacatggctttatatatgtatacccattaactttaaaatgcagaat

SEQ ID NO: 11077 - DNA, 60 bp, Xenorhabdus bovienii
  Promoter sequence Name=Xb4151_4152.C422.promoter11; Position on contig=30052..30111bp; Strand=-; Gene name=UvrA
caaagtataatataacgggtctatgtttaaacttagtcctcgcatggtaaactactttgc

SEQ ID NO: 11078 - DNA, 60 bp, Xenorhabdus bovienii
  Promoter sequence Name=Xb4151_4152.C422.promoter12; Position on contig=30058..30117bp; Strand=+; Gene name=UvrA
tagtttaccatgcgaggactaagtttaaacatagacccgttatattatactttgcgaagt

SEQ ID NO: 11079 - DNA, 60 bp, Xenorhabdus bovienii
  Promoter sequence Name=Xb4151_4152.C422.promoter13; Position on contig=33152..33211bp; Strand=+
ttattttttccccatgcaataagggtatttcctacaatcatttctaataaaataaatttt

SEQ ID NO: 11080 - DNA, 60 bp, Xenorhabdus bovienii
  Promoter sequence Name=Xb4151_4152.C422.promoter14; Position on contig=34151..34210bp; Strand=+
acgtcagctctgcttaagaaccggtcatgtattaaatggttagttgctgtgatatgcttc

SEQ ID NO: 11081 - DNA, 60 bp, Xenorhabdus bovienii
  Promoter sequence Name=Xb4151_4152.C422.promoter15; Position on contig=36486..36545bp; Strand=-; Gene name=XerC
tctcattgtgagagaaacaattaacgctgttcatttaagggtgctttttaaataattctc

SEQ ID NO: 11082 - DNA, 60 bp, Xenorhabdus bovienii
  Promoter sequence Name=Xb4151_4152.C422.promoter16; Position on contig=38070..38129bp; Strand=-; Gene name=Soj (BS)
gaattatcattttgcgcaccagaatcggtacacaaagtaataagaattacactattaaca

SEQ ID NO: 11083 - DNA, 60 bp, Xenorhabdus bovienii
  Promoter sequence Name=Xb4151_4152.C422.promoter17; Position on contig=37879..37938bp; Strand=+; Gene name=Soj (BS)
attatgcccttcgctgcatcttgattgcaacagacgaaactggacgttgagataggtaag

SEQ ID NO: 11084 - DNA, 60 bp, Xenorhabdus bovienii
  Promoter sequence Name=Xb4151_4152.C422.promoter18; Position on contig=44895..44954bp; Strand=+
aagacgataaaaataatcttttctacgatcccgaaaaggggtcgttttttccttttttca

SEQ ID NO: 11085 - DNA, 60 bp, Xenorhabdus bovienii; identical to SEQ ID NO: 10931
  Promoter sequence Name=Xb4151_4152.C423.promoter1; Position on contig= 2992..3051bp; Strand=-

SEQ ID NO: 11086 - DNA, 60 bp, Xenorhabdus bovienii
  Promoter sequence Name=Xb4151_4152.C423.promoter2; Position on contig= 2757..2816bp; Strand=+
ccctcgataatatgcaatgtcattgttcgcctctgaaataaaaaatctatggtccccacc

SEQ ID NO: 11087 - DNA, 60 bp, Xenorhabdus bovienii
  Promoter sequence Name=Xb4151_4152.C423.promoter3; Position on contig= 4184..4243bp; Strand=-
taaaaataaaaaaataggtaacagctttgacaaaatcatgattgtgtttattttatgcgc

SEQ ID NO: 11088 - DNA, 60 bp, Xenorhabdus bovienii
  Promoter sequence Name=Xb4151_4152.C423.promoter4; Position on contig= 3933..3992bp; Strand=+
agtcgctgatggcgatcccgctaaaaactccatcagtctggcgcgggtaaattttttacg

SEQ ID NO: 11089 - DNA, 60 bp, Xenorhabdus bovienii
  Promoter sequence Name=Xb4151_4152.C423.promoter5; Position on contig= 4200..4259bp; Strand=+
caatcatgattttgtcaaagctgttacctatttttttatttttatctcatgatgttacga

SEQ ID NO: 11090 - DNA, 60 bp, Xenorhabdus bovienii
  Promoter sequence Name=Xb4151_4152.C423.promoter6; Position on contig= 4567..4626bp; Strand=+; Gene name=VgrG
gtacccgaatgttatggcctgtgttgttatcaggcgggatgcctatttcataacattcca

SEQ ID NO: 11091 - DNA, 60 bp, Xenorhabdus bovienii
  Promoter sequence Name=Xb4151_4152.C423.promoter7; Position on contig= 14382..14441bp; Strand=-; Gene name=VgrG
gcgctcactgtcataggccagttgttgtgtggtgccatccggcagttcaacatcggtcag

SEQ ID NO: 11092 - DNA, 60 bp, Xenorhabdus bovienii
  Promoter sequence Name=Xb4151_4152.C423.promoter8; Position on contig= 23851..23910bp; Strand=+
aattaaacacgaaaagccggaaaaatccacatgatcttccggctttttataatagcccca

SEQ ID NO: 11093 - DNA, 60 bp, Xenorhabdus bovienii
  Promoter sequence Name=Xb4151_4152.C423.promoter9; Position on contig= 24338..24397bp; Strand=+
gctttgttctgttaggagctgctcactcccttgctcttagttgcttttatagtcaccaat

SEQ ID NO: 11094 - DNA, 60 bp, Xenorhabdus bovienii
  Promoter sequence Name=Xb4151_4152.C423.promoter10; Position on contig=24806..24865bp; Strand=+
taaagtacaatgacatacgaagttacgcaagaatgtatgtcgaaatgtataatgattata

SEQ ID NO: 11095 - DNA, 60 bp, Xenorhabdus bovienii
  Promoter sequence Name=Xb4151_4152.C423.promoter11; Position on contig=27175..27234bp; Strand=-
ggtcatggctacacctcctgtttgaattcacaatataggaacattactacaatacgaata

SEQ ID NO: 11096 - DNA, 60 bp, Xenorhabdus bovienii
  Promoter sequence Name=Xb4151_4152.C423.promoter12; Position on contig=41132..41191bp; Strand=-
ccggcagcagtgccgtatcgacagtgataaccataccgaagatgatttattagacaatta

SEQ ID NO: 11097 - DNA, 60 bp, Xenorhabdus bovienii
  Promoter sequence Name=Xb4151_4152.C423.promoter13; Position on contig=40964..41023bp; Strand=+
ggtaaggtctgtgcctcccgattttcataccagtaacccaccgctagcataatcgccaat

SEQ ID NO: 11098 - DNA, 60 bp, Xenorhabdus bovienii
  Promoter sequence Name=Xb4151_4152.C423.promoter14; Position on contig=47315..47374bp; Strand=-; Gene name=CpsB
gcatatcccctgttacccgttgacgctggtggcatttttattgagtacatcattcaacca

SEQ ID NO: 11099 - DNA, 60 bp, Xenorhabdus bovienii
  Promoter sequence Name=Xb4151_4152.C423.promoter15; Position on contig=47765..47824bp; Strand=-
acaaatgaattctgaggttgtgggaatatgtcaggacgcggtatcggtaatatagattat

SEQ ID NO: 11100 - DNA, 60 bp, Xenorhabdus bovienii
  Promoter sequence Name=Xb4151_4152.C423.promoter16; Position on contig=49240..49299bp; Strand=-; Gene name=HigB
gttttacagcatggttcgcctgaatgcctgctgtagagcctgttttaaagaatttttcta

SEQ ID NO: 11101 - DNA, 60 bp, Xenorhabdus bovienii
  Promoter sequence Name=Xb4151_4152.C423.promoter17; Position on contig=49131..49190bp; Strand=+; Gene name=HigB
agagtgattgcggtggcaaagtcggttgacactgcacacacttaacgtatactgacgcta

SEQ ID NO: 11102 - DNA, 60 bp, Xenorhabdus bovienii
  Promoter sequence Name=Xb4151_4152.C423.promoter18; Position on contig=51355..51414bp; Strand=-
atgtagcgatttttaaaaataaatctttacgatcgtaaaaacgctgctattgtgataacc

SEQ ID NO: 11103 - DNA, 60 bp, Xenorhabdus bovienii
  Promoter sequence Name=Xb4151_4152.C423.promoter19; Position on contig=51052..51111bp; Strand=+
cgaaattgtgttaacagtaattggcaacggggttcaggcagccccattaatttagacact

SEQ ID NO: 11104 - DNA, 60 bp, Xenorhabdus bovienii
  Promoter sequence Name=Xb4151_4152.C423.promoter20; Position on contig=51331..51390bp; Strand=+
taagcctggtgactttgtcatcacggttatcacaatagcagcgtttttacgatcgtaaag

SEQ ID NO: 11105 - DNA, 60 bp, Xenorhabdus bovienii
  Promoter sequence Name=Xb4151_4152.C423.promoter21; Position on contig=54911..54970bp; Strand=-
tattctatctctagagtgatatctttacaaacactccaatagtgatttatattgactgtt

SEQ ID NO: 11106 - DNA, 60 bp, Xenorhabdus bovienii
  Promoter sequence Name=Xb4151_4152.C423.promoter22; Position on contig=56117..56176bp; Strand=-
tgggctgacccgatacgtcgttaatatatgatgtttaaattcatctttattttttatgcc

SEQ ID NO: 11107 - DNA, 60 bp, Xenorhabdus bovienii
  Promoter sequence Name=Xb4151_4152.C423.promoter23; Position on contig=55754..55813bp; Strand=+
attattatcaccctaaagatccaaaatcattcagatgatatcaaattaaaattattttat

SEQ ID NO: 11108 - DNA, 60 bp, Xenorhabdus bovienii
  Promoter sequence Name=Xb4151_4152.C423.promoter24; Position on contig=56323..56382bp; Strand=+
atagccacacaataaaacgactataaataaaatctatcaatttcaatcaatattaaaact

SEQ ID NO: 11109 - DNA, 60 bp, Xenorhabdus bovienii
  Promoter sequence Name=Xb4151_4152.C424.promoter1; Position on contig= 580..639bp; Strand=-
gaaggattgcggctttcttatgtctttctttgtactgaccgggtagataaaaaacgtcaa

SEQ ID NO: 11110 - DNA, 60 bp, Xenorhabdus bovienii
  Promoter sequence Name=Xb4151_4152.C424.promoter2; Position on contig= 349..408bp; Strand=+
tgctgatacccgtttctatccgcttcacgtatctgtcagtccagaccgattcttttctca

SEQ ID NO: 11111 - DNA, 60 bp, Xenorhabdus bovienii
  Promoter sequence Name=Xb4151_4152.C424.promoter3; Position on contig= 6628..6687bp; Strand=-
aatataaatataggggcatttgtcaaaattgtagtcatgaaatgtatttcaatgcctatc

SEQ ID NO: 11112 - DNA, 60 bp, Xenorhabdus bovienii
  Promoter sequence Name=Xb4151_4152.C424.promoter4; Position on contig= 6952..7011bp; Strand=+
attttattacacaatttaagcatcagttattggattcgtgttactgattttatttacagc

SEQ ID NO: 11113 - DNA, 60 bp, Xenorhabdus bovienii
  Promoter sequence Name=Xb4151_4152.C424.promoter5; Position on contig= 8561..8620bp; Strand=-
taaaagttaaacttagtagccttggtatcgcaattaaatccgtaggcgaagatacaaaag

SEQ ID NO: 11114 - DNA, 60 bp, Xenorhabdus bovienii
  Promoter sequence Name=Xb4151_4152.C424.promoter6; Position on contig= 8361..8420bp; Strand=+
tcgtttctcggctgcttcatcaacttcttgttttttaacaaccagattaacgtacttttc

SEQ ID NO: 11115 - DNA, 60 bp, Xenorhabdus bovienii
  Promoter sequence Name=Xb4151_4152.C424.promoter7; Position on contig= 8712..8771bp; Strand=+
cttatttgtttccgctatttttttgtttccgatatcggacattttcgccgaatttgcctt

SEQ ID NO: 11116 - DNA, 60 bp, Xenorhabdus bovienii
  Promoter sequence Name=Xb4151_4152.C424.promoter8; Position on contig= 11149..11208bp; Strand=-
ttaaatagtgtgaaattgcttgataatgaggggctgttccagttgaacagaatagaagag

SEQ ID NO: 11117 - DNA, 60 bp, Xenorhabdus bovienii
  Promoter sequence Name=Xb4151_4152.C424.promoter9; Position on contig= 12766..12825bp; Strand=-
catcatataatatatttgttttgctttaacttgcatctttactgagtaacactgcaaata

SEQ ID NO: 11118 - DNA, 60 bp, Xenorhabdus bovienii
  Promoter sequence Name=Xb4151_4152.C424.promoter10; Position on contig=13297..13356bp; Strand=-
gtaagttccgccatagcgccccttttttatgaatacagatttaaaggtaggattttctac

SEQ ID NO: 11119 - DNA, 60 bp, Xenorhabdus bovienii
  Promoter sequence Name=Xb4151_4152.C424.promoter11; Position on contig=12906..12965bp; Strand=+
gcaaaagcggtcagagccaaccccgtcagtgttggattttttatgcctaaattttaatgg

SEQ ID NO: 11120 - DNA, 60 bp, Xenorhabdus bovienii
  Promoter sequence Name=Xb4151_4152.C424.promoter12; Position on contig=14186..14245bp; Strand=-
taacgccgcttaactgcggttttttttaatttctaattacatgctttttaactgtgtgct

SEQ ID NO: 11121 - DNA, 60 bp, Xenorhabdus bovienii
  Promoter sequence Name=Xb4151_4152.C424.promoter13; Position on contig=14986..15045bp; Strand=-
acaatagcaatatagccaatgctattgaaccttaggttcaagtagactaatatcacctca

SEQ ID NO: 11122 - DNA, 60 bp, Xenorhabdus bovienii
  Promoter sequence Name=Xb4151_4152.C424.promoter14; Position on contig=14910..14969bp; Strand=+
ctttgtggcatatatccccctcaatcccagtacctaaaatggatagctaaaatttagctc

SEQ ID NO: 11123 - DNA, 60 bp, Xenorhabdus bovienii
  Promoter sequence Name=Xb4151_4152.C424.promoter15; Position on contig=16564..16623bp; Strand=+
acggccaataagtttattggtttctaccgggcaatttgccatgtgaataacctctattaa

SEQ ID NO: 11124 - DNA, 60 bp, Xenorhabdus bovienii
  Promoter sequence Name=Xb4151_4152.C424.promoter16; Position on contig=25127..25186bp; Strand=+
ataatattacgggtatggatgccctcgaaatactccagctgctctggtgtcatcttaaat

SEQ ID NO: 11125 - DNA, 60 bp, Xenorhabdus bovienii
  Promoter sequence Name=Xb4151_4152.C424.promoter17; Position on contig=26117..26176bp; Strand=-
tgcgtatatggaacattatctaaaactgaaattactttaccggtaaaattgaatgatagt

SEQ ID NO: 11126 - DNA, 60 bp, Xenorhabdus bovienii
  Promoter sequence Name=Xb4151_4152.C424.promoter18; Position on contig=27390..27449bp; Strand=-
tttgctccaccattttttatggtttatatctatgtcataagcactttcaaaatctccaac

SEQ ID NO: 11127 - DNA, 60 bp, Xenorhabdus bovienii; identical to SEQ ID NO: 10819
  Promoter sequence Name=Xb4151_4152.C424.promoter19; Position on contig=27154..27213bp; Strand=+

SEQ ID NO: 11128 - DNA, 60 bp, Xenorhabdus bovienii
  Promoter sequence Name=Xb4151_4152.C424.promoter20; Position on contig=28389..28448bp; Strand=-
gtataccatacagacggtttttgacctgaaagaagtcaccgcattggcaacatgggacat

SEQ ID NO: 11129 - DNA, 60 bp, Xenorhabdus bovienii
  Promoter sequence Name=Xb4151_4152.C424.promoter21; Position on contig=27849..27908bp; Strand=+
attatcgatccataaataaaaacccgatcaaacggcatagattccgttagtcttttatga

SEQ ID NO: 11130 - DNA, 60 bp, Xenorhabdus bovienii
  Promoter sequence Name=Xb4151_4152.C424.promoter22; Position on contig=29409..29468bp; Strand=-
atcttcaatgacgacgggtatagaatgaaaattagaatttaattagttattatttatcat

SEQ ID NO: 11131 - DNA, 60 bp, Xenorhabdus bovienii
  Promoter sequence Name=Xb4151_4152.C424.promoter23; Position on contig=29381..29440bp; Strand=+
gagagaacaatacacaacacctattataatgataaataataactaattaaattctaattt

SEQ ID NO: 11132 - DNA, 60 bp, Xenorhabdus bovienii
  Promoter sequence Name=Xb4151_4152.C424.promoter24; Position on contig=31073..31132bp; Strand=-
ccggcaacaccacttttgctaacttgccgccgttaacgcgacactgccaacattactgta

SEQ ID NO: 11133 - DNA, 60 bp, Xenorhabdus bovienii
  Promoter sequence Name=Xb4151_4152.C424.promoter25; Position on contig=31890..31949bp; Strand=-
gctgaaaagccggctttttttggtttctagcaaagtaacatagaggatataaataaggtt

SEQ ID NO: 11134 - DNA, 60 bp, Xenorhabdus bovienii
  Promoter sequence Name=Xb4151_4152.C424.promoter26; Position on contig=31536..31595bp; Strand=+
ggtatcgaccgcccggtaaaggtatttccactgacctttcactttgatatacgtttcatc

SEQ ID NO: 11135 - DNA, 60 bp, Xenorhabdus bovienii
  Promoter sequence Name=Xb4151_4152.C424.promoter27; Position on contig=32609..32668bp; Strand=-
taatagcaagctatagcgggaacttagcgtaatatttgaatatttttttttatctgccgg

SEQ ID NO: 11136 - DNA, 60 bp, Xenorhabdus bovienii
  Promoter sequence Name=Xb4151_4152.C424.promoter28; Position on contig=32847..32906bp; Strand=+
gcaagttagcaaaagtggtgttgccggttatttaggccgccagcaaatagaattgttccg

SEQ ID NO: 11137 - DNA, 60 bp, Xenorhabdus bovienii
  Promoter sequence Name=Xb4151_4152.C424.promoter29; Position on contig=35983..36042bp; Strand=+
cgataacttgctgaaccattttgctttcttttccccagaagttgaggaaatattcctgca

SEQ ID NO: 11138 - DNA, 60 bp, Xenorhabdus bovienii
  Promoter sequence Name=Xb4151_4152.C424.promoter30; Position on contig=37382..37441bp; Strand=+
tcatcatgaaactggcgatgttggcgatcggcaatgagtatgcttggcataatttggcgt

SEQ ID NO: 11139 - DNA, 60 bp, Xenorhabdus bovienii
  Promoter sequence Name=Xb4151_4152.C424.promoter31; Position on contig=39134..39193bp; Strand=-
aattattaataccaataacgctaattatattgataatcatttacatctaaaatattgtaa

SEQ ID NO: 11140 - DNA, 60 bp, Xenorhabdus bovienii
  Promoter sequence Name=Xb4151_4152.C424.promoter32; Position on contig=38785..38844bp; Strand=+
gttttggtgcctggtgcactcctctttgctacgattccttgcattaatactattacgttt

SEQ ID NO: 11141 - DNA, 60 bp, Xenorhabdus bovienii
  Promoter sequence Name=Xb4151_4152.C424.promoter33; Position on contig=39684..39743bp; Strand=-
cagaggatgacatgtaacaccgcctttgatttaaggaagaagagccctatcatggcacaa

SEQ ID NO: 11142 - DNA, 60 bp, Xenorhabdus bovienii
  Promoter sequence Name=Xb4151_4152.C424.promoter34; Position on contig=39573..39632bp; Strand=+
aaacactatttatcgataggaaatccgccataaaaagattgaaattgcatagtttcttaa

SEQ ID NO: 11143 - DNA, 60 bp, Xenorhabdus bovienii
  Promoter sequence Name=Xb4151_4152.C424.promoter35; Position on contig=41133..41192bp; Strand=-
aacgggatgaatacgtgacctagttcaggtgccagggcaatcgcatctaaaattcattga

SEQ ID NO: 11144 - DNA, 60 bp, Xenorhabdus bovienii
  Promoter sequence Name=Xb4151_4152.C424.promoter36; Position on contig=41155..41214bp; Strand=+
gccctggcacctgaactaggtcacgtattcatcccgttgtttctcacgtataatgagggt

SEQ ID NO: 11145 - DNA, 60 bp, Xenorhabdus bovienii
  Promoter sequence Name=Xb4151_4152.C424.promoter37; Position on contig=41992..42051bp; Strand=+
catcaatgaacaaccattctgtatctgtattctcagataataatttgaataataaattaa

SEQ ID NO: 11146 - DNA, 60 bp, Xenorhabdus bovienii
  Promoter sequence Name=Xb4151_4152.C424.promoter38; Position on contig=47646..47705bp; Strand=-
ccaattagtttcatatatgattaataacaattgttatttgtataatttattattttgcat

SEQ ID NO: 11147 - DNA, 60 bp, Xenorhabdus bovienii
  Promoter sequence Name=Xb4151_4152.C424.promoter39; Position on contig=48782..48841bp; Strand=-; Gene name=SfcA
ttaatcaatattatataaatattattctcatagcactcataaagaggtatttttatcttt

SEQ ID NO: 11148 - DNA, 60 bp, Xenorhabdus bovienii
  Promoter sequence Name=Xb4151_4152.C424.promoter40; Position on contig=51330..51389bp; Strand=+; Gene name=PhuW
gcataggcttaacagggtagttttatttgtaaataattctcattatctatagtatgcgga

SEQ ID NO: 11149 - DNA, 60 bp, Xenorhabdus bovienii
  Promoter sequence Name=Xb4151_4152.C424.promoter41; Position on contig=52342..52401bp; Strand=+; Gene name=TonB
atgacactaataaataaaaatagttttcatttgtatatctaattgattatcattctctta

SEQ ID NO: 11150 - DNA, 60 bp, Xenorhabdus bovienii
  Promoter sequence Name=Xb4151_4152.C424.promoter42; Position on contig=55434..55493bp; Strand=+; Gene name=CirA
atatttataacccaaggcgctgataatttgttatcagtgtcatgggtattttatcgccaa

SEQ ID NO: 11151 - DNA, 60 bp, Xenorhabdus bovienii
  Promoter sequence Name=Xb4151_4152.C424.promoter43; Position on contig=59274..59333bp; Strand=-; Gene name=GuaB
ccgtaatcgattgcctccagcattttttaaaaaaatttcttgattcgtattctgggatga

SEQ ID NO: 11152 - DNA, 60 bp, Xenorhabdus bovienii
  Promoter sequence Name=Xb4151_4152.C424.promoter44; Position on contig=59291..59350bp; Strand=+; Gene name=GuaB
tcaagaaatttttttaaaaaatgctggaggcaatcgattacggcctgtataatgccgcgg

SEQ ID NO: 11153 - DNA, 60 bp, Xenorhabdus bovienii
  Promoter sequence Name=Xb4151_4152.C424.promoter45; Position on contig=64033..64092bp; Strand=-
gccctagtactgtggctaagggctatagctaaatcatattaatatgacataatatctaac

SEQ ID NO: 11154 - DNA, 60 bp, Xenorhabdus bovienii
  Promoter sequence Name=Xb4151_4152.C424.promoter46; Position on contig=64055..64114bp; Strand=+
tatgatttagctatagcccttagccacagtactagggcaatcgcatctaaaattcattga

SEQ ID NO: 11155 - DNA, 60 bp, Xenorhabdus bovienii
  Promoter sequence Name=Xb4151_4152.C424.promoter47; Position on contig=65579..65638bp; Strand=-
gatagaatcaataattgcaatacttataataaaaaaaaattaaatgctaaaattaatagt

SEQ ID NO: 11156 - DNA, 60 bp, Xenorhabdus bovienii
  Promoter sequence Name=Xb4151_4152.C424.promoter48; Position on contig=66881..66940bp; Strand=-; Gene name=PrpB
cactggttttttatacagtcaatatgtagatcaataaaaaataattttaaattaaatttc

SEQ ID NO: 11157 - DNA, 60 bp, Xenorhabdus bovienii
  Promoter sequence Name=Xb4151_4152.C424.promoter49; Position on contig=66845..66904bp; Strand=+; Gene name=PrpB
tacaaaaaaataatcctggtaattaattacattttagaaatttaatttaaaattattttt

SEQ ID NO: 11158 - DNA, 60 bp, Xenorhabdus bovienii
  Promoter sequence Name=Xb4151_4152.C424.promoter50; Position on contig=68177..68236bp; Strand=-
tcttgtaaattagattgagaagttaacgtttgactcataccagacgccattatctgatgt

SEQ ID NO: 11159 - DNA, 60 bp, Xenorhabdus bovienii
  Promoter sequence Name=Xb4151_4152.C424.promoter51; Position on contig=67980..68039bp; Strand=+
taacaattttactctattaataactaattaagaaaacaatacagtattaaaataatttca

SEQ ID NO: 11160 - DNA, 60 bp, Xenorhabdus bovienii
  Promoter sequence Name=Xb4151_4152.C424.promoter52; Position on contig=68854..68913bp; Strand=-
attggtcgcaggttcgaatcctgcacgacccaccatttagatataaaatcagaattacct

SEQ ID NO: 11161 - DNA, 60 bp, Xenorhabdus bovienii; identical to SEQ ID NO: 11022
  Promoter sequence Name=Xb4151_4152.C425.promoter1; Position on contig= 1789..1848bp; Strand=-; Gene name=InsB

SEQ ID NO: 11162 - DNA, 60 bp, Xenorhabdus bovienii
  Promoter sequence Name=Xb4151_4152.C425.promoter2; Position on contig= 2618..2677bp; Strand=-; Gene name=InsB
cagtattactttcaatgaagaaaacttacacactttcaatctaacgttattttatataaa

SEQ ID NO: 11163 - DNA, 60 bp, Xenorhabdus bovienii
  Promoter sequence Name=Xb4151_4152.C425.promoter3; Position on contig= 3651..3710bp; Strand=-; Gene name=XerC
aaagcatctagcttctctggtaggtattgactcttattgtatatagccataatgcccggc

SEQ ID NO: 11164 - DNA, 60 bp, Xenorhabdus bovienii; identical to SEQ ID NO: 10698
  Promoter sequence Name=Xb4151_4152.C425.promoter4; Position on contig= 3385..3444bp; Strand=+; Gene name=XerC

SEQ ID NO: 11165 - DNA, 60 bp, Xenorhabdus bovienii
  Promoter sequence Name=Xb4151_4152.C425.promoter5; Position on contig= 4764..4823bp; Strand=-
tatcgaatggtcatgttaccctcactgtttaattgtttttgtgagggtattcttaatcaa

SEQ ID NO: 11166 - DNA, 60 bp, Xenorhabdus bovienii
  Promoter sequence Name=Xb4151_4152.C425.promoter6; Position on contig= 4713..4772bp; Strand=+
tataactaactaaatttcataggttttacgccaatttttttatttttatttttgattaag

SEQ ID NO: 11167 - DNA, 60 bp, Xenorhabdus bovienii
  Promoter sequence Name=Xb4151_4152.C425.promoter7; Position on contig= 10456..10515bp; Strand=+
gttgtctcatttttattaactgtatgaattgtaattattttagtttttaaattgagacaa

SEQ ID NO: 11168 - DNA, 60 bp, Xenorhabdus bovienii
  Promoter sequence Name=Xb4151_4152.C425.promoter8; Position on contig= 11524..11583bp; Strand=+
ctgttttatgtcatcaacagtatttgcattttgcataaagatggcttaatatctccaaat

SEQ ID NO: 11169 - DNA, 60 bp, Xenorhabdus bovienii
  Promoter sequence Name=Xb4151_4152.C425.promoter9; Position on contig= 11999..12058bp; Strand=+
aactttggcgtagagggttcgcgcggatgcctgaagagcatcaggactcggttcgattcc

SEQ ID NO: 11170 - DNA, 60 bp, Xenorhabdus bovienii
  Promoter sequence Name=Xb4151_4152.C425.promoter10; Position on contig=12958..13017bp; Strand=-
ggtcgcccctgtgagttagttaaaagtaataagttgatacttaaggtatgttgttagatc

SEQ ID NO: 11171 - DNA, 60 bp, Xenorhabdus bovienii
  Promoter sequence Name=Xb4151_4152.C425.promoter11; Position on contig=12856..12915bp; Strand=+
agattaatttcgtcaactttgattttttcaaattcgtagctcattttttatccttcacag

SEQ ID NO: 11172 - DNA, 60 bp, Xenorhabdus bovienii
  Promoter sequence Name=Xb4151_4152.C425.promoter12; Position on contig=13966..14025bp; Strand=-
tggtacatacggttcattgttgtattccacaacatagagttcatcgttataaaaagggac

SEQ ID NO: 11173 - DNA, 60 bp, Xenorhabdus bovienii
  Promoter sequence Name=Xb4151_4152.C425.promoter13; Position on contig=15884..15943bp; Strand=-
gctgataatgactgtctggggcattgattatttttgattctgacctgtacgctcgatgca

SEQ ID NO: 11174 - DNA, 60 bp, Xenorhabdus bovienii
  Promoter sequence Name=Xb4151_4152.C425.promoter14; Position on contig=15661..15720bp; Strand=+
attattgcaacaacaattaaacccatttccgcctaacaacaaacgaataatatttaacaa

SEQ ID NO: 11175 - DNA, 60 bp, Xenorhabdus bovienii
  Promoter sequence Name=Xb4151_4152.C425.promoter15; Position on contig=16803..16862bp; Strand=-
ggtgacgaactggcgtatctcttcacggattatctggcggagatggttatcattatcctt

SEQ ID NO: 11176 - DNA, 60 bp, Xenorhabdus bovienii
  Promoter sequence Name=Xb4151_4152.C425.promoter16; Position on contig=16460..16519bp; Strand=+
aactgctacataaaggtgcagagtaggttatcaataaggccatcagttaacagggtggca

SEQ ID NO: 11177 - DNA, 60 bp, Xenorhabdus bovienii
  Promoter sequence Name=Xb4151_4152.C425.promoter17; Position on contig=17991..18050bp; Strand=+
agtctttttttatccccgcgaaaaatgaaatttaaatcgggagtcttttttatccctctt

SEQ ID NO: 11178 - DNA, 60 bp, Xenorhabdus bovienii
  Promoter sequence Name=Xb4151_4152.C425.promoter18; Position on contig=20692..20751bp; Strand=-
ttcgcgccatttgtagctggtttgccagtcgttcggctcatcatgggtcagataaaacgc

SEQ ID NO: 11179 - DNA, 60 bp, Xenorhabdus bovienii
  Promoter sequence Name=Xb4151_4152.C425.promoter19; Position on contig=25938..25997bp; Strand=-
aggatcaataacagcactaggccgtgtcccttaatgtaaatcggtagtattatcatctaa

SEQ ID NO: 11180 - DNA, 60 bp, Xenorhabdus bovienii
  Promoter sequence Name=Xb4151_4152.C425.promoter20; Position on contig=25663..25722bp; Strand=+
gtaaacgattaaatatcttgttgataatgcctgattttgaccaacgattaaatcggttat

SEQ ID NO: 11181 - DNA, 60 bp, Xenorhabdus bovienii
  Promoter sequence Name=Xb4151_4152.C425.promoter21; Position on contig=26697..26756bp; Strand=-
aggttcgccaatcaccagagctatctccgggtcacgtgaataaaaggcatgatagaggta

SEQ ID NO: 11182 - DNA, 60 bp, Xenorhabdus bovienii
  Promoter sequence Name=Xb4151_4152.C425.promoter22; Position on contig=26529..26588bp; Strand=+
acattttaatgagttatcatacagtgatagtaaacggaattcggtcgaaaaatcgatacg

SEQ ID NO: 11183 - DNA, 60 bp, Xenorhabdus bovienii
  Promoter sequence Name=Xb4151_4152.C425.promoter23; Position on contig=28049..28108bp; Strand=+
tattatcttctcacacctctttcaggctattgcttaaggacgagatataaaatgggtttg

SEQ ID NO: 11184 - DNA, 60 bp, Xenorhabdus bovienii
  Promoter sequence Name=Xb4151_4152.C425.promoter24; Position on contig=30552..30611bp; Strand=-
tattttaattatcccgtgttatcccagtatatcccgtaacgtagtgttattacaaaaata

SEQ ID NO: 11185 - DNA, 60 bp, Xenorhabdus bovienii
  Promoter sequence Name=Xb4151_4152.C425.promoter25; Position on contig=30365..30424bp; Strand=+
ataccactacacatattttcacgggataacggggtgaatagcatatttattatatatttc

SEQ ID NO: 11186 - DNA, 60 bp, Xenorhabdus bovienii
  Promoter sequence Name=Xb4151_4152.C425.promoter26; Position on contig=33407..33466bp; Strand=+
ttgacgagcggtcttatctgaaagtgtaaatttagggtgagtttgggtatgctgtatatc

SEQ ID NO: 11187 - DNA, 60 bp, Xenorhabdus bovienii
  Promoter sequence Name=Xb4151_4152.C425.promoter27; Position on contig=33691..33750bp; Strand=+
cactaatcagtttgtagatccacgccttgctataacccgttctgcgctgaacttcgggca

SEQ ID NO: 11188 - DNA, 60 bp, Xenorhabdus bovienii
  Promoter sequence Name=Xb4151_4152.C425.promoter28; Position on contig=34025..34084bp; Strand=-
aaaagggcgtaaagatgcggtgatttttcacacacctgtgcccggggcacaatagcctgt

SEQ ID NO: 11189 - DNA, 60 bp, Xenorhabdus bovienii
  Promoter sequence Name=Xb4151_4152.C425.promoter29; Position on contig=33898..33957bp; Strand=+
catttgtgaaatttatcggtttacagggagtatcagctcccgaattgtattctgtatgaa

SEQ ID NO: 11190 - DNA, 60 bp, Xenorhabdus bovienii
  Promoter sequence Name=Xb4151_4152.C425.promoter30; Position on contig=35320..35379bp; Strand=-
cttctgtagtccagtcaggtaggttgaaatccacgatcttatgggggtatatttaggggt

SEQ ID NO: 11191 - DNA, 60 bp, Xenorhabdus bovienii
  Promoter sequence Name=Xb4151_4152.C425.promoter31; Position on contig=35160..35219bp; Strand=+
ggtacttcaaccgccaatagcgagcgccattagggttaaccaataagtatagtccgccac

SEQ ID NO: 11192 - DNA, 60 bp, Xenorhabdus bovienii
  Promoter sequence Name=Xb4151_4152.C425.promoter32; Position on contig=35798..35857bp; Strand=-; Gene name=XerC
aagagcagggaaatcacccaggtttatgaacttttcttttccattcttaaaataacgata

SEQ ID NO: 11193 - DNA, 60 bp, Xenorhabdus bovienii
  Promoter sequence Name=Xb4151_4152.C425.promoter33; Position on contig=35560..35619bp; Strand=+; Gene name=XerC
aaacggattttatagcttgaacagtttcatgtagttgcatatcatttcatcataacttga

SEQ ID NO: 11194 - DNA, 60 bp, Xenorhabdus bovienii
  Promoter sequence Name=Xb4151_4152.C425.promoter34; Position on contig=37044..37103bp; Strand=-
ttttattttctgtcttttttatttaaaaaaacaataataacaatgatatatttgcattga

SEQ ID NO: 11195 - DNA, 60 bp, Xenorhabdus bovienii
  Promoter sequence Name=Xb4151_4152.C425.promoter35; Position on contig=37018..37077bp; Strand=+
tgaattaatagcttatgtttatatattcaatgcaaatatatcattgttattattgttttt

SEQ ID NO: 11196 - DNA, 60 bp, Xenorhabdus bovienii; identical to SEQ ID NO: 10931
  Promoter sequence Name=Xb4151_4152.C425.promoter36; Position on contig=38515..38574bp; Strand=-

SEQ ID NO: 11197 - DNA, 60 bp, Xenorhabdus bovienii
  Promoter sequence Name=Xb4151_4152.C425.promoter37; Position on contig=38333..38392bp; Strand=+
tggaaagaatgtttgccgagatcaataccaataagcgtaacgttttgcatgatggtcttc

SEQ ID NO: 11198 - DNA, 60 bp, Xenorhabdus bovienii
  Promoter sequence Name=Xb4151_4152.C425.promoter38; Position on contig=39699..39758bp; Strand=-
atgttctatctttcagaccttttacttcacgtaatcggatttagctgaatattagctgcc

SEQ ID NO: 11199 - DNA, 60 bp, Xenorhabdus bovienii; identical to SEQ ID NO: 11088
  Promoter sequence Name=Xb4151_4152.C425.promoter39; Position on contig=39456..39515bp; Strand=+

SEQ ID NO: 11200 - DNA, 60 bp, Xenorhabdus bovienii
  Promoter sequence Name=Xb4151_4152.C425.promoter40; Position on contig=40033..40092bp; Strand=-
agccgcaaaaaaagtggcttttttgttatggtgcagaattttatggggataattttttat

SEQ ID NO: 11201 - DNA, 60 bp, Xenorhabdus bovienii
  Promoter sequence Name=Xb4151_4152.C425.promoter41; Position on contig=39775..39834bp; Strand=+
acgcgaataactctaccctatttttttcactagaaaaagattttttttgtaattaatttt

SEQ ID NO: 11202 - DNA, 60 bp, Xenorhabdus bovienii
  Promoter sequence Name=Xb4151_4152.C425.promoter42; Position on contig=45428..45487bp; Strand=-; Gene name=MobA
gccagcatacctgccagcggcccagaaaaatcggtgatgatatccggtatgatgggataa

SEQ ID NO: 11203 - DNA, 60 bp, Xenorhabdus bovienii
  Promoter sequence Name=Xb4151_4152.C425.promoter43; Position on contig=44995..45054bp; Strand=+; Gene name=MobA
tcttcattaatctttaataatgcctctggtacgcagcaaagcagtcttaaaattttcttc

SEQ ID NO: 11204 - DNA, 60 bp, Xenorhabdus bovienii
  Promoter sequence Name=Xb4151_4152.C425.promoter44; Position on contig=46493..46552bp; Strand=-
tggacaattctgtataatatatgcaacttacaacataatttgtgggctgttatccaaaaa

SEQ ID NO: 11205 - DNA, 60 bp, Xenorhabdus bovienii
  Promoter sequence Name=Xb4151_4152.C425.promoter45; Position on contig=46840..46899bp; Strand=-
tataaaaaacaacaaaaacaaattttcaataagcgtcaagagcaaaatataattagaatt

SEQ ID NO: 11206 - DNA, 60 bp, Xenorhabdus bovienii
  Promoter sequence Name=Xb4151_4152.C425.promoter46; Position on contig=46625..46684bp; Strand=+
ctccaattatatataaaataaaattaacactggcgattccatataataagtgcaacacca

SEQ ID NO: 11207 - DNA, 60 bp, Xenorhabdus bovienii
  Promoter sequence Name=Xb4151_4152.C425.promoter47; Position on contig=46980..47039bp; Strand=+
cgtaataaagattaaaatgtttattgctatattaaatatgacttaactattatttttttc

SEQ ID NO: 11208 - DNA, 60 bp, Xenorhabdus bovienii
  Promoter sequence Name=Xb4151_4152.C425.promoter48; Position on contig=47790..47849bp; Strand=+
gtaaatcagaaaaaatatttattctatttctctgttacgtttatcaaatatattcatact

SEQ ID NO: 11209 - DNA, 60 bp, Xenorhabdus bovienii
  Promoter sequence Name=Xb4151_4152.C425.promoter49; Position on contig=49418..49477bp; Strand=+
gtgtcagcccataaattagaaatcgtattggttgatgttttcgctggtaaaaattacacg

SEQ ID NO: 11210 - DNA, 60 bp, Xenorhabdus bovienii
  Promoter sequence Name=Xb4151_4152.C425.promoter50; Position on contig=50244..50303bp; Strand=-; Gene name=DeoR (BS)
cgatcgcaaaaatttgaacatattttgatagagatctgattttttcacaaaatgtgatgg

SEQ ID NO: 11211 - DNA, 60 bp, Xenorhabdus bovienii
  Promoter sequence Name=Xb4151_4152.C425.promoter51; Position on contig=50143..50202bp; Strand=+; Gene name=DeoR (BS)
ccacgaaccgccaaaagagggacatagcaattgaacatttatcaatttaaaatacttttg

SEQ ID NO: 11212 - DNA, 60 bp, Xenorhabdus bovienii
  Promoter sequence Name=Xb4151_4152.C425.promoter52; Position on contig=55052..55111bp; Strand=-
ataactttttgtcataatagactaggttgaactttagcttgtactggtaagttaattgat

SEQ ID NO: 11213 - DNA, 60 bp, Xenorhabdus bovienii
  Promoter sequence Name=Xb4151_4152.C425.promoter53; Position on contig=56054..56113bp; Strand=-
ggtaatatctggggtaataaaatgaataatttgtcttttcttgaattaaaatccatttaa

SEQ ID NO: 11214 - DNA, 60 bp, Xenorhabdus bovienii
  Promoter sequence Name=Xb4151_4152.C425.promoter54; Position on contig=56880..56939bp; Strand=-
tgtattaatcacatgtcctttcacaaggccagagcagataagtgtattaacctgcatatc

SEQ ID NO: 11215 - DNA, 60 bp, Xenorhabdus bovienii
  Promoter sequence Name=Xb4151_4152.C425.promoter55; Position on contig=56619..56678bp; Strand=+
ctcccctgcctgaaccaccattgaaagggtgataacagacgcactggtagaaacttccta

SEQ ID NO: 11216 - DNA, 60 bp, Xenorhabdus bovienii
  Promoter sequence Name=Xb4151_4152.C425.promoter56; Position on contig=58258..58317bp; Strand=-
tcaccaagttttatcagtcattaaatatattttattaattcttcacttatcattttatgt

SEQ ID NO: 11217 - DNA, 60 bp, Xenorhabdus bovienii
  Promoter sequence Name=Xb4151_4152.C425.promoter57; Position on contig=60368..60427bp; Strand=-
atgggtgagggattcagtccattccaaagccaccttttcacgcaaggtaaactgaccgct

SEQ ID NO: 11218 - DNA, 60 bp, Xenorhabdus bovienii
  Promoter sequence Name=Xb4151_4152.C425.promoter58; Position on contig=59930..59989bp; Strand=+
cagcggtttttatatttataaataatcactattctacgcattcgacatattatttctctg

SEQ ID NO: 11219 - DNA, 60 bp, Xenorhabdus bovienii; identical to SEQ ID NO: 11180
  Promoter sequence Name=Xb4151_4152.C425.promoter59; Position on contig=61964..62023bp; Strand=-

SEQ ID NO: 11220 - DNA, 60 bp, Xenorhabdus bovienii
  Promoter sequence Name=Xb4151_4152.C425.promoter60; Position on contig=61654..61713bp; Strand=+
agttgataaggtgagggatgaatggatgaagcagaatcgaataaagatatactaggccgt

SEQ ID NO: 11221 - DNA, 60 bp, Xenorhabdus bovienii
  Promoter sequence Name=Xb4151_4152.C426.promoter1; Position on contig= 548..607bp; Strand=-; Gene name=XerC
aggataaacaccgaaagccagtcggtcttcttttttatcggtagggcggcgatacttcat

SEQ ID NO: 11222 - DNA, 60 bp, Xenorhabdus bovienii
  Promoter sequence Name=Xb4151_4152.C426.promoter2; Position on contig= 188..247bp; Strand=+; Gene name=XerC
tgaaatcggtagacacaagggatttaaaatccctcggctgtaaggctgtgcgggttcaag

SEQ ID NO: 11223 - DNA, 60 bp, Xenorhabdus bovienii
  Promoter sequence Name=Xb4151_4152.C426.promoter3; Position on contig= 1744..1803bp; Strand=+
aagttatatgtattagctcagatttaatctgttagttactcattttttattctgttcaca

SEQ ID NO: 11224 - DNA, 60 bp, Xenorhabdus bovienii
  Promoter sequence Name=Xb4151_4152.C426.promoter4; Position on contig= 2804..2863bp; Strand=-; Gene name=AlpA
ataaatctgatagttaactaactctctaaaagatagcaagttaagggtagcattcactgt

SEQ ID NO: 11225 - DNA, 60 bp, Xenorhabdus bovienii
  Promoter sequence Name=Xb4151_4152.C426.promoter5; Position on contig= 2369..2428bp; Strand=+; Gene name=AlpA
gggctggcatatcttccagtgatagtcttttctaaccaaaaatagttaataatcaaaata

SEQ ID NO: 11226 - DNA, 60 bp, Xenorhabdus bovienii
  Promoter sequence Name=Xb4151_4152.C426.promoter6; Position on contig= 6421..6480bp; Strand=+; Gene name=Hcp
tggttttttattttttggcactacctgaaattcacattaggtaattgtctgattttgttt

SEQ ID NO: 11227 - DNA, 60 bp, Xenorhabdus bovienii
  Promoter sequence Name=Xb4151_4152.C426.promoter7; Position on contig= 8405..8464bp; Strand=-
tggagaactcttccagatatctctgtttttattatcatataaaacaataaaatatttatc

SEQ ID NO: 11228 - DNA, 60 bp, Xenorhabdus bovienii
  Promoter sequence Name=Xb4151_4152.C426.promoter8; Position on contig= 8195..8254bp; Strand=+
taaatgtaattttttttttttagaaaaccatggttggttttattttttatcattatcttt

SEQ ID NO: 11229 - DNA, 60 bp, Xenorhabdus bovienii
  Promoter sequence Name=Xb4151_4152.C426.promoter9; Position on contig= 8645..8704bp; Strand=+
gcttttttattattgtgtgattgaacaccatagcaaaccttctttcttattatttttcat

SEQ ID NO: 11230 - DNA, 60 bp, Xenorhabdus bovienii; identical to SEQ ID NO: 11022
  Promoter sequence Name=Xb4151_4152.C426.promoter10; Position on contig=9674..9733bp; Strand=+

SEQ ID NO: 11231 - DNA, 60 bp, Xenorhabdus bovienii
  Promoter sequence Name=Xb4151_4152.C426.promoter11; Position on contig=10481..10540bp; Strand=-
aacgagtcttggatatttaattgcttgtaataccttgaaatgaatatcaaaatgcttgtt

SEQ ID NO: 11232 - DNA, 60 bp, Xenorhabdus bovienii; identical to SEQ ID NO: 10698
  Promoter sequence Name=Xb4151_4152.C426.promoter12; Position on contig=10284..10343bp; Strand=+

SEQ ID NO: 11233 - DNA, 60 bp, Xenorhabdus bovienii
  Promoter sequence Name=Xb4151_4152.C426.promoter13; Position on contig=12876..12935bp; Strand=-
atgccgccaagaataccggatcacgtattcatcccgttgtttctcacgtataatgagggt

SEQ ID NO: 11234 - DNA, 60 bp, Xenorhabdus bovienii
  Promoter sequence Name=Xb4151_4152.C426.promoter14; Position on contig=12558..12617bp; Strand=+
aggggtatccagcggcagcgtggttacacatcgcggcgcgcgttttttaaagtgcgtaca

SEQ ID NO: 11235 - DNA, 60 bp, Xenorhabdus bovienii
  Promoter sequence Name=Xb4151_4152.C426.promoter15; Position on contig=13398..13457bp; Strand=-
agatacctagtaggacgctaaaattcataatatgtaaccttaagagttaaaatttgctaa

SEQ ID NO: 11236 - DNA, 60 bp, Xenorhabdus bovienii
  Promoter sequence Name=Xb4151_4152.C426.promoter16; Position on contig=14531..14590bp; Strand=+
ctttggcagcaaatcttgcgtcatccacgcataaaaaacatcggcattaatattctcggt

SEQ ID NO: 11237 - DNA, 60 bp, Xenorhabdus bovienii
  Promoter sequence Name=Xb4151_4152.C426.promoter17; Position on contig=15167..15226bp; Strand=-
gctgagatttaacggcaggtatatatagttaaatcatattaatatgacataatatctaac

SEQ ID NO: 11238 - DNA, 60 bp, Xenorhabdus bovienii
  Promoter sequence Name=Xb4151_4152.C426.promoter18; Position on contig=21606..21665bp; Strand=-
ttcgaatatcaggggctgcattgtaacagaagaattgctttttcaggcataatagccgat

SEQ ID NO: 11239 - DNA, 60 bp, Xenorhabdus bovienii
  Promoter sequence Name=Xb4151_4152.C426.promoter19; Position on contig=21295..21354bp; Strand=+
agcgggccgaactactggctttataaccgctatctacccgttcagccaaaaataattgta

SEQ ID NO: 11240 - DNA, 60 bp, Xenorhabdus bovienii
  Promoter sequence Name=Xb4151_4152.C426.promoter20; Position on contig=22999..23058bp; Strand=-
atcttgattcaactgtcatgaatgatgaaaagcagcccagaatcgttgataattcccttt

SEQ ID NO: 11241 - DNA, 60 bp, Xenorhabdus bovienii
  Promoter sequence Name=Xb4151_4152.C426.promoter21; Position on contig=22735..22794bp; Strand=+
ctccagcaaacggacgaaaagctgcttatcatcatcattcaatgagtcatattcatattc

SEQ ID NO: 11242 - DNA, 60 bp, Xenorhabdus bovienii
  Promoter sequence Name=Xb4151_4152.C426.promoter22; Position on contig=26532..26591bp; Strand=-
tcgcataaattcttcattattttcattaaataattttccaaaaatttaaaaataaattga

SEQ ID NO: 11243 - DNA, 60 bp, Xenorhabdus bovienii
  Promoter sequence Name=Xb4151_4152.C426.promoter23; Position on contig=26840..26899bp; Strand=-
tggaagatcgctatttttgagtcaattgattattttgaaaacttcaatatcattaatctt

SEQ ID NO: 11244 - DNA, 60 bp, Xenorhabdus bovienii
  Promoter sequence Name=Xb4151_4152.C426.promoter24; Position on contig=26628..26687bp; Strand=+
gaacaattatgtctatgattgaagtgattttctaactatagaagaaataaaatttcatcc

SEQ ID NO: 11245 - DNA, 60 bp, Xenorhabdus bovienii
  Promoter sequence Name=Xb4151_4152.C426.promoter25; Position on contig=31785..31844bp; Strand=-
taggactgaagtgtgttcagttgatttacttcacactttagtctttttctaataaaaaaa

SEQ ID NO: 11246 - DNA, 60 bp, Xenorhabdus bovienii
  Promoter sequence Name=Xb4151_4152.C426.promoter26; Position on contig=31665..31724bp; Strand=+
taaaataaattagcagcattacagtaataacctgaaaaaacacttactatcatgcagaat

SEQ ID NO: 11247 - DNA, 60 bp, Xenorhabdus bovienii
  Promoter sequence Name=Xb4151_4152.C426.promoter27; Position on contig=36421..36480bp; Strand=-
ttattactgtgccgataccttgattctggcataaaagcagattttggtattaaaacaagg

SEQ ID NO: 11248 - DNA, 60 bp, Xenorhabdus bovienii
  Promoter sequence Name=Xb4151_4152.C426.promoter28; Position on contig=36029..36088bp; Strand=+
agattaaaaacaaaatcactatcatcaagtgattcaaaggtcgtttcgtataatgccctg

SEQ ID NO: 11249 - DNA, 60 bp, Xenorhabdus bovienii
  Promoter sequence Name=Xb4151_4152.C426.promoter29; Position on contig=37199..37258bp; Strand=-
tcggagagataaaaaaggatctgattgcatgaaacctgcctattaaaatgcagaaaagga

SEQ ID NO: 11250 - DNA, 60 bp, Xenorhabdus bovienii
  Promoter sequence Name=Xb4151_4152.C426.promoter30; Position on contig=36945..37004bp; Strand=+
ataggttcttgacggatgaattcttaactaattggttttaagcgctacaaaatttctctg

SEQ ID NO: 11251 - DNA, 60 bp, Xenorhabdus bovienii
  Promoter sequence Name=Xb4151_4152.C426.promoter31; Position on contig=39340..39399bp; Strand=-
ggcagaataatctgcccttaaaatatttccatgttttttaaaaaaattaaaatttagtga

SEQ ID NO: 11252 - DNA, 60 bp, Xenorhabdus bovienii
  Promoter sequence Name=Xb4151_4152.C426.promoter32; Position on contig=40109..40168bp; Strand=-
cacagcactatgccatattttttcgccgggtgaggcaaaatattgtttatactggtggcc

SEQ ID NO: 11253 - DNA, 60 bp, Xenorhabdus bovienii
  Promoter sequence Name=Xb4151_4152.C426.promoter33; Position on contig=41910..41969bp; Strand=-
tttatagatagtgtgctaatgtttctggaaagcgctttgtcttactgtaaactgtaaaaa

SEQ ID NO: 11254 - DNA, 60 bp, Xenorhabdus bovienii
  Promoter sequence Name=Xb4151_4152.C426.promoter34; Position on contig=41629..41688bp; Strand=+
attggtttttaagaaatcaaaatattttgcgacgcgttcatccactttttgctttgcgtc

SEQ ID NO: 11255 - DNA, 60 bp, Xenorhabdus bovienii
  Promoter sequence Name=Xb4151_4152.C426.promoter35; Position on contig=42704..42763bp; Strand=-
gctttccttttccatcatgctgatatttgactatattattgatatttattattaaattat

SEQ ID NO: 11256 - DNA, 60 bp, Xenorhabdus bovienii
  Promoter sequence Name=Xb4151_4152.C426.promoter36; Position on contig=42463..42522bp; Strand=+
atgtcgctggtggcacataacgttgcgctcattaaatgaaactgttttctacttccctgc

SEQ ID NO: 11257 - DNA, 60 bp, Xenorhabdus bovienii
  Promoter sequence Name=Xb4151_4152.C426.promoter37; Position on contig=43803..43862bp; Strand=-
ttcaaccaaagagggttttttgacataatcgatactccatcacttttgtatgttgtatta

SEQ ID NO: 11258 - DNA, 60 bp, Xenorhabdus bovienii
  Promoter sequence Name=Xb4151_4152.C426.promoter38; Position on contig=44276..44335bp; Strand=-
tgtgtcagtttgtggactgtctctgaggtgagagcagcagaaatgtttaaaatccagatg

SEQ ID NO: 11259 - DNA, 60 bp, Xenorhabdus bovienii
  Promoter sequence Name=Xb4151_4152.C426.promoter39; Position on contig=44071..44130bp; Strand=+
aattgccattggcgctcactgcctttgatgcccgccagcgctgaagttattttatccaat

SEQ ID NO: 11260 - DNA, 60 bp, Xenorhabdus bovienii
  Promoter sequence Name=Xb4151_4152.C426.promoter40; Position on contig=47182..47241bp; Strand=-
gtgtataaaactgtaatactctctttgtgtctcgttatccaacattttatcatggcataa

SEQ ID NO: 11261 - DNA, 60 bp, Xenorhabdus bovienii
  Promoter sequence Name=Xb4151_4152.C426.promoter41; Position on contig=47106..47165bp; Strand=+
aggattatgtcgagctttgggcgcttagcataccaaattttgaatggcatgttaattcat

SEQ ID NO: 11262 - DNA, 60 bp, Xenorhabdus bovienii
  Promoter sequence Name=Xb4151_4152.C426.promoter42; Position on contig=53843..53902bp; Strand=-
ctcaggggcgtcattgacaattaaaactcccggatgggggtaggttttataatcttagct

SEQ ID NO: 11263 - DNA, 60 bp, Xenorhabdus bovienii
  Promoter sequence Name=Xb4151_4152.C426.promoter43; Position on contig=53605..53664bp; Strand=+
atcgcctgtaaccaatcgcgagtttcgatcggatccacgtcatttttcaaaatatctgac

SEQ ID NO: 11264 - DNA, 60 bp, Xenorhabdus bovienii
  Promoter sequence Name=Xb4151_4152.C426.promoter44; Position on contig=54876..54935bp; Strand=-
aaatcccttttggttacgattttctgataaaatttaaaataatttgttaaaatttgcagg

SEQ ID NO: 11265 - DNA, 60 bp, Xenorhabdus bovienii
  Promoter sequence Name=Xb4151_4152.C426.promoter45; Position on contig=55387..55446bp; Strand=-
aagtaattagatgaatgatattccatgataattgttttctatatatttagaatatataac

SEQ ID NO: 11266 - DNA, 60 bp, Xenorhabdus bovienii
  Promoter sequence Name=Xb4151_4152.C426.promoter46; Position on contig=55195..55254bp; Strand=+
gctacattaatattgataatactaatatagataattcctgaatagttaaaatattcccta

SEQ ID NO: 11267 - DNA, 60 bp, Xenorhabdus bovienii
  Promoter sequence Name=Xb4151_4152.C426.promoter47; Position on contig=57123..57182bp; Strand=-
acatgttaacctgttacactttgagtggtgccattccacttggttgggaatattgctgtt

SEQ ID NO: 11268 - DNA, 60 bp, Xenorhabdus bovienii
  Promoter sequence Name=Xb4151_4152.C426.promoter48; Position on contig=56923..56982bp; Strand=+
atctgaattcagcgttcccataaatagctgatcgatataaggcccgccaaacttgccggg

SEQ ID NO: 11269 - DNA, 60 bp, Xenorhabdus bovienii
  Promoter sequence Name=Xb4151_4152.C426.promoter49; Position on contig=57516..57575bp; Strand=-; Gene name=HofG
tcaaaacgacaaagttcaacgccagatttataaggcacaatagtttgtagcatatcggtt

SEQ ID NO: 11270 - DNA, 60 bp, Xenorhabdus bovienii
  Promoter sequence Name=Xb4151_4152.C426.promoter50; Position on contig=57224..57283bp; Strand=+; Gene name=HofG
ttgcgaaccagctcgaaaattcctctgtaaaaaatgtaacgaatagttattttttcgagc

SEQ ID NO: 11271 - DNA, 60 bp, Xenorhabdus bovienii
  Promoter sequence Name=Xb4151_4152.C426.promoter51; Position on contig=57837..57896bp; Strand=+; Gene name=GspE
ttaaaaccactctattttcaaacatattatttcgaaaaataagattttaaaattgcttca

SEQ ID NO: 11272 - DNA, 60 bp, Xenorhabdus bovienii
  Promoter sequence Name=Xb4151_4152.C426.promoter52; Position on contig=60694..60753bp; Strand=+; Gene name=CoaE
caggaattatacccgtttgtttatagcccatagaactcccttgagttacaatttaaatat

SEQ ID NO: 11273 - DNA, 60 bp, Xenorhabdus bovienii
  Promoter sequence Name=Xb4151_4152.C426.promoter53; Position on contig=62952..63011bp; Strand=+; Gene name=Uup
taatcacgtcttattgctttttgccaagattcacccaaataaaagcgtattatgtggaca

SEQ ID NO: 11274 - DNA, 60 bp, Xenorhabdus bovienii
  Promoter sequence Name=Xb4151_4152.C426.promoter54; Position on contig=68272..68331bp; Strand=-
taaactgagcatggcacggttgagtttcaaaagtgcaatagcatgttgttgaatgatttg

SEQ ID NO: 11275 - DNA, 60 bp, Xenorhabdus bovienii
  Promoter sequence Name=Xb4151_4152.C426.promoter55; Position on contig=68105..68164bp; Strand=+
aaaggtgagaccaaaaataacgcctaccaaattgtcgccaaagatttaaaatactcattc

SEQ ID NO: 11276 - DNA, 60 bp, Xenorhabdus bovienii
  Promoter sequence Name=Xb4151_4152.C427.promoter1; Position on contig= 3060..3119bp; Strand=-; Gene name=Tag
attgaacttatattaactgtataaatatacaagtaaagaggctcggataagattttttta

SEQ ID NO: 11277 - DNA, 60 bp, Xenorhabdus bovienii
  Promoter sequence Name=Xb4151_4152.C427.promoter2; Position on contig= 3058..3117bp; Strand=+; Gene name=Tag
tataaaaaaatcttatccgagcctctttacttgtatatttatacagttaatataagttca

SEQ ID NO: 11278 - DNA, 60 bp, Xenorhabdus bovienii
  Promoter sequence Name=Xb4151_4152.C427.promoter3; Position on contig= 3783..3842bp; Strand=+; Gene name=AvtA
aaagacccagtgtttaaattcaatgaatattcaatgaatcatcatattataatatataac

SEQ ID NO: 11279 - DNA, 60 bp, Xenorhabdus bovienii
  Promoter sequence Name=Xb4151_4152.C427.promoter4; Position on contig= 5515..5574bp; Strand=+
atttttaaacatcacatcgcctagaaaataatcgccaatatttgaggtaacataatcatc

SEQ ID NO: 11280 - DNA, 60 bp, Xenorhabdus bovienii
  Promoter sequence Name=Xb4151_4152.C427.promoter5; Position on contig= 6713..6772bp; Strand=+
aagttttcaaaatagtagatcacttgaagggaactcagcccggtttttgcgatctgatta

SEQ ID NO: 11281 - DNA, 60 bp, Xenorhabdus bovienii
  Promoter sequence Name=Xb4151_4152.C427.promoter6; Position on contig= 8123..8182bp; Strand=-; Gene name=AraJ
ctcaattcaaacataatcaatcatcatgcctcacaggcgttgctgaatacaatagatcag

SEQ ID NO: 11282 - DNA, 60 bp, Xenorhabdus bovienii
  Promoter sequence Name=Xb4151_4152.C427.promoter7; Position on contig= 9573..9632bp; Strand=-
tcacatttttgggaacatgtcacccgtttgtcttgatctaactgatttataattgcttcc

SEQ ID NO: 11283 - DNA, 60 bp, Xenorhabdus bovienii
  Promoter sequence Name=Xb4151_4152.C427.promoter8; Position on contig= 9605..9664bp; Strand=+
aacgggtgacatgttcccaaaaatgtgaagataatggacaaaaaagctattttttctgga

SEQ ID NO: 11284 - DNA, 60 bp, Xenorhabdus bovienii
  Promoter sequence Name=Xb4151_4152.C427.promoter9; Position on contig= 14018..14077bp; Strand=-
gtacacataaaggcaacgttcgatttgtcaggaatatggacgatcattagaactaattag

SEQ ID NO: 11285 - DNA, 60 bp, Xenorhabdus bovienii
  Promoter sequence Name=Xb4151_4152.C427.promoter10; Position on contig=14038..14097bp; Strand=+
tccatattcctgacaaatcgaacgttgcctttatgtgtacagatctgtactatttgttgc

SEQ ID NO: 11286 - DNA, 60 bp, Xenorhabdus bovienii
  Promoter sequence Name=Xb4151_4152.C427.promoter11; Position on contig=15657..15716bp; Strand=+; Gene name=EntF
gccaggactgattcaaaaagtcattacctgatatccggtcaggtaagcaaatttttattt

SEQ ID NO: 11287 - DNA, 60 bp, Xenorhabdus bovienii
  Promoter sequence Name=Xb4151_4152.C427.promoter12; Position on contig=27552..27611bp; Strand=+; Gene name=SpoVK (BS)
gtaataaataatctatttatcttcattctgatataaatgaaaccacataaaaagcaaaat

SEQ ID NO: 11288 - DNA, 60 bp, Xenorhabdus bovienii
  Promoter sequence Name=Xb4151_4152.C427.promoter13; Position on contig=30225..30284bp; Strand=+; Gene name=LysR
atattattgttacatcagtaatgagatcgttatgctgaatagctgcgtaaaataatgtat

SEQ ID NO: 11289 - DNA, 60 bp, Xenorhabdus bovienii
  Promoter sequence Name=Xb4151_4152.C427.promoter14; Position on contig=30756..30815bp; Strand=+
aatttccactaataatcggattaaaaaagaaacacaacatgcctttttattttaaagaaa

SEQ ID NO: 11290 - DNA, 60 bp, Xenorhabdus bovienii
  Promoter sequence Name=Xb4151_4152.C427.promoter15; Position on contig=32041..32100bp; Strand=-
gcgatagcaccagatcctacaacaatcacatcataattcatcggttctatcctcttcaca

SEQ ID NO: 11291 - DNA, 60 bp, Xenorhabdus bovienii
  Promoter sequence Name=Xb4151_4152.C427.promoter16; Position on contig=31933..31992bp; Strand=+
acataacgaaagcattttccataacttagctgtcagcaaatcatctctaatctgtcccta

SEQ ID NO: 11292 - DNA, 60 bp, Xenorhabdus bovienii
  Promoter sequence Name=Xb4151_4152.C427.promoter17; Position on contig=33730..33789bp; Strand=+
tttaaaataaaacagattgtgattaaaacaccgttttattattaatctacaatataaaaa

SEQ ID NO: 11293 - DNA, 60 bp, Xenorhabdus bovienii
  Promoter sequence Name=Xb4151_4152.C427.promoter18; Position on contig=34747..34806bp; Strand=-
aacaaatcctttatcttgtagtgttgcatctggatgattacgacttttagcatgatcttc

SEQ ID NO: 11294 - DNA, 60 bp, Xenorhabdus bovienii; identical to SEQ ID NO: 10698
  Promoter sequence Name=Xb4151_4152.C427.promoter19; Position on contig=34562..34621bp; Strand=+

SEQ ID NO: 11295 - DNA, 60 bp, Xenorhabdus bovienii
  Promoter sequence Name=Xb4151_4152.C427.promoter20; Position on contig=36525..36584bp; Strand=-
attccacctaacaataatccactggagctcaataattaatcaacgattaaaatgaaagtc

SEQ ID NO: 11296 - DNA, 60 bp, Xenorhabdus bovienii
  Promoter sequence Name=Xb4151_4152.C427.promoter21; Position on contig=40332..40391bp; Strand=-
ggctgttgacgttttgtgaagggaatttgaacagcatgatgattgggtataatcgttttc

SEQ ID NO: 11297 - DNA, 60 bp, Xenorhabdus bovienii
  Promoter sequence Name=Xb4151_4152.C427.promoter22; Position on contig=40263..40322bp; Strand=+
tagcttatcccattgtgtatctgttaacatagtttgcagcataatggtaaagttgagtta

SEQ ID NO: 11298 - DNA, 60 bp, Xenorhabdus bovienii
  Promoter sequence Name=Xb4151_4152.C427.promoter23; Position on contig=42437..42496bp; Strand=-
cgcgaatcgaataggattcttgctccatatgaatctcatttacatgtcattctaaataaa

SEQ ID NO: 11299 - DNA, 60 bp, Xenorhabdus bovienii
  Promoter sequence Name=Xb4151_4152.C427.promoter24; Position on contig=43589..43648bp; Strand=-
tgcgaacgacagctttaaatttatcggatataaatatcattatatttcataataatagat

SEQ ID NO: 11300 - DNA, 60 bp, Xenorhabdus bovienii
  Promoter sequence Name=Xb4151_4152.C427.promoter25; Position on contig=44878..44937bp; Strand=-
cgcagtcgaaaaacgttagacaagctgcttaccctcttatcttcctttactattcggttt

SEQ ID NO: 11301 - DNA, 60 bp, Xenorhabdus bovienii
  Promoter sequence Name=Xb4151_4152.C427.promoter26; Position on contig=45383..45442bp; Strand=-; Gene name=ThiJ
ttatatatcaccaccaatatttggtcatgtattaaatggttagttgctgtgatatgcttc

SEQ ID NO: 11302 - DNA, 60 bp, Xenorhabdus bovienii
  Promoter sequence Name=Xb4151_4152.C427.promoter27; Position on contig=45386..45445bp; Strand=+; Gene name=ThiJ
gcatatcacagcaactaaccatttaatacatgaccaaatattggtggtgatatataaaag

SEQ ID NO: 11303 - DNA, 60 bp, Xenorhabdus bovienii
  Promoter sequence Name=Xb4151_4152.C427.promoter28; Position on contig=47977..48036bp; Strand=-
agaataaattctgtgcgttggcttaaaaccttttgctgtaaatttgttaatatttcgttt

SEQ ID NO: 11304 - DNA, 60 bp, Xenorhabdus bovienii
  Promoter sequence Name=Xb4151_4152.C427.promoter29; Position on contig=49881..49940bp; Strand=-; Gene name=ProP
tatatttatccactgaataatcattcaatttagttaatctatatttcttaaaatctatat

SEQ ID NO: 11305 - DNA, 60 bp, Xenorhabdus bovienii
  Promoter sequence Name=Xb4151_4152.C427.promoter30; Position on contig=50782..50841bp; Strand=+; Gene name=ProP
ttctgtcggcgaaagaatcggtttccttgatatatagtttatataactattattagttaa

SEQ ID NO: 11306 - DNA, 60 bp, Xenorhabdus bovienii
  Promoter sequence Name=Xb4151_4152.C427.promoter31; Position on contig=53302..53361bp; Strand=+
ctacgataggcgtagtaatttatctattgccaaccatcgtggctaaataaaatacgggtt

SEQ ID NO: 11307 - DNA, 60 bp, Xenorhabdus bovienii
  Promoter sequence Name=Xb4151_4152.C428.promoter1; Position on contig= 4897..4956bp; Strand=+
aaaatttacttttgcatctttgacgatcaatgtctcccacgccagatctaaaatacgacg

SEQ ID NO: 11308 - DNA, 60 bp, Xenorhabdus bovienii; identical to SEQ ID NO: 10627
  Promoter sequence Name=Xb4151_4152.C428.promoter2; Position on contig= 7024..7083bp; Strand=-

SEQ ID NO: 11309 - DNA, 60 bp, Xenorhabdus bovienii
  Promoter sequence Name=Xb4151_4152.C428.promoter3; Position on contig= 6798..6857bp; Strand=+
gtttttgcataacgagatgaaatctcccgcctcctgccgcgttgctttatattcaggcaa

SEQ ID NO: 11310 - DNA, 60 bp, Xenorhabdus bovienii
  Promoter sequence Name=Xb4151_4152.C428.promoter4; Position on contig= 8010..8069bp; Strand=-
ttgttggtcaaggaaagtatcgatgacagattgggaaatgtgagcgttataacggccttt

SEQ ID NO: 11311 - DNA, 60 bp, Xenorhabdus bovienii
  Promoter sequence Name=Xb4151_4152.C428.promoter5; Position on contig= 7901..7960bp; Strand=+
acattgtgtccaaattcagcatcagacaggatactccttttcgtcgtatcctgtctgaac

SEQ ID NO: 11312 - DNA, 60 bp, Xenorhabdus bovienii
  Promoter sequence Name=Xb4151_4152.C428.promoter6; Position on contig= 8837..8896bp; Strand=+
gtttctatatctaatatgtttcaaattgtagggtataaattcgtcgttattttatttatt

SEQ ID NO: 11313 - DNA, 60 bp, Xenorhabdus bovienii
  Promoter sequence Name=Xb4151_4152.C428.promoter7; Position on contig= 9079..9138bp; Strand=+
gattttctgacgaagtaatatccgttcctatacttatttaaatgatggataataaaaatc

SEQ ID NO: 11314 - DNA, 60 bp, Xenorhabdus bovienii
  Promoter sequence Name=Xb4151_4152.C428.promoter8; Position on contig= 20138..20197bp; Strand=-; Gene name=MalT
aaataaatattaacactaagttatatgcaatttaaatataaattaatttttaaaataacc

SEQ ID NO: 11315 - DNA, 60 bp, Xenorhabdus bovienii
  Promoter sequence Name=Xb4151_4152.C428.promoter9; Position on contig= 23248..23307bp; Strand=-
cctacggggatattcacagggaggagtgcaagggcgtagccattggctgtaattaaataa

SEQ ID NO: 11316 - DNA, 60 bp, Xenorhabdus bovienii
  Promoter sequence Name=Xb4151_4152.C428.promoter10; Position on contig=30513..30572bp; Strand=-; Gene name=MalE
tttatacccaatagatttcaagttgccgctttgttggcggcaatttgaaagatgaatggt

SEQ ID NO: 11317 - DNA, 60 bp, Xenorhabdus bovienii
  Promoter sequence Name=Xb4151_4152.C428.promoter11; Position on contig=35726..35785bp; Strand=-; Gene name=CDA1
atgtggaatatgaattattgaatgatatgtagttatccttttggaattacaatatatttt

SEQ ID NO: 11318 - DNA, 60 bp, Xenorhabdus bovienii
  Promoter sequence Name=Xb4151_4152.C428.promoter12; Position on contig=37107..37166bp; Strand=-; Gene name=RpoC
tcatgatgtatagaatcatcttctatacacatcgctaatcataaaatgccctctcttggt

SEQ ID NO: 11319 - DNA, 60 bp, Xenorhabdus bovienii
  Promoter sequence Name=Xb4151_4152.C428.promoter13; Position on contig=41146..41205bp; Strand=+
tcacaccacggtgtttcaaacgcttgtatttaccacacaagcattcgtaatcttttactg

SEQ ID NO: 11320 - DNA, 60 bp, Xenorhabdus bovienii
  Promoter sequence Name=Xb4151_4152.C428.promoter14; Position on contig=45829..45888bp; Strand=-; Gene name=RplL
cagttttaagtttgcagcctgactttaaaggctgatggctggcgatttttaatcgccagc

SEQ ID NO: 11321 - DNA, 60 bp, Xenorhabdus bovienii
  Promoter sequence Name=Xb4151_4152.C428.promoter15; Position on contig=47054..47113bp; Strand=-
gtctaaaatctgacgcttaaaatttgccttatattgtatataacaactaatataagtcgt

SEQ ID NO: 11322 - DNA, 60 bp, Xenorhabdus bovienii
  Promoter sequence Name=Xb4151_4152.C428.promoter16; Position on contig=46772..46831bp; Strand=+
ctgacttcagcaacaatcgcttgtttgtcttgaagatttagtgccattagcttcttgctc

SEQ ID NO: 11323 - DNA, 60 bp, Xenorhabdus bovienii
  Promoter sequence Name=Xb4151_4152.C428.promoter17; Position on contig=48381..48440bp; Strand=-
gcctggcttgcaaagggtgtgaaattatcatacaatttcgcgccttttatttttaagtat

SEQ ID NO: 11324 - DNA, 60 bp, Xenorhabdus bovienii
  Promoter sequence Name=Xb4151_4152.C428.promoter18; Position on contig=48136..48195bp; Strand=+
cctttttcaatgctttcagttttcgcattgaacgctttacagaattccatgatgttaaca

SEQ ID NO: 11325 - DNA, 60 bp, Xenorhabdus bovienii
  Promoter sequence Name=Xb4151_4152.C428.promoter19; Position on contig=53924..53983bp; Strand=+
aacacggcatactttacgcaatgctgagtttggttttttaggggtggtagtatatacacg

SEQ ID NO: 11326 - DNA, 60 bp, Xenorhabdus bovienii
  Promoter sequence Name=Xb4151_4152.C428.promoter20; Position on contig=56120..56179bp; Strand=-
ttctgttaagttgcattaatgtgattttataataaatctcgccctgatattttcggtgag

SEQ ID NO: 11327 - DNA, 60 bp, Xenorhabdus bovienii
  Promoter sequence Name=Xb4151_4152.C428.promoter21; Position on contig=55954..56013bp; Strand=+
ccaccaatcagcatagccaaaccatcaacagcagcttcgtaagattttaaaatttcatga

SEQ ID NO: 11328 - DNA, 60 bp, Xenorhabdus bovienii
  Promoter sequence Name=Xb4151_4152.C428.promoter22; Position on contig=56317..56376bp; Strand=-
ccatgacgacagaaaaataattttagctatttattattttttaacggtattaaatgaaat

SEQ ID NO: 11329 - DNA, 60 bp, Xenorhabdus bovienii
  Promoter sequence Name=Xb4151_4152.C428.promoter23; Position on contig=57340..57399bp; Strand=-
atactcaaaacattctataaaagagggttgccatgaaacctttttgttttaatggttctg

SEQ ID NO: 11330 - DNA, 60 bp, Xenorhabdus bovienii
  Promoter sequence Name=Xb4151_4152.C428.promoter24; Position on contig=57187..57246bp; Strand=+
cgccagtgacgctgccaataaagttgtttttaacaatgatttcatcctattctccaatca

SEQ ID NO: 11331 - DNA, 60 bp, Xenorhabdus bovienii
  Promoter sequence Name=Xb4151_4152.C428.promoter25; Position on contig=58395..58454bp; Strand=-
aacaaataatggataaattttgctgtcgctaggtacagataagtagaattccgttacaat

SEQ ID NO: 11332 - DNA, 60 bp, Xenorhabdus bovienii
  Promoter sequence Name=Xb4151_4152.C428.promoter26; Position on contig=61128..61187bp; Strand=-; Gene name=Uup
gcagagatgagaaaacaatcatagaggttgtctgttatagagtatgttaagttaataatt

SEQ ID NO: 11333 - DNA, 60 bp, Xenorhabdus bovienii
  Promoter sequence Name=Xb4151_4152.C428.promoter27; Position on contig=64175..64234bp; Strand=-
taaaagtgaaaccagagatagaaatgtggatcaaacagttaatttggtaagatttaagtc

SEQ ID NO: 11334 - DNA, 60 bp, Xenorhabdus bovienii
  Promoter sequence Name=Xb4151_4152.C428.promoter28; Position on contig=64469..64528bp; Strand=-; Gene name=LysR
ttggattcgcataataagtgcaatttctaagaaaggcggtcagttgctatagtaggcatc

SEQ ID NO: 11335 - DNA, 60 bp, Xenorhabdus bovienii
  Promoter sequence Name=Xb4151_4152.C428.promoter29; Position on contig=65472..65531bp; Strand=-
cattttgaccagttgtcctgataaaacctttagcaaaacgctaagttaaaatgctatcac

SEQ ID NO: 11336 - DNA, 60 bp, Xenorhabdus bovienii
  Promoter sequence Name=Xb4151_4152.C428.promoter30; Position on contig=65139..65198bp; Strand=+
taaatgcctgataatatcttcctttgaatcaaaatgaactctgcttttaaactgctcata

SEQ ID NO: 11337 - DNA, 60 bp, Xenorhabdus bovienii
  Promoter sequence Name=Xb4151_4152.C428.promoter31; Position on contig=65806..65865bp; Strand=+
ccacattatggaataccaaatccattaaaagtaaaatatcatactactaaactattgtgt

SEQ ID NO: 11338 - DNA, 60 bp, Xenorhabdus bovienii
  Promoter sequence Name=Xb4151_4152.C428.promoter32; Position on contig=66663..66722bp; Strand=-
tgaatatgctattcatggggagcatgattatcgtactggatttaatataaaattcattgg

SEQ ID NO: 11339 - DNA, 60 bp, Xenorhabdus bovienii
  Promoter sequence Name=Xb4151_4152.C428.promoter33; Position on contig=66452..66511bp; Strand=+
cgtctttccggtaaggtgatcttcctcaggaaggcggccatacaccctataatcatccgt

SEQ ID NO: 11340 - DNA, 60 bp, Xenorhabdus bovienii
  Promoter sequence Name=Xb4151_4152.C428.promoter34; Position on contig=70017..70076bp; Strand=-
caaaccagtaggacttctccccgttcaagctgacgttttacatcctgtactttttgctcc

SEQ ID NO: 11341 - DNA, 60 bp, Xenorhabdus bovienii
  Promoter sequence Name=Xb4151_4152.C428.promoter35; Position on contig=69723..69782bp; Strand=+
tatcagacttgcggtcatggggggattgttcctcttacccaaatggttaacatttccttt

SEQ ID NO: 11342 - DNA, 60 bp, Xenorhabdus bovienii
  Promoter sequence Name=Xb4151_4152.C428.promoter36; Position on contig=71505..71564bp; Strand=-
tgctgaaaaactgacaagcgggaattttatatagattataatcataccaaaatatgggtg

SEQ ID NO: 11343 - DNA, 60 bp, Xenorhabdus bovienii
  Promoter sequence Name=Xb4151_4152.C428.promoter37; Position on contig=71724..71783bp; Strand=-; Gene name=Crp
aagcgtttctgctttctcgccttgatgaataagcgtgctcttggatggatatttgtgaat

SEQ ID NO: 11344 - DNA, 60 bp, Xenorhabdus bovienii
  Promoter sequence Name=Xb4151_4152.C428.promoter38; Position on contig=71521..71580bp; Strand=+; Gene name=Crp
tgattataatctatataaaattcccgcttgtcagtttttcagcaagttaatatgttaaac

SEQ ID NO: 11345 - DNA, 60 bp, Xenorhabdus bovienii
  Promoter sequence Name=Xb4151_4152.C428.promoter39; Position on contig=72517..72576bp; Strand=-; Gene name=PabA
catcgcattttcctcaccggctgttttttatttgcccttatgtgattttttattcatatt

SEQ ID NO: 11346 - DNA, 60 bp, Xenorhabdus bovienii
  Promoter sequence Name=Xb4151_4152.C428.promoter40; Position on contig=74081..74140bp; Strand=-
tactcgtaaatgtaggtaaatctttggaacttagttctatagggaattacacttaataag

SEQ ID NO: 11347 - DNA, 60 bp, Xenorhabdus bovienii
  Promoter sequence Name=Xb4151_4152.C428.promoter41; Position on contig=74131..74190bp; Strand=+
tttacgagtaagcagctatttgttgagatgaattctgtctgaatagctattatggtctca

SEQ ID NO: 11348 - DNA, 60 bp, Xenorhabdus bovienii
  Promoter sequence Name=Xb4151_4152.C429.promoter1; Position on contig= 5626..5685bp; Strand=-; Gene name=BaeS
tccataccctcacgtcataagtgtcacataagctaaaagaatatttttattctaagagta

SEQ ID NO: 11349 - DNA, 60 bp, Xenorhabdus bovienii
  Promoter sequence Name=Xb4151_4152.C429.promoter2; Position on contig= 7852..7911bp; Strand=+
acgtggcatcatgatatccagtagtagcagatcgattgaagaatcgatatattgtaatgc

SEQ ID NO: 11350 - DNA, 60 bp, Xenorhabdus bovienii
  Promoter sequence Name=Xb4151_4152.C429.promoter3; Position on contig= 8759..8818bp; Strand=+
gggcttttttttatctggcttgaaattaattctctttaaaaatcagctataaaaatttta

SEQ ID NO: 11351 - DNA, 60 bp, Xenorhabdus bovienii
  Promoter sequence Name=Xb4151_4152.C429.promoter4; Position on contig= 9930..9989bp; Strand=+
cccctattaatgccgtctattgggtcatgtattaaatagttagttgttatgataatcttc

SEQ ID NO: 11352 - DNA, 60 bp, Xenorhabdus bovienii
  Promoter sequence Name=Xb4151_4152.C429.promoter5; Position on contig= 10500..10559bp; Strand=-; Gene name=InsB
tatctttccagtaagatggacttcttcaggaagacaatcataaacggcataatcatccgt

SEQ ID NO: 11353 - DNA, 60 bp, Xenorhabdus bovienii
  Promoter sequence Name=Xb4151_4152.C429.promoter6; Position on contig= 10917..10976bp; Strand=+; Gene name=PlsC
tgggaataacgtgccctcagcccgttgttatcttgaccaatcttgattatcttaccttct

SEQ ID NO: 11354 - DNA, 60 bp, Xenorhabdus bovienii
  Promoter sequence Name=Xb4151_4152.C429.promoter7; Position on contig= 13685..13744bp; Strand=-; Gene name=PfkA
acttgtagatgtaatatttaccaatctgctgactgatcccctgacgggaaaatttacggc

SEQ ID NO: 11355 - DNA, 60 bp, Xenorhabdus bovienii
  Promoter sequence Name=Xb4151_4152.C429.promoter8; Position on contig= 13577..13636bp; Strand=+; Gene name=PfkA
gcgtcagaaaataaacataatcttaatgcagactgggtgtttttccgtatcatagatgga

SEQ ID NO: 11356 - DNA, 60 bp, Xenorhabdus bovienii
  Promoter sequence Name=Xb4151_4152.C429.promoter9; Position on contig= 17089..17148bp; Strand=-
accgctcacagggtggtggggaccatcttgtatctttaatctggtttattatggttaagt

SEQ ID NO: 11357 - DNA, 60 bp, Xenorhabdus bovienii
  Promoter sequence Name=Xb4151_4152.C429.promoter10; Position on contig=16683..16742bp; Strand=+
gcaaagtcacgggcttgtcggggattgacgatagcaacagccagccctatggtctgtaaa

SEQ ID NO: 11358 - DNA, 60 bp, Xenorhabdus bovienii
  Promoter sequence Name=Xb4151_4152.C429.promoter11; Position on contig=19656..19715bp; Strand=-
ataaattcataacttaatataaggtcgcatttgcgaccttttttattcttaactgaaaac

SEQ ID NO: 11359 - DNA, 60 bp, Xenorhabdus bovienii
  Promoter sequence Name=Xb4151_4152.C429.promoter12; Position on contig=19710..19769bp; Strand=+
atttattacttatcgtacaatacgttcactggctatcttataggctttagagtcttctct

SEQ ID NO: 11360 - DNA, 60 bp, Xenorhabdus bovienii
  Promoter sequence Name=Xb4151_4152.C429.promoter13; Position on contig=20280..20339bp; Strand=-
ttacgaaaattttgtaaaactcattgcatcataggtgaagtaacatacaatgtaatacaa

SEQ ID NO: 11361 - DNA, 60 bp, Xenorhabdus bovienii
  Promoter sequence Name=Xb4151_4152.C429.promoter14; Position on contig=20317..20376bp; Strand=+
tgagttttacaaaattttcgtaaagccagccatccgtggcttggggttatactggtaaag

SEQ ID NO: 11362 - DNA, 60 bp, Xenorhabdus bovienii
  Promoter sequence Name=Xb4151_4152.C429.promoter15; Position on contig=21388..21447bp; Strand=-
agagaagccccaacgggcttttcttgtgattattttaagcaatcaactgttatgattacc

SEQ ID NO: 11363 - DNA, 60 bp, Xenorhabdus bovienii
  Promoter sequence Name=Xb4151_4152.C429.promoter16; Position on contig=21965..22024bp; Strand=-
ggacatccatcacacaaactctatctaagtaacctcagttgcgaggttagtttttttact

SEQ ID NO: 11364 - DNA, 60 bp, Xenorhabdus bovienii
  Promoter sequence Name=Xb4151_4152.C429.promoter17; Position on contig=21745..21804bp; Strand=+
aaatgtctttttttagagccttaccgacaaagctgtcgcggtagatatataagccagatt

SEQ ID NO: 11365 - DNA, 60 bp, Xenorhabdus bovienii
  Promoter sequence Name=Xb4151_4152.C429.promoter18; Position on contig=22480..22539bp; Strand=-
actcctctcacacttctgaaattgctgatcaaataatcagtaacacttatcattatctca

SEQ ID NO: 11366 - DNA, 60 bp, Xenorhabdus bovienii
  Promoter sequence Name=Xb4151_4152.C429.promoter19; Position on contig=22269..22328bp; Strand=+
tcaaatgtaaccaaacatgttttctcaatccctttatcctgatccattatgataatgtta

SEQ ID NO: 11367 - DNA, 60 bp, Xenorhabdus bovienii
  Promoter sequence Name=Xb4151_4152.C429.promoter20; Position on contig=23279..23338bp; Strand=-
ccggctctggggtcgtgtaggtcgtgacatcaatttattgaatcatgtatagtctgtcta

SEQ ID NO: 11368 - DNA, 60 bp, Xenorhabdus bovienii
  Promoter sequence Name=Xb4151_4152.C429.promoter21; Position on contig=22734..22793bp; Strand=+
cctgcgagtgctttttcgtaatttttccagccatctgtcatataaataataatgttgaaa

SEQ ID NO: 11369 - DNA, 60 bp, Xenorhabdus bovienii
  Promoter sequence Name=Xb4151_4152.C429.promoter22; Position on contig=24807..24866bp; Strand=-
attcgttcatctgacagccccaggttttgatatacagtttttttatcgtcgacattttat

SEQ ID NO: 11370 - DNA, 60 bp, Xenorhabdus bovienii
  Promoter sequence Name=Xb4151_4152.C429.promoter23; Position on contig=24285..24344bp; Strand=+
gcccaactctgtcagcccaagactttgaacatcgaaagtcacgttggaatcatgctgctc

SEQ ID NO: 11371 - DNA, 60 bp, Xenorhabdus bovienii
  Promoter sequence Name=Xb4151_4152.C429.promoter24; Position on contig=26575..26634bp; Strand=-; Gene name=PhoH
acaacaccccgcttggttctgatattcacagccttgccgtagtcaggaatactttctgcc

SEQ ID NO: 11372 - DNA, 60 bp, Xenorhabdus bovienii
  Promoter sequence Name=Xb4151_4152.C429.promoter25; Position on contig=30593..30652bp; Strand=-; Gene name=ArtI
tggcgtttacatttttgtagaaacgatttcctgaatctttttgtttatatgctgtaaaaa

SEQ ID NO: 11373 - DNA, 60 bp, Xenorhabdus bovienii
  Promoter sequence Name=Xb4151_4152.C429.promoter26; Position on contig=30367..30426bp; Strand=+; Gene name=ArtI
aatgcaataattcattacatttaccacaaatttaaccaaatacactttatattattctta

SEQ ID NO: 11374 - DNA, 60 bp, Xenorhabdus bovienii
  Promoter sequence Name=Xb4151_4152.C429.promoter27; Position on contig=31652..31711bp; Strand=+; Gene name=ArtM
tacctcattttttagcctgttcttttgagtcaatgagttaccactaatagaacgttttag

SEQ ID NO: 11375 - DNA, 60 bp, Xenorhabdus bovienii
  Promoter sequence Name=Xb4151_4152.C429.promoter28; Position on contig=34200..34259bp; Strand=-; Gene name=LeuS
gtgtagttacggacgtggcccatatgtagtcggccagaaggataaggtagcatggacagg

SEQ ID NO: 11376 - DNA, 60 bp, Xenorhabdus bovienii
  Promoter sequence Name=Xb4151_4152.C429.promoter29; Position on contig=33959..34018bp; Strand=+; Gene name=LeuS
cagcgatctcactttaacaagtgttgttgcccctatcccttatcagctatgctatgaggt

SEQ ID NO: 11377 - DNA, 60 bp, Xenorhabdus bovienii
  Promoter sequence Name=Xb4151_4152.C429.promoter30; Position on contig=43961..44020bp; Strand=+
caatcacctgctgatattcgacaattccgtcaatatcagcaggtggataaaaaaacaacc

SEQ ID NO: 11378 - DNA, 60 bp, Xenorhabdus bovienii
  Promoter sequence Name=Xb4151_4152.C429.promoter31; Position on contig=45739..45798bp; Strand=-
gtttcaccatgaattgtggcttttaaaatgccccgactggggcattaaatacttaatcaa

SEQ ID NO: 11379 - DNA, 60 bp, Xenorhabdus bovienii
  Promoter sequence Name=Xb4151_4152.C429.promoter32; Position on contig=45727..45786bp; Strand=+
gccacaacgtgattgattaagtatttaatgccccagtcggggcattttaaaagccacaat

SEQ ID NO: 11380 - DNA, 60 bp, Xenorhabdus bovienii
  Promoter sequence Name=Xb4151_4152.C429.promoter33; Position on contig=47491..47550bp; Strand=-
ttgagaatgctttaatgcactaatattgttaattagacgaatatatttaaattttatatt

SEQ ID NO: 11381 - DNA, 60 bp, Xenorhabdus bovienii
  Promoter sequence Name=Xb4151_4152.C429.promoter34; Position on contig=47286..47345bp; Strand=+
atccaatgagcaacgtatcaaaaaaggcaaacacacttttttctttataaaatagtgcaa

SEQ ID NO: 11382 - DNA, 60 bp, Xenorhabdus bovienii
  Promoter sequence Name=Xb4151_4152.C429.promoter35; Position on contig=48266..48325bp; Strand=+; Gene name=LipA
taacatttttcaaaaaaaattgaatggatttattgatctgatggctctgacatagggatt

SEQ ID NO: 11383 - DNA, 60 bp, Xenorhabdus bovienii
  Promoter sequence Name=Xb4151_4152.C429.promoter36; Position on contig=49923..49982bp; Strand=-
cacattttgttatatatttcgtgatctacgttacagacagtagactatattattgttgta

SEQ ID NO: 11384 - DNA, 60 bp, Xenorhabdus bovienii
  Promoter sequence Name=Xb4151_4152.C429.promoter37; Position on contig=49583..49642bp; Strand=+
tgagtaggttctaaatcaagttgaacttaaaaacataaaaaacccgttgtaataaacggg

SEQ ID NO: 11385 - DNA, 60 bp, Xenorhabdus bovienii
  Promoter sequence Name=Xb4151_4152.C429.promoter38; Position on contig=50742..50801bp; Strand=-
tgaaataaatacaatatacgttgtctttttttataaaagacactatatatagtatcttta

SEQ ID NO: 11386 - DNA, 60 bp, Xenorhabdus bovienii
  Promoter sequence Name=Xb4151_4152.C429.promoter39; Position on contig=50666..50725bp; Strand=+
ccctctgacaataaaaatcagaggattgccaatctaattgaacaccctatttttaatgag

SEQ ID NO: 11387 - DNA, 60 bp, Xenorhabdus bovienii
  Promoter sequence Name=Xb4151_4152.C429.promoter40; Position on contig=51449..51508bp; Strand=-; Gene name=ProV
ggttctggatgatctccgaatattttatatagatttctaacttcgagtttaattgtcatg

SEQ ID NO: 11388 - DNA, 60 bp, Xenorhabdus bovienii
  Promoter sequence Name=Xb4151_4152.C429.promoter41; Position on contig=51266..51325bp; Strand=+; Gene name=ProV
tcttaaaaaagattaaaaatcaaattgcagtcacaaacattacgccataataaatgtcta

SEQ ID NO: 11389 - DNA, 60 bp, Xenorhabdus bovienii
  Promoter sequence Name=Xb4151_4152.C429.promoter42; Position on contig=54860..54919bp; Strand=+; Gene name=AzlC (BS)
ctatcaaaaacacgggacttaataatattaattaaataatttatatattttatattttca

SEQ ID NO: 11390 - DNA, 60 bp, Xenorhabdus bovienii
  Promoter sequence Name=Xb4151_4152.C429.promoter43; Position on contig=57125..57184bp; Strand=-; Gene name=EmrK
acctgatttcctgtcacataggcattgtcggtttcctgatgatgacgtaaaacgaggaac

SEQ ID NO: 11391 - DNA, 60 bp, Xenorhabdus bovienii
  Promoter sequence Name=Xb4151_4152.C429.promoter44; Position on contig=56827..56886bp; Strand=+; Gene name=EmrK
tagcctgtatcatctgatacttcatatggctgactattatcctcagataatatttgaatc

SEQ ID NO: 11392 - DNA, 60 bp, Xenorhabdus bovienii
  Promoter sequence Name=Xb4151_4152.C429.promoter45; Position on contig=59889..59948bp; Strand=+
tttaacgcctttcaaatcaactttccgaatatcaagctcacccagtgtagaattggtcag

SEQ ID NO: 11393 - DNA, 60 bp, Xenorhabdus bovienii
  Promoter sequence Name=Xb4151_4152.C429.promoter46; Position on contig=60592..60651bp; Strand=-; Gene name=RimL
ctaatttatctaatgtataatgagatgattttataaaaatactattttattatgatttaa

SEQ ID NO: 11394 - DNA, 60 bp, Xenorhabdus bovienii
  Promoter sequence Name=Xb4151_4152.C429.promoter47; Position on contig=64707..64766bp; Strand=-
gttattataaaaataaaaagaatattaaataagataaattttccttttatttttagcatc

SEQ ID NO: 11395 - DNA, 60 bp, Xenorhabdus bovienii
  Promoter sequence Name=Xb4151_4152.C429.promoter48; Position on contig=65459..65518bp; Strand=+
gatagcgtttcatcaataatgagaattctttttcgctcgaccattgataaaattccatac

SEQ ID NO: 11396 - DNA, 60 bp, Xenorhabdus bovienii
  Promoter sequence Name=Xb4151_4152.C429.promoter49; Position on contig=73563..73622bp; Strand=+
aggattgtgccttaaaatggtattgaaatttatcaatttcaatcgagtaagatttatccg

SEQ ID NO: 11397 - DNA, 60 bp, Xenorhabdus bovienii
  Promoter sequence Name=Xb4151_4152.C429.promoter50; Position on contig=74106..74165bp; Strand=-; Gene name=SpoU
ttaaaaattttatgagatattttaccaatgtaattaaatataaaatttataatatcgttc

SEQ ID NO: 11398 - DNA, 60 bp, Xenorhabdus bovienii
  Promoter sequence Name=Xb4151_4152.C429.promoter51; Position on contig=75403..75462bp; Strand=-
acgggtagaacgggctagacgctgttggcgaagttgataaacggtgttgttatttctcat

SEQ ID NO: 11399 - DNA, 60 bp, Xenorhabdus bovienii
  Promoter sequence Name=Xb4151_4152.C429.promoter52; Position on contig=76309..76368bp; Strand=-
tcctagaatagctgttttatttggtgttacaggaagaattgggccagtaaaatgccccat

SEQ ID NO: 11400 - DNA, 60 bp, Xenorhabdus bovienii
  Promoter sequence Name=Xb4151_4152.C429.promoter53; Position on contig=76119..76178bp; Strand=+
atggtggctaaaattattcatagtaattgtttaatcaagggtgattgtttattgatgtga

SEQ ID NO: 11401 - DNA, 60 bp, Xenorhabdus bovienii
  Promoter sequence Name=Xb4151_4152.C429.promoter54; Position on contig=79200..79259bp; Strand=-; Gene name=Cls
ttgatatccagcttagggcgtttttgcttggcaatatacagagcatccataatatctcgc

SEQ ID NO: 11402 - DNA, 60 bp, Xenorhabdus bovienii
  Promoter sequence Name=Xb4151_4152.C429.promoter55; Position on contig=78882..78941bp; Strand=+; Gene name=Cls
tcaacacttgagagttaattcatactcacaattaaccaaactaatggtattatcgccaga

SEQ ID NO: 11403 - DNA, 60 bp, Xenorhabdus bovienii
  Promoter sequence Name=Xb4151_4152.C429.promoter56; Position on contig=80725..80784bp; Strand=-
aaacaaaatcctgccaactccagcctgttcctggtggtcgactatcataaaattctttcg

SEQ ID NO: 11404 - DNA, 60 bp, Xenorhabdus bovienii
  Promoter sequence Name=Xb4151_4152.C429.promoter57; Position on contig=80399..80458bp; Strand=+
cttgctatcgctagagggaattttttgtatcttatttatcaacaagctatgatttacaga

SEQ ID NO: 11405 - DNA, 60 bp, Xenorhabdus bovienii
  Promoter sequence Name=Xb4151_4152.C430.promoter1; Position on contig= 67..126bp; Strand=+
atatgtaatcggacaggtgtaaatcttaatgtggttttaagtctgatcaaaatataccca

SEQ ID NO: 11406 - DNA, 60 bp, Xenorhabdus bovienii
  Promoter sequence Name=Xb4151_4152.C430.promoter2; Position on contig= 965..1024bp; Strand=+
aaaatttaaataattaattttaattcaatttgccctaaactatttttccactaaataagt

SEQ ID NO: 11407 - DNA, 60 bp, Xenorhabdus bovienii
  Promoter sequence Name=Xb4151_4152.C430.promoter3; Position on contig= 1732..1791bp; Strand=+
caatagtattaaaaatattttcttctgtaagaaattatgagcaattttataattgtcata

SEQ ID NO: 11408 - DNA, 60 bp, Xenorhabdus bovienii
  Promoter sequence Name=Xb4151_4152.C430.promoter4; Position on contig= 2701..2760bp; Strand=+
ttatatacctatcgtcattggagatgcttgatttctcattcaaatcagataatgttaacc

SEQ ID NO: 11409 - DNA, 60 bp, Xenorhabdus bovienii
  Promoter sequence Name=Xb4151_4152.C430.promoter5; Position on contig= 4177..4236bp; Strand=-
aggcaggtggtaacaaatacggctttgatatccattcccgccaccgccaaaatttgcgga

SEQ ID NO: 11410 - DNA, 60 bp, Xenorhabdus bovienii
  Promoter sequence Name=Xb4151_4152.C430.promoter6; Position on contig= 3942..4001bp; Strand=+
tttactttttttatcttttcagggtaacgatttgaataagtttcctgtaggataggtcga

SEQ ID NO: 11411 - DNA, 60 bp, Xenorhabdus bovienii
  Promoter sequence Name=Xb4151_4152.C430.promoter7; Position on contig= 6930..6989bp; Strand=-
accacctataacatccaatgtcattcactaattgttcaaaattcagctaatattctacgg

SEQ ID NO: 11412 - DNA, 60 bp, Xenorhabdus bovienii
  Promoter sequence Name=Xb4151_4152.C430.promoter8; Position on contig= 6876..6935bp; Strand=+
gaagtatcaaaaaaacgcatagcggcaaatgatcatattgattgagttaaagttccgtag

SEQ ID NO: 11413 - DNA, 60 bp, Xenorhabdus bovienii
  Promoter sequence Name=Xb4151_4152.C430.promoter9; Position on contig= 7812..7871bp; Strand=-; Gene name=HemN
aaactccagagctgttgggtatgaagtgtaacgaggccctgaatagttatatttctgaac

SEQ ID NO: 11414 - DNA, 60 bp, Xenorhabdus bovienii
  Promoter sequence Name=Xb4151_4152.C430.promoter10; Position on contig=7612..7671bp; Strand=+; Gene name=HemN
ttacttataaccacagtattagtatgttatttattgtggttattgggtaaactatggcag

SEQ ID NO: 11415 - DNA, 60 bp, Xenorhabdus bovienii
  Promoter sequence Name=Xb4151_4152.C430.promoter11; Position on contig=11688..11747bp; Strand=-
aatcacagactgcacggagagactgcccggtttatgcttaactaaggtacaatgcaccaa

SEQ ID NO: 11416 - DNA, 60 bp, Xenorhabdus bovienii
  Promoter sequence Name=Xb4151_4152.C430.promoter12; Position on contig=11537..11596bp; Strand=+
cgcgtactttgtgccagtagttgcatggctgaatggttggcatagcggataatcaaatcg

SEQ ID NO: 11417 - DNA, 60 bp, Xenorhabdus bovienii
  Promoter sequence Name=Xb4151_4152.C430.promoter13; Position on contig=13341..13400bp; Strand=-
tctcataagcatcaattttataaacattgaccctatacagagacacacatcatcagccca

SEQ ID NO: 11418 - DNA, 60 bp, Xenorhabdus bovienii
  Promoter sequence Name=Xb4151_4152.C430.promoter14; Position on contig=13646..13705bp; Strand=-
tatatgagcaagagcaatgtttctagttgagatcatgactgcgcccgtatattcagcttc

SEQ ID NO: 11419 - DNA, 60 bp, Xenorhabdus bovienii
  Promoter sequence Name=Xb4151_4152.C430.promoter15; Position on contig=13509..13568bp; Strand=+
gcactaatttagtgaagtaggtgagcaaaaaaacaaatttgcaccattatagtgaaaaat

SEQ ID NO: 11420 - DNA, 60 bp, Xenorhabdus bovienii
  Promoter sequence Name=Xb4151_4152.C430.promoter16; Position on contig=16880..16939bp; Strand=-
taacgctttaaaataattgtctaaatgttgcatatatagcaattgctataatactgatac

SEQ ID NO: 11421 - DNA, 60 bp, Xenorhabdus bovienii
  Promoter sequence Name=Xb4151_4152.C430.promoter17; Position on contig=17240..17299bp; Strand=-
tacttacatatattgatattaaataatttattaatgttggtgcactttttactgttcaat

SEQ ID NO: 11422 - DNA, 60 bp, Xenorhabdus bovienii
  Promoter sequence Name=Xb4151_4152.C430.promoter18; Position on contig=20791..20850bp; Strand=-
ataaatgactcatgaaacaattgttatttattggtaatttattcattaaaaatcaaactt

SEQ ID NO: 11423 - DNA, 60 bp, Xenorhabdus bovienii
  Promoter sequence Name=Xb4151_4152.C430.promoter19; Position on contig=22466..22525bp; Strand=-
aaaataaaacaattattacaaccataaaaattgaagaagaaaaaacaatagaatataaac

SEQ ID NO: 11424 - DNA, 60 bp, Xenorhabdus bovienii
  Promoter sequence Name=Xb4151_4152.C430.promoter20; Position on contig=22247..22306bp; Strand=+
atataactcgtattttctaaagagatggaaatagaattatctataggtatattggatgtt

SEQ ID NO: 11425 - DNA, 60 bp, Xenorhabdus bovienii
  Promoter sequence Name=Xb4151_4152.C430.promoter21; Position on contig=24112..24171bp; Strand=-
acattgttatttaattataaatcataggattatacagtggaaaatactataatttcatca

SEQ ID NO: 11426 - DNA, 60 bp, Xenorhabdus bovienii
  Promoter sequence Name=Xb4151_4152.C430.promoter22; Position on contig=23834..23893bp; Strand=+
acagtataactaaaagatgttgtaagaaatccacttgcattatgaggtacaatatcaaaa

SEQ ID NO: 11427 - DNA, 60 bp, Xenorhabdus bovienii
  Promoter sequence Name=Xb4151_4152.C430.promoter23; Position on contig=24507..24566bp; Strand=+
agctgttccaaataatagatcacttgcagagaactcaatccgaattggacgatctgatta

SEQ ID NO: 11428 - DNA, 60 bp, Xenorhabdus bovienii; identical to SEQ ID NO: 10819
  Promoter sequence Name=Xb4151_4152.C430.promoter24; Position on contig=25265..25324bp; Strand=-

SEQ ID NO: 11429 - DNA, 60 bp, Xenorhabdus bovienii
  Promoter sequence Name=Xb4151_4152.C430.promoter25; Position on contig=25108..25167bp; Strand=+
ataatttgatgtacttttgggtggttatatatgtcatcatatatttgtaaaatcattggt

SEQ ID NO: 11430 - DNA, 60 bp, Xenorhabdus bovienii
  Promoter sequence Name=Xb4151_4152.C430.promoter26; Position on contig=27218..27277bp; Strand=-
ggttaattgttatatgattgatatggctattttttatataaagatgttatattctaattg

SEQ ID NO: 11431 - DNA, 60 bp, Xenorhabdus bovienii
  Promoter sequence Name=Xb4151_4152.C430.promoter27; Position on contig=26726..26785bp; Strand=+
ataaataagaaaataattgacattactacacaaaaaattctatttggtagagttatgtga

SEQ ID NO: 11432 - DNA, 60 bp, Xenorhabdus bovienii
  Promoter sequence Name=Xb4151_4152.C430.promoter28; Position on contig=27551..27610bp; Strand=+
agtatacttttttataaatataattaagtaacttattgaggttttagtaactttacattt

SEQ ID NO: 11433 - DNA, 60 bp, Xenorhabdus bovienii
  Promoter sequence Name=Xb4151_4152.C430.promoter29; Position on contig=36448..36507bp; Strand=-
taagtaatttcaaaataaacagcattgtagtctaagccttccatcgctatgttttaatat

SEQ ID NO: 11434 - DNA, 60 bp, Xenorhabdus bovienii
  Promoter sequence Name=Xb4151_4152.C430.promoter30; Position on contig=36427..36486bp; Strand=+
tttagtgctaactcgtttcccatattaaaacatagcgatggaaggcttagactacaatgc

SEQ ID NO: 11435 - DNA, 60 bp, Xenorhabdus bovienii
  Promoter sequence Name=Xb4151_4152.C430.promoter31; Position on contig=38118..38177bp; Strand=-
atttttttgacgaaaaataactttttacgataaaaagttaaaccaaatatatctttttct

SEQ ID NO: 11436 - DNA, 60 bp, Xenorhabdus bovienii
  Promoter sequence Name=Xb4151_4152.C430.promoter32; Position on contig=38431..38490bp; Strand=-; Gene name=PitA
cgcatcgcgcgggtataaataacagttgctactgcatttgcggtatcatgaaacccattg

SEQ ID NO: 11437 - DNA, 60 bp, Xenorhabdus bovienii
  Promoter sequence Name=Xb4151_4152.C430.promoter33; Position on contig=38162..38221bp; Strand=+; Gene name=PitA
ttttcgtcaaaaaaatatcaaaatattaaaaccaaataatcaattgatataattgataaa

SEQ ID NO: 11438 - DNA, 60 bp, Xenorhabdus bovienii
  Promoter sequence Name=Xb4151_4152.C430.promoter34; Position on contig=39946..40005bp; Strand=+; Gene name=UspA
ttcaaatgagatacccatattttcatacagttaagaaaataaaatggtaagttgtgatca

SEQ ID NO: 11439 - DNA, 60 bp, Xenorhabdus bovienii
  Promoter sequence Name=Xb4151_4152.C430.promoter35; Position on contig=41017..41076bp; Strand=-; Gene name=GdhA
ccttaaatggcccaatggcagaattgaactgtacccgccatgcacggttaacctgtactt

SEQ ID NO: 11440 - DNA, 60 bp, Xenorhabdus bovienii
  Promoter sequence Name=Xb4151_4152.C430.promoter36; Position on contig=40650..40709bp; Strand=+; Gene name=GdhA
aggaaacttataaaaatagttgttgaaatataagcgtaagaaagtggtatattcagaaag

SEQ ID NO: 11441 - DNA, 60 bp, Xenorhabdus bovienii
  Promoter sequence Name=Xb4151_4152.C430.promoter37; Position on contig=45149..45208bp; Strand=-
cgccccacgaaacatctaaactcattcgtcatctcacagatatctgatataaaaagaccc

SEQ ID NO: 11442 - DNA, 60 bp, Xenorhabdus bovienii
  Promoter sequence Name=Xb4151_4152.C430.promoter38; Position on contig=44995..45054bp; Strand=+
tacagaaggagtcagtaacgggttagtcatagtgagcgccttagttgtatgtttgggtat

SEQ ID NO: 11443 - DNA, 60 bp, Xenorhabdus bovienii
  Promoter sequence Name=Xb4151_4152.C430.promoter39; Position on contig=47522..47581bp; Strand=-
atcaatcatgcaaatcacccaccaataatataacaaaagatactgtttctaatttaaata

SEQ ID NO: 11444 - DNA, 60 bp, Xenorhabdus bovienii
  Promoter sequence Name=Xb4151_4152.C430.promoter40; Position on contig=48166..48225bp; Strand=-
tttaatgaaatcaaggggttgggttaaaggggagtattgtccccttttaaactcatagtt

SEQ ID NO: 11445 - DNA, 60 bp, Xenorhabdus bovienii
  Promoter sequence Name=Xb4151_4152.C430.promoter41; Position on contig=48130..48189bp; Strand=+
gtttggaaattaataaaatccatatcccactgataaaactatgagtttaaaaggggacaa

SEQ ID NO: 11446 - DNA, 60 bp, Xenorhabdus bovienii
  Promoter sequence Name=Xb4151_4152.C430.promoter42; Position on contig=49855..49914bp; Strand=+
tattgttccaaacgccatcaggtttttatttaaccacatttaaatgatactattcagtgc

SEQ ID NO: 11447 - DNA, 60 bp, Xenorhabdus bovienii
  Promoter sequence Name=Xb4151_4152.C430.promoter43; Position on contig=51097..51156bp; Strand=-; Gene name=RecN
tgaagtcataggtaaaacgctgagaggttttcaatctcttcaatgtttattatcatcgac

SEQ ID NO: 11448 - DNA, 60 bp, Xenorhabdus bovienii
  Promoter sequence Name=Xb4151_4152.C430.promoter44; Position on contig=52874..52933bp; Strand=-
tttactgtataaagaaccagtttatactgtgtgaaagtacagacatgtttttatatacag

SEQ ID NO: 11449 - DNA, 60 bp, Xenorhabdus bovienii
  Promoter sequence Name=Xb4151_4152.C430.promoter45; Position on contig=53920..53979bp; Strand=-; Gene name=GrpE
aggtactttttggtctttactactcatgaatatctccgcgtattttgtattatttgcgct

SEQ ID NO: 11450 - DNA, 60 bp, Xenorhabdus bovienii
  Promoter sequence Name=Xb4151_4152.C430.promoter46; Position on contig=53679..53738bp; Strand=+; Gene name=GrpE
cttttaaaccaatgtctctagcaacttgtctatccatgatgacgtagtatcctttggata

SEQ ID NO: 11451 - DNA, 60 bp, Xenorhabdus bovienii
  Promoter sequence Name=Xb4151_4152.C430.promoter47; Position on contig=55467..55526bp; Strand=-
acattaacaacaaatttaatttttatttaacaaaattaatacccatatataatgaaagga

SEQ ID NO: 11452 - DNA, 60 bp, Xenorhabdus bovienii
  Promoter sequence Name=Xb4151_4152.C430.promoter48; Position on contig=55154..55213bp; Strand=+
atcctgctgtagcggataaatcgtctttccggccttacgttcattggcaacataggtcaa

SEQ ID NO: 11453 - DNA, 60 bp, Xenorhabdus bovienii
  Promoter sequence Name=Xb4151_4152.C430.promoter49; Position on contig=55482..55541bp; Strand=+
tgggtattaattttgttaaataaaaattaaatttgttgttaatgtgttacgattttttgc

SEQ ID NO: 11454 - DNA, 60 bp, Xenorhabdus bovienii
  Promoter sequence Name=Xb4151_4152.C430.promoter50; Position on contig=58212..58271bp; Strand=-
acctgcccacaggatatttttataggatgaagaatacgaccaacctgtttataatcggcg

SEQ ID NO: 11455 - DNA, 60 bp, Xenorhabdus bovienii
  Promoter sequence Name=Xb4151_4152.C430.promoter51; Position on contig=57900..57959bp; Strand=+
gattgtgcctgttctgcaacttgcattgccagttcgcgggtaggggtcaaaatcaagata

SEQ ID NO: 11456 - DNA, 60 bp, Xenorhabdus bovienii
  Promoter sequence Name=Xb4151_4152.C430.promoter52; Position on contig=59331..59390bp; Strand=-; Gene name=RpoE
atttgatccgttaactgctcgctcatccgaggctcactctcctgaggtaaaactccacat

SEQ ID NO: 11457 - DNA, 60 bp, Xenorhabdus bovienii
  Promoter sequence Name=Xb4151_4152.C430.promoter53; Position on contig=59187..59246bp; Strand=+; Gene name=RpoE
gtactatacataaaaggtgagatacgaaataacaggtggttgtaagataaaattacgatc

SEQ ID NO: 11458 - DNA, 60 bp, Xenorhabdus bovienii
  Promoter sequence Name=Xb4151_4152.C430.promoter54; Position on contig=62434..62493bp; Strand=-; Gene name=LepA
gcgtgtcgataaaatttagttgatagacttgtccgtcaattgactggtaatcaagagtga

SEQ ID NO: 11459 - DNA, 60 bp, Xenorhabdus bovienii
  Promoter sequence Name=Xb4151_4152.C430.promoter55; Position on contig=62103..62162bp; Strand=+; Gene name=LepA
cataccgaaaaccacaggcatgactaggttttcacaggtttggcatgtagaatacgcctc

SEQ ID NO: 11460 - DNA, 60 bp, Xenorhabdus bovienii
  Promoter sequence Name=Xb4151_4152.C430.promoter56; Position on contig=65272..65331bp; Strand=-; Gene name=Rnc
ctgttggcactacgatgagtgagcgcctgaagtaacaaatcatgctgtataaaggtatat

SEQ ID NO: 11461 - DNA, 60 bp, Xenorhabdus bovienii
  Promoter sequence Name=Xb4151_4152.C430.promoter57; Position on contig=65068..65127bp; Strand=+; Gene name=Rnc
aattcatctcacagtgtagaatattctgccaaacgagatgattggctttttagaatgatg

SEQ ID NO: 11462 - DNA, 60 bp, Xenorhabdus bovienii
  Promoter sequence Name=Xb4151_4152.C430.promoter58; Position on contig=69164..69223bp; Strand=-
gtgttactgcatttttcattaagaactccgtaatatcattacgttgatataatagctcac

SEQ ID NO: 11463 - DNA, 60 bp, Xenorhabdus bovienii
  Promoter sequence Name=Xb4151_4152.C430.promoter59; Position on contig=68969..69028bp; Strand=+
tttagtaattaatagcgccatttcagtctcttatataaattatcatttaaaatcatataa

SEQ ID NO: 11464 - DNA, 60 bp, Xenorhabdus bovienii
  Promoter sequence Name=Xb4151_4152.C430.promoter60; Position on contig=69923..69982bp; Strand=-
gagcttgaggatcagcgcgagggggttggagcgttttttttcggggtgatattcagccgt

SEQ ID NO: 11465 - DNA, 60 bp, Xenorhabdus bovienii
  Promoter sequence Name=Xb4151_4152.C430.promoter61; Position on contig=69554..69613bp; Strand=+
tcgcagtaatgaatccattgacgttggtaaatatagctaaatcatattaatatgacataa

SEQ ID NO: 11466 - DNA, 60 bp, Xenorhabdus bovienii
  Promoter sequence Name=Xb4151_4152.C430.promoter62; Position on contig=70626..70685bp; Strand=+
tgagcgtcctcctcggcttttcccaatcgcttcatctttcttttatgttgcgcctgaact

SEQ ID NO: 11467 - DNA, 60 bp, Xenorhabdus bovienii
  Promoter sequence Name=Xb4151_4152.C430.promoter63; Position on contig=71266..71325bp; Strand=+; Gene name=RimI
tttttatataaaaataataaacatcgacaaataccgaaacatgaaactaatatatgttag

SEQ ID NO: 11468 - DNA, 60 bp, Xenorhabdus bovienii
  Promoter sequence Name=Xb4151_4152.C430.promoter64; Position on contig=72478..72537bp; Strand=-
ctgtttttacctttatatctattgacgggttatgcaaaacacactcttaaaaaaacattc

SEQ ID NO: 11469 - DNA, 60 bp, Xenorhabdus bovienii
  Promoter sequence Name=Xb4151_4152.C430.promoter65; Position on contig=73537..73596bp; Strand=-; Gene name=Sbp
cttaataattaatttatcttgcggatgctgtgcattccattgtttttcaaattgagggtt

SEQ ID NO: 11470 - DNA, 60 bp, Xenorhabdus bovienii
  Promoter sequence Name=Xb4151_4152.C430.promoter66; Position on contig=73221..73280bp; Strand=+; Gene name=Sbp
tcttttgaattgataattcctacatttcctatagcttatcgcgtttcatcatttctcata

SEQ ID NO: 11471 - DNA, 60 bp, Xenorhabdus bovienii
  Promoter sequence Name=Xb4151_4152.C430.promoter67; Position on contig=77582..77641bp; Strand=-; Gene name=CysK
cgcctgccgttcaagactcatattttcaggcattaataatttcaatttataatttttaac

SEQ ID NO: 11472 - DNA, 60 bp, Xenorhabdus bovienii
  Promoter sequence Name=Xb4151_4152.C430.promoter68; Position on contig=77212..77271bp; Strand=+; Gene name=CysK
tatattttattaccgtcaacccgtctctcgtcatttgggggagcgggtattttttgttta

SEQ ID NO: 11473 - DNA, 60 bp, Xenorhabdus bovienii
  Promoter sequence Name=Xb4151_4152.C430.promoter69; Position on contig=80777..80836bp; Strand=-
aataaagccaatttgtttcatttcaccgagttccatccccagataaataaaatttgggga

SEQ ID NO: 11474 - DNA, 60 bp, Xenorhabdus bovienii
  Promoter sequence Name=Xb4151_4152.C430.promoter70; Position on contig=80473..80532bp; Strand=+
ccagcaacataatatggccttcgaagatctcagccttttctgcacctaaatttttttcgg

SEQ ID NO: 11475 - DNA, 60 bp, Xenorhabdus bovienii
  Promoter sequence Name=Xb4151_4152.C430.promoter71; Position on contig=81363..81422bp; Strand=-
tcagatcaaagtttaaaactttcctagatgatttattcaagtagctttagtatttaacca

SEQ ID NO: 11476 - DNA, 60 bp, Xenorhabdus bovienii
  Promoter sequence Name=Xb4151_4152.C430.promoter72; Position on contig=81107..81166bp; Strand=+
tatttcctcaataacttaaatattcgttgataagccctagaaaattctaaaactagtgta

SEQ ID NO: 11477 - DNA, 60 bp, Xenorhabdus bovienii
  Promoter sequence Name=Xb4151_4152.C430.promoter73; Position on contig=82598..82657bp; Strand=-; Gene name=CysZ
attacctttaattaactgtaaccatcacggcgcagaaataactatataaaatcataaatg

SEQ ID NO: 11478 - DNA, 60 bp, Xenorhabdus bovienii
  Promoter sequence Name=Xb4151_4152.C430.promoter74; Position on contig=83880..83939bp; Strand=-; Gene name=ZipA
tgactcttgaacatgcgactttgacgaattatcaaacagtttatcgccatcattatcgtc

SEQ ID NO: 11479 - DNA, 60 bp, Xenorhabdus bovienii
  Promoter sequence Name=Xb4151_4152.C430.promoter75; Position on contig=83634..83693bp; Strand=+; Gene name=ZipA
tagagacttgcacttgtgctatttgacaaatactcttatctaaagaatattctgccgtgg

SEQ ID NO: 11480 - DNA, 60 bp, Xenorhabdus bovienii
  Promoter sequence Name=Xb4151_4152.C430.promoter76; Position on contig=86996..87055bp; Strand=-
gtacttatatgagacataaagagaatcccagacatggcgaagcacaaatttataattaca

SEQ ID NO: 11481 - DNA, 60 bp, Xenorhabdus bovienii
  Promoter sequence Name=Xb4151_4152.C430.promoter77; Position on contig=86809..86868bp; Strand=+
taaataaaaataaggggggctactgagaatagatcttgatagcaccctatacttgatgtt

SEQ ID NO: 11482 - DNA, 60 bp, Xenorhabdus bovienii
  Promoter sequence Name=Xb4151_4152.C431.promoter1; Position on contig= 2390..2449bp; Strand=+; Gene name=RimL
attattctgaccctaatctcttctttaaggtagagggttatagatgatatttttttatcg

SEQ ID NO: 11483 - DNA, 60 bp, Xenorhabdus bovienii
  Promoter sequence Name=Xb4151_4152.C431.promoter2; Position on contig= 3205..3264bp; Strand=+; Gene name=MviN
ctttatatgtcatttttatgatgccttatgggatagctttacatttttatgcttaactcc

SEQ ID NO: 11484 - DNA, 60 bp, Xenorhabdus bovienii
  Promoter sequence Name=Xb4151_4152.C431.promoter3; Position on contig= 4832..4891bp; Strand=+
tccctgattaataaataatttcatttaatacaaccgtccaagcttttattgggcggttaa

SEQ ID NO: 11485 - DNA, 60 bp, Xenorhabdus bovienii
  Promoter sequence Name=Xb4151_4152.C431.promoter4; Position on contig= 6342..6401bp; Strand=+
ccatcagtactacctttttcattgattttataaggaataatgctctttatcctcaatttt

SEQ ID NO: 11486 - DNA, 60 bp, Xenorhabdus bovienii
  Promoter sequence Name=Xb4151_4152.C431.promoter5; Position on contig= 7094..7153bp; Strand=+
acaccggaaaagtgcgaaaggattcgtatagagcatataggaatggctaaaatttgaata

SEQ ID NO: 11487 - DNA, 60 bp, Xenorhabdus bovienii
  Promoter sequence Name=Xb4151_4152.C431.promoter6; Position on contig= 8914..8973bp; Strand=-
aaatacggttatgtaacactggcatggtgtactttcctgaatttcggtaacatttctgta

SEQ ID NO: 11488 - DNA, 60 bp, Xenorhabdus bovienii
  Promoter sequence Name=Xb4151_4152.C431.promoter7; Position on contig= 8694..8753bp; Strand=+
tatcgggtaatgctgcgccaggccatgattatgatattcctgcgcattatattcaaatgc

SEQ ID NO: 11489 - DNA, 60 bp, Xenorhabdus bovienii
  Promoter sequence Name=Xb4151_4152.C431.promoter8; Position on contig= 10772..10831bp; Strand=-
ttagtcaactgaattattcgcatagtttattatttttcataatactgtatcatatagtca

SEQ ID NO: 11490 - DNA, 60 bp, Xenorhabdus bovienii
  Promoter sequence Name=Xb4151_4152.C431.promoter9; Position on contig= 12590..12649bp; Strand=-
attttttccgttttttgatacgataaatttcctctgaataccctgcatataatatttaaa

SEQ ID NO: 11491 - DNA, 60 bp, Xenorhabdus bovienii
  Promoter sequence Name=Xb4151_4152.C431.promoter10; Position on contig=12429..12488bp; Strand=+
tgtgtatgattcagtggtcatgaaaccggctccagaatataagaggaaaaatgatggatg

SEQ ID NO: 11492 - DNA, 60 bp, Xenorhabdus bovienii
  Promoter sequence Name=Xb4151_4152.C431.promoter11; Position on contig=13004..13063bp; Strand=-
gagccaagtttaagaaagcccgatttagctctgctagtcgggctttctaacattttccct

SEQ ID NO: 11493 - DNA, 60 bp, Xenorhabdus bovienii
  Promoter sequence Name=Xb4151_4152.C431.promoter12; Position on contig=12757..12816bp; Strand=+
cagaacggatgcatttaacggtagcttcacttttgtaaaagaaaaaatacaatactattt

SEQ ID NO: 11494 - DNA, 60 bp, Xenorhabdus bovienii
  Promoter sequence Name=Xb4151_4152.C431.promoter13; Position on contig=13532..13591bp; Strand=-
atggaaaattacaatatggtcatattttgctgtaaaaaataacaaaatatcatcaccttg

SEQ ID NO: 11495 - DNA, 60 bp, Xenorhabdus bovienii
  Promoter sequence Name=Xb4151_4152.C431.promoter14; Position on contig=13926..13985bp; Strand=-
cgatagggaaatagaatttttgcgttgacactcccagcgttcatcgctagtattcgcctc

SEQ ID NO: 11496 - DNA, 60 bp, Xenorhabdus bovienii
  Promoter sequence Name=Xb4151_4152.C431.promoter15; Position on contig=14647..14706bp; Strand=-
tttatcttagcaaaaatatcgatattgtttccagacaataacaattttataaataaaata

SEQ ID NO: 11497 - DNA, 60 bp, Xenorhabdus bovienii
  Promoter sequence Name=Xb4151_4152.C431.promoter16; Position on contig=14302..14361bp; Strand=+
atatcgaaaagtaaaacggctgccatggcgacaaaaagcactgtaaataaaatcagtgac

SEQ ID NO: 11498 - DNA, 60 bp, Xenorhabdus bovienii
  Promoter sequence Name=Xb4151_4152.C431.promoter17; Position on contig=14717..14776bp; Strand=+; Gene name=CspC
atcaaataaaattataattgtacctattcatcatgtcattttgttctaatattgagcaca

SEQ ID NO: 11499 - DNA, 60 bp, Xenorhabdus bovienii
  Promoter sequence Name=Xb4151_4152.C431.promoter18; Position on contig=15803..15862bp; Strand=-
ttcaagagataggtggaatatcacccgttcttatccactgatagatataaaataatggaa

SEQ ID NO: 11500 - DNA, 60 bp, Xenorhabdus bovienii
  Promoter sequence Name=Xb4151_4152.C431.promoter19; Position on contig=16329..16388bp; Strand=-
tttcttcagtgagaaaaattattttctcctttaacctcatatgagagcatactgatggaa

SEQ ID NO: 11501 - DNA, 60 bp, Xenorhabdus bovienii
  Promoter sequence Name=Xb4151_4152.C431.promoter20; Position on contig=16037..16096bp; Strand=+
tataaccgatattattattatattgatgataatttcattgagtggcttattcttgttctg

SEQ ID NO: 11502 - DNA, 60 bp, Xenorhabdus bovienii
  Promoter sequence Name=Xb4151_4152.C431.promoter21; Position on contig=16932..16991bp; Strand=-; Gene name=MgtA
ctggctgtcatatttaaatacttattcccaaacgtttccctactctttattactcgttcc

SEQ ID NO: 11503 - DNA, 60 bp, Xenorhabdus bovienii
  Promoter sequence Name=Xb4151_4152.C431.promoter22; Position on contig=16727..16786bp; Strand=+; Gene name=MgtA
taagaacagcattttgtaagttaaccctacggaaaagtcacgcattttaaaataattgac

SEQ ID NO: 11504 - DNA, 60 bp, Xenorhabdus bovienii
  Promoter sequence Name=Xb4151_4152.C431.promoter23; Position on contig=17210..17269bp; Strand=-
ttccacacagctcactataaatacacatagaatcatagcgaatattgtaatatctaagat

SEQ ID NO: 11505 - DNA, 60 bp, Xenorhabdus bovienii
  Promoter sequence Name=Xb4151_4152.C431.promoter24; Position on contig=17041..17100bp; Strand=+
catttttactgatgttagccatctatttgcttgtacaaaacctaatgtacgatatttcac

SEQ ID NO: 11506 - DNA, 60 bp, Xenorhabdus bovienii
  Promoter sequence Name=Xb4151_4152.C431.promoter25; Position on contig=17811..17870bp; Strand=-
gtaaacagaataaataaacatgaaaaaggaaattatcttacttaatttaaaatataagta

SEQ ID NO: 11507 - DNA, 60 bp, Xenorhabdus bovienii
  Promoter sequence Name=Xb4151_4152.C431.promoter26; Position on contig=17720..17779bp; Strand=+
atcacaataaatataaatttaatgaggtaataaggtcatatttacccgttattcttttta

SEQ ID NO: 11508 - DNA, 60 bp, Xenorhabdus bovienii
  Promoter sequence Name=Xb4151_4152.C431.promoter27; Position on contig=18636..18695bp; Strand=-
attaaggactgttttttgttttatacgatctattaaacttctaaatttaaaatggcgata

SEQ ID NO: 11509 - DNA, 60 bp, Xenorhabdus bovienii
  Promoter sequence Name=Xb4151_4152.C431.promoter28; Position on contig=18953..19012bp; Strand=-
ccagagcagtaactgtcctttgtattactcttgggatcgcccaatttctaaaatatttcg

SEQ ID NO: 11510 - DNA, 60 bp, Xenorhabdus bovienii
  Promoter sequence Name=Xb4151_4152.C431.promoter29; Position on contig=19054..19113bp; Strand=+
tcatgctactggtaattttgtcgtgagtgattctttgatcacttaattaatttttcatat

SEQ ID NO: 11511 - DNA, 60 bp, Xenorhabdus bovienii
  Promoter sequence Name=Xb4151_4152.C431.promoter30; Position on contig=25011..25070bp; Strand=-; Gene name=Tar
ggcttctgtatcgttctttaaaccattaaagaacagtcccccggagataaattgcagagc

SEQ ID NO: 11512 - DNA, 60 bp, Xenorhabdus bovienii
  Promoter sequence Name=Xb4151_4152.C431.promoter31; Position on contig=24786..24845bp; Strand=+; Gene name=Tar
ggctgccgtgattgttgccactcattatagccagtcgagcaaaacggcagccttacttgt

SEQ ID NO: 11513 - DNA, 60 bp, Xenorhabdus bovienii
  Promoter sequence Name=Xb4151_4152.C431.promoter32; Position on contig=32063..32122bp; Strand=-
cgaaattacactattttcatgttatattttttattacccaagagatatttaatgaagtat

SEQ ID NO: 11514 - DNA, 60 bp, Xenorhabdus bovienii
  Promoter sequence Name=Xb4151_4152.C431.promoter33; Position on contig=32003..32062bp; Strand=+
gattttttattaatgtaaaatcatgttgattcaataaaatatattgtaaatattaatgga

SEQ ID NO: 11515 - DNA, 60 bp, Xenorhabdus bovienii
  Promoter sequence Name=Xb4151_4152.C431.promoter34; Position on contig=32310..32369bp; Strand=+
ataaataagccatattaatgctcttttattgggaatcatcatgatatgaaaatacttttt

SEQ ID NO: 11516 - DNA, 60 bp, Xenorhabdus bovienii
  Promoter sequence Name=Xb4151_4152.C431.promoter35; Position on contig=38097..38156bp; Strand=-
tatctcgcaatcaagaaaattaatagttttttatataaaaaaataggtattatttgcata

SEQ ID NO: 11517 - DNA, 60 bp, Xenorhabdus bovienii
  Promoter sequence Name=Xb4151_4152.C431.promoter36; Position on contig=38075..38134bp; Strand=+; Gene name=AlsT (BS)
caatacccccaaaaccatttattatgcaaataatacctatttttttatataaaaaactat

SEQ ID NO: 11518 - DNA, 60 bp, Xenorhabdus bovienii
  Promoter sequence Name=Xb4151_4152.C431.promoter37; Position on contig=39919..39978bp; Strand=-; Gene name=FlhB
tcttcagccacgactttccttggtgagcgttcgttattgcatgcagaaaaattgcttttg

SEQ ID NO: 11519 - DNA, 60 bp, Xenorhabdus bovienii
  Promoter sequence Name=Xb4151_4152.C431.promoter38; Position on contig=43243..43302bp; Strand=+
tgtcaggatttttccgataccattactgacagtgtcattaaatatggcaatttagtttct

SEQ ID NO: 11520 - DNA, 60 bp, Xenorhabdus bovienii
  Promoter sequence Name=Xb4151_4152.C431.promoter39; Position on contig=44366..44425bp; Strand=+
tttcataaagtggttccttatattccatttaataatattatttgttgtataattttagct

SEQ ID NO: 11521 - DNA, 60 bp, Xenorhabdus bovienii
  Promoter sequence Name=Xb4151_4152.C431.promoter40; Position on contig=45111..45170bp; Strand=+
aaagaaaataataaactaaaacagatgatgtttttaattgccttttttatactcccccta

SEQ ID NO: 11522 - DNA, 60 bp, Xenorhabdus bovienii
  Promoter sequence Name=Xb4151_4152.C431.promoter41; Position on contig=45511..45570bp; Strand=-
acaccaactcattttgttattaaaattgttattaacgatcaattaattataattgatagg

SEQ ID NO: 11523 - DNA, 60 bp, Xenorhabdus bovienii
  Promoter sequence Name=Xb4151_4152.C431.promoter42; Position on contig=46075..46134bp; Strand=+; Gene name=FimA
aggaacatacccttagttttgttcttaaaaacacaattatcatttattaaaatttattga

SEQ ID NO: 11524 - DNA, 60 bp, Xenorhabdus bovienii
  Promoter sequence Name=Xb4151_4152.C431.promoter43; Position on contig=52890..52949bp; Strand=-; Gene name=FlgB
acgaataatcaaccgcgttacactattaacatccaacaggtactgaatattttttgaaat

SEQ ID NO: 11525 - DNA, 60 bp, Xenorhabdus bovienii
  Promoter sequence Name=Xb4151_4152.C431.promoter44; Position on contig=52965..53024bp; Strand=+; Gene name=FlgB
caattcaatttgtgtctattcatcgaatcagctttttcttctgagtttattctgttagct

SEQ ID NO: 11526 - DNA, 60 bp, Xenorhabdus bovienii
  Promoter sequence Name=Xb4151_4152.C431.promoter45; Position on contig=54059..54118bp; Strand=-; Gene name=FlgD
tgtcgtcaattcattgttttgcattgggttggtgggatcttggttcttaagttgagcaac

SEQ ID NO: 11527 - DNA, 60 bp, Xenorhabdus bovienii
  Promoter sequence Name=Xb4151_4152.C431.promoter46; Position on contig=60767..60826bp; Strand=-; Gene name=FlgK
agcatgtttggtttgtgcagagctatgttgctggttgatgaactcgctatattcgcggtt

SEQ ID NO: 11528 - DNA, 60 bp, Xenorhabdus bovienii
  Promoter sequence Name=Xb4151_4152.C431.promoter47; Position on contig=63672..63731bp; Strand=-
aaaggggcggtaactgactggttgctttttatccgggcacaggccattaaatttttggtg

SEQ ID NO: 11529 - DNA, 60 bp, Xenorhabdus bovienii
  Promoter sequence Name=Xb4151_4152.C431.promoter48; Position on contig=63417..63476bp; Strand=+
tattttaggtagaaaaaaggcttcatttatgatctgataatcgtcgccaaactcatatca

SEQ ID NO: 11530 - DNA, 60 bp, Xenorhabdus bovienii
  Promoter sequence Name=Xb4151_4152.C431.promoter49; Position on contig=125240..125299bp; Strand=-
tcaaaaataaatgaattctaactcttttataagtgggattaaaaaaataaagtatctgct

SEQ ID NO: 11531 - DNA, 60 bp, Xenorhabdus bovienii
  Promoter sequence Name=Xb4151_4152.C431.promoter50; Position on contig=125088..125147bp; Strand=+
agaggaggattcagaggaactttcaaacgcaagctgatctttgttgatacgattgcatga

SEQ ID NO: 11532 - DNA, 60 bp, Xenorhabdus bovienii
  Promoter sequence Name=Xb4151_4152.C431.promoter51; Position on contig=125443..125502bp; Strand=+
aaaggtatattgttatgattatatttaataaaattataactttatttaaaagttattaac

SEQ ID NO: 11533 - DNA, 60 bp, Xenorhabdus bovienii
  Promoter sequence Name=Xb4151_4152.C431.promoter52; Position on contig=125919..125978bp; Strand=+; Gene name=SmtA
tatatattaatataaagatgcgtgagttaaatcacaaactaaaatgttattattaataat

SEQ ID NO: 11534 - DNA, 60 bp, Xenorhabdus bovienii
  Promoter sequence Name=Xb4151_4152.C431.promoter53; Position on contig=126844..126903bp; Strand=+
atgtctttttttaatacatgtattttataaataataatatatataaaatcagttaccctc

SEQ ID NO: 11535 - DNA, 60 bp, Xenorhabdus bovienii
  Promoter sequence Name=Xb4151_4152.C431.promoter54; Position on contig=127811..127870bp; Strand=-
caaaaatcagcccattgctttttttcttaaagaaagcaacggactgatataaaaagaaaa

SEQ ID NO: 11536 - DNA, 60 bp, Xenorhabdus bovienii
  Promoter sequence Name=Xb4151_4152.C431.promoter55; Position on contig=133330..133389bp; Strand=-; Gene name=FhaB
cttgactgtcaacccctgccgccagtattcccagggcaatcgcatctaaaattcattgac

SEQ ID NO: 11537 - DNA, 60 bp, Xenorhabdus bovienii
  Promoter sequence Name=Xb4151_4152.C431.promoter56; Position on contig=133274..133333bp; Strand=+; Gene name=FhaB
acagaggacataaggatggatttaaaagctgcataacgacatgaaattaaaccattgtca

SEQ ID NO: 11538 - DNA, 60 bp, Xenorhabdus bovienii
  Promoter sequence Name=Xb4151_4152.C431.promoter57; Position on contig=142167..142226bp; Strand=-
gccatcttttatccgatgcactgaatttcgggagaacatcttatgagtacgatcaaagtg

SEQ ID NO: 11539 - DNA, 60 bp, Xenorhabdus bovienii
  Promoter sequence Name=Xb4151_4152.C431.promoter58; Position on contig=141912..141971bp; Strand=+
aacgcattattggcatcgtttttttgatgatggctgaaagcttttacatgctgggtggga

SEQ ID NO: 11540 - DNA, 60 bp, Xenorhabdus bovienii
  Promoter sequence Name=Xb4151_4152.C431.promoter59; Position on contig=142980..143039bp; Strand=-
tatggcgtcccctgcaggaatcgaacctacaactagcccttaggaggggctcgttatatc

SEQ ID NO: 11541 - DNA, 60 bp, Xenorhabdus bovienii
  Promoter sequence Name=Xb4151_4152.C431.promoter60; Position on contig=142964..143023bp; Strand=+
tccccttagttaaatggatataacgagcccctcctaagggctagttgtaggttcgattcc

SEQ ID NO: 11542 - DNA, 60 bp, Xenorhabdus bovienii; identical to SEQ ID NO: 11022
  Promoter sequence Name=Xb4151_4152.C431.promoter61; Position on contig=143861..143920bp; Strand=-

SEQ ID NO: 11543 - DNA, 60 bp, Xenorhabdus bovienii; identical to SEQ ID NO: 11300
  Promoter sequence Name=Xb4151_4152.C431.promoter62; Position on contig=143645..143704bp; Strand=+

SEQ ID NO: 11544 - DNA, 60 bp, Xenorhabdus bovienii; identical to SEQ ID NO: 11022
  Promoter sequence Name=Xb4151_4152.C431.promoter63; Position on contig=144651..144710bp; Strand=-

SEQ ID NO: 11545 - DNA, 60 bp, Xenorhabdus bovienii; identical to SEQ ID NO: 11300
  Promoter sequence Name=Xb4151_4152.C431.promoter64; Position on contig=144435..144494bp; Strand=+

SEQ ID NO: 11546 - DNA, 60 bp, Xenorhabdus bovienii
  Promoter sequence Name=Xb4151_4152.C431.promoter65; Position on contig=144988..145047bp; Strand=-
ttaattttgctatacggtattcaattgatataaaaaaccatcctaagtaatattgactgg

SEQ ID NO: 11547 - DNA, 60 bp, Xenorhabdus bovienii
  Promoter sequence Name=Xb4151_4152.C431.promoter66; Position on contig=146847..146906bp; Strand=-
aatattcataacagcttttttacctcattgatagaagataaaatcatcatactttatctt

SEQ ID NO: 11548 - DNA, 60 bp, Xenorhabdus bovienii
  Promoter sequence Name=Xb4151_4152.C431.promoter67; Position on contig=149513..149572bp; Strand=-
ccaacagttttatcggctccttaaaaagaacctttaatttttattgaaaaacttttttct

SEQ ID NO: 11549 - DNA, 60 bp, Xenorhabdus bovienii
  Promoter sequence Name=Xb4151_4152.C431.promoter68; Position on contig=149352..149411bp; Strand=+
agaaatgctagccatgttgactcctttattagtaaagcatcactgggtatgttatcggat

SEQ ID NO: 11550 - DNA, 60 bp, Xenorhabdus bovienii
  Promoter sequence Name=Xb4151_4152.C431.promoter69; Position on contig=150685..150744bp; Strand=+; Gene name=FliA
cttgccgatccttattttttaacctttgtcagggacagactgaaacttacgatgcatttg

SEQ ID NO: 11551 - DNA, 60 bp, Xenorhabdus bovienii
  Promoter sequence Name=Xb4151_4152.C431.promoter70; Position on contig=156395..156454bp; Strand=-
acaacaataaaaaccattaaatatcaattaaataaatactaacaagttataatatttacc

SEQ ID NO: 11552 - DNA, 60 bp, Xenorhabdus bovienii
  Promoter sequence Name=Xb4151_4152.C431.promoter71; Position on contig=156295..156354bp; Strand=+
aagttacataacaatatctgtcatgttgcaactttgtgcaaccatgttaaaagcggccgt

SEQ ID NO: 11553 - DNA, 60 bp, Xenorhabdus bovienii
  Promoter sequence Name=Xb4151_4152.C431.promoter72; Position on contig=156780..156839bp; Strand=-; Gene name=PutP
tgaaagttattagcattggtgaatttactgtcatgcaggttcttctccatagtgtttctg

SEQ ID NO: 11554 - DNA, 60 bp, Xenorhabdus bovienii
  Promoter sequence Name=Xb4151_4152.C431.promoter73; Position on contig=156549..156608bp; Strand=+; Gene name=PutP
attagttgttaaaaatgttttagctaatctaggatagaaagtgattttaaaataattaca

SEQ ID NO: 11555 - DNA, 60 bp, Xenorhabdus bovienii
  Promoter sequence Name=Xb4151_4152.C431.promoter74; Position on contig=158661..158720bp; Strand=-
ttaaacctgacaaactttgattgaatttatatttaaattcaatgcattaaattaaattta

SEQ ID NO: 11556 - DNA, 60 bp, Xenorhabdus bovienii
  Promoter sequence Name=Xb4151_4152.C431.promoter75; Position on contig=158301..158360bp; Strand=+
tgtgataaaaagcctctgaacaatcagaggctttttaattagttgtttattataaattgg

SEQ ID NO: 11557 - DNA, 60 bp, Xenorhabdus bovienii
  Promoter sequence Name=Xb4151_4152.C431.promoter76; Position on contig=158614..158673bp; Strand=+
atgattttatttaatcacctttagtcattaataagtattaatagtcataaatttaattta

SEQ ID NO: 11558 - DNA, 60 bp, Xenorhabdus bovienii
  Promoter sequence Name=Xb4151_4152.C432.promoter1; Position on contig= 1116..1175bp; Strand=-
tcattcctgattgttacctctgaacttcccaccttttttattcagagcataatgcgcctg

SEQ ID NO: 11559 - DNA, 60 bp, Xenorhabdus bovienii
  Promoter sequence Name=Xb4151_4152.C432.promoter2; Position on contig= 1565..1624bp; Strand=-
aacttgcgagtttaacctgtatagctgatacccgtggtagctgcggttacgtttacattt

SEQ ID NO: 11560 - DNA, 60 bp, Xenorhabdus bovienii
  Promoter sequence Name=Xb4151_4152.C432.promoter3; Position on contig= 6033..6092bp; Strand=-
gtaaaaaatacgtcttcttgtgtccataccctgtcccatccgttcgttagaataaatttt

SEQ ID NO: 11561 - DNA, 60 bp, Xenorhabdus bovienii
  Promoter sequence Name=Xb4151_4152.C432.promoter4; Position on contig= 7159..7218bp; Strand=-
gaataacggttcaatcgcctggataccgattcagagataccgacatttaaaataatctca

SEQ ID NO: 11562 - DNA, 60 bp, Xenorhabdus bovienii
  Promoter sequence Name=Xb4151_4152.C432.promoter5; Position on contig= 6851..6910bp; Strand=+
aaatcgcagtacgtcacgggtgcaggcgtggacgtcactgatgggcgtaacctccccctg

SEQ ID NO: 11563 - DNA, 60 bp, Xenorhabdus bovienii
  Promoter sequence Name=Xb4151_4152.C432.promoter6; Position on contig= 7260..7319bp; Strand=+
gattttgcatacaaacgccttcatttccactaagctctaaaaataaatttcacccacatt

SEQ ID NO: 11564 - DNA, 60 bp, Xenorhabdus bovienii; identical to SEQ ID NO: 10698
  Promoter sequence Name=Xb4151_4152.C432.promoter7; Position on contig= 13366..13425bp; Strand=+

SEQ ID NO: 11565 - DNA, 60 bp, Xenorhabdus bovienii
  Promoter sequence Name=Xb4151_4152.C432.promoter8; Position on contig= 19731..19790bp; Strand=-
acaggaaggctctcatgcttatgaaaactgtaatgttgctcccaagttataaaccctcgt

SEQ ID NO: 11566 - DNA, 60 bp, Xenorhabdus bovienii
  Promoter sequence Name=Xb4151_4152.C432.promoter9; Position on contig= 27837..27896bp; Strand=-
gagtaatacataccagttttgttttgtctttgcaggttaattattggcaatctgatgtat

SEQ ID NO: 11567 - DNA, 60 bp, Xenorhabdus bovienii
  Promoter sequence Name=Xb4151_4152.C432.promoter10; Position on contig=27778..27837bp; Strand=+
aaatttttaaagtagcaatgttatttgttttgaagcagttcacctcctatactgaatcca

SEQ ID NO: 11568 - DNA, 60 bp, Xenorhabdus bovienii
  Promoter sequence Name=Xb4151_4152.C432.promoter11; Position on contig=29602..29661bp; Strand=-
ggggtcgcattttgatgcaaccccttgataattctggtggcccctgctggacttgaacca

SEQ ID NO: 11569 - DNA, 60 bp, Xenorhabdus bovienii
  Promoter sequence Name=Xb4151_4152.C432.promoter12; Position on contig=29816..29875bp; Strand=-
ttcgtatggtcaaccaattgagcgtaaagtgcgcgagaagccgctggaataatcactaat

SEQ ID NO: 11570 - DNA, 60 bp, Xenorhabdus bovienii
  Promoter sequence Name=Xb4151_4152.C432.promoter13; Position on contig=30825..30884bp; Strand=+
gttttcgacgcgaccggcggtgccactgtattgacgttgcacaccggcagaatgcgtgcc

SEQ ID NO: 11571 - DNA, 60 bp, Xenorhabdus bovienii
  Promoter sequence Name=Xb4151_4152.C432.promoter14; Position on contig=31603..31662bp; Strand=-
tctacgacaggactggcaataatatcgttgatgcccaccttctcctttaccgtgtttttt

SEQ ID NO: 11572 - DNA, 60 bp, Xenorhabdus bovienii
  Promoter sequence Name=Xb4151_4152.C432.promoter15; Position on contig=31317..31376bp; Strand=+
tctttattttaacctacaccatcccatcaacataatataaccattggtaatatctattat

SEQ ID NO: 11573 - DNA, 60 bp, Xenorhabdus bovienii
  Promoter sequence Name=Xb4151_4152.C432.promoter16; Position on contig=32839..32898bp; Strand=-
cgagtcgtatcatgcatcaattcgagggcttctttttgggcatctgttagattaattttc

SEQ ID NO: 11574 - DNA, 60 bp, Xenorhabdus bovienii
  Promoter sequence Name=Xb4151_4152.C432.promoter17; Position on contig=34341..34400bp; Strand=-
gaactaattttatctaatataccatttttactccaaatgcctaaaggttcattagcgcca

SEQ ID NO: 11575 - DNA, 60 bp, Xenorhabdus bovienii
  Promoter sequence Name=Xb4151_4152.C432.promoter18; Position on contig=33923..33982bp; Strand=+
agaatacaacattatctatcttcacatcacattacgggatgcaatgggataatacgggat

SEQ ID NO: 11576 - DNA, 60 bp, Xenorhabdus bovienii
  Promoter sequence Name=Xb4151_4152.C432.promoter19; Position on contig=37044..37103bp; Strand=-; Gene name=InsB
cagccatctgtcatataaataataatgttgaaaggtgccagtaaagctaataggcgcaca

SEQ ID NO: 11577 - DNA, 60 bp, Xenorhabdus bovienii; identical to SEQ ID NO: 11537
  Promoter sequence Name=Xb4151_4152.C432.promoter20; Position on contig=38666..38725bp; Strand=-

SEQ ID NO: 11578 - DNA, 60 bp, Xenorhabdus bovienii
  Promoter sequence Name=Xb4151_4152.C432.promoter21; Position on contig=38609..38668bp; Strand=+
accacagagtaaatgatactgaggtggcaggacagggcaatcgcatctaaaattcattga

SEQ ID NO: 11579 - DNA, 60 bp, Xenorhabdus bovienii
  Promoter sequence Name=Xb4151_4152.C432.promoter22; Position on contig=40279..40338bp; Strand=-
ttttagctgattcctcaaaggttcattcctaaataaaggctcgacgttagaattgcgctg

SEQ ID NO: 11580 - DNA, 60 bp, Xenorhabdus bovienii
  Promoter sequence Name=Xb4151_4152.C432.promoter23; Position on contig=40039..40098bp; Strand=+
agaagaagatattttttcataatcattctccacatcttttacaacgttattatcacaaag

SEQ ID NO: 11581 - DNA, 60 bp, Xenorhabdus bovienii
  Promoter sequence Name=Xb4151_4152.C432.promoter24; Position on contig=40489..40548bp; Strand=+
gaactgagtttaatccatcctgataacgtcgaactaagtgactacgtaatcatagataaa

SEQ ID NO: 11582 - DNA, 60 bp, Xenorhabdus bovienii; identical to SEQ ID NO: 10931
  Promoter sequence Name=Xb4151_4152.C432.promoter25; Position on contig=41752..41811bp; Strand=+; Gene name=McrB

SEQ ID NO: 11583 - DNA, 60 bp, Xenorhabdus bovienii
  Promoter sequence Name=Xb4151_4152.C432.promoter26; Position on contig=45595..45654bp; Strand=-
gctttaaagtcacgataatgtgacatatgaaagaggatcaaaatcgtcatgatttcactg

SEQ ID NO: 11584 - DNA, 60 bp, Xenorhabdus bovienii
  Promoter sequence Name=Xb4151_4152.C432.promoter27; Position on contig=45863..45922bp; Strand=+
gacaaagttccagagaatagaaactggctctagatatgtctaatcaagtataaagtggta

SEQ ID NO: 11585 - DNA, 60 bp, Xenorhabdus bovienii
  Promoter sequence Name=Xb4151_4152.C432.promoter28; Position on contig=50247..50306bp; Strand=-
ccgatagatgtgcaggtaaaggaggctagaaaaagcgaaggccgcgttgtaatgaggcgg

SEQ ID NO: 11586 - DNA, 60 bp, Xenorhabdus bovienii
  Promoter sequence Name=Xb4151_4152.C432.promoter29; Position on contig=51137..51196bp; Strand=-
cgcgggcacagtgtgtgccgttgccggggttgtattttgttgcatggtattctcctgata

SEQ ID NO: 11587 - DNA, 60 bp, Xenorhabdus bovienii
  Promoter sequence Name=Xb4151_4152.C432.promoter30; Position on contig=50834..50893bp; Strand=+
tcctgacattattttttgtcccgggaaatgaattacccattgaccttatgatttccgttt

SEQ ID NO: 11588 - DNA, 60 bp, Xenorhabdus bovienii
  Promoter sequence Name=Xb4151_4152.C432.promoter31; Position on contig=54905..54964bp; Strand=-
ccctgattgatttaaagaatcagcttaattttcactataaccctttgtattaacgccatt

SEQ ID NO: 11589 - DNA, 60 bp, Xenorhabdus bovienii
  Promoter sequence Name=Xb4151_4152.C432.promoter32; Position on contig=54879..54938bp; Strand=+
ttcggggcgctttttttttgtttttaaatggcgttaatacaaagggttatagtgaaaatt

SEQ ID NO: 11590 - DNA, 60 bp, Xenorhabdus bovienii
  Promoter sequence Name=Xb4151_4152.C432.promoter33; Position on contig=56024..56083bp; Strand=+
atcgggacgggagaaagaagtattgtcactgacagtcacctaacttcatcatttaacaat

SEQ ID NO: 11591 - DNA, 60 bp, Xenorhabdus bovienii
  Promoter sequence Name=Xb4151_4152.C432.promoter34; Position on contig=57459..57518bp; Strand=-
ggttgttaaatttcctgacaaaggcgcgaaaaacaaacaatagttaataagatgttgaat

SEQ ID NO: 11592 - DNA, 60 bp, Xenorhabdus bovienii
  Promoter sequence Name=Xb4151_4152.C432.promoter35; Position on contig=57242..57301bp; Strand=+
gatttaggaggtggtttgtgcgagctgccctgcatcaatattgatggtatgaaaaaggaa

SEQ ID NO: 11593 - DNA, 60 bp, Xenorhabdus bovienii
  Promoter sequence Name=Xb4151_4152.C432.promoter36; Position on contig=60216..60275bp; Strand=-; Gene name=DcuB
aggggcttaaacacccctgaaatattcccgcctcaaacccttttcttaaaataacccgct

SEQ ID NO: 11594 - DNA, 60 bp, Xenorhabdus bovienii
  Promoter sequence Name=Xb4151_4152.C432.promoter37; Position on contig=61801..61860bp; Strand=-
tataatttacacttataaaaacgtgaaaagtttgtgttaaaacaaagtataatgatgtaa

SEQ ID NO: 11595 - DNA, 60 bp, Xenorhabdus bovienii
  Promoter sequence Name=Xb4151_4152.C432.promoter38; Position on contig=61602..61661bp; Strand=+
catgttatgtactccttagtttatttaatgttgtgaaaatttattgttaaatttttgtat

SEQ ID NO: 11596 - DNA, 60 bp, Xenorhabdus bovienii
  Promoter sequence Name=Xb4151_4152.C432.promoter39; Position on contig=61934..61993bp; Strand=+
gcattaaattacgataagtaatttcaatgtgaatactgtgctgctgttaatgtataaaac

SEQ ID NO: 11597 - DNA, 60 bp, Xenorhabdus bovienii
  Promoter sequence Name=Xb4151_4152.C432.promoter40; Position on contig=62168..62227bp; Strand=+
gcactttggtaaaggaatgagtgactttaactaacctgagtttcgtttaagaagagaact

SEQ ID NO: 11598 - DNA, 60 bp, Xenorhabdus bovienii
  Promoter sequence Name=Xb4151_4152.C432.promoter41; Position on contig=65006..65065bp; Strand=-
tatttccctgctataagagttagtaatgtcgttaagacttctatttttttaatgtgtttt

SEQ ID NO: 11599 - DNA, 60 bp, Xenorhabdus bovienii
  Promoter sequence Name=Xb4151_4152.C432.promoter42; Position on contig=64968..65027bp; Strand=+
tcatagtttggctcatctcacattgcctccgaaagattaaaacacattaaaaaaatagaa

SEQ ID NO: 11600 - DNA, 60 bp, Xenorhabdus bovienii
  Promoter sequence Name=Xb4151_4152.C432.promoter43; Position on contig=67048..67107bp; Strand=-; Gene name=SpeB
caaagacattcgactggtagcgggcttccagcgttaaccgattaattaacaattcttcat

SEQ ID NO: 11601 - DNA, 60 bp, Xenorhabdus bovienii
  Promoter sequence Name=Xb4151_4152.C432.promoter44; Position on contig=68218..68277bp; Strand=-
gattatttgtaagagtaatcttttagcgtaatcaagttccgggttgctgaaatttagtga

SEQ ID NO: 11602 - DNA, 60 bp, Xenorhabdus bovienii
  Promoter sequence Name=Xb4151_4152.C432.promoter45; Position on contig=68600..68659bp; Strand=+
gcgttacgggtgtgtgagcttagcttgaaaacggcatcccgctgttttaaaatcactttg

SEQ ID NO: 11603 - DNA, 60 bp, Xenorhabdus bovienii
  Promoter sequence Name=Xb4151_4152.C432.promoter46; Position on contig=71813..71872bp; Strand=-
tattgattgtgataatcatttgtattgccattatcattaacggtcgatatgctagcacag

SEQ ID NO: 11604 - DNA, 60 bp, Xenorhabdus bovienii
  Promoter sequence Name=Xb4151_4152.C432.promoter47; Position on contig=71643..71702bp; Strand=+
agcatacgggcgataaagatagcgcggaaatgtgcattatttttaagtaaactgaagtcc

SEQ ID NO: 11605 - DNA, 60 bp, Xenorhabdus bovienii
  Promoter sequence Name=Xb4151_4152.C432.promoter48; Position on contig=85315..85374bp; Strand=-
ccatagatttcatctcttaaaataggatttcttggaaataattactttataatcagattc

SEQ ID NO: 11606 - DNA, 60 bp, Xenorhabdus bovienii
  Promoter sequence Name=Xb4151_4152.C432.promoter49; Position on contig=85132..85191bp; Strand=+
ctactcacccaaagataaatagttatcattcactaaacaatattgattatcatttttatt

SEQ ID NO: 11607 - DNA, 60 bp, Xenorhabdus bovienii
  Promoter sequence Name=Xb4151_4152.C432.promoter50; Position on contig=87876..87935bp; Strand=-; Gene name=MenF
acggaaaagctcaggtatatcgcgatgtaattggcagtcagtatctgtattatcaccgac

SEQ ID NO: 11608 - DNA, 60 bp, Xenorhabdus bovienii
  Promoter sequence Name=Xb4151_4152.C432.promoter51; Position on contig=87669..87728bp; Strand=+; Gene name=MenF
caggtgtaatacgtttttctaattcgaaccgtaacaggcagaaaaaataaaataacagtc

SEQ ID NO: 11609 - DNA, 60 bp, Xenorhabdus bovienii
  Promoter sequence Name=Xb4151_4152.C432.promoter52; Position on contig=90667..90726bp; Strand=+
ttcccaataattcagaaaagttaaagaaaaaatagctggttctgaaataaaatatgatat

SEQ ID NO: 11610 - DNA, 60 bp, Xenorhabdus bovienii
  Promoter sequence Name=Xb4151_4152.C432.promoter53; Position on contig=92477..92536bp; Strand=-
tcttttaaatttaaaaaatactattgacaaaataatgagttattatgtatgtttattttg

SEQ ID NO: 11611 - DNA, 60 bp, Xenorhabdus bovienii; identical to SEQ ID NO: 10819
  Promoter sequence Name=Xb4151_4152.C432.promoter54; Position on contig=92760..92819bp; Strand=-

SEQ ID NO: 11612 - DNA, 60 bp, Xenorhabdus bovienii
  Promoter sequence Name=Xb4151_4152.C432.promoter55; Position on contig=92649..92708bp; Strand=+
ccaataaaaccctgttgtgcaagcattgaattgatatggtttgcggctatatacccgtcg

SEQ ID NO: 11613 - DNA, 60 bp, Xenorhabdus bovienii
  Promoter sequence Name=Xb4151_4152.C432.promoter56; Position on contig=95179..95238bp; Strand=-
ccgtattgaagccataatggatcgcaatctaaggctttagaaatttctaaaataaatcta

SEQ ID NO: 11614 - DNA, 60 bp, Xenorhabdus bovienii
  Promoter sequence Name=Xb4151_4152.C432.promoter57; Position on contig=94949..95008bp; Strand=+
tttaattaaagtaggattcttacaacaaaaactgtatttgacaaacagtataatgtgtta

SEQ ID NO: 11615 - DNA, 60 bp, Xenorhabdus bovienii
  Promoter sequence Name=Xb4151_4152.C432.promoter58; Position on contig=95309..95368bp; Strand=+
aggatagatgacaattctgtatttttgtcaaacaaaatttaacttcgtaatttttgcgta

SEQ ID NO: 11616 - DNA, 60 bp, Xenorhabdus bovienii; identical to SEQ ID NO: 11169
  Promoter sequence Name=Xb4151_4152.C432.promoter59; Position on contig=101359..101418bp; Strand=+

SEQ ID NO: 11617 - DNA, 60 bp, Xenorhabdus bovienii; identical to SEQ ID NO: 11170
  Promoter sequence Name=Xb4151_4152.C432.promoter60; Position on contig=102318..102377bp; Strand=-

SEQ ID NO: 11618 - DNA, 60 bp, Xenorhabdus bovienii; identical to SEQ ID NO: 11171
  Promoter sequence Name=Xb4151_4152.C432.promoter61; Position on contig=102216..102275bp; Strand=+

SEQ ID NO: 11619 - DNA, 60 bp, Xenorhabdus bovienii
  Promoter sequence Name=Xb4151_4152.C432.promoter62; Position on contig=105205..105264bp; Strand=-
gaactggcgtatctcttcacggattatctgacggaggtgatcgtcgttatcctttattac

SEQ ID NO: 11620 - DNA, 60 bp, Xenorhabdus bovienii
  Promoter sequence Name=Xb4151_4152.C432.promoter63; Position on contig=104761..104820bp; Strand=+
aagaacctccaataaataatatatttgcaataatccatacccccatctttcctcaataac

SEQ ID NO: 11621 - DNA, 60 bp, Xenorhabdus bovienii
  Promoter sequence Name=Xb4151_4152.C433.promoter1; Position on contig= 931..990bp; Strand=-; Gene name=MetA
ggtacacgaattggcattactgaaacctcgattgttaaatcacttgtatacttagacttc

SEQ ID NO: 11622 - DNA, 60 bp, Xenorhabdus bovienii
  Promoter sequence Name=Xb4151_4152.C433.promoter2; Position on contig= 805..864bp; Strand=+; Gene name=MetA
actcaatttctgctttattctttttcttattaccctttcttattcgatagaataaaatga

SEQ ID NO: 11623 - DNA, 60 bp, Xenorhabdus bovienii
  Promoter sequence Name=Xb4151_4152.C433.promoter3; Position on contig= 2081..2140bp; Strand=-; Gene name=AceB
tttccattatttaaacttaagtaaattaatttaaataaatcaaatgattaaatgaattta

SEQ ID NO: 11624 - DNA, 60 bp, Xenorhabdus bovienii
  Promoter sequence Name=Xb4151_4152.C433.promoter4; Position on contig= 1915..1974bp; Strand=+; Gene name=AceB
aataaaaataaaaatgagaattagctgaagcgagccatttctcatttttttaattttcta

SEQ ID NO: 11625 - DNA, 60 bp, Xenorhabdus bovienii
  Promoter sequence Name=Xb4151_4152.C433.promoter5; Position on contig= 7007..7066bp; Strand=+
tcatggataaaaataatgtttcactgaacgataaaaattagagattgcatactattaatt

SEQ ID NO: 11626 - DNA, 60 bp, Xenorhabdus bovienii
  Promoter sequence Name=Xb4151_4152.C433.promoter6; Position on contig= 8457..8516bp; Strand=-; Gene name=IclR
gtgcagaataaggtgccagttgcatcacactttaatgacagggattttaaattccctgta

SEQ ID NO: 11627 - DNA, 60 bp, Xenorhabdus bovienii
  Promoter sequence Name=Xb4151_4152.C433.promoter7; Position on contig= 9490..9549bp; Strand=-
gatatctcagagtggttccactcatcggatgtgttttccccctcgttatcatccataata

SEQ ID NO: 11628 - DNA, 60 bp, Xenorhabdus bovienii
  Promoter sequence Name=Xb4151_4152.C433.promoter8; Position on contig= 9367..9426bp; Strand=+
cgttattttggttcttttggtacgcttgttggcaacggctgtactcataaaataccctct

SEQ ID NO: 11629 - DNA, 60 bp, Xenorhabdus bovienii
  Promoter sequence Name=Xb4151_4152.C433.promoter9; Position on contig= 11202..11261bp; Strand=-; Gene name=Pgi
attggtcaaaatagtccatgatttccacccctaattgctgatataggtaaaaacgataat

SEQ ID NO: 11630 - DNA, 60 bp, Xenorhabdus bovienii
  Promoter sequence Name=Xb4151_4152.C433.promoter10; Position on contig=11151..11210bp; Strand=+; Gene name=Pgi
tgagtcaacgtttaggcattgagcatcaatatctttcatgatggaactaaaattatcgtt

SEQ ID NO: 11631 - DNA, 60 bp, Xenorhabdus bovienii
  Promoter sequence Name=Xb4151_4152.C433.promoter11; Position on contig=13028..13087bp; Strand=+
ataaaattgcctcgcctccaataaacatggctattgaggtgaggcgcttatgattacgaa

SEQ ID NO: 11632 - DNA, 60 bp, Xenorhabdus bovienii
  Promoter sequence Name=Xb4151_4152.C433.promoter12; Position on contig=17301..17360bp; Strand=-; Gene name=DgkA
aatcaaacctgttgattgattttccataaaaaattttcttcaattagcataatatttgta

SEQ ID NO: 11633 - DNA, 60 bp, Xenorhabdus bovienii
  Promoter sequence Name=Xb4151_4152.C433.promoter13; Position on contig=17121..17180bp; Strand=+; Gene name=DgkA
gataagcttactttttactaagaatttcagtggaaaattcaataatttataatatatttt

SEQ ID NO: 11634 - DNA, 60 bp, Xenorhabdus bovienii
  Promoter sequence Name=Xb4151_4152.C433.promoter14; Position on contig=19058..19117bp; Strand=+
gcctgtgtcagtaacttttttggattgatagttttcattacacctttcacactcagcatg

SEQ ID NO: 11635 - DNA, 60 bp, Xenorhabdus bovienii
  Promoter sequence Name=Xb4151_4152.C433.promoter15; Position on contig=19611..19670bp; Strand=+
taaggcctaataaagttaatccttttttccataatccaatgattaggtaatagaaaattc

SEQ ID NO: 11636 - DNA, 60 bp, Xenorhabdus bovienii
  Promoter sequence Name=Xb4151_4152.C433.promoter16; Position on contig=20429..20488bp; Strand=-
ccctaaaccgcataactagttgatttatattattagtaaatccaatctaacatgggggca

SEQ ID NO: 11637 - DNA, 60 bp, Xenorhabdus bovienii
  Promoter sequence Name=Xb4151_4152.C433.promoter17; Position on contig=26586..26645bp; Strand=-
cagctttcgagctggtttttttacgcctaaaaaacataaaagataaataaatttatcaat

SEQ ID NO: 11638 - DNA, 60 bp, Xenorhabdus bovienii
  Promoter sequence Name=Xb4151_4152.C433.promoter18; Position on contig=27125..27184bp; Strand=+
tgaaatgttttgcaagtgatagttttcattgtttctttctttgtgactattatcacggtt

SEQ ID NO: 11639 - DNA, 60 bp, Xenorhabdus bovienii; identical to SEQ ID NO: 11169
  Promoter sequence Name=Xb4151_4152.C433.promoter19; Position on contig=32819..32878bp; Strand=+

SEQ ID NO: 11640 - DNA, 60 bp, Xenorhabdus bovienii
  Promoter sequence Name=Xb4151_4152.C433.promoter20; Position on contig=33309..33368bp; Strand=+
ggtcggcatacttggtttgtaagcctgatgctacaaatggcaatagttaaaatgagttct

SEQ ID NO: 11641 - DNA, 60 bp, Xenorhabdus bovienii
  Promoter sequence Name=Xb4151_4152.C433.promoter21; Position on contig=33953..34012bp; Strand=-
tcttcatattccaccccatttgaacaatgggcgtccgtggggtgagctatggtcgcccct

SEQ ID NO: 11642 - DNA, 60 bp, Xenorhabdus bovienii
  Promoter sequence Name=Xb4151_4152.C433.promoter22; Position on contig=33691..33750bp; Strand=+
tttataaaaacccccataatagcgatattgtcgtccattcctgtagttactgtattggtt

SEQ ID NO: 11643 - DNA, 60 bp, Xenorhabdus bovienii
  Promoter sequence Name=Xb4151_4152.C433.promoter23; Position on contig=35807..35866bp; Strand=-
ggtaaaggaatattggctttagtttcagagagtaactaattgttaattattattcgcttg

SEQ ID NO: 11644 - DNA, 60 bp, Xenorhabdus bovienii
  Promoter sequence Name=Xb4151_4152.C433.promoter24; Position on contig=35776..35835bp; Strand=+
agcaattcctaaacccatcttcacgcaacaacaagcgaataataattaacaattagttac

SEQ ID NO: 11645 - DNA, 60 bp, Xenorhabdus bovienii; identical to SEQ ID NO: 11619
  Promoter sequence Name=Xb4151_4152.C433.promoter25; Position on contig=36904..36963bp; Strand=-

SEQ ID NO: 11646 - DNA, 60 bp, Xenorhabdus bovienii; identical to SEQ ID NO: 11176
  Promoter sequence Name=Xb4151_4152.C433.promoter26; Position on contig=36567..36626bp; Strand=+

SEQ ID NO: 11647 - DNA, 60 bp, Xenorhabdus bovienii
  Promoter sequence Name=Xb4151_4152.C433.promoter27; Position on contig=51047..51106bp; Strand=+
taattagtatgaaagctaggtgccgcataaaagaaaattaatcctgaaaaaataaaggaa

SEQ ID NO: 11648 - DNA, 60 bp, Xenorhabdus bovienii
  Promoter sequence Name=Xb4151_4152.C433.promoter28; Position on contig=51532..51591bp; Strand=+
agctatgaagacctgctgattgaacaaattacataaataatcgtccatactaacccgctt

SEQ ID NO: 11649 - DNA, 60 bp, Xenorhabdus bovienii
  Promoter sequence Name=Xb4151_4152.C433.promoter29; Position on contig=53811..53870bp; Strand=-
ccattatggttagataaatcccaaataaattaataggttccggcttgtaatatttggcgt

SEQ ID NO: 11650 - DNA, 60 bp, Xenorhabdus bovienii
  Promoter sequence Name=Xb4151_4152.C433.promoter30; Position on contig=55071..55130bp; Strand=-
aacatattgaataatgtttatttataaatataaatataaatataaatataaatataaata

SEQ ID NO: 11651 - DNA, 60 bp, Xenorhabdus bovienii; identical to SEQ ID NO: 10819
  Promoter sequence Name=Xb4151_4152.C433.promoter31; Position on contig=54904..54963bp; Strand=+

SEQ ID NO: 11652 - DNA, 60 bp, Xenorhabdus bovienii
  Promoter sequence Name=Xb4151_4152.C433.promoter32; Position on contig=55141..55200bp; Strand=+
ttattttattattttattattttattattttattattttattattttattattttattag

SEQ ID NO: 11653 - DNA, 60 bp, Xenorhabdus bovienii
  Promoter sequence Name=Xb4151_4152.C433.promoter33; Position on contig=56089..56148bp; Strand=-; Gene name=TldD
gagagcgtgggagaccgcatcttccaattgcttgcgctgttctgcgatatattgattagt

SEQ ID NO: 11654 - DNA, 60 bp, Xenorhabdus bovienii
  Promoter sequence Name=Xb4151_4152.C433.promoter34; Position on contig=55829..55888bp; Strand=+; Gene name=TldD
tcttcctcttcagcaggataattgtcaagccaatcttcaggctgctttaccataattttt

SEQ ID NO: 11655 - DNA, 60 bp, Xenorhabdus bovienii
  Promoter sequence Name=Xb4151_4152.C433.promoter35; Position on contig=57961..58020bp; Strand=-
aaaacagttcgtgatcatgatctctttattttcacgtcagaacagcctaatatcaatttt

SEQ ID NO: 11656 - DNA, 60 bp, Xenorhabdus bovienii
  Promoter sequence Name=Xb4151_4152.C433.promoter36; Position on contig=57586..57645bp; Strand=+
gcccaaaagagcagcccctaaaggtgccatgacagacaggtgcttggtactatcctgtag

SEQ ID NO: 11657 - DNA, 60 bp, Xenorhabdus bovienii
  Promoter sequence Name=Xb4151_4152.C433.promoter37; Position on contig=59433..59492bp; Strand=-; Gene name=FruB
ataaatttagcttatagtattgcctatttacaaatagtattcctattacaatcaaagttc

SEQ ID NO: 11658 - DNA, 60 bp, Xenorhabdus bovienii
  Promoter sequence Name=Xb4151_4152.C433.promoter38; Position on contig=61512..61571bp; Strand=-
aactcatcactgttctacttacatacccaatagattcaggtgaaaggtataaacagtgca

SEQ ID NO: 11659 - DNA, 60 bp, Xenorhabdus bovienii
  Promoter sequence Name=Xb4151_4152.C433.promoter39; Position on contig=61310..61369bp; Strand=+
gcattttccggtaatccaagctgttttgatgccagttcactgataatctctaaggcgcgc

SEQ ID NO: 11660 - DNA, 60 bp, Xenorhabdus bovienii
  Promoter sequence Name=Xb4151_4152.C433.promoter40; Position on contig=65858..65917bp; Strand=-; Gene name=GutQ
aacagagaaagatgaagggtagagtatgtataaagcacaggtaatggtataagcagctgt

SEQ ID NO: 11661 - DNA, 60 bp, Xenorhabdus bovienii
  Promoter sequence Name=Xb4151_4152.C433.promoter41; Position on contig=67987..68046bp; Strand=-
tgcgttagcaaagttgtgacaaattttactttttatcgcttgaccgtcagaatatataag

SEQ ID NO: 11662 - DNA, 60 bp, Xenorhabdus bovienii
  Promoter sequence Name=Xb4151_4152.C433.promoter42; Position on contig=67872..67931bp; Strand=+
ccggtaatgaacagagcaatagtcagaaacatggggtgttccttaaataaaatttattcc

SEQ ID NO: 11663 - DNA, 60 bp, Xenorhabdus bovienii
  Promoter sequence Name=Xb4151_4152.C433.promoter43; Position on contig=71363..71422bp; Strand=-; Gene name=BolA
caagtgccaatgctttcatcagcacttctttaatttcatcagtatccataatttgctcac

SEQ ID NO: 11664 - DNA, 60 bp, Xenorhabdus bovienii
  Promoter sequence Name=Xb4151_4152.C433.promoter44; Position on contig=71248..71307bp; Strand=+; Gene name=BolA
ttttcccataattatcgcccttgtaagtcatcctcttacaagggcgtttttcttggttta

SEQ ID NO: 11665 - DNA, 60 bp, Xenorhabdus bovienii
  Promoter sequence Name=Xb4151_4152.C433.promoter45; Position on contig=75822..75881bp; Strand=-
ttgataccacggctcattggctttcctggcattaaagagttttgttttttaattttaatt

SEQ ID NO: 11666 - DNA, 60 bp, Xenorhabdus bovienii
  Promoter sequence Name=Xb4151_4152.C433.promoter46; Position on contig=75605..75664bp; Strand=+
tttcttttcattgaatacgttctcttaatacctaagccagaaagggaaatcgtacttaaa

SEQ ID NO: 11667 - DNA, 60 bp, Xenorhabdus bovienii
  Promoter sequence Name=Xb4151_4152.C433.promoter47; Position on contig=76414..76473bp; Strand=-
ggcgtatcatcgcaaatttgtataaaattgacacatcaagtggcatataaattaattaat

SEQ ID NO: 11668 - DNA, 60 bp, Xenorhabdus bovienii
  Promoter sequence Name=Xb4151_4152.C433.promoter48; Position on contig=76272..76331bp; Strand=+
caataattaatccaatcagtgcatattcccaagtcatggcaacccctttattaacttcag

SEQ ID NO: 11669 - DNA, 60 bp, Xenorhabdus bovienii
  Promoter sequence Name=Xb4151_4152.C433.promoter49; Position on contig=78139..78198bp; Strand=-; Gene name=RplM
ttcggcgttaacaataatgatgtaatcaccagtatcaacgtgcggagtatattccgcttt

SEQ ID NO: 11670 - DNA, 60 bp, Xenorhabdus bovienii
  Promoter sequence Name=Xb4151_4152.C433.promoter50; Position on contig=77797..77856bp; Strand=+; Gene name=RplM
gcaggataattattgaattgggggtcgattttttatgatgacttctctataatcttgcga

SEQ ID NO: 11671 - DNA, 60 bp, Xenorhabdus bovienii
  Promoter sequence Name=Xb4151_4152.C433.promoter51; Position on contig=79348..79407bp; Strand=-; Gene name=Gst
agagtaggaaccgtctgataaggattcagatcaatcaaatcctgaggcaaattacctgct

SEQ ID NO: 11672 - DNA, 60 bp, Xenorhabdus bovienii
  Promoter sequence Name=Xb4151_4152.C433.promoter52; Position on contig=79008..79067bp; Strand=+; Gene name=Gst
catcattaattctcaatgtacttccccacaaaatgtgcaaaatctggtagactagtaata

SEQ ID NO: 11673 - DNA, 60 bp, Xenorhabdus bovienii
  Promoter sequence Name=Xb4151_4152.C433.promoter53; Position on contig=80767..80826bp; Strand=+
cactgactttcacctgttgtaatgttataggcgacttcatccctttttccactttctcct

SEQ ID NO: 11674 - DNA, 60 bp, Xenorhabdus bovienii
  Promoter sequence Name=Xb4151_4152.C433.promoter54; Position on contig=87222..87281bp; Strand=-
taaagcaagtggtctttggctgagggcgcaaatcagacgcctgtagcaataatatatacc

SEQ ID NO: 11675 - DNA, 60 bp, Xenorhabdus bovienii
  Promoter sequence Name=Xb4151_4152.C433.promoter55; Position on contig=87110..87169bp; Strand=+
atatgcgcaattaatccaaagccacagttatctttttcctgcgatttatcatacaacatg

SEQ ID NO: 11676 - DNA, 60 bp, Xenorhabdus bovienii
  Promoter sequence Name=Xb4151_4152.C433.promoter56; Position on contig=87647..87706bp; Strand=+; Gene name=BaeS
ttgactaagaataaataattgatttctttttgttctgaaagaatttttaaaataaatatc

SEQ ID NO: 11677 - DNA, 60 bp, Xenorhabdus bovienii
  Promoter sequence Name=Xb4151_4152.C433.promoter57; Position on contig=90367..90426bp; Strand=-; Gene name=ElbB
ccacttaatataactgcaacgcatttcatatttatctccatttgtagtagattaatgctt

SEQ ID NO: 11678 - DNA, 60 bp, Xenorhabdus bovienii
  Promoter sequence Name=Xb4151_4152.C433.promoter58; Position on contig=90181..90240bp; Strand=+; Gene name=ElbB
gcgcgaatactgcgccaacaccagggaaacttgtctacccgcttatctaaaatttgtttt

SEQ ID NO: 11679 - DNA, 60 bp, Xenorhabdus bovienii
  Promoter sequence Name=Xb4151_4152.C433.promoter59; Position on contig=93008..93067bp; Strand=-
tctctaaataaaatagattcttaatatataggtcataacgtgctggatagaattaaagtc

SEQ ID NO: 11680 - DNA, 60 bp, Xenorhabdus bovienii
  Promoter sequence Name=Xb4151_4152.C433.promoter60; Position on contig=93386..93445bp; Strand=-
aaacagtttctgcaacaacaggggcttgtctttgttgcggagaatgtgaaaattcggggt

SEQ ID NO: 11681 - DNA, 60 bp, Xenorhabdus bovienii
  Promoter sequence Name=Xb4151_4152.C433.promoter61; Position on contig=92993..93052bp; Strand=+
actttctgtaaagcagactttaattctatccagcacgttatgacctatatattaagaatc

SEQ ID NO: 11682 - DNA, 60 bp, Xenorhabdus bovienii
  Promoter sequence Name=Xb4151_4152.C433.promoter62; Position on contig=95578..95637bp; Strand=-
accttgctctaatttcgcaagtatttgatctgccttctgctgttcattatgatcatgaag

SEQ ID NO: 11683 - DNA, 60 bp, Xenorhabdus bovienii
  Promoter sequence Name=Xb4151_4152.C433.promoter63; Position on contig=95273..95332bp; Strand=+
gctgtgcagactaaaccagttttgaaacgcacaaaaattgagggaagcatactgtatcca

SEQ ID NO: 11684 - DNA, 60 bp, Xenorhabdus bovienii
  Promoter sequence Name=Xb4151_4152.C433.promoter64; Position on contig=97572..97631bp; Strand=-; Gene name=LysR
aattttctcaatcagtaattttgaatatagcaaccagattaactggctaacatttcaacg

SEQ ID NO: 11685 - DNA, 60 bp, Xenorhabdus bovienii
  Promoter sequence Name=Xb4151_4152.C433.promoter65; Position on contig=97553..97612bp; Strand=+; Gene name=LysR
ctgatcttaattatctggacgttgaaatgttagccagttaatctggttgctatattcaaa

SEQ ID NO: 11686 - DNA, 60 bp, Xenorhabdus bovienii
  Promoter sequence Name=Xb4151_4152.C433.promoter66; Position on contig=99150..99209bp; Strand=-
tttttcgtatgtcaggtaattccttcaaaaaaactgcaataaattgttaatattccttac

SEQ ID NO: 11687 - DNA, 60 bp, Xenorhabdus bovienii
  Promoter sequence Name=Xb4151_4152.C433.promoter67; Position on contig=99008..99067bp; Strand=+
atgaacatctccaagatacagaaggcaatgataataaaaggtctgtttatatttttaatg

SEQ ID NO: 11688 - DNA, 60 bp, Xenorhabdus bovienii
  Promoter sequence Name=Xb4151_4152.C433.promoter68; Position on contig=102312..102371bp; Strand=-
taagattaatctcaggaagaacaggatgatttttgacatctgtgctttaaactccttata

SEQ ID NO: 11689 - DNA, 60 bp, Xenorhabdus bovienii
  Promoter sequence Name=Xb4151_4152.C433.promoter69; Position on contig=102265..102324bp; Strand=+
tatgctcctgaaatatacgatggatgaatttctaacatagtctcttttataaggagttta

SEQ ID NO: 11690 - DNA, 60 bp, Xenorhabdus bovienii
  Promoter sequence Name=Xb4151_4152.C433.promoter70; Position on contig=103023..103082bp; Strand=+
acgccaactaatatcaacaggctatcgcccggtaaaaaagccgcaggcaatatcccattt

SEQ ID NO: 11691 - DNA, 60 bp, Xenorhabdus bovienii
  Promoter sequence Name=Xb4151_4152.C433.promoter71; Position on contig=103477..103536bp; Strand=+
cccaaaatagcatgatttaattatttatcatgtggactgcttgaatttatgtttttttat

SEQ ID NO: 11692 - DNA, 60 bp, Xenorhabdus bovienii
  Promoter sequence Name=Xb4151_4152.C433.promoter72; Position on contig=107229..107288bp; Strand=-
tatattcacattaaatcccagaatttgaagaacggtttttactggcacatcatttcttga

SEQ ID NO: 11693 - DNA, 60 bp, Xenorhabdus bovienii
  Promoter sequence Name=Xb4151_4152.C433.promoter73; Position on contig=107283..107342bp; Strand=+; Gene name=RimL
aatatatttaaaaatagttcagcgtttcttttatgccgatgatattttaatctttatggc

SEQ ID NO: 11694 - DNA, 60 bp, Xenorhabdus bovienii
  Promoter sequence Name=Xb4151_4152.C433.promoter74; Position on contig=109202..109261bp; Strand=-; Gene name=WecD
aattttactcaaatatattaacaattacatcttatttataaagaatataaaataaataac

SEQ ID NO: 11695 - DNA, 60 bp, Xenorhabdus bovienii
  Promoter sequence Name=Xb4151_4152.C433.promoter75; Position on contig=111032..111091bp; Strand=-
accaagatatatcccaatccctggcatatatcgttaccgccattcggcaaaattttgatg

SEQ ID NO: 11696 - DNA, 60 bp, Xenorhabdus bovienii
  Promoter sequence Name=Xb4151_4152.C433.promoter76; Position on contig=110747..110806bp; Strand=+
aaaaaactaataaatgaaaagcggtggcctattttggcaataacaggttcaatcatagtt

SEQ ID NO: 11697 - DNA, 60 bp, Xenorhabdus bovienii
  Promoter sequence Name=Xb4151_4152.C434.promoter1; Position on contig= 2001..2060bp; Strand=-
atggtggagctaagcgggatcgaaccgctgacctcctgcgtgcaaggcaggcgctctccc

SEQ ID NO: 11698 - DNA, 60 bp, Xenorhabdus bovienii
  Promoter sequence Name=Xb4151_4152.C434.promoter2; Position on contig= 5425..5484bp; Strand=-
tggcggtgcggacgggactcgaacccgcgacccccggcgtgacaggccggtattctaacc

SEQ ID NO: 11699 - DNA, 60 bp, Xenorhabdus bovienii
  Promoter sequence Name=Xb4151_4152.C434.promoter3; Position on contig= 6629..6688bp; Strand=-
gtcgtgatgaagctttcagccatctgacacactcctaactctactgtcatactaattatg

SEQ ID NO: 11700 - DNA, 60 bp, Xenorhabdus bovienii
  Promoter sequence Name=Xb4151_4152.C434.promoter4; Position on contig= 6528..6587bp; Strand=+
ttttcagtaattcagtgtccacatgtatctccaatagtttttgtcgttaagatttaaata

SEQ ID NO: 11701 - DNA, 60 bp, Xenorhabdus bovienii
  Promoter sequence Name=Xb4151_4152.C434.promoter5; Position on contig= 8747..8806bp; Strand=-
tcatacagatttcattcactctctttataaaaagcacccaaaaacattaaattattaata

SEQ ID NO: 11702 - DNA, 60 bp, Xenorhabdus bovienii
  Promoter sequence Name=Xb4151_4152.C434.promoter6; Position on contig= 8597..8656bp; Strand=+
cttagcaagaaagtcgctatcatgaattgataaaaaataataaaaagtattttgttgtta

SEQ ID NO: 11703 - DNA, 60 bp, Xenorhabdus bovienii
  Promoter sequence Name=Xb4151_4152.C434.promoter7; Position on contig= 9055..9114bp; Strand=-
tccatgattattgacaacgattaattttatttttttcacaggaaaattattttaaccata

SEQ ID NO: 11704 - DNA, 60 bp, Xenorhabdus bovienii
  Promoter sequence Name=Xb4151_4152.C434.promoter8; Position on contig= 9484..9543bp; Strand=-; Gene name=IlvB
ctgttcatgacgacataacaagtgttcaattcccccgtcatacagcgcatcataaatcgg

SEQ ID NO: 11705 - DNA, 60 bp, Xenorhabdus bovienii
  Promoter sequence Name=Xb4151_4152.C434.promoter9; Position on contig= 12258..12317bp; Strand=+; Gene name=IlvD
aagacaaaatgtaacaggcggctcgttccctgcctgttttgattgctgatactaattaga

SEQ ID NO: 11706 - DNA, 60 bp, Xenorhabdus bovienii
  Promoter sequence Name=Xb4151_4152.C434.promoter10; Position on contig=16834..16893bp; Strand=-; Gene name=IlvC
acgacatttgcctaactgcgctaattgctggcgcaggttcaacgtatcaaaataattagc

SEQ ID NO: 11707 - DNA, 60 bp, Xenorhabdus bovienii
  Promoter sequence Name=Xb4151_4152.C434.promoter11; Position on contig=16701..16760bp; Strand=+; Gene name=IlvC
tctaccgtaacaaatttgctgttgcataaaatgcaacataatcttgttaatatatcaatt

SEQ ID NO: 11708 - DNA, 60 bp, Xenorhabdus bovienii
  Promoter sequence Name=Xb4151_4152.C434.promoter12; Position on contig=19644..19703bp; Strand=-
ttaattagtcgcggattcattattatttataatctaattttgtgatatagattgaaattt

SEQ ID NO: 11709 - DNA, 60 bp, Xenorhabdus bovienii
  Promoter sequence Name=Xb4151_4152.C434.promoter13; Position on contig=20162..20221bp; Strand=-; Gene name=UvrD
gaaataattaagttattctattttttaaccctcacttatatgacaattatttttcaaatt

SEQ ID NO: 11710 - DNA, 60 bp, Xenorhabdus bovienii
  Promoter sequence Name=Xb4151_4152.C434.promoter14; Position on contig=25374..25433bp; Strand=-; Gene name=TrxA
cagggaccacaccattcagcccagaattcgatgagaactgcgccttttacatttaatttt

SEQ ID NO: 11711 - DNA, 60 bp, Xenorhabdus bovienii
  Promoter sequence Name=Xb4151_4152.C434.promoter15; Position on contig=25152..25211bp; Strand=+; Gene name=TrxA
agtcggaaaacttcttttctgtcaaatgtgttttgctcatagtgtggtagaatatcagtt

SEQ ID NO: 11712 - DNA, 60 bp, Xenorhabdus bovienii
  Promoter sequence Name=Xb4151_4152.C434.promoter16; Position on contig=26084..26143bp; Strand=-
agataatagtaacgaaacgtggttaatttcaaatataagaactatctcatcataaaaact

SEQ ID NO: 11713 - DNA, 60 bp, Xenorhabdus bovienii
  Promoter sequence Name=Xb4151_4152.C434.promoter17; Position on contig=26658..26717bp; Strand=-; Gene name=Rho
ggcgttttcaggcttgtcaaagttaacttcgttaactttcaacagggcaaaatagcgttc

SEQ ID NO: 11714 - DNA, 60 bp, Xenorhabdus bovienii
  Promoter sequence Name=Xb4151_4152.C434.promoter18; Position on contig=27617..27676bp; Strand=+
atttcgtcaaaacgccacaagaatgtggcgtttttttatcaagggattaacctgttcgcc

SEQ ID NO: 11715 - DNA, 60 bp, Xenorhabdus bovienii
  Promoter sequence Name=Xb4151_4152.C434.promoter19; Position on contig=28113..28172bp; Strand=-; Gene name=Rfe
attcccgcacaagccagatataaccatttatgaggtataaattcttttgttatagcaaaa

SEQ ID NO: 11716 - DNA, 60 bp, Xenorhabdus bovienii
  Promoter sequence Name=Xb4151_4152.C434.promoter20; Position on contig=30456..30515bp; Strand=-; Gene name=WecB
ttctaatactggcttcatgccttcaaggatacgacacgtgatatccgtaagatcctgccc

SEQ ID NO: 11717 - DNA, 60 bp, Xenorhabdus bovienii
  Promoter sequence Name=Xb4151_4152.C434.promoter21; Position on contig=30118..30177bp; Strand=+; Gene name=WecB
aagttttattcggggaatacaaaataatgactatttccgatggtctgtatgctacataca

SEQ ID NO: 11718 - DNA, 60 bp, Xenorhabdus bovienii
  Promoter sequence Name=Xb4151_4152.C434.promoter22; Position on contig=41048..41107bp; Strand=+; Gene name=AnsP
ttgtctgctattcactatgcataatgaaacaggctttgactcgattttataattttttat

SEQ ID NO: 11719 - DNA, 60 bp, Xenorhabdus bovienii
  Promoter sequence Name=Xb4151_4152.C434.promoter23; Position on contig=43378..43437bp; Strand=-
agagacgcttaatggtatggtttgtcgcagaaatacaacatcatacataaaatacattta

SEQ ID NO: 11720 - DNA, 60 bp, Xenorhabdus bovienii
  Promoter sequence Name=Xb4151_4152.C434.promoter24; Position on contig=48212..48271bp; Strand=-
tctgtttgtttattttctctatttaaataaaatattattttaatatttaaaattattttt

SEQ ID NO: 11721 - DNA, 60 bp, Xenorhabdus bovienii
  Promoter sequence Name=Xb4151_4152.C434.promoter25; Position on contig=48806..48865bp; Strand=-; Gene name=CyaA
gccatgaggaacgttgcttttgatataaccgggcatcattggatgatgataatgcaataa

SEQ ID NO: 11722 - DNA, 60 bp, Xenorhabdus bovienii
  Promoter sequence Name=Xb4151_4152.C434.promoter26; Position on contig=48413..48472bp; Strand=+; Gene name=CyaA
aaaataatcaactataatccctttttcaaaaaacgtattattatgtctattctgtgatta

SEQ ID NO: 11723 - DNA, 60 bp, Xenorhabdus bovienii
  Promoter sequence Name=Xb4151_4152.C434.promoter27; Position on contig=51351..51410bp; Strand=+
tttttattatttatttatttatttatttaattaattaaatatagatttatattgtatttt

SEQ ID NO: 11724 - DNA, 60 bp, Xenorhabdus bovienii
  Promoter sequence Name=Xb4151_4152.C434.promoter28; Position on contig=52008..52067bp; Strand=-
tttcatcataataattaatgcctgtaattcatgcgtcaatactctctataatcgcagtta

SEQ ID NO: 11725 - DNA, 60 bp, Xenorhabdus bovienii
  Promoter sequence Name=Xb4151_4152.C434.promoter29; Position on contig=51780..51839bp; Strand=+
ccacttttggttgccaaccagatttgatgaaagggttcctggcggttgataatgattttg

SEQ ID NO: 11726 - DNA, 60 bp, Xenorhabdus bovienii
  Promoter sequence Name=Xb4151_4152.C434.promoter30; Position on contig=53051..53110bp; Strand=+
ggcaagccactctatatgatagggcctgcaactcacgtttatgaaggtacgattcatttg

SEQ ID NO: 11727 - DNA, 60 bp, Xenorhabdus bovienii
  Promoter sequence Name=Xb4151_4152.C434.promoter31; Position on contig=57731..57790bp; Strand=+; Gene name=CorA
ggtcgaatgttgacaggctttttcgtctaagcgtaacattcgcgccttacgataaacgta

SEQ ID NO: 11728 - DNA, 60 bp, Xenorhabdus bovienii
  Promoter sequence Name=Xb4151_4152.C434.promoter32; Position on contig=59998..60057bp; Strand=-
ctatcgggatagagcattagataatttaatgataaaaaatagtcagttacattgattgta

SEQ ID NO: 11729 - DNA, 60 bp, Xenorhabdus bovienii
  Promoter sequence Name=Xb4151_4152.C434.promoter33; Position on contig=59662..59721bp; Strand=+
tagaacgcctttggcagtctgttggtcagtcataatatccttgaatgtaaaataaaatca

SEQ ID NO: 11730 - DNA, 60 bp, Xenorhabdus bovienii
  Promoter sequence Name=Xb4151_4152.C434.promoter34; Position on contig=60029..60088bp; Strand=+
ttaaattatctaatgctctatcccgatagtaggtgtttatatgatagtaaaatcggtttt

SEQ ID NO: 11731 - DNA, 60 bp, Xenorhabdus bovienii
  Promoter sequence Name=Xb4151_4152.C434.promoter35; Position on contig=60380..60439bp; Strand=+; Gene name=AraJ
aaaaaaacattactctaatttaatgaattataaccaagagtacttgttattttgaattac

SEQ ID NO: 11732 - DNA, 60 bp, Xenorhabdus bovienii
  Promoter sequence Name=Xb4151_4152.C434.promoter36; Position on contig=62350..62409bp; Strand=-
taagttttccttcaataaattgtttttcgaggtgcttcgcaaactggtaagatgagttat

SEQ ID NO: 11733 - DNA, 60 bp, Xenorhabdus bovienii
  Promoter sequence Name=Xb4151_4152.C434.promoter37; Position on contig=62084..62143bp; Strand=+
ggccatgttgccgaccagcttatcttgattgcgaaattgaagctctgcatagtcgtgatc

SEQ ID NO: 11734 - DNA, 60 bp, Xenorhabdus bovienii
  Promoter sequence Name=Xb4151_4152.C434.promoter38; Position on contig=62580..62639bp; Strand=+; Gene name=RecQ
tttcaacagtgagatagcatagtatgtacaggcacctgaatcgcgtctgtattttttact

SEQ ID NO: 11735 - DNA, 60 bp, Xenorhabdus bovienii
  Promoter sequence Name=Xb4151_4152.C434.promoter39; Position on contig=66640..66699bp; Strand=-
gtacttataataaaaatcattaagataaatatattttagagtttaaattcaccagaaaat

SEQ ID NO: 11736 - DNA, 60 bp, Xenorhabdus bovienii
  Promoter sequence Name=Xb4151_4152.C434.promoter40; Position on contig=66980..67039bp; Strand=-
tacatgaccgttttatgagtatgcaaaaccaatttctcaattagtgatacacttttagat

SEQ ID NO: 11737 - DNA, 60 bp, Xenorhabdus bovienii
  Promoter sequence Name=Xb4151_4152.C434.promoter41; Position on contig=66739..66798bp; Strand=+
caatagagtatttagctcatactccattgtatcctgagtccagatgataaaacgtcgcca

SEQ ID NO: 11738 - DNA, 60 bp, Xenorhabdus bovienii
  Promoter sequence Name=Xb4151_4152.C434.promoter42; Position on contig=67208..67267bp; Strand=+
tttccaacaagatggttttcttccagagggcaatgataaacagcataatcatccgtgcag

SEQ ID NO: 11739 - DNA, 60 bp, Xenorhabdus bovienii
  Promoter sequence Name=Xb4151_4152.C434.promoter43; Position on contig=68451..68510bp; Strand=-
taagaccgatgttatagctttaatagtaatgagttgattgccaagggtaaaattctaaaa

SEQ ID NO: 11740 - DNA, 60 bp, Xenorhabdus bovienii
  Promoter sequence Name=Xb4151_4152.C434.promoter44; Position on contig=68295..68354bp; Strand=+
tcaacataaccaataagactcaacctgctgttattaaaagataaaaatacaatggaaatt

SEQ ID NO: 11741 - DNA, 60 bp, Xenorhabdus bovienii
  Promoter sequence Name=Xb4151_4152.C434.promoter45; Position on contig=68550..68609bp; Strand=+
gaaagagtccccctctgctttcaatcagcagactgatcttttggagtttacaatatgtca

SEQ ID NO: 11742 - DNA, 60 bp, Xenorhabdus bovienii
  Promoter sequence Name=Xb4151_4152.C434.promoter46; Position on contig=69799..69858bp; Strand=-
taatttcatctattttgctgattatcgctgtgagtgatcaaaaacgttatgatacaccac

SEQ ID NO: 11743 - DNA, 60 bp, Xenorhabdus bovienii
  Promoter sequence Name=Xb4151_4152.C434.promoter47; Position on contig=69747..69806bp; Strand=+
actttttgacatgatatatcctagtttccttcaaaacagatagtctgtattagtggtgta

SEQ ID NO: 11744 - DNA, 60 bp, Xenorhabdus bovienii
  Promoter sequence Name=Xb4151_4152.C434.promoter48; Position on contig=78440..78499bp; Strand=-
tcgcatagaaggtctggatgcggcttcacagatggcctctgcatcaataaaatcattttt

SEQ ID NO: 11745 - DNA, 60 bp, Xenorhabdus bovienii
  Promoter sequence Name=Xb4151_4152.C434.promoter49; Position on contig=78093..78152bp; Strand=+
ataaaccagattaaagatacaagatggtcaccctcaccctgtaggagtatgctgacagag

SEQ ID NO: 11746 - DNA, 60 bp, Xenorhabdus bovienii
  Promoter sequence Name=Xb4151_4152.C434.promoter50; Position on contig=79759..79818bp; Strand=-; Gene name=FabG
atcaatcacatttttgcatgccgcctgatccgtcacatcaagaggaataaaatcaatatc

SEQ ID NO: 11747 - DNA, 60 bp, Xenorhabdus bovienii
  Promoter sequence Name=Xb4151_4152.C434.promoter51; Position on contig=79457..79516bp; Strand=+; Gene name=FabG
gatattttctgtcttttttatttgtaatttatattttttaatatatttattatgtttatt

SEQ ID NO: 11748 - DNA, 60 bp, Xenorhabdus bovienii
  Promoter sequence Name=Xb4151_4152.C434.promoter52; Position on contig=80375..80434bp; Strand=+
aaaccgttttttcttttccaccattgccgtaaggcagaagaaaaagataagataatcacc

SEQ ID NO: 11749 - DNA, 60 bp, Xenorhabdus bovienii
  Promoter sequence Name=Xb4151_4152.C434.promoter53; Position on contig=81492..81551bp; Strand=-
gtactttatctctctttttatcacgttcccttcatctttaaaacatctacattgattaaa

SEQ ID NO: 11750 - DNA, 60 bp, Xenorhabdus bovienii
  Promoter sequence Name=Xb4151_4152.C434.promoter54; Position on contig=81398..81457bp; Strand=+
atattcattaataatacaattggtttatttttcatagaaaagaatgatatagtgcaataa

SEQ ID NO: 11751 - DNA, 60 bp, Xenorhabdus bovienii
  Promoter sequence Name=Xb4151_4152.C434.promoter55; Position on contig=82713..82772bp; Strand=+
ccctagtgtaacttagcggtgatgggtcacatcgactatatgtgagataaaatactgccg

SEQ ID NO: 11752 - DNA, 60 bp, Xenorhabdus bovienii
  Promoter sequence Name=Xb4151_4152.C434.promoter56; Position on contig=83817..83876bp; Strand=+
gtatcatgagtaatcattttttgtgatgagtgcatggtgtatttatttattttattaatt

SEQ ID NO: 11753 - DNA, 60 bp, Xenorhabdus bovienii
  Promoter sequence Name=Xb4151_4152.C434.promoter57; Position on contig=84489..84548bp; Strand=-
aaaaacacgagtgattttaaaaaaatgacgaaacagtgttttaatgttaacttataaaaa

SEQ ID NO: 11754 - DNA, 60 bp, Xenorhabdus bovienii
  Promoter sequence Name=Xb4151_4152.C434.promoter58; Position on contig=84821..84880bp; Strand=-
gtttaacgttctgaattttcgtttaattatcccatattcccagaataaaaaatccatctt

SEQ ID NO: 11755 - DNA, 60 bp, Xenorhabdus bovienii
  Promoter sequence Name=Xb4151_4152.C434.promoter59; Position on contig=84918..84977bp; Strand=+
tgcctcggttatagctgagtagattgttttttatacttgtataatgccaggatgaatttt

SEQ ID NO: 11756 - DNA, 60 bp, Xenorhabdus bovienii
  Promoter sequence Name=Xb4151_4152.C434.promoter60; Position on contig=85813..85872bp; Strand=-; Gene name=RimL
ttctgtttccagtttgataatcataacgcctccttaaagactcaggataaaaatcattca

SEQ ID NO: 11757 - DNA, 60 bp, Xenorhabdus bovienii
  Promoter sequence Name=Xb4151_4152.C434.promoter61; Position on contig=85740..85799bp; Strand=+; Gene name=RimL
ttggataataaaaatccatgccatagccgccggaaaatgtgtatcattttccggcggttt

SEQ ID NO: 11758 - DNA, 60 bp, Xenorhabdus bovienii
  Promoter sequence Name=Xb4151_4152.C435.promoter1; Position on contig= 2277..2336bp; Strand=+; Gene name=HtrB
tgcatcgctcactcgattattaacagacataaaagcggatgattgatatcatccgctttt

SEQ ID NO: 11759 - DNA, 60 bp, Xenorhabdus bovienii
  Promoter sequence Name=Xb4151_4152.C435.promoter2; Position on contig= 4905..4964bp; Strand=-
tcagtatcattcttattacggggttgataatcaagaatctaaatggttagcttacggtaa

SEQ ID NO: 11760 - DNA, 60 bp, Xenorhabdus bovienii
  Promoter sequence Name=Xb4151_4152.C435.promoter3; Position on contig= 6005..6064bp; Strand=-
aagtaatcttaccaagttgaaaattagacacttgtcatattttcatgaaaaatagcaatt

SEQ ID NO: 11761 - DNA, 60 bp, Xenorhabdus bovienii
  Promoter sequence Name=Xb4151_4152.C435.promoter4; Position on contig= 6447..6506bp; Strand=-; Gene name=Zwf
agtttttcagacataaacgttgccaacgcttcctcaaccacctttgtgtaggctttttta

SEQ ID NO: 11762 - DNA, 60 bp, Xenorhabdus bovienii
  Promoter sequence Name=Xb4151_4152.C435.promoter5; Position on contig= 6007..6066bp; Strand=+; Gene name=Zwf
ttgctatttttcatgaaaatatgacaagtgtctaattttcaacttggtaagattacttct

SEQ ID NO: 11763 - DNA, 60 bp, Xenorhabdus bovienii
  Promoter sequence Name=Xb4151_4152.C435.promoter6; Position on contig= 7883..7942bp; Strand=+
atttctgataatcacaaaatgttacctgatgaagaaaaatagatattatgtgaagcagaa

SEQ ID NO: 11764 - DNA, 60 bp, Xenorhabdus bovienii
  Promoter sequence Name=Xb4151_4152.C435.promoter7; Position on contig= 8196..8255bp; Strand=+; Gene name=EmrE
tcttctcctgctaaccggtttttcaccggacgattctagtttttcgccaaaatgtcaggc

SEQ ID NO: 11765 - DNA, 60 bp, Xenorhabdus bovienii
  Promoter sequence Name=Xb4151_4152.C435.promoter8; Position on contig= 9553..9612bp; Strand=-; Gene name=DinG
gcaagtacgccatttttcgcaaaatcgtctgacacgaaccgtctctttacaataaaatgt

SEQ ID NO: 11766 - DNA, 60 bp, Xenorhabdus bovienii
  Promoter sequence Name=Xb4151_4152.C435.promoter9; Position on contig= 12969..13028bp; Strand=+
gcagtgcctgttgaaacgattttgaccgaatgatcctgtctgactgataaagtttgcaga

SEQ ID NO: 11767 - DNA, 60 bp, Xenorhabdus bovienii
  Promoter sequence Name=Xb4151_4152.C435.promoter10; Position on contig=13156..13215bp; Strand=+; Gene name=CaiC
aaagttagtttaagtcaaaaataattaaatcagtgtataatcaaagcattatacatccaa

SEQ ID NO: 11768 - DNA, 60 bp, Xenorhabdus bovienii
  Promoter sequence Name=Xb4151_4152.C435.promoter11; Position on contig=16161..16220bp; Strand=-
cgttgtctttttcaaaatccatagaaatacatgacagagtcatagggtattatttaatat

SEQ ID NO: 11769 - DNA, 60 bp, Xenorhabdus bovienii
  Promoter sequence Name=Xb4151_4152.C435.promoter12; Position on contig=16574..16633bp; Strand=-; Gene name=LdcC
tttcctggcgttcaaacaatttatttaataattgctgtatttcccgatataattcatcat

SEQ ID NO: 11770 - DNA, 60 bp, Xenorhabdus bovienii
  Promoter sequence Name=Xb4151_4152.C435.promoter13; Position on contig=20090..20149bp; Strand=+; Gene name=IndA
gagttagtaacttttccgcctaatttcacatcaagatcgatttgtgataaaactcacatt

SEQ ID NO: 11771 - DNA, 60 bp, Xenorhabdus bovienii
  Promoter sequence Name=Xb4151_4152.C435.promoter14; Position on contig=20896..20955bp; Strand=-; Gene name=NupC
attatttttttattgacagagaacaaatatccaaccagaagaagtattactattcccatt

SEQ ID NO: 11772 - DNA, 60 bp, Xenorhabdus bovienii
  Promoter sequence Name=Xb4151_4152.C435.promoter15; Position on contig=22363..22422bp; Strand=-; Gene name=UspA
cctaatgcataagcattaataattgcggatgaaatagggagtacatgtagaatatgtaac

SEQ ID NO: 11773 - DNA, 60 bp, Xenorhabdus bovienii
  Promoter sequence Name=Xb4151_4152.C435.promoter16; Position on contig=22149..22208bp; Strand=+; Gene name=UspA
cgttatcggcgctaacatgttgaggtgttagataactcacagtaagttatgctgaacccc

SEQ ID NO: 11774 - DNA, 60 bp, Xenorhabdus bovienii
  Promoter sequence Name=Xb4151_4152.C435.promoter17; Position on contig=23505..23564bp; Strand=-; Gene name=EndA
cataaaataatcaggtttattaaactattgaattctaattatttgagtagtattaaacca

SEQ ID NO: 11775 - DNA, 60 bp, Xenorhabdus bovienii
  Promoter sequence Name=Xb4151_4152.C435.promoter18; Position on contig=23461..23520bp; Strand=+; Gene name=EndA
ttgctaatagtcatttatttggttaaatttaattattattaagttggtttaatactactc

SEQ ID NO: 11776 - DNA, 60 bp, Xenorhabdus bovienii
  Promoter sequence Name=Xb4151_4152.C435.promoter19; Position on contig=24758..24817bp; Strand=+; Gene name=CutC
gggtaatcttttatcaaaaaaaagttaaaaaatatttcagtaaaatttatttttttacct

SEQ ID NO: 11777 - DNA, 60 bp, Xenorhabdus bovienii
  Promoter sequence Name=Xb4151_4152.C435.promoter20; Position on contig=28217..28276bp; Strand=-
caattttttgctaactgataatattcatactatttattattaaatactatgatttatagc

SEQ ID NO: 11778 - DNA, 60 bp, Xenorhabdus bovienii
  Promoter sequence Name=Xb4151_4152.C435.promoter21; Position on contig=28322..28381bp; Strand=+; Gene name=AspS
cagtataatgcctgccttttttgacaattcttcctaaagaacaatgccaaaatttccgca

SEQ ID NO: 11779 - DNA, 60 bp, Xenorhabdus bovienii
  Promoter sequence Name=Xb4151_4152.C435.promoter22; Position on contig=32015..32074bp; Strand=+; Gene name=RuvA
tatgctggatatacgtccagctttttttatgctataagctgcagcggaatgatttatttt

SEQ ID NO: 11780 - DNA, 60 bp, Xenorhabdus bovienii
  Promoter sequence Name=Xb4151_4152.C435.promoter23; Position on contig=34085..34144bp; Strand=+; Gene name=OmpW
ataataaattcattaataccttgttttgacaaaaaatctttaaaagatgtgatctgtctt

SEQ ID NO: 11781 - DNA, 60 bp, Xenorhabdus bovienii
  Promoter sequence Name=Xb4151_4152.C435.promoter24; Position on contig=36741..36800bp; Strand=-
tgagtacgggtatgacacaatggcatgatacttaaagtaaaaatgagaataatgtttcga

SEQ ID NO: 11782 - DNA, 60 bp, Xenorhabdus bovienii
  Promoter sequence Name=Xb4151_4152.C435.promoter25; Position on contig=36550..36609bp; Strand=+
ctcaagtaatgctgattttactttggctgtaatgacggtatcgtcaatataattccctgt

SEQ ID NO: 11783 - DNA, 60 bp, Xenorhabdus bovienii
  Promoter sequence Name=Xb4151_4152.C435.promoter26; Position on contig=43495..43554bp; Strand=-
tatcgatacgaaagtgcaaaaacccgctctaaaaagcgggtttttttataactatgttta

SEQ ID NO: 11784 - DNA, 60 bp, Xenorhabdus bovienii
  Promoter sequence Name=Xb4151_4152.C435.promoter27; Position on contig=44122..44181bp; Strand=-
ttctcccataatgtcgaaatttcaacgccagccaccagcgacagtggtaaattctgttgc

SEQ ID NO: 11785 - DNA, 60 bp, Xenorhabdus bovienii
  Promoter sequence Name=Xb4151_4152.C435.promoter28; Position on contig=43842..43901bp; Strand=+
tagggtgttggtgctaaagatcctgtttataaaccaaattaaaaagatagaatgaagtgg

SEQ ID NO: 11786 - DNA, 60 bp, Xenorhabdus bovienii
  Promoter sequence Name=Xb4151_4152.C435.promoter29; Position on contig=44804..44863bp; Strand=+; Gene name=SUA5
ctgcataaagtaagaggttatacttgtgagccagtttttttatattcatcctgacaaccc

SEQ ID NO: 11787 - DNA, 60 bp, Xenorhabdus bovienii
  Promoter sequence Name=Xb4151_4152.C435.promoter30; Position on contig=48089..48148bp; Strand=-; Gene name=SppA
agacaaatactccacagatccaccttatcttcaattatgatgaacaatattcttcattct

SEQ ID NO: 11788 - DNA, 60 bp, Xenorhabdus bovienii
  Promoter sequence Name=Xb4151_4152.C435.promoter31; Position on contig=49437..49496bp; Strand=-
gacgatttcattcagggaatatatacagatgatatagaataaaaaggtaaaatgctcgtt

SEQ ID NO: 11789 - DNA, 60 bp, Xenorhabdus bovienii
  Promoter sequence Name=Xb4151_4152.C435.promoter32; Position on contig=49762..49821bp; Strand=-; Gene name=TopA
ttgcgatatataaaataaattctcttttttatattgcgatagatttgcaagatatcaact

SEQ ID NO: 11790 - DNA, 60 bp, Xenorhabdus bovienii
  Promoter sequence Name=Xb4151_4152.C435.promoter33; Position on contig=49656..49715bp; Strand=+; Gene name=TopA
tgtttacaactgttaaatcatacaattgcatggcatgtgctggtatataaaataccttaa

SEQ ID NO: 11791 - DNA, 60 bp, Xenorhabdus bovienii
  Promoter sequence Name=Xb4151_4152.C435.promoter34; Position on contig=52875..52934bp; Strand=-; Gene name=LysR
catcttcaagcattctgacttgtttgctgatccctggttgagaggtgtacaatccttctg

SEQ ID NO: 11792 - DNA, 60 bp, Xenorhabdus bovienii
  Promoter sequence Name=Xb4151_4152.C435.promoter35; Position on contig=53798..53857bp; Strand=+
aaaatcagaggaaggcagctgatgttatcttcctctattctttatttaaaaattaataat

SEQ ID NO: 11793 - DNA, 60 bp, Xenorhabdus bovienii
  Promoter sequence Name=Xb4151_4152.C435.promoter36; Position on contig=54749..54808bp; Strand=+; Gene name=AcnA
gctatatggtttaaatagtgttggcggtttttatcgacttttatatccataattcatcct

SEQ ID NO: 11794 - DNA, 60 bp, Xenorhabdus bovienii
  Promoter sequence Name=Xb4151_4152.C435.promoter37; Position on contig=58063..58122bp; Strand=-
cttttagatgaccaagcacttgagatactgataattttggcggaatttttactaaaagat

SEQ ID NO: 11795 - DNA, 60 bp, Xenorhabdus bovienii
  Promoter sequence Name=Xb4151_4152.C435.promoter38; Position on contig=57715..57774bp; Strand=+
gaatatgaatatttagaaaaaaactgcgtctacactgacgcagtttttattcttaactga

SEQ ID NO: 11796 - DNA, 60 bp, Xenorhabdus bovienii
  Promoter sequence Name=Xb4151_4152.C435.promoter39; Position on contig=59136..59195bp; Strand=-
tccattcatctgatgattttatatacggacaggcgtattatttctgttataatccgttag

SEQ ID NO: 11797 - DNA, 60 bp, Xenorhabdus bovienii
  Promoter sequence Name=Xb4151_4152.C435.promoter40; Position on contig=59373..59432bp; Strand=-
cgattgttgctaattgattatgccaaataacaggcatagtggttcgttaaattaacattt

SEQ ID NO: 11798 - DNA, 60 bp, Xenorhabdus bovienii
  Promoter sequence Name=Xb4151_4152.C435.promoter41; Position on contig=59364..59423bp; Strand=+
gtggacgagaaatgttaatttaacgaaccactatgcctgttatttggcataatcaattag

SEQ ID NO: 11799 - DNA, 60 bp, Xenorhabdus bovienii
  Promoter sequence Name=Xb4151_4152.C435.promoter42; Position on contig=61095..61154bp; Strand=-; Gene name=PyrF
ctgcggatcaatcttgtcaacaaatgctaacgccgcgtcctgattgtcataatccaatgc

SEQ ID NO: 11800 - DNA, 60 bp, Xenorhabdus bovienii
  Promoter sequence Name=Xb4151_4152.C435.promoter43; Position on contig=60958..61017bp; Strand=+; Gene name=PyrF
ggcaatatctgcgtgttttcattaatacatgtttcattacggacatgtttacttttcatt

SEQ ID NO: 11801 - DNA, 60 bp, Xenorhabdus bovienii
  Promoter sequence Name=Xb4151_4152.C435.promoter44; Position on contig=63138..63197bp; Strand=-; Gene name=VacB
tacaaatagacagtaaataaactgccgccaataacaagcggcagttttataatcagcacg

SEQ ID NO: 11802 - DNA, 60 bp, Xenorhabdus bovienii
  Promoter sequence Name=Xb4151_4152.C435.promoter45; Position on contig=65166..65225bp; Strand=-
taagatgttacttgctccatacccctgattcgcgtaaaactgttatccaaaattatcgat

SEQ ID NO: 11803 - DNA, 60 bp, Xenorhabdus bovienii
  Promoter sequence Name=Xb4151_4152.C435.promoter46; Position on contig=65033..65092bp; Strand=+
aaaaatccaaagcctttttcagttcctttaactaaaccttctacgcgtagggtctgagag

SEQ ID NO: 11804 - DNA, 60 bp, Xenorhabdus bovienii
  Promoter sequence Name=Xb4151_4152.C435.promoter47; Position on contig=71781..71840bp; Strand=-
caaggtggggcaatctctgtcatttacattgactataaacagtactttactttcaaatat

SEQ ID NO: 11805 - DNA, 60 bp, Xenorhabdus bovienii
  Promoter sequence Name=Xb4151_4152.C435.promoter48; Position on contig=71734..71793bp; Strand=+
caataaataaaagaaggtattcagtcattgctatacctgaaaataatatatttgaaagta

SEQ ID NO: 11806 - DNA, 60 bp, Xenorhabdus bovienii
  Promoter sequence Name=Xb4151_4152.C435.promoter49; Position on contig=72364..72423bp; Strand=-; Gene name=MviM
aatatcaccacttttcaccaattagcaaataatcaaagttcctgtgttactatctttttc

SEQ ID NO: 11807 - DNA, 60 bp, Xenorhabdus bovienii
  Promoter sequence Name=Xb4151_4152.C435.promoter50; Position on contig=72373..72432bp; Strand=+; Gene name=MviM
agtaacacaggaactttgattatttgctaattggtgaaaagtggtgatattttctgacct

SEQ ID NO: 11808 - DNA, 60 bp, Xenorhabdus bovienii
  Promoter sequence Name=Xb4151_4152.C435.promoter51; Position on contig=75590..75649bp; Strand=-
acttcgatagtactttcattttcttgccagtcaatgtgttgactggcttttttgtatata

SEQ ID NO: 11809 - DNA, 60 bp, Xenorhabdus bovienii
  Promoter sequence Name=Xb4151_4152.C435.promoter52; Position on contig=77166..77225bp; Strand=-
gagtttagacccatatcgatattaaagacagaacgcatacttccataatgttgtatgcat

SEQ ID NO: 11810 - DNA, 60 bp, Xenorhabdus bovienii
  Promoter sequence Name=Xb4151_4152.C435.promoter53; Position on contig=76844..76903bp; Strand=+
aacgggccatgccctatactggatttgaagataatttcttcatttggtttgatgtccgca

SEQ ID NO: 11811 - DNA, 60 bp, Xenorhabdus bovienii
  Promoter sequence Name=Xb4151_4152.C435.promoter54; Position on contig=78789..78848bp; Strand=-; Gene name=FumC
gggaactctgttgggtgtttgccttccagcacctctttcgccgcagcaataattgcatca

SEQ ID NO: 11812 - DNA, 60 bp, Xenorhabdus bovienii
  Promoter sequence Name=Xb4151_4152.C435.promoter55; Position on contig=78371..78430bp; Strand=+; Gene name=FumC
tcataatgttggatctggttggtcattttcagcatggcaagacttcctataataaaaaac

SEQ ID NO: 11813 - DNA, 60 bp, Xenorhabdus bovienii
  Promoter sequence Name=Xb4151_4152.C435.promoter56; Position on contig=81030..81089bp; Strand=-
attaggcttttttgtatgttttgttgaagatctgctccttttgttgttatactaatatgt

SEQ ID NO: 11814 - DNA, 60 bp, Xenorhabdus bovienii
  Promoter sequence Name=Xb4151_4152.C435.promoter57; Position on contig=80911..80970bp; Strand=+
caatttttcttcctgttttttgaagctggacgtaagtgattctattgaaaagtatttatt

SEQ ID NO: 11815 - DNA, 60 bp, Xenorhabdus bovienii
  Promoter sequence Name=Xb4151_4152.C435.promoter58; Position on contig=83332..83391bp; Strand=-; Gene name=LysR
atcacttatcaccatattaatactttaaacatatcattcatgatgattaatatattagac

SEQ ID NO: 11816 - DNA, 60 bp, Xenorhabdus bovienii
  Promoter sequence Name=Xb4151_4152.C435.promoter59; Position on contig=83311..83370bp; Strand=+; Gene name=LysR
ataggaattcatgaatattttgtctaatatattaatcatcatgaatgatatgtttaaagt

SEQ ID NO: 11817 - DNA, 60 bp, Xenorhabdus bovienii
  Promoter sequence Name=Xb4151_4152.C435.promoter60; Position on contig=84341..84400bp; Strand=+; Gene name=NagC
cgatcacatttctattgtaaacggatatcttctaatttaaacagggacataatcgttact

SEQ ID NO: 11818 - DNA, 60 bp, Xenorhabdus bovienii
  Promoter sequence Name=Xb4151_4152.C435.promoter61; Position on contig=85667..85726bp; Strand=+; Gene name=BioD
caggcaaaacattgcgctaacgcaatccctatctcaaacacatatcctaaactttaagtc

SEQ ID NO: 11819 - DNA, 60 bp, Xenorhabdus bovienii
  Promoter sequence Name=Xb4151_4152.C435.promoter62; Position on contig=86924..86983bp; Strand=-
ttaacaaacgtgaagaaaaacagtttgataagtatgaggtggacgttgataatcgagatg

SEQ ID NO: 11820 - DNA, 60 bp, Xenorhabdus bovienii
  Promoter sequence Name=Xb4151_4152.C435.promoter63; Position on contig=86602..86661bp; Strand=+
tttcccagagccttctacaacttgatcattaggaacaacttcaagcctaaaatcttcttt

SEQ ID NO: 11821 - DNA, 60 bp, Xenorhabdus bovienii
  Promoter sequence Name=Xb4151_4152.C435.promoter64; Position on contig=88103..88162bp; Strand=-
aatagtggataaagaattcactcattgactaatgacgaagaactttttctactgatatga

SEQ ID NO: 11822 - DNA, 60 bp, Xenorhabdus bovienii
  Promoter sequence Name=Xb4151_4152.C435.promoter65; Position on contig=88045..88104bp; Strand=+
ctcctgtcacaaaaacaatcatagtcatcctcttcgttaccaattgttaccattaatttc

SEQ ID NO: 11823 - DNA, 60 bp, Xenorhabdus bovienii
  Promoter sequence Name=Xb4151_4152.C435.promoter66; Position on contig=89659..89718bp; Strand=-; Gene name=LysR
gctatcgcattttggcaactttgcagaaaaatatcaccttcaggagttagactcaagctt

SEQ ID NO: 11824 - DNA, 60 bp, Xenorhabdus bovienii
  Promoter sequence Name=Xb4151_4152.C435.promoter67; Position on contig=89372..89431bp; Strand=+; Gene name=LysR
ccaaaagttatgaagttggattaaaacaacaaaaaggaaccgatatgtatgactatatga

SEQ ID NO: 11825 - DNA, 60 bp, Xenorhabdus bovienii
  Promoter sequence Name=Xb4151_4152.C435.promoter68; Position on contig=91651..91710bp; Strand=-
ataagacattatttttaataatttattagtacaaatcttattgtagataacatctcatta

SEQ ID NO: 11826 - DNA, 60 bp, Xenorhabdus bovienii
  Promoter sequence Name=Xb4151_4152.C435.promoter69; Position on contig=91992..92051bp; Strand=-
actcatcttataacgactccgctggataactccagtgaagtcgccgttatattattagcg

SEQ ID NO: 11827 - DNA, 60 bp, Xenorhabdus bovienii
  Promoter sequence Name=Xb4151_4152.C435.promoter70; Position on contig=91728..91787bp; Strand=+
tttgcagataatgacaagatttttttcaaaagagaagcctactttcgtctactgtttgta

SEQ ID NO: 11828 - DNA, 60 bp, Xenorhabdus bovienii
  Promoter sequence Name=Xb4151_4152.C435.promoter71; Position on contig=93040..93099bp; Strand=-
agtaaaatttgacttatgagcggtgaaaaacaccgctcatatttttctatacttagaata

SEQ ID NO: 11829 - DNA, 60 bp, Xenorhabdus bovienii
  Promoter sequence Name=Xb4151_4152.C435.promoter72; Position on contig=92892..92951bp; Strand=+
agcaggatatttattttcaattacttccatgagttgatgaattttcatattatctattga

SEQ ID NO: 11830 - DNA, 60 bp, Xenorhabdus bovienii
  Promoter sequence Name=Xb4151_4152.C435.promoter73; Position on contig=93680..93739bp; Strand=+; Gene name=CirA
aaataattcatttattttccttgctatacgctgtttgtaaggcaagtcaatattttttca

SEQ ID NO: 11831 - DNA, 60 bp, Xenorhabdus bovienii
  Promoter sequence Name=Xb4151_4152.C435.promoter74; Position on contig=96530..96589bp; Strand=-
ccttttttgaggattttaactcaatataaagtatctttatttaaaggtaaattaaaataa

SEQ ID NO: 11832 - DNA, 60 bp, Xenorhabdus bovienii
  Promoter sequence Name=Xb4151_4152.C435.promoter75; Position on contig=96214..96273bp; Strand=+
ctcattgcaccggaagtcagcataactgattgatacatctcagttggtgtaattggcgtg

SEQ ID NO: 11833 - DNA, 60 bp, Xenorhabdus bovienii
  Promoter sequence Name=Xb4151_4152.C435.promoter76; Position on contig=98566..98625bp; Strand=-
acaataattaattttattatttttttaaaaaaactttaaaacaattgtaaaaaaattatg

SEQ ID NO: 11834 - DNA, 60 bp, Xenorhabdus bovienii
  Promoter sequence Name=Xb4151_4152.C435.promoter77; Position on contig=99416..99475bp; Strand=-; Gene name=AprE (BS)
atagcataataattaaacccgaaatgcaagaagcttattaacttttttataacagtttag

SEQ ID NO: 11835 - DNA, 60 bp, Xenorhabdus bovienii
  Promoter sequence Name=Xb4151_4152.C435.promoter78; Position on contig=99370..99429bp; Strand=+; Gene name=AprE (BS)
acaactataagtaaaattccaaagtgtgactatgttatttttgtaactaaactgttataa

SEQ ID NO: 11836 - DNA, 60 bp, Xenorhabdus bovienii
  Promoter sequence Name=Xb4151_4152.C435.promoter79; Position on contig=103434..103493bp; Strand=-; Gene name=AraJ
aaaaggggatcataggttatattttatatcaaagtcgcattccagtttattatccttaag

SEQ ID NO: 11837 - DNA, 60 bp, Xenorhabdus bovienii
  Promoter sequence Name=Xb4151_4152.C435.promoter80; Position on contig=103333..103392bp; Strand=+; Gene name=AraJ
tatattgtggcatgttgtcactcatgagtttttttatatgaaaagtttatcattaaggtg

SEQ ID NO: 11838 - DNA, 60 bp, Xenorhabdus bovienii; identical to SEQ ID NO: 10819
  Promoter sequence Name=Xb4151_4152.C435.promoter81; Position on contig=106758..106817bp; Strand=-

SEQ ID NO: 11839 - DNA, 60 bp, Xenorhabdus bovienii
  Promoter sequence Name=Xb4151_4152.C435.promoter82; Position on contig=106510..106569bp; Strand=+
aaaacccaatttctctcccttttcatcacataggtttgtcagataagcaatatgttttcg

SEQ ID NO: 11840 - DNA, 60 bp, Xenorhabdus bovienii
  Promoter sequence Name=Xb4151_4152.C435.promoter83; Position on contig=108487..108546bp; Strand=-; Gene name=MhpC
aatgccagaacccgatagtccccttttaaatattcaatttgatgacgaaaaatttcttta

SEQ ID NO: 11841 - DNA, 60 bp, Xenorhabdus bovienii
  Promoter sequence Name=Xb4151_4152.C435.promoter84; Position on contig=108276..108335bp; Strand=+; Gene name=MhpC
taatgatataaataaattatatattaatatggaaatcattactccggtaacatattttct

SEQ ID NO: 11842 - DNA, 60 bp, Xenorhabdus bovienii
  Promoter sequence Name=Xb4151_4152.C435.promoter85; Position on contig=109709..109768bp; Strand=+
gtttaacaaactcatagaatttttttgattacctttgaggccaacaataaaatccccgcc

SEQ ID NO: 11843 - DNA, 60 bp, Xenorhabdus bovienii
  Promoter sequence Name=Xb4151_4152.C435.promoter86; Position on contig=110570..110629bp; Strand=-
cagattattttcttttatttcattgactgtcgaatcatattttttggcaatatattccaa

SEQ ID NO: 11844 - DNA, 60 bp, Xenorhabdus bovienii
  Promoter sequence Name=Xb4151_4152.C435.promoter87; Position on contig=110143..110202bp; Strand=+
gtttttagtgagaataatctgaattttctcatttttatttgtttttttattttaattttt

SEQ ID NO: 11845 - DNA, 60 bp, Xenorhabdus bovienii
  Promoter sequence Name=Xb4151_4152.C435.promoter88; Position on contig=117028..117087bp; Strand=+
tttatttgaataagcctaagccgtaattgaagatgcttgatttttcattgtaatccttaa

SEQ ID NO: 11846 - DNA, 60 bp, Xenorhabdus bovienii
  Promoter sequence Name=Xb4151_4152.C435.promoter89; Position on contig=117486..117545bp; Strand=-
aaaatatatttatatattatctattaaatataaatataaatataaatataaatataaata

SEQ ID NO: 11847 - DNA, 60 bp, Xenorhabdus bovienii
  Promoter sequence Name=Xb4151_4152.C435.promoter90; Position on contig=117356..117415bp; Strand=+
tgatgagagccagagcgggaattttttgttttatttaaagaaatttccgctattacaggc

SEQ ID NO: 11848 - DNA, 60 bp, Xenorhabdus bovienii
  Promoter sequence Name=Xb4151_4152.C435.promoter91; Position on contig=141982..142041bp; Strand=-; Gene name=MdlB
ttgcctgtaataaaattagatatataagtaaaacacgactaaccatgtaaaatacattga

SEQ ID NO: 11849 - DNA, 60 bp, Xenorhabdus bovienii
  Promoter sequence Name=Xb4151_4152.C435.promoter92; Position on contig=143854..143913bp; Strand=-; Gene name=MdaB
caaaaaaaaataaccataacgggtctaataaattgatatatacattttatattacccata

SEQ ID NO: 11850 - DNA, 60 bp, Xenorhabdus bovienii
  Promoter sequence Name=Xb4151_4152.C435.promoter93; Position on contig=146082..146141bp; Strand=-
ctattgttcacacattcatatttatttaaggcataatccaaaaaaataaaaataattatc

SEQ ID NO: 11851 - DNA, 60 bp, Xenorhabdus bovienii
  Promoter sequence Name=Xb4151_4152.C435.promoter94; Position on contig=146047..146106bp; Strand=+
aaacgtatggaaggtaaaaaatgatttataaaattgataattatttttatttttttggat

SEQ ID NO: 11852 - DNA, 60 bp, Xenorhabdus bovienii
  Promoter sequence Name=Xb4151_4152.C435.promoter95; Position on contig=146712..146771bp; Strand=-; Gene name=AsnS
tgaaagaggtttttttattgtgttgtcgctaatcatgattttccttgtataaaaaataaa

SEQ ID NO: 11853 - DNA, 60 bp, Xenorhabdus bovienii
  Promoter sequence Name=Xb4151_4152.C435.promoter96; Position on contig=146548..146607bp; Strand=+; Gene name=AsnS
tgagtaagtagtgataactattttgaaaaatatcggtatatatatctaataatgttatca

SEQ ID NO: 11854 - DNA, 60 bp, Xenorhabdus bovienii
  Promoter sequence Name=Xb4151_4152.C435.promoter97; Position on contig=147873..147932bp; Strand=+; Gene name=SmtA
gtactgcgtaattatctaactaaggtgaaaaatgaaacacttaactttagagtcaattcc

SEQ ID NO: 11855 - DNA, 60 bp, Xenorhabdus bovienii
  Promoter sequence Name=Xb4151_4152.C435.promoter98; Position on contig=154105..154164bp; Strand=+; Gene name=ProS
aagatgtactagccaaaattattcttttcagtaggaataactcttattaaattggagtta

SEQ ID NO: 11856 - DNA, 60 bp, Xenorhabdus bovienii
  Promoter sequence Name=Xb4151_4152.C435.promoter99; Position on contig=155541..155600bp; Strand=-; Gene name=ProP
ataaattgagattgctccaatcattttatttatcattgtcattcctttattatcagttaa

SEQ ID NO: 11857 - DNA, 60 bp, Xenorhabdus bovienii
  Promoter sequence Name=Xb4151_4152.C435.promoter100; Position on contig=155399..155458bp; Strand=+; Gene name=ProP
atttttctcgctataaaaattaataaaacagtgcgagacgcgcataatataatcatacat

SEQ ID NO: 11858 - DNA, 60 bp, Xenorhabdus bovienii
  Promoter sequence Name=Xb4151_4152.C435.promoter101; Position on contig=156817..156876bp; Strand=+
taagataatttttgattagcgggtatttctgaaaagcagaagagagctcatataggactc

SEQ ID NO: 11859 - DNA, 60 bp, Xenorhabdus bovienii
  Promoter sequence Name=Xb4151_4152.C435.promoter102; Position on contig=160158..160217bp; Strand=+
ccgccagcctcaatttgtgtcaataaattgccagcgctgaaaggggcatagttttttcgg

SEQ ID NO: 11860 - DNA, 60 bp, Xenorhabdus bovienii
  Promoter sequence Name=Xb4151_4152.C435.promoter103; Position on contig=173072..173131bp; Strand=-
acgcgtaaatatttcagttaatctttaattttttcagaattttgggatattattagacct

SEQ ID NO: 11861 - DNA, 60 bp, Xenorhabdus bovienii
  Promoter sequence Name=Xb4151_4152.C435.promoter104; Position on contig=173090..173149bp; Strand=+
aaattctgaaaaaattaaagattaactgaaatatttacgcgtaacgataaaaagtcgggc

SEQ ID NO: 11862 - DNA, 60 bp, Xenorhabdus bovienii
  Promoter sequence Name=Xb4151_4152.C435.promoter105; Position on contig=177204..177263bp; Strand=-
tcaaaaaatctaggtaaagctaacttcttatagggatgcggcgatgctaaactgaaagca

SEQ ID NO: 11863 - DNA, 60 bp, Xenorhabdus bovienii
  Promoter sequence Name=Xb4151_4152.C435.promoter106; Position on contig=176957..177016bp; Strand=+
tctttatcaacaggcatctggggagctgcaggcacgcgggaggtctgtatggtgtgatct

SEQ ID NO: 11864 - DNA, 60 bp, Xenorhabdus bovienii
  Promoter sequence Name=Xb4151_4152.C435.promoter107; Position on contig=177522..177581bp; Strand=-
gctaaacggttatccggccttgcaagaacctgaaactgttgaggatttttaatccgttaa

SEQ ID NO: 11865 - DNA, 60 bp, Xenorhabdus bovienii
  Promoter sequence Name=Xb4151_4152.C435.promoter108; Position on contig=178525..178584bp; Strand=+
ttccatttgtctgacagcatccagtagccgattgcgagtcacttttttattaaagacaac

SEQ ID NO: 11866 - DNA, 60 bp, Xenorhabdus bovienii
  Promoter sequence Name=Xb4151_4152.C435.promoter109; Position on contig=180935..180994bp; Strand=-
gtcatatctgattttcaacccactgcctgatagcaggctgatgcagtaaaaattaaggag

SEQ ID NO: 11867 - DNA, 60 bp, Xenorhabdus bovienii
  Promoter sequence Name=Xb4151_4152.C435.promoter110; Position on contig=180893..180952bp; Strand=+
cagctcaggatgaacgcctcattatcttgacgtgatgaatttctccttaatttttactgc

SEQ ID NO: 11868 - DNA, 60 bp, Xenorhabdus bovienii
  Promoter sequence Name=Xb4151_4152.C435.promoter111; Position on contig=181214..181273bp; Strand=+
gctgtacagagatcaggacgtttattgtcagtgttcaaaacgcaggttaatgtttttcgg

SEQ ID NO: 11869 - DNA, 60 bp, Xenorhabdus bovienii
  Promoter sequence Name=Xb4151_4152.C435.promoter112; Position on contig=185352..185411bp; Strand=-
tagagaggaattatggataatttaaaatatttacctttcagtgaaattaatattaatgat

SEQ ID NO: 11870 - DNA, 60 bp, Xenorhabdus bovienii
  Promoter sequence Name=Xb4151_4152.C435.promoter113; Position on contig=185274..185333bp; Strand=+
cagaggaactatttgatttcttgtaaaaccatgcaacaaatccatgtttataatcagatt

SEQ ID NO: 11871 - DNA, 60 bp, Xenorhabdus bovienii
  Promoter sequence Name=Xb4151_4152.C436.promoter1; Position on contig= 2424..2483bp; Strand=-; Gene name=PutP
tcgtatttattatttcctaagcaatattcatacattgtggaactaaataacattattgtt

SEQ ID NO: 11872 - DNA, 60 bp, Xenorhabdus bovienii
  Promoter sequence Name=Xb4151_4152.C436.promoter2; Position on contig= 2423..2482bp; Strand=+; Gene name=PutP
taacaataatgttatttagttccacaatgtatgaatattgcttaggaaataataaatacg

SEQ ID NO: 11873 - DNA, 60 bp, Xenorhabdus bovienii
  Promoter sequence Name=Xb4151_4152.C436.promoter3; Position on contig= 11670..11729bp; Strand=-
atagcaaattatcaataacactcgcttaaacaagaaaaatatcactgtgaaataacatag

SEQ ID NO: 11874 - DNA, 60 bp, Xenorhabdus bovienii
  Promoter sequence Name=Xb4151_4152.C436.promoter4; Position on contig= 12069..12128bp; Strand=-
ttttgataaaaatatttaattaaaaaacaatccaaaattattattaataatatgttttct

SEQ ID NO: 11875 - DNA, 60 bp, Xenorhabdus bovienii
  Promoter sequence Name=Xb4151_4152.C436.promoter5; Position on contig= 11988..12047bp; Strand=+
aatagttttgtttttttatttttgacaataagaaattagattaatttcttggtttttttt

SEQ ID NO: 11876 - DNA, 60 bp, Xenorhabdus bovienii
  Promoter sequence Name=Xb4151_4152.C436.promoter6; Position on contig= 14903..14962bp; Strand=-
atggtcataatcattttatttccaaggagttatttagattaaatatttataaaactaaac

SEQ ID NO: 11877 - DNA, 60 bp, Xenorhabdus bovienii
  Promoter sequence Name=Xb4151_4152.C436.promoter7; Position on contig= 14935..14994bp; Strand=+
tccttggaaataaaatgattatgaccatgaagagcaatatataaagtaaaaatcagtaat

SEQ ID NO: 11878 - DNA, 60 bp, Xenorhabdus bovienii
  Promoter sequence Name=Xb4151_4152.C436.promoter8; Position on contig= 16220..16279bp; Strand=+
aggtaagaaaatacgtggattggaacgatcagaaacggaacccatgataaattttgagat

SEQ ID NO: 11879 - DNA, 60 bp, Xenorhabdus bovienii
  Promoter sequence Name=Xb4151_4152.C436.promoter9; Position on contig= 17190..17249bp; Strand=+
agccaataaatagcctttttatttgtaggttaattaattaaagattacataataatatta

SEQ ID NO: 11880 - DNA, 60 bp, Xenorhabdus bovienii
  Promoter sequence Name=Xb4151_4152.C436.promoter10; Position on contig=22246..22305bp; Strand=-
tcgctcatttcctgctttggctcataacttccctgtatatcttatcgtatagtgttggcg

SEQ ID NO: 11881 - DNA, 60 bp, Xenorhabdus bovienii
  Promoter sequence Name=Xb4151_4152.C436.promoter11; Position on contig=23106..23165bp; Strand=-; Gene name=SirA
caaaatatcatcaactgccgcactttgcttttgttgcgcaacgcgcgtatgatgcgtttc

SEQ ID NO: 11882 - DNA, 60 bp, Xenorhabdus bovienii
  Promoter sequence Name=Xb4151_4152.C436.promoter12; Position on contig=26108..26167bp; Strand=-
ttctgtcggtatcatttattttgattattcactcactggttatctgatcaaataacaaaa

SEQ ID NO: 11883 - DNA, 60 bp, Xenorhabdus bovienii
  Promoter sequence Name=Xb4151_4152.C436.promoter13; Position on contig=25852..25911bp; Strand=+
gttgtgtgaacttttatcttctttgccatgaacgccgtgggaatgtttatggtctttatt

SEQ ID NO: 11884 - DNA, 60 bp, Xenorhabdus bovienii
  Promoter sequence Name=Xb4151_4152.C436.promoter14; Position on contig=27322..27381bp; Strand=-
cattaagctattttctttacccgtttgcgggtgcaattaatacttattaggataagctaa

SEQ ID NO: 11885 - DNA, 60 bp, Xenorhabdus bovienii
  Promoter sequence Name=Xb4151_4152.C436.promoter15; Position on contig=27094..27153bp; Strand=+
tagtcataatttatatagtttaagcatttgtcatccgatgctatttgcataatagacggc

SEQ ID NO: 11886 - DNA, 60 bp, Xenorhabdus bovienii
  Promoter sequence Name=Xb4151_4152.C436.promoter16; Position on contig=27350..27409bp; Strand=+; Gene name=FtsY
acccgcaaacgggtaaagaaaatagcttaatgggataggttgttaaacgccataattaac

SEQ ID NO: 11887 - DNA, 60 bp, Xenorhabdus bovienii
  Promoter sequence Name=Xb4151_4152.C436.promoter17; Position on contig=30613..30672bp; Strand=+; Gene name=RpoD
catatctttggcttgaataaaccttatcggtgggctcaggcaaaatttacaaggccatca

SEQ ID NO: 11888 - DNA, 60 bp, Xenorhabdus bovienii
  Promoter sequence Name=Xb4151_4152.C436.promoter18; Position on contig=33288..33347bp; Strand=-
agaaaattcatgctgttaaaattttttgccaaaaaaattggaaaaagtaagataaattac

SEQ ID NO: 11889 - DNA, 60 bp, Xenorhabdus bovienii
  Promoter sequence Name=Xb4151_4152.C436.promoter19; Position on contig=33799..33858bp; Strand=-
ttcactcacaatttttgctagttgtcttaaataatcaaattcctgctgataataatattc

SEQ ID NO: 11890 - DNA, 60 bp, Xenorhabdus bovienii
  Promoter sequence Name=Xb4151_4152.C436.promoter20; Position on contig=33477..33536bp; Strand=+
ctcatcaaactaatttattaatttcaaataatgatattgagaatctctaatattttgcga

SEQ ID NO: 11891 - DNA, 60 bp, Xenorhabdus bovienii
  Promoter sequence Name=Xb4151_4152.C436.promoter21; Position on contig=42880..42939bp; Strand=+
taatacagtaagttatattttttccagaaaaaatagcaccgaaaatattataattatctc

SEQ ID NO: 11892 - DNA, 60 bp, Xenorhabdus bovienii
  Promoter sequence Name=Xb4151_4152.C436.promoter22; Position on contig=56724..56783bp; Strand=-
gcttagttttaaattgctatttatagattaattacgttctatgttattaaaatgttatta

SEQ ID NO: 11893 - DNA, 60 bp, Xenorhabdus bovienii
  Promoter sequence Name=Xb4151_4152.C436.promoter23; Position on contig=56976..57035bp; Strand=-
gtttaattcatttctaaaagaaatttttatcctatttctcaaatcgtaaaatagaaaaaa

SEQ ID NO: 11894 - DNA, 60 bp, Xenorhabdus bovienii
  Promoter sequence Name=Xb4151_4152.C436.promoter24; Position on contig=56811..56870bp; Strand=+
gacttaaacaattttttttatgtgtaggcagtaaaaaatagaagtgttattttttatctg

SEQ ID NO: 11895 - DNA, 60 bp, Xenorhabdus bovienii
  Promoter sequence Name=Xb4151_4152.C436.promoter25; Position on contig=57687..57746bp; Strand=+
cagctaattggagtacccaactgcttagagataacaacaagatgatttatattaatccgg

SEQ ID NO: 11896 - DNA, 60 bp, Xenorhabdus bovienii
  Promoter sequence Name=Xb4151_4152.C436.promoter26; Position on contig=58262..58321bp; Strand=-
ttaattttattttactaattttcagtatttaaaaactttatttactttacattcaatacg

SEQ ID NO: 11897 - DNA, 60 bp, Xenorhabdus bovienii
  Promoter sequence Name=Xb4151_4152.C436.promoter27; Position on contig=58634..58693bp; Strand=+
aatttgacttaggataagttatataggattatgtttacagtttgatataaaatgttttgt

SEQ ID NO: 11898 - DNA, 60 bp, Xenorhabdus bovienii
  Promoter sequence Name=Xb4151_4152.C436.promoter28; Position on contig=59284..59343bp; Strand=-
caatatgcagcgcagtagtaagtgaatgaatccccagttacatagataacaatgtgactg

SEQ ID NO: 11899 - DNA, 60 bp, Xenorhabdus bovienii
  Promoter sequence Name=Xb4151_4152.C436.promoter29; Position on contig=58959..59018bp; Strand=+
tcattttttatcaagtgacattcattcttcttcatattccatccttgaataattacacct

SEQ ID NO: 11900 - DNA, 60 bp, Xenorhabdus bovienii
  Promoter sequence Name=Xb4151_4152.C436.promoter30; Position on contig=65241..65300bp; Strand=-
tggattattagtccttttttgcttgctggatggtaaatcaatttacttattattgaaggg

SEQ ID NO: 11901 - DNA, 60 bp, Xenorhabdus bovienii
  Promoter sequence Name=Xb4151_4152.C436.promoter31; Position on contig=65038..65097bp; Strand=+
atccaaaccatttgctttcaaccattgatagtaaccggggctgttttcacaatgatactg

SEQ ID NO: 11902 - DNA, 60 bp, Xenorhabdus bovienii
  Promoter sequence Name=Xb4151_4152.C436.promoter32; Position on contig=65885..65944bp; Strand=-; Gene name=Exo
tccaataaaaaaaacaaaccaaaaatatacaacacttacacccaagtaattgtttttaaa

SEQ ID NO: 11903 - DNA, 60 bp, Xenorhabdus bovienii
  Promoter sequence Name=Xb4151_4152.C436.promoter33; Position on contig=69971..70030bp; Strand=-
gagattctgcccctcaaaactggcggtcatgtcaccagcaagctgcgtaacataataatc

SEQ ID NO: 11904 - DNA, 60 bp, Xenorhabdus bovienii
  Promoter sequence Name=Xb4151_4152.C436.promoter34; Position on contig=69490..69549bp; Strand=+
atatttatttaaataatataaaaataataagaatatatctgaagatgtattataaatatt

SEQ ID NO: 11905 - DNA, 60 bp, Xenorhabdus bovienii
  Promoter sequence Name=Xb4151_4152.C436.promoter35; Position on contig=70860..70919bp; Strand=-
cacaggccagccgctttcatgtcagcttcaattagctgtaatttaagtagaatttgttgt

SEQ ID NO: 11906 - DNA, 60 bp, Xenorhabdus bovienii
  Promoter sequence Name=Xb4151_4152.C436.promoter36; Position on contig=70727..70786bp; Strand=+
tttcattttatcttgccgcaagttttccgctgaaatcatatcagtgatattcttattgcc

SEQ ID NO: 11907 - DNA, 60 bp, Xenorhabdus bovienii
  Promoter sequence Name=Xb4151_4152.C436.promoter37; Position on contig=76581..76640bp; Strand=-
ctcagcggtgctgattaacgaataatttccggctggcgcgattttgcaatcattggcaga

SEQ ID NO: 11908 - DNA, 60 bp, Xenorhabdus bovienii
  Promoter sequence Name=Xb4151_4152.C436.promoter38; Position on contig=76228..76287bp; Strand=+
ctgatcgaaaccgtgagcctgccatagtcgcgtcaggagacgatcaatataatcactgcg

SEQ ID NO: 11909 - DNA, 60 bp, Xenorhabdus bovienii
  Promoter sequence Name=Xb4151_4152.C436.promoter39; Position on contig=77624..77683bp; Strand=-; Gene name=RpsB
tatgtgtcgatccgtgtgtgttatttacacaaatgagttaatttagcatctctgaaaaac

SEQ ID NO: 11910 - DNA, 60 bp, Xenorhabdus bovienii
  Promoter sequence Name=Xb4151_4152.C436.promoter40; Position on contig=77592..77651bp; Strand=+; Gene name=RpsB
ggcattctgcataattgtttctgccagattcggtttttcagagatgctaaattaactcat

SEQ ID NO: 11911 - DNA, 60 bp, Xenorhabdus bovienii
  Promoter sequence Name=Xb4151_4152.C436.promoter41; Position on contig=78623..78682bp; Strand=-; Gene name=Tsf
gtaatgtcagccatttgttttattcctcgatgtgtctcgcgggaagataatattccgcgt

SEQ ID NO: 11912 - DNA, 60 bp, Xenorhabdus bovienii
  Promoter sequence Name=Xb4151_4152.C436.promoter42; Position on contig=78584..78643bp; Strand=+; Gene name=Tsf
tgtcacggccccctttacatatctgatatagaactatccacgcggaatattatcttcccg

SEQ ID NO: 11913 - DNA, 60 bp, Xenorhabdus bovienii
  Promoter sequence Name=Xb4151_4152.C436.promoter43; Position on contig=79560..79619bp; Strand=+; Gene name=PyrH
ttttatctcatgatgaatttttacatctgggctgcatagcatggatgtgtaattgtaata

SEQ ID NO: 11914 - DNA, 60 bp, Xenorhabdus bovienii
  Promoter sequence Name=Xb4151_4152.C436.promoter44; Position on contig=82647..82706bp; Strand=-; Gene name=UppS
gtctgggtaacgttagcaatgagttacagtcactggaagatatcactcaaaatgatcctt

SEQ ID NO: 11915 - DNA, 60 bp, Xenorhabdus bovienii
  Promoter sequence Name=Xb4151_4152.C436.promoter45; Position on contig=82414..82473bp; Strand=+; Gene name=UppS
gaattttgctaataagtatatatttgtttgcgttttggcaaatggtatagttcgcgggta

SEQ ID NO: 11916 - DNA, 60 bp, Xenorhabdus bovienii
  Promoter sequence Name=Xb4151_4152.C436.promoter46; Position on contig=88073..88132bp; Strand=+; Gene name=HlpA
aatcgtttttggcggaaaatcgccttattactagataaggtgattgttaattttccaaca

SEQ ID NO: 11917 - DNA, 60 bp, Xenorhabdus bovienii
  Promoter sequence Name=Xb4151_4152.C436.promoter47; Position on contig=91076..91135bp; Strand=-; Gene name=LpxB
tgtcagcgggcgctgattgttaacagaagagaaggtagccaaaggagtatccttcatcta

SEQ ID NO: 11918 - DNA, 60 bp, Xenorhabdus bovienii
  Promoter sequence Name=Xb4151_4152.C436.promoter48; Position on contig=90989..91048bp; Strand=+; Gene name=LpxB
ttcagacggcaaataacccacatgtgaaagcattcagtgattttctggaaaattcagcaa

SEQ ID NO: 11919 - DNA, 60 bp, Xenorhabdus bovienii
  Promoter sequence Name=Xb4151_4152.C436.promoter49; Position on contig=97525..97584bp; Strand=-; Gene name=RhaT
aaacgcgtaaataatatatttatatttgtccatagaaaaacccaatttattatttttcga

SEQ ID NO: 11920 - DNA, 60 bp, Xenorhabdus bovienii
  Promoter sequence Name=Xb4151_4152.C436.promoter50; Position on contig=97473..97532bp; Strand=+; Gene name=RhaT
tattatcattctgacaaaattgggatgaaataggctgttttatcagctagactcgaaaaa

SEQ ID NO: 11921 - DNA, 60 bp, Xenorhabdus bovienii
  Promoter sequence Name=Xb4151_4152.C436.promoter51; Position on contig=99940..99999bp; Strand=+
tatcaatttaccctcagtatctattaaaggttactgaaggtaaattttattctttactga

SEQ ID NO: 11922 - DNA, 60 bp, Xenorhabdus bovienii
  Promoter sequence Name=Xb4151_4152.C436.promoter52; Position on contig=100351..100410bp; Strand=+
cagttggatgtgtaaatgaagctggtgctggcaagctagctcaaggttatcataatcatc

SEQ ID NO: 11923 - DNA, 60 bp, Xenorhabdus bovienii
  Promoter sequence Name=Xb4151_4152.C436.promoter53; Position on contig=103305..103364bp; Strand=-
actcgctggtagactagcggtttatctttattttctgggttgggtggcacaatcttgtcg

SEQ ID NO: 11924 - DNA, 60 bp, Xenorhabdus bovienii
  Promoter sequence Name=Xb4151_4152.C436.promoter54; Position on contig=103071..103130bp; Strand=+
tcgccccagcattattcatctcttcacgaacaatgttttcgactttttttaatacacgga

SEQ ID NO: 11925 - DNA, 60 bp, Xenorhabdus bovienii
  Promoter sequence Name=Xb4151_4152.C436.promoter55; Position on contig=107254..107313bp; Strand=-
tagttttatgctttgattaggaagcgattgatgatgctaattcatttataatttaattta

SEQ ID NO: 11926 - DNA, 60 bp, Xenorhabdus bovienii
  Promoter sequence Name=Xb4151_4152.C436.promoter56; Position on contig=109408..109467bp; Strand=-
acgaaatatacctttttgagaacattactattatataaagacatttataaaaataaaaag

SEQ ID NO: 11927 - DNA, 60 bp, Xenorhabdus bovienii
  Promoter sequence Name=Xb4151_4152.C436.promoter57; Position on contig=109200..109259bp; Strand=+
attttttcagctaaggaagtaggaataaatttttttatacgtatggctaaaatttcttgt

SEQ ID NO: 11928 - DNA, 60 bp, Xenorhabdus bovienii
  Promoter sequence Name=Xb4151_4152.C436.promoter58; Position on contig=109502..109561bp; Strand=+
acaattttaaaatgttatttagtcatgtctcatgcgagagtctcacttattatatgaatt

SEQ ID NO: 11929 - DNA, 60 bp, Xenorhabdus bovienii
  Promoter sequence Name=Xb4151_4152.C436.promoter59; Position on contig=109812..109871bp; Strand=+
gcaacctttttgcattcatcctcgtagttaattaaatcaaatgtcagtaatctttatcgc

SEQ ID NO: 11930 - DNA, 60 bp, Xenorhabdus bovienii
  Promoter sequence Name=Xb4151_4152.C436.promoter60; Position on contig=110635..110694bp; Strand=+
taatgtttatttaaaaaataataatcaatgtaaaaaataacaaatattattatgctatta

SEQ ID NO: 11931 - DNA, 60 bp, Xenorhabdus bovienii
  Promoter sequence Name=Xb4151_4152.C436.promoter61; Position on contig=111217..111276bp; Strand=-
gtcgtaacgtgccatcatctttttcccgtattgaaaacagtccagatgataatactatca

SEQ ID NO: 11932 - DNA, 60 bp, Xenorhabdus bovienii
  Promoter sequence Name=Xb4151_4152.C436.promoter62; Position on contig=111176..111235bp; Strand=+
cgtagagatggccgctgtagtccgtgtcccttaatgcaaattgatagtattatcatctgg

SEQ ID NO: 11933 - DNA, 60 bp, Xenorhabdus bovienii
  Promoter sequence Name=Xb4151_4152.C436.promoter63; Position on contig=112611..112670bp; Strand=+
aaagtcttttttgtggtataccgtcatgaacccaatataaaaatgtttaaaatcacgctg

SEQ ID NO: 11934 - DNA, 60 bp, Xenorhabdus bovienii
  Promoter sequence Name=Xb4151_4152.C436.promoter64; Position on contig=113249..113308bp; Strand=+
atggtaaggccttctttgcgtaattttttcgccaacatccgatagcctaaactttcccgg

SEQ ID NO: 11935 - DNA, 60 bp, Xenorhabdus bovienii
  Promoter sequence Name=Xb4151_4152.C436.promoter65; Position on contig=113930..113989bp; Strand=-
aaatgacgataacgatataaaccattatcaacctttttatccgattttagattatttttc

SEQ ID NO: 11936 - DNA, 60 bp, Xenorhabdus bovienii
  Promoter sequence Name=Xb4151_4152.C436.promoter66; Position on contig=113734..113793bp; Strand=+
atcggtaaatttttggggtgattttcgtttcataaagacactttaattaaagtcattcta

SEQ ID NO: 11937 - DNA, 60 bp, Xenorhabdus bovienii
  Promoter sequence Name=Xb4151_4152.C436.promoter67; Position on contig=114132..114191bp; Strand=+; Gene name=HisB
gtaaaacgtcaacacgccctagtatcatctaatttatatcctcaccttattattcagtca

SEQ ID NO: 11938 - DNA, 60 bp, Xenorhabdus bovienii
  Promoter sequence Name=Xb4151_4152.C437.promoter1; Position on contig= 549..608bp; Strand=-
attgctggtaatcaggaactatcattgcggctatcagaaaggctagttataatccagcgg

SEQ ID NO: 11939 - DNA, 60 bp, Xenorhabdus bovienii
  Promoter sequence Name=Xb4151_4152.C437.promoter2; Position on contig= 290..349bp; Strand=+
cggttcctgcgggtaaatttttcatggaataggctaataaccctatactgaccatcatcg

SEQ ID NO: 11940 - DNA, 60 bp, Xenorhabdus bovienii; identical to SEQ ID NO: 10931
  Promoter sequence Name=Xb4151_4152.C437.promoter3; Position on contig= 1543..1602bp; Strand=-

SEQ ID NO: 11941 - DNA, 60 bp, Xenorhabdus bovienii
  Promoter sequence Name=Xb4151_4152.C437.promoter4; Position on contig= 3359..3418bp; Strand=-; Gene name=KamA
tctgcaagttgttttagccagacttctctgacagggggaatatgggttataatgtgtgcc

SEQ ID NO: 11942 - DNA, 60 bp, Xenorhabdus bovienii
  Promoter sequence Name=Xb4151_4152.C437.promoter5; Position on contig= 3273..3332bp; Strand=+; Gene name=KamA
attttaagacctgaacggaattcgttggtactataagtagccatggatatcctctaattt

SEQ ID NO: 11943 - DNA, 60 bp, Xenorhabdus bovienii
  Promoter sequence Name=Xb4151_4152.C437.promoter6; Position on contig= 5013..5072bp; Strand=-; Gene name=GroL
ggaattgtccatccaataggataaactttgaaggcgagcagatttttctgctcgcctttt

SEQ ID NO: 11944 - DNA, 60 bp, Xenorhabdus bovienii
  Promoter sequence Name=Xb4151_4152.C437.promoter7; Position on contig= 7920..7979bp; Strand=-
gtaaagtcaaaggtctcaagtattgaaaagcgttattatcatccccactctatgatttac

SEQ ID NO: 11945 - DNA, 60 bp, Xenorhabdus bovienii
  Promoter sequence Name=Xb4151_4152.C437.promoter8; Position on contig= 8296..8355bp; Strand=-; Gene name=AspA
atgccacggatgaattcaggcacatcattgatagtacggtcactgatataaaagttttca

SEQ ID NO: 11946 - DNA, 60 bp, Xenorhabdus bovienii
  Promoter sequence Name=Xb4151_4152.C437.promoter9; Position on contig= 9688..9747bp; Strand=+
acgtgcctttttaattcatcatataaattattccacttttacttttataaaatgaaacgt

SEQ ID NO: 11947 - DNA, 60 bp, Xenorhabdus bovienii
  Promoter sequence Name=Xb4151_4152.C437.promoter10; Position on contig=10094..10153bp; Strand=+
cttaatttccctcaagcaattgtacaattcagatagtttctgattggtaacattttccta

SEQ ID NO: 11948 - DNA, 60 bp, Xenorhabdus bovienii
  Promoter sequence Name=Xb4151_4152.C437.promoter11; Position on contig=11206..11265bp; Strand=-; Gene name=MutS
tctaaatcctttgctggtgattctttcatattgatcgcattcaattctactattcctgtt

SEQ ID NO: 11949 - DNA, 60 bp, Xenorhabdus bovienii
  Promoter sequence Name=Xb4151_4152.C437.promoter12; Position on contig=10996..11055bp; Strand=+; Gene name=MutS
gactttaatttttctggccttagtttgcccgaacttggttttctggctttaatgtaatca

SEQ ID NO: 11950 - DNA, 60 bp, Xenorhabdus bovienii
  Promoter sequence Name=Xb4151_4152.C437.promoter13; Position on contig=16083..16142bp; Strand=-; Gene name=Pcm
tattttgctttaaatcttttgtaattcgaaatttctttataaatcattatgcttaaaact

SEQ ID NO: 11951 - DNA, 60 bp, Xenorhabdus bovienii
  Promoter sequence Name=Xb4151_4152.C437.promoter14; Position on contig=17708..17767bp; Strand=-
atagaacccattagattctttcctttatataggcaagcatcctctgttaagatcaatcga

SEQ ID NO: 11952 - DNA, 60 bp, Xenorhabdus bovienii
  Promoter sequence Name=Xb4151_4152.C437.promoter15; Position on contig=18406..18465bp; Strand=-
atgaaagtggttttgctcaatcgatgccacgtaaacagggcaagggttacgctgttttgg

SEQ ID NO: 11953 - DNA, 60 bp, Xenorhabdus bovienii
  Promoter sequence Name=Xb4151_4152.C437.promoter16; Position on contig=18264..18323bp; Strand=+
tttggcagcaaatcttgcgtccatccacgcataaaaaacatcggcattaatattcccggt

SEQ ID NO: 11954 - DNA, 60 bp, Xenorhabdus bovienii
  Promoter sequence Name=Xb4151_4152.C437.promoter17; Position on contig=19374..19433bp; Strand=+
tctttcatgttttaatttaacattagtcacatgtttaatcgtggtagtaaatttattaat

SEQ ID NO: 11955 - DNA, 60 bp, Xenorhabdus bovienii; identical to SEQ ID NO: 11022
  Promoter sequence Name=Xb4151_4152.C437.promoter18; Position on contig=20093..20152bp; Strand=+

SEQ ID NO: 11956 - DNA, 60 bp, Xenorhabdus bovienii
  Promoter sequence Name=Xb4151_4152.C437.promoter19; Position on contig=20809..20868bp; Strand=-
gtcatgacccatttctgggtcatgtattaaatggttagttgctgtgatatgcttccggct

SEQ ID NO: 11957 - DNA, 60 bp, Xenorhabdus bovienii
  Promoter sequence Name=Xb4151_4152.C437.promoter20; Position on contig=21071..21130bp; Strand=+
cagctatctgtcatgtaaataataatgttgaaaggtgccagtaaagctaataggcgcatt

SEQ ID NO: 11958 - DNA, 60 bp, Xenorhabdus bovienii
  Promoter sequence Name=Xb4151_4152.C437.promoter21; Position on contig=22204..22263bp; Strand=-
ccaaaaaaattgaaaaagaaaaaagtaaaatccctcacccattattttttaattaaattt

SEQ ID NO: 11959 - DNA, 60 bp, Xenorhabdus bovienii
  Promoter sequence Name=Xb4151_4152.C437.promoter22; Position on contig=22784..22843bp; Strand=-
atcaaatggtgtcctttacgcagcattgaaacgagctctatccccgctaaaatcgtttga

SEQ ID NO: 11960 - DNA, 60 bp, Xenorhabdus bovienii
  Promoter sequence Name=Xb4151_4152.C437.promoter23; Position on contig=24972..25031bp; Strand=+
tcaaaaattccccgttttgatttgttatccatatgggggtgtggtgttaattttatgttt

SEQ ID NO: 11961 - DNA, 60 bp, Xenorhabdus bovienii
  Promoter sequence Name=Xb4151_4152.C437.promoter24; Position on contig=27811..27870bp; Strand=+
acccaattcattacgagcacgttcttcaatcgcttcttgaccttttttcagatctttaat

SEQ ID NO: 11962 - DNA, 60 bp, Xenorhabdus bovienii
  Promoter sequence Name=Xb4151_4152.C437.promoter25; Position on contig=32717..32776bp; Strand=-
gaactaataattcctttttgtcatttcataaccggatctcagcctcatatattcattctt

SEQ ID NO: 11963 - DNA, 60 bp, Xenorhabdus bovienii
  Promoter sequence Name=Xb4151_4152.C437.promoter26; Position on contig=37396..37455bp; Strand=-
aagatggtagtgctcatgatgcttttctctgattccaaaaggccggctattctacctgaa

SEQ ID NO: 11964 - DNA, 60 bp, Xenorhabdus bovienii
  Promoter sequence Name=Xb4151_4152.C437.promoter27; Position on contig=38693..38752bp; Strand=-; Gene name=AnsP
agagcctaaagccataaagcgaatatgccgtacgctcagaccctgtttaagctgattttc

SEQ ID NO: 11965 - DNA, 60 bp, Xenorhabdus bovienii
  Promoter sequence Name=Xb4151_4152.C437.promoter28; Position on contig=38497..38556bp; Strand=+; Gene name=AnsP
ttattgggtaaatcataaaaaaactctggttttactaaactgccgggtattattacagat

SEQ ID NO: 11966 - DNA, 60 bp, Xenorhabdus bovienii
  Promoter sequence Name=Xb4151_4152.C437.promoter29; Position on contig=40998..41057bp; Strand=-
acagaacctttttgtacgtaatagattgaaatcaataattgacatgtcatattagatgaa

SEQ ID NO: 11967 - DNA, 60 bp, Xenorhabdus bovienii
  Promoter sequence Name=Xb4151_4152.C437.promoter30; Position on contig=40820..40879bp; Strand=+
tgcccatgtggtaatgaattgtcttcaagtaatcgtttagatgtaggtaaaacccgctct

SEQ ID NO: 11968 - DNA, 60 bp, Xenorhabdus bovienii
  Promoter sequence Name=Xb4151_4152.C437.promoter31; Position on contig=42008..42067bp; Strand=-
aaatcaactaaatagcggacagctaattttatcaatataaaaatcgttcgaattttagtc

SEQ ID NO: 11969 - DNA, 60 bp, Xenorhabdus bovienii
  Promoter sequence Name=Xb4151_4152.C437.promoter32; Position on contig=41982..42041bp; Strand=+
tttccattacgatatgaagtgatcctgactaaaattcgaacgatttttatattgataaaa

SEQ ID NO: 11970 - DNA, 60 bp, Xenorhabdus bovienii
  Promoter sequence Name=Xb4151_4152.C437.promoter33; Position on contig=42535..42594bp; Strand=-; Gene name=Map
cgttcttcgtctcgcagagtcaacaccttgaaaccattacgggtaactaaaatagtatgt

SEQ ID NO: 11971 - DNA, 60 bp, Xenorhabdus bovienii
  Promoter sequence Name=Xb4151_4152.C437.promoter34; Position on contig=42308..42367bp; Strand=+; Gene name=Map
aataattacagtgttgtgcgtgaatactgtggtcatggcatcggccgtaatatgcatgag

SEQ ID NO: 11972 - DNA, 60 bp, Xenorhabdus bovienii
  Promoter sequence Name=Xb4151_4152.C437.promoter35; Position on contig=42709..42768bp; Strand=+
ttattcctttgtgaaaaatatcatttttttcgcattgaagactgtagtaaaatcgagctc

SEQ ID NO: 11973 - DNA, 60 bp, Xenorhabdus bovienii
  Promoter sequence Name=Xb4151_4152.C437.promoter36; Position on contig=44737..44796bp; Strand=-; Gene name=CstA
attattgttcataagacaccctttttaaggtaagacgaacagcaagtcatgatttaatct

SEQ ID NO: 11974 - DNA, 60 bp, Xenorhabdus bovienii
  Promoter sequence Name=Xb4151_4152.C437.promoter37; Position on contig=44672..44731bp; Strand=+; Gene name=CstA
agtgtggcgaggagtatagcttccctatggctatcagatagctggcttataaaaagggaa

SEQ ID NO: 11975 - DNA, 60 bp, Xenorhabdus bovienii
  Promoter sequence Name=Xb4151_4152.C437.promoter38; Position on contig=46978..47037bp; Strand=+
cggtaacggctatactgtaatagcgataccccgcataatcgcctttgtattatgtggggt

SEQ ID NO: 11976 - DNA, 60 bp, Xenorhabdus bovienii
  Promoter sequence Name=Xb4151_4152.C437.promoter39; Position on contig=49180..49239bp; Strand=-
aatactaatagctggttttattcgattggtttaaataccttgctatttaaaattaatcta

SEQ ID NO: 11977 - DNA, 60 bp, Xenorhabdus bovienii
  Promoter sequence Name=Xb4151_4152.C437.promoter40; Position on contig=49417..49476bp; Strand=-
gaataaaaatctaaaaataaaattagacaaaacttttagtcgcgaattttaattaaacaa

SEQ ID NO: 11978 - DNA, 60 bp, Xenorhabdus bovienii
  Promoter sequence Name=Xb4151_4152.C437.promoter41; Position on contig=49403..49462bp; Strand=+
ttccacaataaaaattgtttaattaaaattcgcgactaaaagttttgtctaattttattt

SEQ ID NO: 11979 - DNA, 60 bp, Xenorhabdus bovienii
  Promoter sequence Name=Xb4151_4152.C437.promoter42; Position on contig=49825..49884bp; Strand=+
ttttttattctatatggctcgtgaaatttaataaaataggtatggattataattaattaa

SEQ ID NO: 11980 - DNA, 60 bp, Xenorhabdus bovienii
  Promoter sequence Name=Xb4151_4152.C437.promoter43; Position on contig=51077..51136bp; Strand=+
taacaaaatgccccagtttttgccgagatagccactgatcacgctgggataatctttaca

SEQ ID NO: 11981 - DNA, 60 bp, Xenorhabdus bovienii
  Promoter sequence Name=Xb4151_4152.C437.promoter44; Position on contig=51565..51624bp; Strand=+
gagatagcaaagggaaaccatacagaaaaaaaatgcgggtttatttgtatcatcatgata

SEQ ID NO: 11982 - DNA, 60 bp, Xenorhabdus bovienii
  Promoter sequence Name=Xb4151_4152.C437.promoter45; Position on contig=52105..52164bp; Strand=+; Gene name=FabH
ctgtcacattttaaaattaacttcataaggtatgattgcattgtattataaataaattta

SEQ ID NO: 11983 - DNA, 60 bp, Xenorhabdus bovienii
  Promoter sequence Name=Xb4151_4152.C437.promoter46; Position on contig=53341..53400bp; Strand=+
ctgaatatataaacttaaaatttatgataatgattctgcttgtttaatataatgatttct

SEQ ID NO: 11984 - DNA, 60 bp, Xenorhabdus bovienii
  Promoter sequence Name=Xb4151_4152.C437.promoter47; Position on contig=53552..53611bp; Strand=+; Gene name=CsgG
aaatcacacgatttttccactatttgaattcaggtaatggccatgattaaaattaacttg

SEQ ID NO: 11985 - DNA, 60 bp, Xenorhabdus bovienii
  Promoter sequence Name=Xb4151_4152.C437.promoter48; Position on contig=56997..57056bp; Strand=-
caataaaccttgtagaatcacctacactttctaggtatgtcacaccgtaaaaagaccatt

SEQ ID NO: 11986 - DNA, 60 bp, Xenorhabdus bovienii
  Promoter sequence Name=Xb4151_4152.C437.promoter49; Position on contig=56824..56883bp; Strand=+
cccccatggcagccagataagccgaagaaatatggctgaccatataggtattaattaata

SEQ ID NO: 11987 - DNA, 60 bp, Xenorhabdus bovienii
  Promoter sequence Name=Xb4151_4152.C437.promoter50; Position on contig=61498..61557bp; Strand=-
catgatgtctttcacctgaattaacaattcaatcttatttaacaagaaataattaggctt

SEQ ID NO: 11988 - DNA, 60 bp, Xenorhabdus bovienii
  Promoter sequence Name=Xb4151_4152.C437.promoter51; Position on contig=61236..61295bp; Strand=+
tgccaatgtgctaccggagccattgcgaacgaaggtagtttttacattatatttttcacc

SEQ ID NO: 11989 - DNA, 60 bp, Xenorhabdus bovienii
  Promoter sequence Name=Xb4151_4152.C437.promoter52; Position on contig=62572..62631bp; Strand=-
taaagggtgaaaatctgagattgtaacgccagatatatccttcaaatcagaatagatatt

SEQ ID NO: 11990 - DNA, 60 bp, Xenorhabdus bovienii
  Promoter sequence Name=Xb4151_4152.C437.promoter53; Position on contig=62418..62477bp; Strand=+
acaagaggggcaagtcacatcaatctttgccatttgaatgttctccaaataggcaggcta

SEQ ID NO: 11991 - DNA, 60 bp, Xenorhabdus bovienii
  Promoter sequence Name=Xb4151_4152.C437.promoter54; Position on contig=63070..63129bp; Strand=-; Gene name=PncA
catattgtgcgagaacatcttccagccccgttccgtcgaacgcattataaaatcgcttgg

SEQ ID NO: 11992 - DNA, 60 bp, Xenorhabdus bovienii
  Promoter sequence Name=Xb4151_4152.C437.promoter55; Position on contig=62678..62737bp; Strand=+; Gene name=PncA
aatcaagaggattattttttttaatataaaatatacgatatatcgcatatgatggaggct

SEQ ID NO: 11993 - DNA, 60 bp, Xenorhabdus bovienii
  Promoter sequence Name=Xb4151_4152.C437.promoter56; Position on contig=66080..66139bp; Strand=-
agttctctctaaacgtttctataatttaagagcatgctgttccctggcattttttaatgc

SEQ ID NO: 11994 - DNA, 60 bp, Xenorhabdus bovienii
  Promoter sequence Name=Xb4151_4152.C437.promoter57; Position on contig=65654..65713bp; Strand=+
tcaatcacacggcgctgttgattaaccttgatgggataaaccaggaaataatcgccctta

SEQ ID NO: 11995 - DNA, 60 bp, Xenorhabdus bovienii
  Promoter sequence Name=Xb4151_4152.C437.promoter58; Position on contig=66434..66493bp; Strand=-
atgtattttgataaatttcattttgcaattttgcctgattgcaggtataaactgcgcgcg

SEQ ID NO: 11996 - DNA, 60 bp, Xenorhabdus bovienii
  Promoter sequence Name=Xb4151_4152.C437.promoter59; Position on contig=66161..66220bp; Strand=+
caatatggtgccgactcgatattaccagtctgtttgaatgctttcggtaacatcggaatg

SEQ ID NO: 11997 - DNA, 60 bp, Xenorhabdus bovienii
  Promoter sequence Name=Xb4151_4152.C437.promoter60; Position on contig=69008..69067bp; Strand=-
gaaaaatagctaatacagttatttttctcttttcttgatgctacatttatacttacaaat

SEQ ID NO: 11998 - DNA, 60 bp, Xenorhabdus bovienii
  Promoter sequence Name=Xb4151_4152.C437.promoter61; Position on contig=69422..69481bp; Strand=-
gaaattattttaattaatcaactttttacatttctatacaatataaatatcattgaatta

SEQ ID NO: 11999 - DNA, 60 bp, Xenorhabdus bovienii
  Promoter sequence Name=Xb4151_4152.C437.promoter62; Position on contig=69759..69818bp; Strand=+; Gene name=FecB
caatccattatttacctatataaattattcatggacttaccgataactttcatattacgt

SEQ ID NO: 12000 - DNA, 60 bp, Xenorhabdus bovienii
  Promoter sequence Name=Xb4151_4152.C437.promoter63; Position on contig=71128..71187bp; Strand=-; Gene name=GltP
gtccataaagtatcctgttgttaatataattaattgtttttatttgttatttttttatcg

SEQ ID NO: 12001 - DNA, 60 bp, Xenorhabdus bovienii
  Promoter sequence Name=Xb4151_4152.C437.promoter64; Position on contig=71090..71149bp; Strand=+; Gene name=GltP
cggcaaaaatcaaacatttttgctatgaaacaataaagcgataaaaaaataacaaataaa

SEQ ID NO: 12002 - DNA, 60 bp, Xenorhabdus bovienii
  Promoter sequence Name=Xb4151_4152.C437.promoter65; Position on contig=72983..73042bp; Strand=-; Gene name=PutA
attaatcagcattttatacgatttagcaggtaacatttcttttgcgatattatgcagttt

SEQ ID NO: 12003 - DNA, 60 bp, Xenorhabdus bovienii
  Promoter sequence Name=Xb4151_4152.C437.promoter66; Position on contig=72753..72812bp; Strand=+; Gene name=PutA
aataacaaaaaagttaactaattaataacacactaaataatttattgttaatattataac

SEQ ID NO: 12004 - DNA, 60 bp, Xenorhabdus bovienii
  Promoter sequence Name=Xb4151_4152.C437.promoter67; Position on contig=76004..76063bp; Strand=-
atcccaaaatcatacacgttgtattttcttccttgttaatactccttattatttcacatg

SEQ ID NO: 12005 - DNA, 60 bp, Xenorhabdus bovienii
  Promoter sequence Name=Xb4151_4152.C437.promoter68; Position on contig=75964..76023bp; Strand=+
attgatgaatcattgccctaaatgttaaagaattacattacatgtgaaataataaggagt

SEQ ID NO: 12006 - DNA, 60 bp, Xenorhabdus bovienii
  Promoter sequence Name=Xb4151_4152.C437.promoter69; Position on contig=79343..79402bp; Strand=-; Gene name=MazG
gatactttatcctgtttagatggtttgtagcgcatttaaggttagggtatactgctttcc

SEQ ID NO: 12007 - DNA, 60 bp, Xenorhabdus bovienii
  Promoter sequence Name=Xb4151_4152.C437.promoter70; Position on contig=83879..83938bp; Strand=+; Gene name=BaeS
cggtaacggaaataatgcctcggtttacggagcggcggtttggggagtaaaattgcacca

SEQ ID NO: 12008 - DNA, 60 bp, Xenorhabdus bovienii
  Promoter sequence Name=Xb4151_4152.C437.promoter71; Position on contig=87915..87974bp; Strand=+; Gene name=Pfs
gtaaacagtgattcaatgttacactgccgcatcgaataagagtgccttttcatagacact

SEQ ID NO: 12009 - DNA, 60 bp, Xenorhabdus bovienii
  Promoter sequence Name=Xb4151_4152.C437.promoter72; Position on contig=90068..90127bp; Strand=-
cttgttgcctttgtgtagcaaaacttgaacgaatcagtcaggtatcggataatcgcggct

SEQ ID NO: 12010 - DNA, 60 bp, Xenorhabdus bovienii
  Promoter sequence Name=Xb4151_4152.C437.promoter73; Position on contig=89981..90040bp; Strand=+
aatgcagcatcatcgctcatttttttgctccagaccggtgttccggtaaaaattctcaga

SEQ ID NO: 12011 - DNA, 60 bp, Xenorhabdus bovienii
  Promoter sequence Name=Xb4151_4152.C437.promoter74; Position on contig=96962..97021bp; Strand=-; Gene name=SfsA
gctaatggtcggcaagatcaatgaactgaaattaaagtagcgaatgctacaatgacgtcc

SEQ ID NO: 12012 - DNA, 60 bp, Xenorhabdus bovienii
  Promoter sequence Name=Xb4151_4152.C437.promoter75; Position on contig=96926..96985bp; Strand=+; Gene name=SfsA
aataacaaaggatcaccctaaccattaactttcaatggacgtcattgtagcattcgctac

SEQ ID NO: 12013 - DNA, 60 bp, Xenorhabdus bovienii
  Promoter sequence Name=Xb4151_4152.C437.promoter76; Position on contig=98098..98157bp; Strand=-; Gene name=DksA
gatcagggaagttcgctgcctcatcttgcatatgagatacagtacggtctacttcatccc

SEQ ID NO: 12014 - DNA, 60 bp, Xenorhabdus bovienii
  Promoter sequence Name=Xb4151_4152.C437.promoter77; Position on contig=97822..97881bp; Strand=+; Gene name=DksA
ttgcaaaactaatggcaggaacaattgccaacctcgcagtcatctgctatttatagcggc

SEQ ID NO: 12015 - DNA, 60 bp, Xenorhabdus bovienii
  Promoter sequence Name=Xb4151_4152.C437.promoter78; Position on contig=99357..99416bp; Strand=+; Gene name=PcnB
gtgtttctattggctctgcaagcattctcaaagaatgtccagtaagttatgattagcggc

SEQ ID NO: 12016 - DNA, 60 bp, Xenorhabdus bovienii
  Promoter sequence Name=Xb4151_4152.C437.promoter79; Position on contig=105761..105820bp; Strand=-
gatggtgatgagtatatagttgatacagtaagttgtaatggtcatgtttatatttgtgga

SEQ ID NO: 12017 - DNA, 60 bp, Xenorhabdus bovienii
  Promoter sequence Name=Xb4151_4152.C437.promoter80; Position on contig=106177..106236bp; Strand=-
tataaaataaaagtgttattttttttatgtgtcatttgttgtgtttgtgtaatttgtttg

SEQ ID NO: 12018 - DNA, 60 bp, Xenorhabdus bovienii
  Promoter sequence Name=Xb4151_4152.C437.promoter81; Position on contig=106052..106111bp; Strand=+
ttatagttcaataaataaatatcatttccaatatacataataaatactataatatgttta

SEQ ID NO: 12019 - DNA, 60 bp, Xenorhabdus bovienii
  Promoter sequence Name=Xb4151_4152.C437.promoter82; Position on contig=106694..106753bp; Strand=-; Gene name=PanD
gttataaatatcaatcgcttcatattccagaatgccggctgcatccataaaattttgatc

SEQ ID NO: 12020 - DNA, 60 bp, Xenorhabdus bovienii
  Promoter sequence Name=Xb4151_4152.C437.promoter83; Position on contig=106494..106553bp; Strand=+; Gene name=PanD
ctcaaaaaaactgctagtcgcattttggtgtttttttgacaacctgatatagtcattcct

SEQ ID NO: 12021 - DNA, 60 bp, Xenorhabdus bovienii
  Promoter sequence Name=Xb4151_4152.C437.promoter84; Position on contig=108907..108966bp; Strand=-; Gene name=CynT
cttcaatttttctcatcataactaatagcctggcaacgtttttgagataggatcatatac

SEQ ID NO: 12022 - DNA, 60 bp, Xenorhabdus bovienii
  Promoter sequence Name=Xb4151_4152.C437.promoter85; Position on contig=108764..108823bp; Strand=+; Gene name=CynT
cataagtaaaaacacctttattctttgctatctttgagtgcaagatgcaaattatgccat

SEQ ID NO: 12023 - DNA, 60 bp, Xenorhabdus bovienii
  Promoter sequence Name=Xb4151_4152.C437.promoter86; Position on contig=110243..110302bp; Strand=-
acggtatatcaatcggtgtatcacttttcgtaaaaagacacatgattttattttaatttt

SEQ ID NO: 12024 - DNA, 60 bp, Xenorhabdus bovienii
  Promoter sequence Name=Xb4151_4152.C437.promoter87; Position on contig=110181..110240bp; Strand=+
gttcggagatcatcacttctacaatatgttttggtttactcataactatatatttttaaa

SEQ ID NO: 12025 - DNA, 60 bp, Xenorhabdus bovienii
  Promoter sequence Name=Xb4151_4152.C437.promoter88; Position on contig=111381..111440bp; Strand=-
tgtcatgatttctatatccgtaatgtctacaaactacaataatttgttataaaaaaacat

SEQ ID NO: 12026 - DNA, 60 bp, Xenorhabdus bovienii
  Promoter sequence Name=Xb4151_4152.C437.promoter89; Position on contig=111343..111402bp; Strand=+
gcatagggaatgcttatattttgacttatgtctgttttatgtttttttataacaaattat

SEQ ID NO: 12027 - DNA, 60 bp, Xenorhabdus bovienii; identical to SEQ ID NO: 10635
  Promoter sequence Name=Xb4151_4152.C437.promoter90; Position on contig=114918..114977bp; Strand=-

SEQ ID NO: 12028 - DNA, 60 bp, Xenorhabdus bovienii
  Promoter sequence Name=Xb4151_4152.C437.promoter91; Position on contig=114827..114886bp; Strand=+
ttgtgataaatctggaaaataagtttttaaacactttgctctcctgttgtgattagcaga

SEQ ID NO: 12029 - DNA, 60 bp, Xenorhabdus bovienii
  Promoter sequence Name=Xb4151_4152.C437.promoter92; Position on contig=117961..118020bp; Strand=+; Gene name=Lgt
ctcccgtctgaagcaggacggctcttaatccattttactgcctatgctattatttgcgat

SEQ ID NO: 12030 - DNA, 60 bp, Xenorhabdus bovienii
  Promoter sequence Name=Xb4151_4152.C437.promoter93; Position on contig=121169..121228bp; Strand=-
catgattaccttttatttaatgcggattaattttttcaattcaagattattttaataaag

SEQ ID NO: 12031 - DNA, 60 bp, Xenorhabdus bovienii; identical to SEQ ID NO: 10819
  Promoter sequence Name=Xb4151_4152.C437.promoter94; Position on contig=120883..120942bp; Strand=+

SEQ ID NO: 12032 - DNA, 60 bp, Xenorhabdus bovienii
  Promoter sequence Name=Xb4151_4152.C438.promoter1; Position on contig= 1739..1798bp; Strand=-; Gene name=DadA
aagatcatattttttggttgcagcatagtatgttaatgaatcaagattattattcatgtt

SEQ ID NO: 12033 - DNA, 60 bp, Xenorhabdus bovienii
  Promoter sequence Name=Xb4151_4152.C438.promoter2; Position on contig= 1423..1482bp; Strand=+; Gene name=DadA
atcacaaaacgataagataaaaatctaaacttattaataaaatgtttaataattgtgaca

SEQ ID NO: 12034 - DNA, 60 bp, Xenorhabdus bovienii
  Promoter sequence Name=Xb4151_4152.C438.promoter3; Position on contig= 5020..5079bp; Strand=+
cttattttcgtgatttattttcagcttgtgattaagccgctatcatatatgatattggga

SEQ ID NO: 12035 - DNA, 60 bp, Xenorhabdus bovienii
  Promoter sequence Name=Xb4151_4152.C438.promoter4; Position on contig= 5711..5770bp; Strand=-
catgctctttctcaataaataatgattgacgttagccgtaaaatctctagaatgcgcctc

SEQ ID NO: 12036 - DNA, 60 bp, Xenorhabdus bovienii
  Promoter sequence Name=Xb4151_4152.C438.promoter5; Position on contig= 6975..7034bp; Strand=-
acgcttcgtcatcgtgttttattccatctgccataaaaaataacaggtaatatactatca

SEQ ID NO: 12037 - DNA, 60 bp, Xenorhabdus bovienii
  Promoter sequence Name=Xb4151_4152.C438.promoter6; Position on contig= 6696..6755bp; Strand=+
attgtcacccagttgacggatcagggattgccagtggtgatattggttagtatgtactcg

SEQ ID NO: 12038 - DNA, 60 bp, Xenorhabdus bovienii
  Promoter sequence Name=Xb4151_4152.C438.promoter7; Position on contig= 7984..8043bp; Strand=+; Gene name=FusA
agtactcagccagacaatcattgattgtttataaatccaagttcggcgaaaataagcccc

SEQ ID NO: 12039 - DNA, 60 bp, Xenorhabdus bovienii
  Promoter sequence Name=Xb4151_4152.C438.promoter8; Position on contig= 9730..9789bp; Strand=+; Gene name=OsmY
tctttttatagcatagggtcaacaaatcgttgacccttatcagtttgtaatctctttctg

SEQ ID NO: 12040 - DNA, 60 bp, Xenorhabdus bovienii
  Promoter sequence Name=Xb4151_4152.C438.promoter9; Position on contig= 11716..11775bp; Strand=-
gaataatgactatctatcagtatattgctgttcaaacaatacgtttgtaaaattttcgtt

SEQ ID NO: 12041 - DNA, 60 bp, Xenorhabdus bovienii
  Promoter sequence Name=Xb4151_4152.C438.promoter10; Position on contig=11533..11592bp; Strand=+
accatttaatacatgacccgttcgtacatagcttcgcttcggtattttatatttttacta

SEQ ID NO: 12042 - DNA, 60 bp, Xenorhabdus bovienii
  Promoter sequence Name=Xb4151_4152.C438.promoter11; Position on contig=13997..14056bp; Strand=-; Gene name=NupC
tgagttgcattggaagaatccctgttcactgaatgaatgaataatgaaaaaatatgccag

SEQ ID NO: 12043 - DNA, 60 bp, Xenorhabdus bovienii
  Promoter sequence Name=Xb4151_4152.C438.promoter12; Position on contig=13846..13905bp; Strand=+; Gene name=NupC
ttagaaactagatggatttatgtgatctggatctcattttgtgtttttatattacttttt

SEQ ID NO: 12044 - DNA, 60 bp, Xenorhabdus bovienii
  Promoter sequence Name=Xb4151_4152.C438.promoter13; Position on contig=15371..15430bp; Strand=+
cctgcttttgtttttcctgaaactgtttgatgtgatactaatcacaataaaatgtctatc

SEQ ID NO: 12045 - DNA, 60 bp, Xenorhabdus bovienii
  Promoter sequence Name=Xb4151_4152.C438.promoter14; Position on contig=16512..16571bp; Strand=+; Gene name=DeoA
atcaataacaacacattgaatgcacgttaagataaagtgcattactaccattcttttcag

SEQ ID NO: 12046 - DNA, 60 bp, Xenorhabdus bovienii
  Promoter sequence Name=Xb4151_4152.C438.promoter15; Position on contig=18249..18308bp; Strand=-; Gene name=DeoB
ggcgtgtctttaccagaagaaagttcactcgcatagccgtaggctccaataatttcagca

SEQ ID NO: 12047 - DNA, 60 bp, Xenorhabdus bovienii
  Promoter sequence Name=Xb4151_4152.C438.promoter16; Position on contig=20685..20744bp; Strand=+; Gene name=FimA
tcatttctgtgcttcggcttccttttggctatgagtatctatatctttaaattaaagggc

SEQ ID NO: 12048 - DNA, 60 bp, Xenorhabdus bovienii
  Promoter sequence Name=Xb4151_4152.C438.promoter17; Position on contig=21943..22002bp; Strand=-
tctactgtttttttattagcgacgttctctttattaatgttgttttttatattaatagct

SEQ ID NO: 12049 - DNA, 60 bp, Xenorhabdus bovienii
  Promoter sequence Name=Xb4151_4152.C438.promoter18; Position on contig=21531..21590bp; Strand=+
tagatgtaaattgaaatacccttttttatttaaccaatggcattctctctaattggctgt

SEQ ID NO: 12050 - DNA, 60 bp, Xenorhabdus bovienii
  Promoter sequence Name=Xb4151_4152.C438.promoter19; Position on contig=24845..24904bp; Strand=-; Gene name=FimC
cgttaatcttattccccttatcatcttcaatccatgcctgtgccagataaggtaaatcga

SEQ ID NO: 12051 - DNA, 60 bp, Xenorhabdus bovienii
  Promoter sequence Name=Xb4151_4152.C438.promoter20; Position on contig=24575..24634bp; Strand=+; Gene name=FimC
agacaagtcagaaaattgaattgaagtgacgtattatgttgctgatttaacatggaaagt

SEQ ID NO: 12052 - DNA, 60 bp, Xenorhabdus bovienii
  Promoter sequence Name=Xb4151_4152.C438.promoter21; Position on contig=25452..25511bp; Strand=+; Gene name=FimA
gaaccttgtggataacgtcccatcagttgtcatgctgatgggaaatctaaagtctcatta

SEQ ID NO: 12053 - DNA, 60 bp, Xenorhabdus bovienii
  Promoter sequence Name=Xb4151_4152.C438.promoter22; Position on contig=27362..27421bp; Strand=+
ccattcctgttaggaatggctttttttttgccagaaatacccatcagataataagtgact

SEQ ID NO: 12054 - DNA, 60 bp, Xenorhabdus bovienii
  Promoter sequence Name=Xb4151_4152.C438.promoter23; Position on contig=32226..32285bp; Strand=+; Gene name=NadR
taccaataaacaaccagttttgtttttacctttcacaacaagcgtgttattttgtttagt

SEQ ID NO: 12055 - DNA, 60 bp, Xenorhabdus bovienii
  Promoter sequence Name=Xb4151_4152.C438.promoter24; Position on contig=33993..34052bp; Strand=-; Gene name=PhnL
attattatttacaatgagcatataataaataagatatttcttaatcttagaataaaaatc

SEQ ID NO: 12056 - DNA, 60 bp, Xenorhabdus bovienii
  Promoter sequence Name=Xb4151_4152.C438.promoter25; Position on contig=33935..33994bp; Strand=+; Gene name=PhnL
cttatgctatttttatttaacttgtatttgccttagtcgtaattaattaatattgttaga

SEQ ID NO: 12057 - DNA, 60 bp, Xenorhabdus bovienii
  Promoter sequence Name=Xb4151_4152.C438.promoter26; Position on contig=36778..36837bp; Strand=-
ttgaactcgtgctaatcaggtagcaacacgatatgtaaaatttagggtaaaatgccccat

SEQ ID NO: 12058 - DNA, 60 bp, Xenorhabdus bovienii
  Promoter sequence Name=Xb4151_4152.C438.promoter27; Position on contig=36672..36731bp; Strand=+
aacaattttaccaacccgatgcatactataaacatattgagccaatgtaatttacctttt

SEQ ID NO: 12059 - DNA, 60 bp, Xenorhabdus bovienii
  Promoter sequence Name=Xb4151_4152.C438.promoter28; Position on contig=37358..37417bp; Strand=-; Gene name=MltE
cttgccagagaatcgatatatttggatgtcagagaacgcgctggtggtaaagtcggataa

SEQ ID NO: 12060 - DNA, 60 bp, Xenorhabdus bovienii
  Promoter sequence Name=Xb4151_4152.C438.promoter29; Position on contig=36990..37049bp; Strand=+; Gene name=MltE
tatccttatgaattcactgttgtaatcaatcatgtcaataatatggttataattgaatag

SEQ ID NO: 12061 - DNA, 60 bp, Xenorhabdus bovienii
  Promoter sequence Name=Xb4151_4152.C438.promoter30; Position on contig=40011..40070bp; Strand=-; Gene name=GpmB
tttcgccatggcgaacaagatagacctgtaacatattcattttccgttatactgcatctg

SEQ ID NO: 12062 - DNA, 60 bp, Xenorhabdus bovienii
  Promoter sequence Name=Xb4151_4152.C438.promoter31; Position on contig=39933..39992bp; Strand=+; Gene name=GpmB
atcgcttttatttttgcagggttagttgttgcagcaataacgtggtacataataaataaa

SEQ ID NO: 12063 - DNA, 60 bp, Xenorhabdus bovienii
  Promoter sequence Name=Xb4151_4152.C438.promoter32; Position on contig=41588..41647bp; Strand=-
cagaaaaacgttttggtttttcaaaatagtaagttgttgtacatttgtatgattttcttt

SEQ ID NO: 12064 - DNA, 60 bp, Xenorhabdus bovienii
  Promoter sequence Name=Xb4151_4152.C438.promoter33; Position on contig=41889..41948bp; Strand=-
cctattgttaatgaatttaacaatataactcttgacagattatcggttaagctattaatt

SEQ ID NO: 12065 - DNA, 60 bp, Xenorhabdus bovienii
  Promoter sequence Name=Xb4151_4152.C438.promoter34; Position on contig=42201..42260bp; Strand=-; Gene name=CreA
gtccacttaaattaaataaatgcagtgaaaatattcactattaacatataatgctaatca

SEQ ID NO: 12066 - DNA, 60 bp, Xenorhabdus bovienii
  Promoter sequence Name=Xb4151_4152.C438.promoter35; Position on contig=42178..42237bp; Strand=+; Gene name=CreA
gaaaatgatttaatgaaaggtattgattagcattatatgttaatagtgaatattttcact

SEQ ID NO: 12067 - DNA, 60 bp, Xenorhabdus bovienii
  Promoter sequence Name=Xb4151_4152.C438.promoter36; Position on contig=43664..43723bp; Strand=-
gctttttcgggtatgtaccctcaaaaaagcgatgctggcttctagcgtaaaatatatcaa

SEQ ID NO: 12068 - DNA, 60 bp, Xenorhabdus bovienii
  Promoter sequence Name=Xb4151_4152.C438.promoter37; Position on contig=44291..44350bp; Strand=-; Gene name=LysC
tttctgtccaaaaaaaagcccgtatcttgtaggatacgggctttttttattttatgttta

SEQ ID NO: 12069 - DNA, 60 bp, Xenorhabdus bovienii
  Promoter sequence Name=Xb4151_4152.C438.promoter38; Position on contig=44268..44327bp; Strand=+; Gene name=LysC
gagttacggggcgggctgacgcgtaaacataaaataaaaaaagcccgtatcctacaagat

SEQ ID NO: 12070 - DNA, 60 bp, Xenorhabdus bovienii
  Promoter sequence Name=Xb4151_4152.C438.promoter39; Position on contig=50041..50100bp; Strand=-
cagggaagtcagtttatcggtcatgtttaatatctcatcgttatacgtaaaatattggca

SEQ ID NO: 12071 - DNA, 60 bp, Xenorhabdus bovienii
  Promoter sequence Name=Xb4151_4152.C438.promoter40; Position on contig=49791..49850bp; Strand=+
ccccagcaatgcaggctggctatatttctttgttgcgggtggactttcataatcgagtgt

SEQ ID NO: 12072 - DNA, 60 bp, Xenorhabdus bovienii
  Promoter sequence Name=Xb4151_4152.C438.promoter41; Position on contig=51066..51125bp; Strand=+; Gene name=MoaB
cgacataatgaggtcgccttttattttttcgcttcaccataagcgatattttctctctat

SEQ ID NO: 12073 - DNA, 60 bp, Xenorhabdus bovienii
  Promoter sequence Name=Xb4151_4152.C438.promoter42; Position on contig=52727..52786bp; Strand=+
ggtaataccgtacttatcaaataaaatatcctgatagcaagcctgattataataagtctg

SEQ ID NO: 12074 - DNA, 60 bp, Xenorhabdus bovienii
  Promoter sequence Name=Xb4151_4152.C438.promoter43; Position on contig=52972..53031bp; Strand=+; Gene name=GalE
tctttttatactctttcttgttatcatttttattgtgtgaaacagtgacactaacaaaaa

SEQ ID NO: 12075 - DNA, 60 bp, Xenorhabdus bovienii
  Promoter sequence Name=Xb4151_4152.C438.promoter44; Position on contig=56192..56251bp; Strand=-
tttaaaagaacaaataaaaactatatataacaaaatgtgattaattctatattaatagat

SEQ ID NO: 12076 - DNA, 60 bp, Xenorhabdus bovienii
  Promoter sequence Name=Xb4151_4152.C438.promoter45; Position on contig=55840..55899bp; Strand=+
tttttttttctactgagaaagaagtgtcatctccagaaatataagcgataagattccatc

SEQ ID NO: 12077 - DNA, 60 bp, Xenorhabdus bovienii
  Promoter sequence Name=Xb4151_4152.C438.promoter46; Position on contig=56233..56292bp; Strand=+; Gene name=CysK
ttttatttgttcttttaaatccattgtcatgcggcgttattctttaccaatctgaaagtt

SEQ ID NO: 12078 - DNA, 60 bp, Xenorhabdus bovienii
  Promoter sequence Name=Xb4151_4152.C438.promoter47; Position on contig=58964..59023bp; Strand=+; Gene name=Def
ttgccttctgctgtaaattatccctaaatatccacttgaggataaggtattattcctgct

SEQ ID NO: 12079 - DNA, 60 bp, Xenorhabdus bovienii
  Promoter sequence Name=Xb4151_4152.C438.promoter48; Position on contig=60580..60639bp; Strand=-; Gene name=HofG
agtagtgtaaatccagactgtccattaatacttcctccattctttgttgtcattgtctta

SEQ ID NO: 12080 - DNA, 60 bp, Xenorhabdus bovienii; identical to SEQ ID NO: 10819
  Promoter sequence Name=Xb4151_4152.C438.promoter49; Position on contig=60341..60400bp; Strand=+; Gene name=HofG

SEQ ID NO: 12081 - DNA, 60 bp, Xenorhabdus bovienii
  Promoter sequence Name=Xb4151_4152.C438.promoter50; Position on contig=75768..75827bp; Strand=-
gcgagtggctgtcatcaaaaaaaacattttacgttctctcaatttattaatatcaatata

SEQ ID NO: 12082 - DNA, 60 bp, Xenorhabdus bovienii
  Promoter sequence Name=Xb4151_4152.C438.promoter51; Position on contig=75641..75700bp; Strand=+
attcggtacagcgttctttcatgaaactctccagatgaattcttattcatgatttttgta

SEQ ID NO: 12083 - DNA, 60 bp, Xenorhabdus bovienii
  Promoter sequence Name=Xb4151_4152.C438.promoter52; Position on contig=77831..77890bp; Strand=-
aaagatatttgccccaaagtttcatattataccttatctcctgtcattatgattcgacga

SEQ ID NO: 12084 - DNA, 60 bp, Xenorhabdus bovienii
  Promoter sequence Name=Xb4151_4152.C438.promoter53; Position on contig=81673..81732bp; Strand=-; Gene name=Hcp
atcactcatcgtcatataatttattgacaaatatacaacttattgtttctcttagagtat

SEQ ID NO: 12085 - DNA, 60 bp, Xenorhabdus bovienii
  Promoter sequence Name=Xb4151_4152.C438.promoter54; Position on contig=82213..82272bp; Strand=-; Gene name=Bax
taatggtatttctataaagtaaaattttttgtaacggaatttattagtttaattaatttt

SEQ ID NO: 12086 - DNA, 60 bp, Xenorhabdus bovienii
  Promoter sequence Name=Xb4151_4152.C438.promoter55; Position on contig=82515..82574bp; Strand=+; Gene name=Bax
aattttatgaatggtgaataatggtagccagatattgattgttctgctaatattcgtatg

SEQ ID NO: 12087 - DNA, 60 bp, Xenorhabdus bovienii
  Promoter sequence Name=Xb4151_4152.C438.promoter56; Position on contig=84198..84257bp; Strand=-
gttacagcgcggcgataggtcatgtattaaatggttagttgctgtgatatgcttccggct

SEQ ID NO: 12088 - DNA, 60 bp, Xenorhabdus bovienii
  Promoter sequence Name=Xb4151_4152.C438.promoter57; Position on contig=84382..84441bp; Strand=+; Gene name=DltB (BS)
gctcctaataatccgctatgtattaattacacagtggattatttttttataatttccctg

SEQ ID NO: 12089 - DNA, 60 bp, Xenorhabdus bovienii
  Promoter sequence Name=Xb4151_4152.C438.promoter58; Position on contig=88718..88777bp; Strand=+
atccccgtacctacggggaacacttgatttcgacccgcaacccctctgaaaatgccggtt

SEQ ID NO: 12090 - DNA, 60 bp, Xenorhabdus bovienii
  Promoter sequence Name=Xb4151_4152.C438.promoter59; Position on contig=91534..91593bp; Strand=-; Gene name=PurR
ctcgcgatcttgtgttgctggtaatgttaccgacaataagttaccggtaacattttatag

SEQ ID NO: 12091 - DNA, 60 bp, Xenorhabdus bovienii
  Promoter sequence Name=Xb4151_4152.C438.promoter60; Position on contig=92714..92773bp; Strand=-; Gene name=PurR
ccagcatttttggctaaaaatcgtattgttatggtgtataaatgtgttaaaaccgctttt

SEQ ID NO: 12092 - DNA, 60 bp, Xenorhabdus bovienii
  Promoter sequence Name=Xb4151_4152.C438.promoter61; Position on contig=97327..97386bp; Strand=-
acctaaatcagccaaattcctgccgtattttttaccataccgatcatttgtaacattgct

SEQ ID NO: 12093 - DNA, 60 bp, Xenorhabdus bovienii
  Promoter sequence Name=Xb4151_4152.C438.promoter62; Position on contig=96967..97026bp; Strand=+
gcaagagcggtaaatcgaggcagttcatacttgatttgcggccccagtaaaatcacatcg

SEQ ID NO: 12094 - DNA, 60 bp, Xenorhabdus bovienii
  Promoter sequence Name=Xb4151_4152.C438.promoter63; Position on contig=98051..98110bp; Strand=-
attaatatgttgttaaatttattaattgtaataaatttaattaagaatatattaataaaa

SEQ ID NO: 12095 - DNA, 60 bp, Xenorhabdus bovienii
  Promoter sequence Name=Xb4151_4152.C438.promoter64; Position on contig=97797..97856bp; Strand=+
aggtcttaagcaccaatggcttattttagatacaaaaaaacttcatttatgatttgataa

SEQ ID NO: 12096 - DNA, 60 bp, Xenorhabdus bovienii
  Promoter sequence Name=Xb4151_4152.C438.promoter65; Position on contig=98299..98358bp; Strand=-; Gene name=AcrR
tgtcatattttctccttatttatttgaaattaaataaaaaatattttcatagtgactata

SEQ ID NO: 12097 - DNA, 60 bp, Xenorhabdus bovienii
  Promoter sequence Name=Xb4151_4152.C438.promoter66; Position on contig=98209..98268bp; Strand=+; Gene name=AcrR
atggcacaaaaaagaaacttatataaaaaataataaaaaattgcatgtataatgcaaggc

SEQ ID NO: 12098 - DNA, 60 bp, Xenorhabdus bovienii
  Promoter sequence Name=Xb4151_4152.C438.promoter67; Position on contig=101928..101987bp; Strand=-
atacagcacacaggcactagggcgtgtcccttaatgcaaattgatagtattatcatctga

SEQ ID NO: 12099 - DNA, 60 bp, Xenorhabdus bovienii
  Promoter sequence Name=Xb4151_4152.C438.promoter68; Position on contig=101528..101587bp; Strand=+
atgagcgtcagcgatatcgggatgttttttttcgcgcctgcagcatctttactcgcgcga

SEQ ID NO: 12100 - DNA, 60 bp, Xenorhabdus bovienii
  Promoter sequence Name=Xb4151_4152.C438.promoter69; Position on contig=102800..102859bp; Strand=+; Gene name=MdaB
tgacatgtttatataccaaaggtaacttactaatggtaacctacttttagtatatagatt

SEQ ID NO: 12101 - DNA, 60 bp, Xenorhabdus bovienii
  Promoter sequence Name=Xb4151_4152.C438.promoter70; Position on contig=104345..104404bp; Strand=-
cgtctaaacatcatggtgcccctcaatttacagcacattgaggagactattattcgggaa

SEQ ID NO: 12102 - DNA, 60 bp, Xenorhabdus bovienii
  Promoter sequence Name=Xb4151_4152.C438.promoter71; Position on contig=105943..106002bp; Strand=+
ggcttttataacgggagccaacattgctgtggatggaggtgtgaatttataatgtgacca

SEQ ID NO: 12103 - DNA, 60 bp, Xenorhabdus bovienii
  Promoter sequence Name=Xb4151_4152.C438.promoter72; Position on contig=115948..116007bp; Strand=-
gcaagacaaagtgtagcggctaacaatttgctgaagttagttaaggtcataataaactca

SEQ ID NO: 12104 - DNA, 60 bp, Xenorhabdus bovienii
  Promoter sequence Name=Xb4151_4152.C438.promoter73; Position on contig=115869..115928bp; Strand=+
tagttactcattttccagcattattcgttaacagacttcatataacctatgataatctac

SEQ ID NO: 12105 - DNA, 60 bp, Xenorhabdus bovienii
  Promoter sequence Name=Xb4151_4152.C438.promoter74; Position on contig=119728..119787bp; Strand=+
ctcagaagaaaccagcatccatgcttgcccaagcaaagcaggcaagtaattatcaacaaa

SEQ ID NO: 12106 - DNA, 60 bp, Xenorhabdus bovienii
  Promoter sequence Name=Xb4151_4152.C438.promoter75; Position on contig=121382..121441bp; Strand=-; Gene name=LysR
tgagccgatctagcaatccacatattctgtgaacctcatagggtgcgtataatttaaatc

SEQ ID NO: 12107 - DNA, 60 bp, Xenorhabdus bovienii
  Promoter sequence Name=Xb4151_4152.C438.promoter76; Position on contig=121304..121363bp; Strand=+; Gene name=LysR
gtttcacccgtgtgacttgtggttgatctcacttaactgccctcctgtaaaattctttat

SEQ ID NO: 12108 - DNA, 60 bp, Xenorhabdus bovienii; identical to SEQ ID NO: 11022
  Promoter sequence Name=Xb4151_4152.C438.promoter77; Position on contig=127950..128009bp; Strand=+

SEQ ID NO: 12109 - DNA, 60 bp, Xenorhabdus bovienii
  Promoter sequence Name=Xb4151_4152.C438.promoter78; Position on contig=128857..128916bp; Strand=-
aggcaaacctgcctgcttcgcattttgatattgttccaatgccttagtatacttattttg

SEQ ID NO: 12110 - DNA, 60 bp, Xenorhabdus bovienii; identical to SEQ ID NO: 10698
  Promoter sequence Name=Xb4151_4152.C438.promoter79; Position on contig=128560..128619bp; Strand=+

SEQ ID NO: 12111 - DNA, 60 bp, Xenorhabdus bovienii
  Promoter sequence Name=Xb4151_4152.C438.promoter80; Position on contig=129582..129641bp; Strand=+
tgtataaacaagaattaggctttacaattaaattagatctaaataaatatctttaaccat

SEQ ID NO: 12112 - DNA, 60 bp, Xenorhabdus bovienii
  Promoter sequence Name=Xb4151_4152.C438.promoter81; Position on contig=136082..136141bp; Strand=+
attatacgtgaatatataaatatatttatttaacatcactctggtttttttatcagggga

SEQ ID NO: 12113 - DNA, 60 bp, Xenorhabdus bovienii
  Promoter sequence Name=Xb4151_4152.C438.promoter82; Position on contig=137003..137062bp; Strand=-
gggagataaagtaaaaacatattatgctcacgtaaccactccacttttatttttgtctcg

SEQ ID NO: 12114 - DNA, 60 bp, Xenorhabdus bovienii
  Promoter sequence Name=Xb4151_4152.C438.promoter83; Position on contig=136644..136703bp; Strand=+
aaaaaacgcgatgaaacggaatttgctgaaaaatcggccttactggataagattaaggcc

SEQ ID NO: 12115 - DNA, 60 bp, Xenorhabdus bovienii
  Promoter sequence Name=Xb4151_4152.C438.promoter84; Position on contig=140075..140134bp; Strand=-
agataactaagatcatctagaattttaattctaggatagaccaataataaaatattataa

SEQ ID NO: 12116 - DNA, 60 bp, Xenorhabdus bovienii
  Promoter sequence Name=Xb4151_4152.C438.promoter85; Position on contig=140954..141013bp; Strand=-
ggtgctgaagctgctaaatttaattaattcaatggaaaaaccgtgattaatatcacaata

SEQ ID NO: 12117 - DNA, 60 bp, Xenorhabdus bovienii
  Promoter sequence Name=Xb4151_4152.C438.promoter86; Position on contig=141282..141341bp; Strand=+
cttatgacgatgtcacacttatctgtgaattggatgagcagtggttttttataggcaata

SEQ ID NO: 12118 - DNA, 60 bp, Xenorhabdus bovienii
  Promoter sequence Name=Xb4151_4152.C438.promoter87; Position on contig=142297..142356bp; Strand=+
ttatgcgttagccctgggcagttattgtatgtaaggtgtttgtttgttaaagccactgaa

SEQ ID NO: 12119 - DNA, 60 bp, Xenorhabdus bovienii
  Promoter sequence Name=Xb4151_4152.C438.promoter88; Position on contig=144761..144820bp; Strand=-
caacgcatttttacacttcacctgagggggaattaataacaattacttaacatccatgtt

SEQ ID NO: 12120 - DNA, 60 bp, Xenorhabdus bovienii
  Promoter sequence Name=Xb4151_4152.C438.promoter89; Position on contig=145228..145287bp; Strand=-
aaggtggtcatcaataaccgccttgcctagatataaataataatataaaaatcatgatgt

SEQ ID NO: 12121 - DNA, 60 bp, Xenorhabdus bovienii
  Promoter sequence Name=Xb4151_4152.C438.promoter90; Position on contig=147277..147336bp; Strand=-
aagaagaagtatcgtctgaattttgccattgcatggcaatacgctgataaataaaaaatt

SEQ ID NO: 12122 - DNA, 60 bp, Xenorhabdus bovienii
  Promoter sequence Name=Xb4151_4152.C438.promoter91; Position on contig=147229..147288bp; Strand=+
aggtgtgaataaaaatgcttttttcattggctcttctccataaaaagtaattttttattt

SEQ ID NO: 12123 - DNA, 60 bp, Xenorhabdus bovienii
  Promoter sequence Name=Xb4151_4152.C438.promoter92; Position on contig=150617..150676bp; Strand=-; Gene name=HemA
aaagtcattttaactgcattgagttatcacgggaatcaatctcatgataatattaataac

SEQ ID NO: 12124 - DNA, 60 bp, Xenorhabdus bovienii
  Promoter sequence Name=Xb4151_4152.C438.promoter93; Position on contig=150516..150575bp; Strand=+; Gene name=HemA
ttacggcatagccgtccgattgacttttattgaattgatgcatcaagtagaatgctcatc

SEQ ID NO: 12125 - DNA, 60 bp, Xenorhabdus bovienii
  Promoter sequence Name=Xb4151_4152.C438.promoter94; Position on contig=157391..157450bp; Strand=-
gtcatgcggacgccttattttttggttttagattaaatgaatactcgtaaaattaatggg

SEQ ID NO: 12126 - DNA, 60 bp, Xenorhabdus bovienii
  Promoter sequence Name=Xb4151_4152.C438.promoter95; Position on contig=161813..161872bp; Strand=-
tcccttaaataagatcattgttatcttaattgccctttcagattttttattttattttat

SEQ ID NO: 12127 - DNA, 60 bp, Xenorhabdus bovienii
  Promoter sequence Name=Xb4151_4152.C438.promoter96; Position on contig=161763..161822bp; Strand=+
tcattttctctaagtcctttagaggtcaatttatcagcattattaataaaataaaataaa

SEQ ID NO: 12128 - DNA, 60 bp, Xenorhabdus bovienii
  Promoter sequence Name=Xb4151_4152.C438.promoter97; Position on contig=162660..162719bp; Strand=+
actactgacagaaattgtcactcaccattgatactctgcgggcagttctactgtattaaa

SEQ ID NO: 12129 - DNA, 60 bp, Xenorhabdus bovienii
  Promoter sequence Name=Xb4151_4152.C438.promoter98; Position on contig=163578..163637bp; Strand=+
taagccataaatctttaagatattcccattagagcaggttgttgaggtgaactctgcgaa

SEQ ID NO: 12130 - DNA, 60 bp, Xenorhabdus bovienii
  Promoter sequence Name=Xb4151_4152.C438.promoter99; Position on contig=164316..164375bp; Strand=-; Gene name=SerA
aatccactcatcggtattagaggaagagtgaaaaaaaataatattcatacaatcttattc

SEQ ID NO: 12131 - DNA, 60 bp, Xenorhabdus bovienii
  Promoter sequence Name=Xb4151_4152.C438.promoter100; Position on contig=164150..164209bp; Strand=+; Gene name=SerA
caatttgaatgtttgatagtcatttactaaagcagatgcactttttgtaatatgtagtgg

SEQ ID NO: 12132 - DNA, 60 bp, Xenorhabdus bovienii
  Promoter sequence Name=Xb4151_4152.C439.promoter1; Position on contig= 1392..1451bp; Strand=+
gtttcttaatgagaattaatcattacaaataaattaattacacattttaccctacatctt

SEQ ID NO: 12133 - DNA, 60 bp, Xenorhabdus bovienii
  Promoter sequence Name=Xb4151_4152.C439.promoter2; Position on contig= 2938..2997bp; Strand=+
aaatccattatatggatattcaggttttcatattaatttcaatatattacaatatttttt

SEQ ID NO: 12134 - DNA, 60 bp, Xenorhabdus bovienii
  Promoter sequence Name=Xb4151_4152.C439.promoter3; Position on contig= 7193..7252bp; Strand=+
atttaaaatattaataatatttgataaaaattaaccatcccaagagataacagttattag

SEQ ID NO: 12135 - DNA, 60 bp, Xenorhabdus bovienii
  Promoter sequence Name=Xb4151_4152.C439.promoter4; Position on contig= 11045..11104bp; Strand=-
cagagaacagactgttttttatctttttaaataatataaattttagttaatttagctcat

SEQ ID NO: 12136 - DNA, 60 bp, Xenorhabdus bovienii
  Promoter sequence Name=Xb4151_4152.C439.promoter5; Position on contig= 11060..11119bp; Strand=+; Gene name=NlpD
taaaatttatattatttaaaaagataaaaaacagtctgttctctggtcagaagtaacccc

SEQ ID NO: 12137 - DNA, 60 bp, Xenorhabdus bovienii
  Promoter sequence Name=Xb4151_4152.C439.promoter6; Position on contig= 15929..15988bp; Strand=-; Gene name=WcaG
tcatttggctcacctctaaatagtcagttcactttatctttgatgcgtataatagcactt

SEQ ID NO: 12138 - DNA, 60 bp, Xenorhabdus bovienii
  Promoter sequence Name=Xb4151_4152.C439.promoter7; Position on contig= 15888..15947bp; Strand=+; Gene name=WcaG
caggattttcccctgtttaagctgctgtcgtcaggaatgttaagtgctattatacgcatc

SEQ ID NO: 12139 - DNA, 60 bp, Xenorhabdus bovienii
  Promoter sequence Name=Xb4151_4152.C439.promoter8; Position on contig= 19947..20006bp; Strand=-
aaataataattaaattaatatttttgtataaataaataactatatgttattattgcttgt

SEQ ID NO: 12140 - DNA, 60 bp, Xenorhabdus bovienii
  Promoter sequence Name=Xb4151_4152.C439.promoter9; Position on contig= 19952..20011bp; Strand=+
caataataacatatagttatttatttatacaaaaatattaatttaattattatttgaata

SEQ ID NO: 12141 - DNA, 60 bp, Xenorhabdus bovienii
  Promoter sequence Name=Xb4151_4152.C439.promoter10; Position on contig=21473..21532bp; Strand=-; Gene name=WcaA
cttaaatagttttgagctttttatttcaatttacatatgatagtgatattatgagttttt

SEQ ID NO: 12142 - DNA, 60 bp, Xenorhabdus bovienii
  Promoter sequence Name=Xb4151_4152.C439.promoter11; Position on contig=23849..23908bp; Strand=-
tgttgtagtcttatcaccagaatttttttgattccattatgattttttatcatttttcga

SEQ ID NO: 12143 - DNA, 60 bp, Xenorhabdus bovienii
  Promoter sequence Name=Xb4151_4152.C439.promoter12; Position on contig=23658..23717bp; Strand=+
tacaccaaaatgtgataataactgtttttaatggtactcagaccagctatacagcgcaat

SEQ ID NO: 12144 - DNA, 60 bp, Xenorhabdus bovienii
  Promoter sequence Name=Xb4151_4152.C439.promoter13; Position on contig=27168..27227bp; Strand=+; Gene name=KdtA
tccataaaaggggccgcattttacacactttcttcaggccaatgtggtactatagccgca

SEQ ID NO: 12145 - DNA, 60 bp, Xenorhabdus bovienii
  Promoter sequence Name=Xb4151_4152.C439.promoter14; Position on contig=30590..30649bp; Strand=+; Gene name=RfaL
tggggctcaattccccggcgactggtttcaacctctggtagctccggcatactgactcct

SEQ ID NO: 12146 - DNA, 60 bp, Xenorhabdus bovienii
  Promoter sequence Name=Xb4151_4152.C439.promoter15; Position on contig=34902..34961bp; Strand=-; Gene name=RfaG
accatctatccgtaatagtgtctgttttcatctgattataaagtggttatttttttctta

SEQ ID NO: 12147 - DNA, 60 bp, Xenorhabdus bovienii
  Promoter sequence Name=Xb4151_4152.C439.promoter16; Position on contig=36781..36840bp; Strand=-
acgccacctttgaggatcttgggtttggcgagaagagcctatctcagtaagtttttttat

SEQ ID NO: 12148 - DNA, 60 bp, Xenorhabdus bovienii
  Promoter sequence Name=Xb4151_4152.C439.promoter17; Position on contig=37723..37782bp; Strand=+; Gene name=Dfp
tttggcacctgaataaggcaggttctcaacttaatattttcttatggtagaatcttaggt

SEQ ID NO: 12149 - DNA, 60 bp, Xenorhabdus bovienii
  Promoter sequence Name=Xb4151_4152.C439.promoter18; Position on contig=39495..39554bp; Strand=+; Gene name=AcrR
accgtcaaccgattttcatattttttgcccatgatcgtggtgggcaaaaaatagctggat

SEQ ID NO: 12150 - DNA, 60 bp, Xenorhabdus bovienii
  Promoter sequence Name=Xb4151_4152.C439.promoter19; Position on contig=40215..40274bp; Strand=+
tttcatgctgagaatgataacgtgcggttttttcgttgaattgtgttaatatgcatcttc

SEQ ID NO: 12151 - DNA, 60 bp, Xenorhabdus bovienii
  Promoter sequence Name=Xb4151_4152.C439.promoter20; Position on contig=41903..41962bp; Strand=-
ataactctccgcgtagatgcaggataggcattcgccgtgttaggtcgtataatgcgcccc

SEQ ID NO: 12152 - DNA, 60 bp, Xenorhabdus bovienii
  Promoter sequence Name=Xb4151_4152.C439.promoter21; Position on contig=42881..42940bp; Strand=+; Gene name=XerC
acatatcacaaagccagcatacaccttgttgtatctggcttttttgttatcagagcattg

SEQ ID NO: 12153 - DNA, 60 bp, Xenorhabdus bovienii
  Promoter sequence Name=Xb4151_4152.C439.promoter22; Position on contig=45636..45695bp; Strand=-
ctatagattctcttcgtgattttttattttctacccatttacgtatttctgctgcatcaa

SEQ ID NO: 12154 - DNA, 60 bp, Xenorhabdus bovienii
  Promoter sequence Name=Xb4151_4152.C439.promoter23; Position on contig=45246..45305bp; Strand=+
gatataattaaaataattatcaggtattcgatttttattctaatctttaaaattcatcac

SEQ ID NO: 12155 - DNA, 60 bp, Xenorhabdus bovienii
  Promoter sequence Name=Xb4151_4152.C439.promoter24; Position on contig=45707..45766bp; Strand=+
tatttataactttattgatttatctttatgataaattaaatcttatccaacataactaac

SEQ ID NO: 12156 - DNA, 60 bp, Xenorhabdus bovienii
  Promoter sequence Name=Xb4151_4152.C439.promoter25; Position on contig=52407..52466bp; Strand=-
acattctgggtgataaattgtatttcattgaaataaaatactttttctattttacgtgag

SEQ ID NO: 12157 - DNA, 60 bp, Xenorhabdus bovienii
  Promoter sequence Name=Xb4151_4152.C439.promoter26; Position on contig=52366..52425bp; Strand=+
gacttttagtttttatgttgggtttcctaccaagtaaaaatctcacgtaaaatagaaaaa

SEQ ID NO: 12158 - DNA, 60 bp, Xenorhabdus bovienii
  Promoter sequence Name=Xb4151_4152.C439.promoter27; Position on contig=52726..52785bp; Strand=+
tttatctgcgtagcttagcgtgcgattggttgcgttatatgaagatgtaaaagtcaccgt

SEQ ID NO: 12159 - DNA, 60 bp, Xenorhabdus bovienii
  Promoter sequence Name=Xb4151_4152.C439.promoter28; Position on contig=54010..54069bp; Strand=-
caaccatttttttcagtgccttgatagcgtgatctttggcttcacggtagccgttggcat

SEQ ID NO: 12160 - DNA, 60 bp, Xenorhabdus bovienii
  Promoter sequence Name=Xb4151_4152.C439.promoter29; Position on contig=53779..53838bp; Strand=+
ctatttaggggtacacggctattttttattggagattgcacaatgcctaaaatcacagat

SEQ ID NO: 12161 - DNA, 60 bp, Xenorhabdus bovienii
  Promoter sequence Name=Xb4151_4152.C439.promoter30; Position on contig=55327..55386bp; Strand=+
caaggcttcataccacctactcaatgaataaattcaatagggtttcataacataccagaa

SEQ ID NO: 12162 - DNA, 60 bp, Xenorhabdus bovienii
  Promoter sequence Name=Xb4151_4152.C439.promoter31; Position on contig=57898..57957bp; Strand=-
tgacatattgttgaaccctacattaatttattccaagatttatcttgtttaatttatcgt

SEQ ID NO: 12163 - DNA, 60 bp, Xenorhabdus bovienii
  Promoter sequence Name=Xb4151_4152.C439.promoter32; Position on contig=57856..57915bp; Strand=+
atgattattatcctgaacaccagttgagttgtgaaaagtcttacgataaattaaacaaga

SEQ ID NO: 12164 - DNA, 60 bp, Xenorhabdus bovienii
  Promoter sequence Name=Xb4151_4152.C439.promoter33; Position on contig=61318..61377bp; Strand=-
ctgatgcgagaaataagtgtgttatgtattcttcaaagtctgagcactatgctggctctg

SEQ ID NO: 12165 - DNA, 60 bp, Xenorhabdus bovienii
  Promoter sequence Name=Xb4151_4152.C439.promoter34; Position on contig=61637..61696bp; Strand=-; Gene name=PhnF
catcctcgtttattaattgttttttaatcgcaatttcaatggcttgttgtaattgtatgt

SEQ ID NO: 12166 - DNA, 60 bp, Xenorhabdus bovienii
  Promoter sequence Name=Xb4151_4152.C439.promoter35; Position on contig=61388..61447bp; Strand=+; Gene name=PhnF
ttcaaagtgatactgacaaactcccgacttcttatataagcaagatttatactttacatt

SEQ ID NO: 12167 - DNA, 60 bp, Xenorhabdus bovienii
  Promoter sequence Name=Xb4151_4152.C439.promoter36; Position on contig=64396..64455bp; Strand=-
gtatgacaatccattgaagatggaattggacgatatcttatcgcaaataaaataaacagt

SEQ ID NO: 12168 - DNA, 60 bp, Xenorhabdus bovienii
  Promoter sequence Name=Xb4151_4152.C439.promoter37; Position on contig=64066..64125bp; Strand=+
caaatagatccccgagattatcttttttttcatacgccattcagttccataattgagttc

SEQ ID NO: 12169 - DNA, 60 bp, Xenorhabdus bovienii
  Promoter sequence Name=Xb4151_4152.C439.promoter38; Position on contig=65063..65122bp; Strand=-; Gene name=MhpC
atttcgccttgtggaagggtagaattcccacatccggcataatcaggaataatcaccgta

SEQ ID NO: 12170 - DNA, 60 bp, Xenorhabdus bovienii
  Promoter sequence Name=Xb4151_4152.C439.promoter39; Position on contig=64799..64858bp; Strand=+; Gene name=MhpC
gtaagataaaatagtttaattacaaaataatagaatacatgctctattaaacttaaaatt

SEQ ID NO: 12171 - DNA, 60 bp, Xenorhabdus bovienii
  Promoter sequence Name=Xb4151_4152.C439.promoter40; Position on contig=65921..65980bp; Strand=-; Gene name=PncA
attaatgtgaaatggtgttttatatttaattaatgattattatttatataatatttgctt

SEQ ID NO: 12172 - DNA, 60 bp, Xenorhabdus bovienii
  Promoter sequence Name=Xb4151_4152.C439.promoter41; Position on contig=66817..66876bp; Strand=+
atttgttaattaaactcacttaggttacgaaatctcatatcaaaagtaattatgaaatat

SEQ ID NO: 12173 - DNA, 60 bp, Xenorhabdus bovienii
  Promoter sequence Name=Xb4151_4152.C439.promoter42; Position on contig=68498..68557bp; Strand=+
tcgactctatattttattaaaaattttaaattgacaatcaccatctataaaattatcaat

SEQ ID NO: 12174 - DNA, 60 bp, Xenorhabdus bovienii
  Promoter sequence Name=Xb4151_4152.C439.promoter43; Position on contig=69216..69275bp; Strand=+
catgaataaatcttccgacactatttttagaaacggtatatttaataattattttaaata

SEQ ID NO: 12175 - DNA, 60 bp, Xenorhabdus bovienii
  Promoter sequence Name=Xb4151_4152.C439.promoter44; Position on contig=71014..71073bp; Strand=+
ggaaacccggtagactaaacggcgcatcgacacgcactagcgtgtttttttatatgcgca

SEQ ID NO: 12176 - DNA, 60 bp, Xenorhabdus bovienii
  Promoter sequence Name=Xb4151_4152.C439.promoter45; Position on contig=72594..72653bp; Strand=-; Gene name=FdhD
tggcaactgattacggtatctatgccgtgaatttcgtgtggggaagtgataatgctttct

SEQ ID NO: 12177 - DNA, 60 bp, Xenorhabdus bovienii
  Promoter sequence Name=Xb4151_4152.C439.promoter46; Position on contig=72217..72276bp; Strand=+; Gene name=FdhD
ccgtaggtatgtaattttgggcctagatttatgaatatttttcttttcattatggattct

SEQ ID NO: 12178 - DNA, 60 bp, Xenorhabdus bovienii
  Promoter sequence Name=Xb4151_4152.C439.promoter47; Position on contig=74040..74099bp; Strand=-
ggaataaataaatttaatgataaattaaatttatcattaaagatgggtatcttacgggaa

SEQ ID NO: 12179 - DNA, 60 bp, Xenorhabdus bovienii
  Promoter sequence Name=Xb4151_4152.C439.promoter48; Position on contig=74414..74473bp; Strand=+
aattttaattaataaactctgtaaaacccagaataaataataataattatcatttacatt

SEQ ID NO: 12180 - DNA, 60 bp, Xenorhabdus bovienii
  Promoter sequence Name=Xb4151_4152.C439.promoter49; Position on contig=84963..85022bp; Strand=-
aggtgtaaggatcggtgtatgatccttgcgctttattacacagtccgtataatcctccac

SEQ ID NO: 12181 - DNA, 60 bp, Xenorhabdus bovienii
  Promoter sequence Name=Xb4151_4152.C439.promoter50; Position on contig=84639..84698bp; Strand=+
agtacggacggttggaaagtgcgtttcatagcgatttctacctaacttaaaatttgttac

SEQ ID NO: 12182 - DNA, 60 bp, Xenorhabdus bovienii
  Promoter sequence Name=Xb4151_4152.C439.promoter51; Position on contig=91800..91859bp; Strand=-
acagggataaattcattaattaatcttggattgtttctgtttatatttatacttaatatg

SEQ ID NO: 12183 - DNA, 60 bp, Xenorhabdus bovienii
  Promoter sequence Name=Xb4151_4152.C439.promoter52; Position on contig=91588..91647bp; Strand=+
atagctatttatacgataaaccattccataaatacataataataagtaataataacccag

SEQ ID NO: 12184 - DNA, 60 bp, Xenorhabdus bovienii
  Promoter sequence Name=Xb4151_4152.C439.promoter53; Position on contig=92156..92215bp; Strand=+
ctataatagttcaaataaattcaataaattaatttataaaaagagtacagcatgacagtt

SEQ ID NO: 12185 - DNA, 60 bp, Xenorhabdus bovienii
  Promoter sequence Name=Xb4151_4152.C439.promoter54; Position on contig=94443..94502bp; Strand=-
aggtatgaataaaaagaaacggtgatcagaaacctacattttttctgtagtcttttaaca

SEQ ID NO: 12186 - DNA, 60 bp, Xenorhabdus bovienii
  Promoter sequence Name=Xb4151_4152.C439.promoter55; Position on contig=93937..93996bp; Strand=+
atatccctgccagccggttgctttcagcttgggataaatttcattggtataatccccgcc

SEQ ID NO: 12187 - DNA, 60 bp, Xenorhabdus bovienii
  Promoter sequence Name=Xb4151_4152.C439.promoter56; Position on contig=97868..97927bp; Strand=-
ataactcattattttatcattttttatctaatatttttttagtttgttaaacttagtaaa

SEQ ID NO: 12188 - DNA, 60 bp, Xenorhabdus bovienii
  Promoter sequence Name=Xb4151_4152.C439.promoter57; Position on contig=98260..98319bp; Strand=-
ttattagtaaaataattaatgcaattaatattattaatttagttaattatattaatttgg

SEQ ID NO: 12189 - DNA, 60 bp, Xenorhabdus bovienii
  Promoter sequence Name=Xb4151_4152.C439.promoter58; Position on contig=106311..106370bp; Strand=-
ttttaaacatcagtgaataatatctcaaagtacattacacaaccgattataattattgtg

SEQ ID NO: 12190 - DNA, 60 bp, Xenorhabdus bovienii
  Promoter sequence Name=Xb4151_4152.C439.promoter59; Position on contig=107850..107909bp; Strand=-
tgaccggatttttttatggttttttgtgaagatttataggatggatgtataattttgttt

SEQ ID NO: 12191 - DNA, 60 bp, Xenorhabdus bovienii
  Promoter sequence Name=Xb4151_4152.C439.promoter60; Position on contig=107305..107364bp; Strand=+
taacaagttggcagagcctgtaagaatgaaacgccctgatgttctattagtatcaactac

SEQ ID NO: 12192 - DNA, 60 bp, Xenorhabdus bovienii
  Promoter sequence Name=Xb4151_4152.C439.promoter61; Position on contig=111345..111404bp; Strand=-
ggcttttttgcattgcgaaatatgtagcaatttattttgcaaacaggtttactttcatac

SEQ ID NO: 12193 - DNA, 60 bp, Xenorhabdus bovienii
  Promoter sequence Name=Xb4151_4152.C439.promoter62; Position on contig=111269..111328bp; Strand=+
ccagcggcaaggatcacaacactttttgcgctatttgcactaatagacataataaacctg

SEQ ID NO: 12194 - DNA, 60 bp, Xenorhabdus bovienii
  Promoter sequence Name=Xb4151_4152.C439.promoter63; Position on contig=116787..116846bp; Strand=-
ttaagattaagccaattcattaattgaaatagaggtattgtgctttgaatattaacgcaa

SEQ ID NO: 12195 - DNA, 60 bp, Xenorhabdus bovienii
  Promoter sequence Name=Xb4151_4152.C439.promoter64; Position on contig=116488..116547bp; Strand=+
ggcctgcgctacaatcttgttacgttccagctcagcttctgttttggcatcatcaataat

SEQ ID NO: 12196 - DNA, 60 bp, Xenorhabdus bovienii
  Promoter sequence Name=Xb4151_4152.C439.promoter65; Position on contig=118485..118544bp; Strand=-; Gene name=GidB
tattcactttttcgctacttatggattgaattcattttggctgcccgtataatttgcacg

SEQ ID NO: 12197 - DNA, 60 bp, Xenorhabdus bovienii
  Promoter sequence Name=Xb4151_4152.C439.promoter66; Position on contig=121563..121622bp; Strand=-
ttaattagcaacgatcaaacttatttggtctaatgtccaaacttgagtagaatcctctcc

SEQ ID NO: 12198 - DNA, 60 bp, Xenorhabdus bovienii
  Promoter sequence Name=Xb4151_4152.C439.promoter67; Position on contig=121755..121814bp; Strand=-; Gene name=FldA
agtttcaatttagcttctgtgtataactactgatttagatcccagcttatactgacttgg

SEQ ID NO: 12199 - DNA, 60 bp, Xenorhabdus bovienii
  Promoter sequence Name=Xb4151_4152.C439.promoter68; Position on contig=122361..122420bp; Strand=-; Gene name=Lrp
ggtttataaccatattatccacaggtagatcccagtagactcacagcgtacaatagccgt

SEQ ID NO: 12200 - DNA, 60 bp, Xenorhabdus bovienii
  Promoter sequence Name=Xb4151_4152.C439.promoter69; Position on contig=122979..123038bp; Strand=-
ttagtgaccctatgtcctgttgatatagattaagcaacagaatgaggtataaattcaata

SEQ ID NO: 12201 - DNA, 60 bp, Xenorhabdus bovienii
  Promoter sequence Name=Xb4151_4152.C439.promoter70; Position on contig=127160..127219bp; Strand=-; Gene name=RbsD
ttaataaacagggtaataaataaaaaagtataacttattgaataagttatactgaatcga

SEQ ID NO: 12202 - DNA, 60 bp, Xenorhabdus bovienii
  Promoter sequence Name=Xb4151_4152.C439.promoter71; Position on contig=127177..127236bp; Strand=+; Gene name=RbsD
attcaataagttatacttttttatttattaccctgtttattaaacgttttaatcatgatc

SEQ ID NO: 12203 - DNA, 60 bp, Xenorhabdus bovienii
  Promoter sequence Name=Xb4151_4152.C439.promoter72; Position on contig=134695..134754bp; Strand=-
ttttttttaacaaaactggcatttacgctctcttttcgatcagatattggtgttatcgac

SEQ ID NO: 12204 - DNA, 60 bp, Xenorhabdus bovienii
  Promoter sequence Name=Xb4151_4152.C439.promoter73; Position on contig=134428..134487bp; Strand=+
atgattaagacttttagcaattgccggcaatgcggtattaaggatggttgcatccaggga

SEQ ID NO: 12205 - DNA, 60 bp, Xenorhabdus bovienii
  Promoter sequence Name=Xb4151_4152.C440.promoter1; Position on contig= 2394..2453bp; Strand=-
tactttcaaacaaaagaatatggtaaattgattttttactagttagttaaaattcataat

SEQ ID NO: 12206 - DNA, 60 bp, Xenorhabdus bovienii
  Promoter sequence Name=Xb4151_4152.C440.promoter2; Position on contig= 2584..2643bp; Strand=+
ctgacatagtgttatgttaataaattgacaattgtatattttagaagtatacttcaggag

SEQ ID NO: 12207 - DNA, 60 bp, Xenorhabdus bovienii
  Promoter sequence Name=Xb4151_4152.C440.promoter3; Position on contig= 9441..9500bp; Strand=-
gatttcaggaagccgaggatgcggggttttttaggtcagatcagcaataaactctttatg

SEQ ID NO: 12208 - DNA, 60 bp, Xenorhabdus bovienii
  Promoter sequence Name=Xb4151_4152.C440.promoter4; Position on contig= 9357..9416bp; Strand=+
tcaatccgcagcatgtgttttccttcattcttaaatcgttaaccaaataaattagtcaga

SEQ ID NO: 12209 - DNA, 60 bp, Xenorhabdus bovienii
  Promoter sequence Name=Xb4151_4152.C440.promoter5; Position on contig= 10743..10802bp; Strand=-
atcaccgatacccagccggcgttttttctcttccagcgtcagccagagataattttccgg

SEQ ID NO: 12210 - DNA, 60 bp, Xenorhabdus bovienii
  Promoter sequence Name=Xb4151_4152.C440.promoter6; Position on contig= 10423..10482bp; Strand=+
catcgtagtcggtgtggtgctgttggttgcggtgatttggctgctggcgaaatcggccgg

SEQ ID NO: 12211 - DNA, 60 bp, Xenorhabdus bovienii
  Promoter sequence Name=Xb4151_4152.C440.promoter7; Position on contig= 17939..17998bp; Strand=+
atagccaaaataacttttaccgtgctttttcgtccaggttgccgcggtatctttctggca

SEQ ID NO: 12212 - DNA, 60 bp, Xenorhabdus bovienii
  Promoter sequence Name=Xb4151_4152.C440.promoter8; Position on contig= 19399..19458bp; Strand=-
ttacactcttatttttccagactaattacatagttattcctataaataatttaatttaat

SEQ ID NO: 12213 - DNA, 60 bp, Xenorhabdus bovienii
  Promoter sequence Name=Xb4151_4152.C440.promoter9; Position on contig= 19876..19935bp; Strand=-; Gene name=SmtA
gagtccgaagatggagctgaacgcataataactctccaattatttgtgataatacaataa

SEQ ID NO: 12214 - DNA, 60 bp, Xenorhabdus bovienii
  Promoter sequence Name=Xb4151_4152.C440.promoter10; Position on contig=19826..19885bp; Strand=+; Gene name=SmtA
atttgccttgagcaaaaataggcgaagtcgtaagagattaaactgttaatttattgtatt

SEQ ID NO: 12215 - DNA, 60 bp, Xenorhabdus bovienii
  Promoter sequence Name=Xb4151_4152.C440.promoter11; Position on contig=23364..23423bp; Strand=-
cactgagagtaaggccttctttgcgtaatttttccgccagcatccggtaacataagcttt

SEQ ID NO: 12216 - DNA, 60 bp, Xenorhabdus bovienii
  Promoter sequence Name=Xb4151_4152.C440.promoter12; Position on contig=24224..24283bp; Strand=+
gtaatttactcaatttggtcgctgtgaaaaatttttggaggttccctttataatatcaaa

SEQ ID NO: 12217 - DNA, 60 bp, Xenorhabdus bovienii
  Promoter sequence Name=Xb4151_4152.C440.promoter13; Position on contig=29150..29209bp; Strand=-
tcacagcaactaaccatttaatacatgaccgtttttttagcttaaattatattcaatgaa

SEQ ID NO: 12218 - DNA, 60 bp, Xenorhabdus bovienii
  Promoter sequence Name=Xb4151_4152.C440.promoter14; Position on contig=31181..31240bp; Strand=+
tacccaatggtttttctattcagccttttgattcgggtacgatgcgttaaattcgttctc

SEQ ID NO: 12219 - DNA, 60 bp, Xenorhabdus bovienii; identical to SEQ ID NO: 10698
  Promoter sequence Name=Xb4151_4152.C440.promoter15; Position on contig=31718..31777bp; Strand=+

SEQ ID NO: 12220 - DNA, 60 bp, Xenorhabdus bovienii
  Promoter sequence Name=Xb4151_4152.C440.promoter16; Position on contig=32158..32217bp; Strand=+; Gene name=Qor
aaacactataacgaaatacagttgaattattaattatttggtatttatataaaaataata

SEQ ID NO: 12221 - DNA, 60 bp, Xenorhabdus bovienii
  Promoter sequence Name=Xb4151_4152.C440.promoter17; Position on contig=34454..34513bp; Strand=-; Gene name=XerC
ttctatgctatagtaggccatctttgatgctctcctgttcaggtccccatattaatgggg

SEQ ID NO: 12222 - DNA, 60 bp, Xenorhabdus bovienii
  Promoter sequence Name=Xb4151_4152.C440.promoter18; Position on contig=34347..34406bp; Strand=+; Gene name=XerC
gcactcgttgatatggcagtgaattcactatgtttttgtatatgtgtattttcgtgcatt

SEQ ID NO: 12223 - DNA, 60 bp, Xenorhabdus bovienii
  Promoter sequence Name=Xb4151_4152.C440.promoter19; Position on contig=35848..35907bp; Strand=+
tttaattaaatcaagaggttaaattaaaggggaggattgtcccctttaaactcatagtct

SEQ ID NO: 12224 - DNA, 60 bp, Xenorhabdus bovienii
  Promoter sequence Name=Xb4151_4152.C440.promoter20; Position on contig=39536..39595bp; Strand=-
gggatgaacaggggcggcagcgtaataccggcattcgcccctttctttatgctggcttta

SEQ ID NO: 12225 - DNA, 60 bp, Xenorhabdus bovienii; identical to SEQ ID NO: 11110
  Promoter sequence Name=Xb4151_4152.C440.promoter21; Position on contig=39177..39236bp; Strand=+

SEQ ID NO: 12226 - DNA, 60 bp, Xenorhabdus bovienii
  Promoter sequence Name=Xb4151_4152.C440.promoter22; Position on contig=49479..49538bp; Strand=+
gtaatctgcgacctgaacgagacggcattgaccagcaggccaacggttaacgtcgataaa

SEQ ID NO: 12227 - DNA, 60 bp, Xenorhabdus bovienii
  Promoter sequence Name=Xb4151_4152.C440.promoter23; Position on contig=51198..51257bp; Strand=-
ccacgcgattggtcgaagcccgctttcagatcgggatcattaccctgaataattacccga

SEQ ID NO: 12228 - DNA, 60 bp, Xenorhabdus bovienii
  Promoter sequence Name=Xb4151_4152.C440.promoter24; Position on contig=50647..50706bp; Strand=+
gcgagcacctttaaaacggcggactggttgtagtccagagcagggcgtataaacggttta

SEQ ID NO: 12229 - DNA, 60 bp, Xenorhabdus bovienii; identical to SEQ ID NO: 10931
  Promoter sequence Name=Xb4151_4152.C440.promoter25; Position on contig=52256..52315bp; Strand=-

SEQ ID NO: 12230 - DNA, 60 bp, Xenorhabdus bovienii
  Promoter sequence Name=Xb4151_4152.C440.promoter26; Position on contig=53433..53492bp; Strand=-
cgtgtcccttaattatataaccgcttgtaaaagagtcgaatacagcctaatttcaccatg

SEQ ID NO: 12231 - DNA, 60 bp, Xenorhabdus bovienii; identical to SEQ ID NO: 11088
  Promoter sequence Name=Xb4151_4152.C440.promoter27; Position on contig=53197..53256bp; Strand=+

SEQ ID NO: 12232 - DNA, 60 bp, Xenorhabdus bovienii
  Promoter sequence Name=Xb4151_4152.C440.promoter28; Position on contig=54061..54120bp; Strand=-
aatcgaactaagcatgttgaagttacttttgtttgtaaagggttatttatcctgagcata

SEQ ID NO: 12233 - DNA, 60 bp, Xenorhabdus bovienii
  Promoter sequence Name=Xb4151_4152.C440.promoter29; Position on contig=53891..53950bp; Strand=+
cttttgtagctaaaatccagtgccaacgcttggctaccgcccattgataaaataaaaaac

SEQ ID NO: 12234 - DNA, 60 bp, Xenorhabdus bovienii
  Promoter sequence Name=Xb4151_4152.C440.promoter30; Position on contig=55212..55271bp; Strand=+
ccaaaaagattacgtcagtatcagaccttattgaagtatttcacaggtaaaattcacttc

SEQ ID NO: 12235 - DNA, 60 bp, Xenorhabdus bovienii
  Promoter sequence Name=Xb4151_4152.C440.promoter31; Position on contig=55578..55637bp; Strand=+
attgactttaattttaatcgttgattaattattgagcgccagtggattattgttaggtgg

SEQ ID NO: 12236 - DNA, 60 bp, Xenorhabdus bovienii
  Promoter sequence Name=Xb4151_4152.C440.promoter32; Position on contig=57997..58056bp; Strand=-
aagcatgatggtatttatatacaatatgttaatgataaagaaatttttaaattgaaactt

SEQ ID NO: 12237 - DNA, 60 bp, Xenorhabdus bovienii
  Promoter sequence Name=Xb4151_4152.C440.promoter33; Position on contig=58467..58526bp; Strand=-
aaaaacgagagttaattataagatttgactaccgtcaatagtgagaataatataaaaaca

SEQ ID NO: 12238 - DNA, 60 bp, Xenorhabdus bovienii
  Promoter sequence Name=Xb4151_4152.C440.promoter34; Position on contig=61047..61106bp; Strand=-
aggcaagaaagaatatattttttcatattactctccacgtgtaacgtcattataaaaaga

SEQ ID NO: 12239 - DNA, 60 bp, Xenorhabdus bovienii
  Promoter sequence Name=Xb4151_4152.C440.promoter35; Position on contig=60816..60875bp; Strand=+
ggaaattgtgaggcggtattttgcggagctttgaagaaggtaatttttaaattggcagat

SEQ ID NO: 12240 - DNA, 60 bp, Xenorhabdus bovienii
  Promoter sequence Name=Xb4151_4152.C440.promoter36; Position on contig=62281..62340bp; Strand=-
gtcgtaagcagaattatttgcgaatgttggtgttgacaattcgacgttaaccgtctttcg

SEQ ID NO: 12241 - DNA, 60 bp, Xenorhabdus bovienii
  Promoter sequence Name=Xb4151_4152.C440.promoter37; Position on contig=61941..62000bp; Strand=+
tccaacaattcagcatgcccgtgaatatcaccagaaaaatggaagggtgtcatttttttc

SEQ ID NO: 12242 - DNA, 60 bp, Xenorhabdus bovienii
  Promoter sequence Name=Xb4151_4152.C440.promoter38; Position on contig=63826..63885bp; Strand=-
gcgatgaagttagaaggtgcggataagtaaaacacaggaatatagggtataatagtgaca

SEQ ID NO: 12243 - DNA, 60 bp, Xenorhabdus bovienii
  Promoter sequence Name=Xb4151_4152.C440.promoter39; Position on contig=63594..63653bp; Strand=+
cgattgcggacgagccacgatccaaccctgactttccagcaattgataggcttgtagcac

SEQ ID NO: 12244 - DNA, 60 bp, Xenorhabdus bovienii
  Promoter sequence Name=Xb4151_4152.C440.promoter40; Position on contig=68259..68318bp; Strand=-
cattctgcaccataaacggttggccaataatgttttggcgtatgtaatacaatgccaagg

SEQ ID NO: 12245 - DNA, 60 bp, Xenorhabdus bovienii
  Promoter sequence Name=Xb4151_4152.C440.promoter41; Position on contig=67919..67978bp; Strand=+
acggccagttgcattaacgcagatagcttattccattggaggtctgttaacatagttcgc

SEQ ID NO: 12246 - DNA, 60 bp, Xenorhabdus bovienii
  Promoter sequence Name=Xb4151_4152.C440.promoter42; Position on contig=72769..72828bp; Strand=+
ttcactaaattaataactaaggtgattaaaaagcggatttaatgcgttaaaatgaagcaa

SEQ ID NO: 12247 - DNA, 60 bp, Xenorhabdus bovienii
  Promoter sequence Name=Xb4151_4152.C440.promoter43; Position on contig=73956..74015bp; Strand=-
gtacaaatgaataaaaaaggaatccattgatttttatttcaatgtgctaatatcaaatgg

SEQ ID NO: 12248 - DNA, 60 bp, Xenorhabdus bovienii
  Promoter sequence Name=Xb4151_4152.C440.promoter44; Position on contig=73973..74032bp; Strand=+
attgaaataaaaatcaatggattccttttttattcatttgtacatattaaaatagcctat

SEQ ID NO: 12249 - DNA, 60 bp, Xenorhabdus bovienii
  Promoter sequence Name=Xb4151_4152.C440.promoter45; Position on contig=74990..75049bp; Strand=-
tgtctacaccagtcacaggatctttgatgggcaaaaaacaaccattttatttttgttatt

SEQ ID NO: 12250 - DNA, 60 bp, Xenorhabdus bovienii
  Promoter sequence Name=Xb4151_4152.C440.promoter46; Position on contig=74824..74883bp; Strand=+
cacgctatcttttaccgcgtcctgtaagggtaatttataaatatcgttaaaataatgtcg

SEQ ID NO: 12251 - DNA, 60 bp, Xenorhabdus bovienii
  Promoter sequence Name=Xb4151_4152.C440.promoter47; Position on contig=75713..75772bp; Strand=-
aaataattattaataataaaacaattatttcagtgccgccaatgcgctgtcatagtcagg

SEQ ID NO: 12252 - DNA, 60 bp, Xenorhabdus bovienii
  Promoter sequence Name=Xb4151_4152.C440.promoter48; Position on contig=76084..76143bp; Strand=+; Gene name=VgrG
caaaatagttttttatatgaaatattgcatatagattaataccttcttgcaatcaaaata

SEQ ID NO: 12253 - DNA, 60 bp, Xenorhabdus bovienii
  Promoter sequence Name=Xb4151_4152.C440.promoter49; Position on contig=93326..93385bp; Strand=+
actgttaccacataaattaaaactgttgttctgcattcaacattattcattattcattgt

SEQ ID NO: 12254 - DNA, 60 bp, Xenorhabdus bovienii
  Promoter sequence Name=Xb4151_4152.C440.promoter50; Position on contig=102372..102431bp; Strand=-
ttattctgacacattggatatttttccctctattttttatatcagtcaataatgcattga

SEQ ID NO: 12255 - DNA, 60 bp, Xenorhabdus bovienii
  Promoter sequence Name=Xb4151_4152.C440.promoter51; Position on contig=101917..101976bp; Strand=+
gttgatgttttaaggtcatcgccctaatcacgtcatccatctctgagtaaaattattcat

SEQ ID NO: 12256 - DNA, 60 bp, Xenorhabdus bovienii
  Promoter sequence Name=Xb4151_4152.C440.promoter52; Position on contig=103644..103703bp; Strand=-
cactgttgcaaataaagttggttctgtcgtattaagccgtgtccgggtatcatgctgttt

SEQ ID NO: 12257 - DNA, 60 bp, Xenorhabdus bovienii
  Promoter sequence Name=Xb4151_4152.C440.promoter53; Position on contig=103525..103584bp; Strand=+
acgcaggctcagcgcataggccagataccagcgaacacactgagcgataacatcggtggg

SEQ ID NO: 12258 - DNA, 60 bp, Xenorhabdus bovienii
  Promoter sequence Name=Xb4151_4152.C440.promoter54; Position on contig=104105..104164bp; Strand=-
aaatttgctattgattttgcgtatttattaaatccactgttcataggtaaaatacattaa

SEQ ID NO: 12259 - DNA, 60 bp, Xenorhabdus bovienii
  Promoter sequence Name=Xb4151_4152.C440.promoter55; Position on contig=104000..104059bp; Strand=+
aatgattacgggtatattaatatatagaattgccacaatctatcttttatattaattttc

SEQ ID NO: 12260 - DNA, 60 bp, Xenorhabdus bovienii
  Promoter sequence Name=Xb4151_4152.C440.promoter56; Position on contig=105145..105204bp; Strand=+; Gene name=SerA
cctaatctaatcatttaatacatgaccgttttttgtatatagtgataatcagacaacaga

SEQ ID NO: 12261 - DNA, 60 bp, Xenorhabdus bovienii
  Promoter sequence Name=Xb4151_4152.C440.promoter57; Position on contig=109081..109140bp; Strand=+; Gene name=AccD
tagtaggtttgaacagtttttttatccacactgtaatggcattgtggtttaatggcacgt

SEQ ID NO: 12262 - DNA, 60 bp, Xenorhabdus bovienii
  Promoter sequence Name=Xb4151_4152.C440.promoter58; Position on contig=112282..112341bp; Strand=-; Gene name=CvpA
cgagaaaccaatgatggcaataattgtataatcaatccagaccatattctaatccaaaac

SEQ ID NO: 12263 - DNA, 60 bp, Xenorhabdus bovienii
  Promoter sequence Name=Xb4151_4152.C440.promoter59; Position on contig=112203..112262bp; Strand=+; Gene name=CvpA
tttcagtagactgaaaaatctgctacgcaaacgttttcgttttctgttagaatgcgcccg

SEQ ID NO: 12264 - DNA, 60 bp, Xenorhabdus bovienii
  Promoter sequence Name=Xb4151_4152.C440.promoter60; Position on contig=115910..115969bp; Strand=-; Gene name=Gst
gctaacagataacagcatttttcgctgttacgcaggccatcccctgctatagtcaataat

SEQ ID NO: 12265 - DNA, 60 bp, Xenorhabdus bovienii
  Promoter sequence Name=Xb4151_4152.C440.promoter61; Position on contig=116664..116723bp; Strand=+; Gene name=MutT
attggtaaatatagtttcagtacattaccactgatttgagttgtctgtaaaatgccaccc

SEQ ID NO: 12266 - DNA, 60 bp, Xenorhabdus bovienii
  Promoter sequence Name=Xb4151_4152.C440.promoter62; Position on contig=118953..119012bp; Strand=+
aatatatataatattcttgtaagaatattacggtaatctactttggctaatatatgattc

SEQ ID NO: 12267 - DNA, 60 bp, Xenorhabdus bovienii
  Promoter sequence Name=Xb4151_4152.C440.promoter63; Position on contig=125984..126043bp; Strand=+
cctcagtcaactatcgaacagggtgaatagcgaaaataattaatcgttataattagaaag

SEQ ID NO: 12268 - DNA, 60 bp, Xenorhabdus bovienii
  Promoter sequence Name=Xb4151_4152.C440.promoter64; Position on contig=134327..134386bp; Strand=+
aggggaataaaaagttaggaagatcaggcgcttttctgcctgatctcatactttcgccgc

SEQ ID NO: 12269 - DNA, 60 bp, Xenorhabdus bovienii
  Promoter sequence Name=Xb4151_4152.C440.promoter65; Position on contig=141587..141646bp; Strand=-
ttaattatgatgttaagtgatgtgattgaatattcacatttctttggtaatcgtcagcac

SEQ ID NO: 12270 - DNA, 60 bp, Xenorhabdus bovienii
  Promoter sequence Name=Xb4151_4152.C440.promoter66; Position on contig=142423..142482bp; Strand=-
tttacgattacaatttcaataaaaatttgcaaatgggcattttactttaaaataaaataa

SEQ ID NO: 12271 - DNA, 60 bp, Xenorhabdus bovienii
  Promoter sequence Name=Xb4151_4152.C440.promoter67; Position on contig=142781..142840bp; Strand=-; Gene name=ArgD
ttaatcactaaaataaaaatgaattgatataccatgaaatgtatttgtttaattaatagg

SEQ ID NO: 12272 - DNA, 60 bp, Xenorhabdus bovienii
  Promoter sequence Name=Xb4151_4152.C440.promoter68; Position on contig=150464..150523bp; Strand=+
gatttaggtcggtttttaatattattatctttataaaaaatttattggatatttaattca

SEQ ID NO: 12273 - DNA, 60 bp, Xenorhabdus bovienii
  Promoter sequence Name=Xb4151_4152.C440.promoter69; Position on contig=152816..152875bp; Strand=-
acgttgattgactgacgagcaaccgttaaagaggtttccgtgtcccgtataattatgttg

SEQ ID NO: 12274 - DNA, 60 bp, Xenorhabdus bovienii
  Promoter sequence Name=Xb4151_4152.C440.promoter70; Position on contig=154240..154299bp; Strand=-
ttttcgcaacactttggttcagtttgttaacagattatttcattttttaacatcattctt

SEQ ID NO: 12275 - DNA, 60 bp, Xenorhabdus bovienii
  Promoter sequence Name=Xb4151_4152.C440.promoter71; Position on contig=154331..154390bp; Strand=+
acataaaagtctgtgtaggataccgtttgctagcaataaagacaaaatatacttaatagt

SEQ ID NO: 12276 - DNA, 60 bp, Xenorhabdus bovienii
  Promoter sequence Name=Xb4151_4152.C440.promoter72; Position on contig=154986..155045bp; Strand=+
taaatggttgttttgcgctactcataaaaaatggatacagaagggcgttatactcatctt

SEQ ID NO: 12277 - DNA, 60 bp, Xenorhabdus bovienii
  Promoter sequence Name=Xb4151_4152.C440.promoter73; Position on contig=160120..160179bp; Strand=-; Gene name=LysR
ccaactaaaaacacgtcattatttgaaatataaaaccaagaataaataaaaataaagaat

SEQ ID NO: 12278 - DNA, 60 bp, Xenorhabdus bovienii
  Promoter sequence Name=Xb4151_4152.C440.promoter74; Position on contig=162190..162249bp; Strand=+; Gene name=NuoA
tggttttttgtttgtaaataaataggtagtcgcttttgccatgcaggcaaaatattgttt

SEQ ID NO: 12279 - DNA, 60 bp, Xenorhabdus bovienii
  Promoter sequence Name=Xb4151_4152.C440.promoter75; Position on contig=179062..179121bp; Strand=-
gactcaataataatgtaactctcccctttaggcagggcaatcgcatctaaaattcattga

SEQ ID NO: 12280 - DNA, 60 bp, Xenorhabdus bovienii
  Promoter sequence Name=Xb4151_4152.C440.promoter76; Position on contig=179084..179143bp; Strand=+
gccctgcctaaaggggagagttacattattattgagtcagaaggtgttaaaattagccgg

SEQ ID NO: 12281 - DNA, 60 bp, Xenorhabdus bovienii
  Promoter sequence Name=Xb4151_4152.C440.promoter77; Position on contig=183010..183069bp; Strand=-
cggagatactatctatcaaaaggttaaaaggtgagaaatcccacctttatacttttatga

SEQ ID NO: 12282 - DNA, 60 bp, Xenorhabdus bovienii
  Promoter sequence Name=Xb4151_4152.C440.promoter78; Position on contig=182583..182642bp; Strand=+
tctcttttgagtaaaatttatatacacactcaaaatcttcatatgggtaagtttttttat

SEQ ID NO: 12283 - DNA, 60 bp, Xenorhabdus bovienii
  Promoter sequence Name=Xb4151_4152.C440.promoter79; Position on contig=183371..183430bp; Strand=+
gcttggtgtatagccaccatctgaatagaatgaattcgtaaaaagtgtattcttttttta

SEQ ID NO: 12284 - DNA, 60 bp, Xenorhabdus bovienii
  Promoter sequence Name=Xb4151_4152.C440.promoter80; Position on contig=186588..186647bp; Strand=-
catcattgaataaaccataggctttgctttttgcgctatacacacgatgtaattcagcca

SEQ ID NO: 12285 - DNA, 60 bp, Xenorhabdus bovienii
  Promoter sequence Name=Xb4151_4152.C440.promoter81; Position on contig=186177..186236bp; Strand=+
gagacgactgtggcataaatcaaagatcctgaatatacaaagccctatatactaccgtat

SEQ ID NO: 12286 - DNA, 60 bp, Xenorhabdus bovienii
  Promoter sequence Name=Xb4151_4152.C440.promoter82; Position on contig=187951..188010bp; Strand=-; Gene name=SSL2
aatcagcccaaaagtactttctatttgctgtcatataggtttttcgttaaaatgccgccc

SEQ ID NO: 12287 - DNA, 60 bp, Xenorhabdus bovienii
  Promoter sequence Name=Xb4151_4152.C440.promoter83; Position on contig=189919..189978bp; Strand=-; Gene name=RsuA
gtcactattggagtacaagattaaccagataatattcagagtcatcgtaacatcaataat

SEQ ID NO: 12288 - DNA, 60 bp, Xenorhabdus bovienii
  Promoter sequence Name=Xb4151_4152.C440.promoter84; Position on contig=189868..189927bp; Strand=+; Gene name=RsuA
attcagttgctaaagtaagatggctataacatgtagtttattattgttataattattgat

SEQ ID NO: 12289 - DNA, 60 bp, Xenorhabdus bovienii
  Promoter sequence Name=Xb4151_4152.C440.promoter85; Position on contig=190769..190828bp; Strand=+; Gene name=ProP
ctatttaacaagttgttacgggagttaaagcgtgcaacaacaacgattatcctatttggg

SEQ ID NO: 12290 - DNA, 60 bp, Xenorhabdus bovienii
  Promoter sequence Name=Xb4151_4152.C440.promoter86; Position on contig=192306..192365bp; Strand=-
aataatatttttatattataatcagttaattaacaacaaaattattttaatctatagtca

SEQ ID NO: 12291 - DNA, 60 bp, Xenorhabdus bovienii
  Promoter sequence Name=Xb4151_4152.C440.promoter87; Position on contig=192412..192471bp; Strand=+
aagttgcttatttgcataaaaataagttgaattttttacctaaacagtataaatatatac

SEQ ID NO: 12292 - DNA, 60 bp, Xenorhabdus bovienii
  Promoter sequence Name=Xb4151_4152.C440.promoter88; Position on contig=193927..193986bp; Strand=-; Gene name=PgpB
gatattgcttatctcctcaaaactacacaatttttaccaaacaagtataaaatagcaaca

SEQ ID NO: 12293 - DNA, 60 bp, Xenorhabdus bovienii
  Promoter sequence Name=Xb4151_4152.C440.promoter89; Position on contig=194895..194954bp; Strand=-
aaaattgagacaaatatatattatcggtactgaagtggggatttagctatttttccgata

SEQ ID NO: 12294 - DNA, 60 bp, Xenorhabdus bovienii
  Promoter sequence Name=Xb4151_4152.C440.promoter90; Position on contig=194997..195056bp; Strand=+
tatcctaacttgttagaatattatgttgaaatgtagtctttataaataaaaatcataaag

SEQ ID NO: 12295 - DNA, 60 bp, Xenorhabdus bovienii
  Promoter sequence Name=Xb4151_4152.C440.promoter91; Position on contig=195523..195582bp; Strand=+
tattgtttatttgatttataaatataattattaattgtaaatttttttataattttgttt

SEQ ID NO: 12296 - DNA, 60 bp, Xenorhabdus bovienii
  Promoter sequence Name=Xb4151_4152.C440.promoter92; Position on contig=198156..198215bp; Strand=-
tacaacaaaaggaatttacttatcatccataaatatttgtttacacatatcattcattaa

SEQ ID NO: 12297 - DNA, 60 bp, Xenorhabdus bovienii
  Promoter sequence Name=Xb4151_4152.C440.promoter93; Position on contig=198852..198911bp; Strand=-; Gene name=FruK
ttaagatttctctgttatttataacatcaaaattgaatcgtttcagttaaaattaccact

SEQ ID NO: 12298 - DNA, 60 bp, Xenorhabdus bovienii
  Promoter sequence Name=Xb4151_4152.C440.promoter94; Position on contig=198862..198921bp; Strand=+; Gene name=FruK
ttaactgaaacgattcaattttgatgttataaataacagagaaatcttaatattacttat

SEQ ID NO: 12299 - DNA, 60 bp, Xenorhabdus bovienii
  Promoter sequence Name=Xb4151_4152.C440.promoter95; Position on contig=200763..200822bp; Strand=-
gttaaattgtattctctgtttttgacagagatttttttggcaggatgaacaatgccataa

SEQ ID NO: 12300 - DNA, 60 bp, Xenorhabdus bovienii
  Promoter sequence Name=Xb4151_4152.C440.promoter96; Position on contig=200485..200544bp; Strand=+
gcttctgcttcgggatgaccaaggttgatcaggtaactgtcgtggggaagaatttgttgg

SEQ ID NO: 12301 - DNA, 60 bp, Xenorhabdus bovienii
  Promoter sequence Name=Xb4151_4152.C440.promoter97; Position on contig=201987..202046bp; Strand=-; Gene name=LysR
aacaaaagtcacacttaattaatccattttaatggttatatatataaatattatcaattt

SEQ ID NO: 12302 - DNA, 60 bp, Xenorhabdus bovienii
  Promoter sequence Name=Xb4151_4152.C440.promoter98; Position on contig=201970..202029bp; Strand=+; Gene name=LysR
aagctttttaatcaataaaattgataatatttatatatataaccattaaaatggattaat

SEQ ID NO: 12303 - DNA, 60 bp, Xenorhabdus bovienii
  Promoter sequence Name=Xb4151_4152.C440.promoter99; Position on contig=203056..203115bp; Strand=+; Gene name=LysP
gtatcttataatcgctaatagccgctattctcgagacggggatttgttacaatttcacat

SEQ ID NO: 12304 - DNA, 60 bp, Xenorhabdus bovienii
  Promoter sequence Name=Xb4151_4152.C440.promoter100; Position on contig=204883..204942bp; Strand=-; Gene name=FecB
tgcaaaactcgccatcatagcggagcttgccagtagactgatattcatacccttcacgac

SEQ ID NO: 12305 - DNA, 60 bp, Xenorhabdus bovienii
  Promoter sequence Name=Xb4151_4152.C440.promoter101; Position on contig=204636..204695bp; Strand=+; Gene name=FecB
tgttaataaacatcaataaattgatatttattaattaacttattattatttatatattac

SEQ ID NO: 12306 - DNA, 60 bp, Xenorhabdus bovienii
  Promoter sequence Name=Xb4151_4152.C440.promoter102; Position on contig=207908..207967bp; Strand=+; Gene name=CirA
gttttattaaaactaaagcttaataaatataacactgacagggataaataattatccctg

SEQ ID NO: 12307 - DNA, 60 bp, Xenorhabdus bovienii
  Promoter sequence Name=Xb4151_4152.C440.promoter103; Position on contig=210349..210408bp; Strand=+
cagttatttttttgctttgagttattttttacaacaccaagaggccggattttgttccgg

SEQ ID NO: 12308 - DNA, 60 bp, Xenorhabdus bovienii
  Promoter sequence Name=Xb4151_4152.C440.promoter104; Position on contig=212105..212164bp; Strand=+; Gene name=GlcD
ttaattaaaataaaaaatatcaatagcataaaaatcaccaaaaggcgtcatataataaat

SEQ ID NO: 12309 - DNA, 60 bp, Xenorhabdus bovienii
  Promoter sequence Name=Xb4151_4152.C440.promoter105; Position on contig=215556..215615bp; Strand=-
taagccgtgcaataaaacttatatcaacacgatcaatacacaaaaataagataatacatt

SEQ ID NO: 12310 - DNA, 60 bp, Xenorhabdus bovienii
  Promoter sequence Name=Xb4151_4152.C440.promoter106; Position on contig=216197..216256bp; Strand=-
tttagacagctcacgacgctctttagacaactctgcatttttgatgatatattcatcaac

SEQ ID NO: 12311 - DNA, 60 bp, Xenorhabdus bovienii
  Promoter sequence Name=Xb4151_4152.C440.promoter107; Position on contig=215818..215877bp; Strand=+
gatgctgggacgatgaaaatgattgattaaggaatatacttaaagtttatcatgtcaata

SEQ ID NO: 12312 - DNA, 60 bp, Xenorhabdus bovienii
  Promoter sequence Name=Xb4151_4152.C440.promoter108; Position on contig=220137..220196bp; Strand=+
cgcaccataatcgacaaaagcagcttccagactaggttcaatccgtgtaattttaccttt

SEQ ID NO: 12313 - DNA, 60 bp, Xenorhabdus bovienii
  Promoter sequence Name=Xb4151_4152.C440.promoter109; Position on contig=220713..220772bp; Strand=+; Gene name=RluA
actttatctctttagcggttttttatcaggaaatagcgataagttgttaatctttagtct

SEQ ID NO: 12314 - DNA, 60 bp, Xenorhabdus bovienii
  Promoter sequence Name=Xb4151_4152.C440.promoter110; Position on contig=222454..222513bp; Strand=-
acctgcacctttccaccaaatattcgcctattaagcggcgtatagtttaaaatgcctgag

SEQ ID NO: 12315 - DNA, 60 bp, Xenorhabdus bovienii
  Promoter sequence Name=Xb4151_4152.C441.promoter1; Position on contig= 5364..5423bp; Strand=-
gaaccccatttcccactaacaaagagttgtttctcggttcagcttattagaatatagaag

SEQ ID NO: 12316 - DNA, 60 bp, Xenorhabdus bovienii
  Promoter sequence Name=Xb4151_4152.C441.promoter2; Position on contig= 5321..5380bp; Strand=+
ctcatcattttattcctcaatgcaaaaagcgctttaacataaccttctatattctaataa

SEQ ID NO: 12317 - DNA, 60 bp, Xenorhabdus bovienii
  Promoter sequence Name=Xb4151_4152.C441.promoter3; Position on contig= 8019..8078bp; Strand=-
aaatttgaaattatttactgttaaacatttataattaactgaaatgtaattattttatat

SEQ ID NO: 12318 - DNA, 60 bp, Xenorhabdus bovienii
  Promoter sequence Name=Xb4151_4152.C441.promoter4; Position on contig= 8792..8851bp; Strand=-
agcgatttgacgttggttttaatttatttccactgatttattatttttataattaattat

SEQ ID NO: 12319 - DNA, 60 bp, Xenorhabdus bovienii
  Promoter sequence Name=Xb4151_4152.C441.promoter5; Position on contig= 8743..8802bp; Strand=+
ataaaatacacacattacaaacactatttcatgttcattaaggtgaattataattaatta

SEQ ID NO: 12320 - DNA, 60 bp, Xenorhabdus bovienii
  Promoter sequence Name=Xb4151_4152.C441.promoter6; Position on contig= 10845..10904bp; Strand=-
aagaattgtaactcaacgataataaggaataacagtagaaaaaataatatatttttattg

SEQ ID NO: 12321 - DNA, 60 bp, Xenorhabdus bovienii
  Promoter sequence Name=Xb4151_4152.C441.promoter7; Position on contig= 10847..10906bp; Strand=+
ataaaaatatattattttttctactgttattccttattatcgttgagttacaattcttta

SEQ ID NO: 12322 - DNA, 60 bp, Xenorhabdus bovienii
  Promoter sequence Name=Xb4151_4152.C441.promoter8; Position on contig= 13558..13617bp; Strand=-
accagtctgataatttaacaaaacttccagtattgctgataatgggttatccttccagaa

SEQ ID NO: 12323 - DNA, 60 bp, Xenorhabdus bovienii
  Promoter sequence Name=Xb4151_4152.C441.promoter9; Position on contig= 14246..14305bp; Strand=-
tttcttattcatgaaaaaatcccctaactgtaggaaaataggctgactataatatcaaat

SEQ ID NO: 12324 - DNA, 60 bp, Xenorhabdus bovienii
  Promoter sequence Name=Xb4151_4152.C441.promoter10; Position on contig=14205..14264bp; Strand=+
cactcatatcatatttatctcgccctgtcccaatagaaggtatttgatattatagtcagc

SEQ ID NO: 12325 - DNA, 60 bp, Xenorhabdus bovienii
  Promoter sequence Name=Xb4151_4152.C441.promoter11; Position on contig=15117..15176bp; Strand=+
catttgctctgcggtagtaatgtgttatttactatctgattgttgcctataatcctaatc

SEQ ID NO: 12326 - DNA, 60 bp, Xenorhabdus bovienii
  Promoter sequence Name=Xb4151_4152.C441.promoter12; Position on contig=17154..17213bp; Strand=+
tgctccagttccccgcgataaaaaatcacggagtcgcgagtatcttttaaacttgttgct

SEQ ID NO: 12327 - DNA, 60 bp, Xenorhabdus bovienii
  Promoter sequence Name=Xb4151_4152.C441.promoter13; Position on contig=18820..18879bp; Strand=-
aaataaaaaaccctatcggatattgatggggttttctataattttgtgacaatgcacgaa

SEQ ID NO: 12328 - DNA, 60 bp, Xenorhabdus bovienii
  Promoter sequence Name=Xb4151_4152.C441.promoter14; Position on contig=18674..18733bp; Strand=+
tgaaactcctttcctgttgctgcttttaactcatattgcaatatttctataattttttta

SEQ ID NO: 12329 - DNA, 60 bp, Xenorhabdus bovienii
  Promoter sequence Name=Xb4151_4152.C441.promoter15; Position on contig=19364..19423bp; Strand=-
tagtagattttatctatcccttatattaataaccaatataaatatattaaaattattgta

SEQ ID NO: 12330 - DNA, 60 bp, Xenorhabdus bovienii
  Promoter sequence Name=Xb4151_4152.C441.promoter16; Position on contig=19479..19538bp; Strand=+
cattaatttatttattgatgtaattaataaataaattaatgaaatgtttttatttattga

SEQ ID NO: 12331 - DNA, 60 bp, Xenorhabdus bovienii
  Promoter sequence Name=Xb4151_4152.C441.promoter17; Position on contig=20458..20517bp; Strand=+
taacgataaaacactttaggtatttcccataaaaacacctaataaattaaaattgtagca

SEQ ID NO: 12332 - DNA, 60 bp, Xenorhabdus bovienii
  Promoter sequence Name=Xb4151_4152.C441.promoter18; Position on contig=21810..21869bp; Strand=-; Gene name=LysR
cgccagaaatacacggatatcatcccaaaccaatgattgcgctgttttatttttcatttt

SEQ ID NO: 12333 - DNA, 60 bp, Xenorhabdus bovienii
  Promoter sequence Name=Xb4151_4152.C441.promoter19; Position on contig=21483..21542bp; Strand=+; Gene name=LysR
tgccagcaggtttttcctcagcactttgccatgaatgccactttttaatgccataaaaat

SEQ ID NO: 12334 - DNA, 60 bp, Xenorhabdus bovienii
  Promoter sequence Name=Xb4151_4152.C441.promoter20; Position on contig=23381..23440bp; Strand=-
atacttttgttattatttaaataaattttaaatatgctatttacatttatttttttatca

SEQ ID NO: 12335 - DNA, 60 bp, Xenorhabdus bovienii
  Promoter sequence Name=Xb4151_4152.C441.promoter21; Position on contig=23397..23456bp; Strand=+
gtaaatagcatatttaaaatttatttaaataataacaaaagtatcgtcaaaattattctt

SEQ ID NO: 12336 - DNA, 60 bp, Xenorhabdus bovienii
  Promoter sequence Name=Xb4151_4152.C441.promoter22; Position on contig=25414..25473bp; Strand=-
tctcttttcaattgaaatccctctgttaattccttggctgtctatgtcacaatgatagct

SEQ ID NO: 12337 - DNA, 60 bp, Xenorhabdus bovienii
  Promoter sequence Name=Xb4151_4152.C441.promoter23; Position on contig=25120..25179bp; Strand=+
agtaatagctcgcccattgcgcgcataacaaaaaacaacataaatccgatgatcatatat

SEQ ID NO: 12338 - DNA, 60 bp, Xenorhabdus bovienii
  Promoter sequence Name=Xb4151_4152.C441.promoter24; Position on contig=27828..27887bp; Strand=+
gagtccgaagatggagctaaacgcataataattcaccaattactcgtgataatacaataa

SEQ ID NO: 12339 - DNA, 60 bp, Xenorhabdus bovienii
  Promoter sequence Name=Xb4151_4152.C441.promoter25; Position on contig=28951..29010bp; Strand=-
ctggagagggcagaaacggtttttccttcatgtaacattaagagtgccatgagtcggcgt

SEQ ID NO: 12340 - DNA, 60 bp, Xenorhabdus bovienii
  Promoter sequence Name=Xb4151_4152.C441.promoter26; Position on contig=28670..28729bp; Strand=+
aattttggtaggctaaaattgattaaataaccgcgcttccatgtagccattattccaccc

SEQ ID NO: 12341 - DNA, 60 bp, Xenorhabdus bovienii
  Promoter sequence Name=Xb4151_4152.C441.promoter27; Position on contig=30919..30978bp; Strand=-
caaatataacagctaacatgattatctccttgaaggacagaaaacgctaagatatcttgc

SEQ ID NO: 12342 - DNA, 60 bp, Xenorhabdus bovienii
  Promoter sequence Name=Xb4151_4152.C441.promoter28; Position on contig=32514..32573bp; Strand=-
aaaagactcagcaaaaagataaatatgctgatgtaaaaatccatatctatgatatttatc

SEQ ID NO: 12343 - DNA, 60 bp, Xenorhabdus bovienii
  Promoter sequence Name=Xb4151_4152.C441.promoter29; Position on contig=32252..32311bp; Strand=+
agcttttccccccggtggttaaattctgtgacatctgtcacccatttcatattaggctgt

SEQ ID NO: 12344 - DNA, 60 bp, Xenorhabdus bovienii; identical to SEQ ID NO: 10750
  Promoter sequence Name=Xb4151_4152.C441.promoter30; Position on contig=33135..33194bp; Strand=+

SEQ ID NO: 12345 - DNA, 60 bp, Xenorhabdus bovienii
  Promoter sequence Name=Xb4151_4152.C441.promoter31; Position on contig=35193..35252bp; Strand=-
agactattttaattttgtaacgtttgtaacgcttttccgaccccccataaattttcaata

SEQ ID NO: 12346 - DNA, 60 bp, Xenorhabdus bovienii
  Promoter sequence Name=Xb4151_4152.C441.promoter32; Position on contig=34808..34867bp; Strand=+
atattgatatctacctaatagttacattttcacaacacatgacatggtaaaatagcacac

SEQ ID NO: 12347 - DNA, 60 bp, Xenorhabdus bovienii
  Promoter sequence Name=Xb4151_4152.C441.promoter33; Position on contig=35396..35455bp; Strand=+
tgttttgtaatgctttgtaacggttaaaacgttacatgagaattgtttatcatcagtagg

SEQ ID NO: 12348 - DNA, 60 bp, Xenorhabdus bovienii
  Promoter sequence Name=Xb4151_4152.C441.promoter34; Position on contig=37189..37248bp; Strand=-
ctctgtgctcctttatcttcaattgcggtaccggcaatttctccggttctactttgctaa

SEQ ID NO: 12349 - DNA, 60 bp, Xenorhabdus bovienii
  Promoter sequence Name=Xb4151_4152.C441.promoter35; Position on contig=37612..37671bp; Strand=-; Gene name=XerC
cagtgatccgtaagtaaacgtggctttttcttcgttcactaactgctcataatggttcca

SEQ ID NO: 12350 - DNA, 60 bp, Xenorhabdus bovienii
  Promoter sequence Name=Xb4151_4152.C441.promoter36; Position on contig=37384..37443bp; Strand=+; Gene name=XerC
ggccataaccaatcgtccacgggatgccacctgttgccgggtcagggtaggctttcagct

SEQ ID NO: 12351 - DNA, 60 bp, Xenorhabdus bovienii
  Promoter sequence Name=Xb4151_4152.C441.promoter37; Position on contig=38613..38672bp; Strand=+
ttttatttggtcaggacgggactggaaaataaaaataacttattgaataaattacattta

SEQ ID NO: 12352 - DNA, 60 bp, Xenorhabdus bovienii
  Promoter sequence Name=Xb4151_4152.C441.promoter38; Position on contig=39465..39524bp; Strand=+
tgatttgtccgaggtggtcactttgaccacccgagacatatcttccgtaaattcgtcttt

SEQ ID NO: 12353 - DNA, 60 bp, Xenorhabdus bovienii; identical to SEQ ID NO: 10819
  Promoter sequence Name=Xb4151_4152.C441.promoter39; Position on contig=40015..40074bp; Strand=-

SEQ ID NO: 12354 - DNA, 60 bp, Xenorhabdus bovienii
  Promoter sequence Name=Xb4151_4152.C441.promoter40; Position on contig=53082..53141bp; Strand=-
agtaaaagtagttagtgatgcgccttgtcgctgcttcatgtggttggtagagtagacgga

SEQ ID NO: 12355 - DNA, 60 bp, Xenorhabdus bovienii
  Promoter sequence Name=Xb4151_4152.C441.promoter41; Position on contig=53597..53656bp; Strand=+; Gene name=Qor
gctcgtccgtttcagcactttcaattttatctatattgtgatgatgtcaaaatggtgatg

SEQ ID NO: 12356 - DNA, 60 bp, Xenorhabdus bovienii
  Promoter sequence Name=Xb4151_4152.C441.promoter42; Position on contig=54733..54792bp; Strand=+; Gene name=AroQ
tacaaataatggtagcagaaaaagatgacaaaccgttgacatcgagttatcttggtcgat

SEQ ID NO: 12357 - DNA, 60 bp, Xenorhabdus bovienii
  Promoter sequence Name=Xb4151_4152.C441.promoter43; Position on contig=63486..63545bp; Strand=+
caataaaatattattttgttgaaaattaaaacattttttttgatttttactctgattttt

SEQ ID NO: 12358 - DNA, 60 bp, Xenorhabdus bovienii
  Promoter sequence Name=Xb4151_4152.C441.promoter44; Position on contig=66436..66495bp; Strand=+
tatcgattcgctcaaagtttggcctttcatatcttgtgaaaaatgcgtaatatacgcgcc

SEQ ID NO: 12359 - DNA, 60 bp, Xenorhabdus bovienii
  Promoter sequence Name=Xb4151_4152.C441.promoter45; Position on contig=69932..69991bp; Strand=-
ctgaatagaaaaaccattgggtattcaaaatcggaagaaatgcacgataaagtgatagga

SEQ ID NO: 12360 - DNA, 60 bp, Xenorhabdus bovienii; identical to SEQ ID NO: 12218
  Promoter sequence Name=Xb4151_4152.C441.promoter46; Position on contig=69969..70028bp; Strand=+

SEQ ID NO: 12361 - DNA, 60 bp, Xenorhabdus bovienii
  Promoter sequence Name=Xb4151_4152.C441.promoter47; Position on contig=71487..71546bp; Strand=-; Gene name=InsB
cgctctatacgttgggtaaaaattttgcctaccagatatttttccggcataacttcccca

SEQ ID NO: 12362 - DNA, 60 bp, Xenorhabdus bovienii
  Promoter sequence Name=Xb4151_4152.C441.promoter48; Position on contig=71314..71373bp; Strand=+; Gene name=InsB
agcagtggtctttgataggcaataaaaaacaacgtcattggctttggtataattttgata

SEQ ID NO: 12363 - DNA, 60 bp, Xenorhabdus bovienii
  Promoter sequence Name=Xb4151_4152.C441.promoter49; Position on contig=71832..71891bp; Strand=+
actgagcagtattgtctacttttttggatgcgccctgaatggtcagccaaactacctttt

SEQ ID NO: 12364 - DNA, 60 bp, Xenorhabdus bovienii
  Promoter sequence Name=Xb4151_4152.C441.promoter50; Position on contig=72265..72324bp; Strand=+; Gene name=AroA
aaatatattttataaattgttcaatgtaggattattcgccatgattgtaaatttatatta

SEQ ID NO: 12365 - DNA, 60 bp, Xenorhabdus bovienii
  Promoter sequence Name=Xb4151_4152.C441.promoter51; Position on contig=86369..86428bp; Strand=-; Gene name=ProP
aatgttgcgacataagttaccgatttatagttataaaatagggattctatgatttccact

SEQ ID NO: 12366 - DNA, 60 bp, Xenorhabdus bovienii
  Promoter sequence Name=Xb4151_4152.C441.promoter52; Position on contig=86268..86327bp; Strand=+; Gene name=ProP
ctgtgttatcagaataaaatcactgacaagttgcagaatagatatcttaaaatatcgaat

SEQ ID NO: 12367 - DNA, 60 bp, Xenorhabdus bovienii
  Promoter sequence Name=Xb4151_4152.C441.promoter53; Position on contig=88356..88415bp; Strand=-; Gene name=DnaK
ccgccctttatggtttattggcgctgtcagaggccataaaacctttttaatattttgttt

SEQ ID NO: 12368 - DNA, 60 bp, Xenorhabdus bovienii
  Promoter sequence Name=Xb4151_4152.C441.promoter54; Position on contig=88424..88483bp; Strand=+; Gene name=DnaK
aatgtgatggcatcaactaaacaatgggctggaaaagaatttttttattaaacttaattt

SEQ ID NO: 12369 - DNA, 60 bp, Xenorhabdus bovienii
  Promoter sequence Name=Xb4151_4152.C441.promoter55; Position on contig=90603..90662bp; Strand=+; Gene name=DnaJ
aagtaacagggcgcctgttacttgttaactaacacgggcgttgaggtaactctacgcccg

SEQ ID NO: 12370 - DNA, 60 bp, Xenorhabdus bovienii
  Promoter sequence Name=Xb4151_4152.C441.promoter56; Position on contig=93390..93449bp; Strand=-; Gene name=ClpP
tctaaacggaaaatatatcttttaatcagtagaatttactaaaatatagaatatttttat

SEQ ID NO: 12371 - DNA, 60 bp, Xenorhabdus bovienii
  Promoter sequence Name=Xb4151_4152.C441.promoter57; Position on contig=93355..93414bp; Strand=+; Gene name=ClpP
ccaagatctatcaataattaattaaaatatatcagataaaaatattctatattttagtaa

SEQ ID NO: 12372 - DNA, 60 bp, Xenorhabdus bovienii
  Promoter sequence Name=Xb4151_4152.C441.promoter58; Position on contig=95581..95640bp; Strand=-
gtaaataatcactgagttaaatgaaagaaatttttattttaattttttaatatattgata

SEQ ID NO: 12373 - DNA, 60 bp, Xenorhabdus bovienii
  Promoter sequence Name=Xb4151_4152.C441.promoter59; Position on contig=95694..95753bp; Strand=+
gtaaatatgatgccaaattatgttttgcgaggattatctcgtaatattaaaatcatttaa

SEQ ID NO: 12374 - DNA, 60 bp, Xenorhabdus bovienii
  Promoter sequence Name=Xb4151_4152.C441.promoter60; Position on contig=101282..101341bp; Strand=+
tatttatgttaaataaaaatcagggcgtgactttttataagcatttctattattaaaaca

SEQ ID NO: 12375 - DNA, 60 bp, Xenorhabdus bovienii
  Promoter sequence Name=Xb4151_4152.C441.promoter61; Position on contig=103171..103230bp; Strand=-
cgattggtaatatcttgtaaagattaatatggaaatcattactccggtaacatattttct

SEQ ID NO: 12376 - DNA, 60 bp, Xenorhabdus bovienii; identical to SEQ ID NO: 12359
  Promoter sequence Name=Xb4151_4152.C441.promoter62; Position on contig=104356..104415bp; Strand=-

SEQ ID NO: 12377 - DNA, 60 bp, Xenorhabdus bovienii
  Promoter sequence Name=Xb4151_4152.C441.promoter63; Position on contig=105295..105354bp; Strand=-; Gene name=InsB
tattattaaattatttttttgtttaattttttattaaatattgacaggataataaataac

SEQ ID NO: 12378 - DNA, 60 bp, Xenorhabdus bovienii
  Promoter sequence Name=Xb4151_4152.C441.promoter64; Position on contig=105044..105103bp; Strand=+; Gene name=InsB
gcatatcacagcaactaaccatttaatacatgacctaggataagacgaaaagtgatcgcc

SEQ ID NO: 12379 - DNA, 60 bp, Xenorhabdus bovienii
  Promoter sequence Name=Xb4151_4152.C441.promoter65; Position on contig=105534..105593bp; Strand=-; Gene name=MarR
gttagtatttttttaatgggtctgtcggatatattgatacacatttttatcattcaaaat

SEQ ID NO: 12380 - DNA, 60 bp, Xenorhabdus bovienii
  Promoter sequence Name=Xb4151_4152.C441.promoter66; Position on contig=106362..106421bp; Strand=-; Gene name=MhpD
taacttatttttaacttttgtttggcagaataattttatttatttgttaatgttgaattc

SEQ ID NO: 12381 - DNA, 60 bp, Xenorhabdus bovienii
  Promoter sequence Name=Xb4151_4152.C441.promoter67; Position on contig=106373..106432bp; Strand=+; Gene name=MhpD
taacaaataaataaaattattctgccaaacaaaagttaaaaataagttaaattcaatgcc

SEQ ID NO: 12382 - DNA, 60 bp, Xenorhabdus bovienii
  Promoter sequence Name=Xb4151_4152.C441.promoter68; Position on contig=114301..114360bp; Strand=-; Gene name=ProP
gaaaggaaaacacaaatagaacaaataaaaacaggatcaagcggcggaacaatttgttga

SEQ ID NO: 12383 - DNA, 60 bp, Xenorhabdus bovienii
  Promoter sequence Name=Xb4151_4152.C441.promoter69; Position on contig=114127..114186bp; Strand=+; Gene name=ProP
aatcgcagcatctgccaatacagtgacagttttcatgccagtttccataaaaacgcgaca

SEQ ID NO: 12384 - DNA, 60 bp, Xenorhabdus bovienii
  Promoter sequence Name=Xb4151_4152.C441.promoter70; Position on contig=117336..117395bp; Strand=-; Gene name=HtpX
tagcggtgtcagtggcaccgcttttaaacaaataaaccgcactattttatgctataaaca

SEQ ID NO: 12385 - DNA, 60 bp, Xenorhabdus bovienii
  Promoter sequence Name=Xb4151_4152.C441.promoter71; Position on contig=118280..118339bp; Strand=-
agtaagcttaaactaaattatttttcttatgattttattattttgtttaaaatgttatca

SEQ ID NO: 12386 - DNA, 60 bp, Xenorhabdus bovienii
  Promoter sequence Name=Xb4151_4152.C441.promoter72; Position on contig=120347..120406bp; Strand=-
agttactattacatgttcaattatgtttataacaataagttaacaattattatgacatac

SEQ ID NO: 12387 - DNA, 60 bp, Xenorhabdus bovienii
  Promoter sequence Name=Xb4151_4152.C441.promoter73; Position on contig=119972..120031bp; Strand=+
tgttttcagctaacagaatcgctaatccaatcacaaagctaaacaataaaaatacaacca

SEQ ID NO: 12388 - DNA, 60 bp, Xenorhabdus bovienii
  Promoter sequence Name=Xb4151_4152.C441.promoter74; Position on contig=120789..120848bp; Strand=-
agtgcataaatatggaaaaataattaaaacggataaaaattatccgctaaaatgtaaaat

SEQ ID NO: 12389 - DNA, 60 bp, Xenorhabdus bovienii
  Promoter sequence Name=Xb4151_4152.C441.promoter75; Position on contig=121855..121914bp; Strand=-
acagggacagcctcccaatcgctcatacattttcccttttctttatatataatttttaaa

SEQ ID NO: 12390 - DNA, 60 bp, Xenorhabdus bovienii
  Promoter sequence Name=Xb4151_4152.C441.promoter76; Position on contig=123996..124055bp; Strand=-
gtgtcggcttggtcagtccgagctgatttcaccacttttttctcaataacaattttttca

SEQ ID NO: 12391 - DNA, 60 bp, Xenorhabdus bovienii
  Promoter sequence Name=Xb4151_4152.C441.promoter77; Position on contig=129534..129593bp; Strand=-; Gene name=Lrp
cttttgtctaaaatgtacaggtgcaaaataggaaaaacttaggtacactcctgtttatgc

SEQ ID NO: 12392 - DNA, 60 bp, Xenorhabdus bovienii
  Promoter sequence Name=Xb4151_4152.C441.promoter78; Position on contig=129763..129822bp; Strand=+
aactaagtgacattcttggatttcttcaagtttctgtacagcagtattaaactgctcaaa

SEQ ID NO: 12393 - DNA, 60 bp, Xenorhabdus bovienii
  Promoter sequence Name=Xb4151_4152.C441.promoter79; Position on contig=130956..131015bp; Strand=-; Gene name=TrxB
agacggaatggttttttttcgaaatcgactttctgaatatggtcagaaataatttctgtt

SEQ ID NO: 12394 - DNA, 60 bp, Xenorhabdus bovienii
  Promoter sequence Name=Xb4151_4152.C441.promoter80; Position on contig=130570..130629bp; Strand=+; Gene name=TrxB
gtaacctctccttacattcccattacatcatagttactatctatcggtaaaatcgttaat

SEQ ID NO: 12395 - DNA, 60 bp, Xenorhabdus bovienii
  Promoter sequence Name=Xb4151_4152.C441.promoter81; Position on contig=131972..132031bp; Strand=-; Gene name=MdlB
ggcggcgatcagcatcagaaactgaacgatgagattttcgcgggggatattatccatgat

SEQ ID NO: 12396 - DNA, 60 bp, Xenorhabdus bovienii
  Promoter sequence Name=Xb4151_4152.C441.promoter82; Position on contig=131737..131796bp; Strand=+; Gene name=MdlB
aaggtttggccgctggcaaacagtatcaccagcctttttgatacattgtatcatcacctg

SEQ ID NO: 12397 - DNA, 60 bp, Xenorhabdus bovienii
  Promoter sequence Name=Xb4151_4152.C441.promoter83; Position on contig=136303..136362bp; Strand=-; Gene name=InfA
tatggggttagctcaactgtaaccttgtctccagtcaggatgcgaatatagtttttacgc

SEQ ID NO: 12398 - DNA, 60 bp, Xenorhabdus bovienii
  Promoter sequence Name=Xb4151_4152.C441.promoter84; Position on contig=136070..136129bp; Strand=+; Gene name=InfA
atatccattatgaggaaaatgatggtttaaaatacgacattcctttacataatgagggtt

SEQ ID NO: 12399 - DNA, 60 bp, Xenorhabdus bovienii
  Promoter sequence Name=Xb4151_4152.C441.promoter85; Position on contig=139177..139236bp; Strand=-
ttcatgaagtgataaaatatatagcagtagaatgaattagttcatactaaaatttagcag

SEQ ID NO: 12400 - DNA, 60 bp, Xenorhabdus bovienii
  Promoter sequence Name=Xb4151_4152.C441.promoter86; Position on contig=139134..139193bp; Strand=+
gttataaaactcactcattgttcttccgctgggtattaactttctgctaaattttagtat

SEQ ID NO: 12401 - DNA, 60 bp, Xenorhabdus bovienii
  Promoter sequence Name=Xb4151_4152.C441.promoter87; Position on contig=140053..140112bp; Strand=+
caggaacatatactcccctttttcgtatcagatttaattaatttctttatgatacctaat

SEQ ID NO: 12402 - DNA, 60 bp, Xenorhabdus bovienii
  Promoter sequence Name=Xb4151_4152.C441.promoter88; Position on contig=141186..141245bp; Strand=+
cgttacctgatgcatgaaaaggttaaaaagaaaacttatttggcatcaaaatcaatctat

SEQ ID NO: 12403 - DNA, 60 bp, Xenorhabdus bovienii
  Promoter sequence Name=Xb4151_4152.C441.promoter89; Position on contig=142137..142196bp; Strand=+; Gene name=ArtI
ctgtcattacaaatagtcagttagaacataaaacaagcatcagtaacatttatcaaccat

SEQ ID NO: 12404 - DNA, 60 bp, Xenorhabdus bovienii
  Promoter sequence Name=Xb4151_4152.C441.promoter90; Position on contig=146683..146742bp; Strand=-; Gene name=GrxC
acttgggcgaccaaaaatgacagtatacatacaaactccttagtggtaataatcgtgaac

SEQ ID NO: 12405 - DNA, 60 bp, Xenorhabdus bovienii
  Promoter sequence Name=Xb4151_4152.C441.promoter91; Position on contig=146494..146553bp; Strand=+; Gene name=GrxC
ctcttttgttgagattttcttcatgactttctaccttctgagcctgataaaatagactct

SEQ ID NO: 12406 - DNA, 60 bp, Xenorhabdus bovienii
  Promoter sequence Name=Xb4151_4152.C441.promoter92; Position on contig=146989..147048bp; Strand=+; Gene name=PgpB
ctatccagccagaaatatcgatgctttcttctggatagtggcaggctcataatattgact

SEQ ID NO: 12407 - DNA, 60 bp, Xenorhabdus bovienii
  Promoter sequence Name=Xb4151_4152.C441.promoter93; Position on contig=148737..148796bp; Strand=+; Gene name=SdaC
catttcactgaaaataactatattttccctaccaaaagactagggtttatttttttgatt

SEQ ID NO: 12408 - DNA, 60 bp, Xenorhabdus bovienii
  Promoter sequence Name=Xb4151_4152.C441.promoter94; Position on contig=151703..151762bp; Strand=-; Gene name=Gst
agaaaatctttacgcttattgggttggagtcttatctcataacatcctatattaatagag

SEQ ID NO: 12409 - DNA, 60 bp, Xenorhabdus bovienii
  Promoter sequence Name=Xb4151_4152.C441.promoter95; Position on contig=151733..151792bp; Strand=+; Gene name=Gst
actccaacccaataagcgtaaagattttcttgttacccgaatgaatttattatcatatta

SEQ ID NO: 12410 - DNA, 60 bp, Xenorhabdus bovienii
  Promoter sequence Name=Xb4151_4152.C441.promoter96; Position on contig=153366..153425bp; Strand=-
ttgtgtatgaaaagcaacttttttttcaaagaagctgtttgtgtttttctaattgtttgt

SEQ ID NO: 12411 - DNA, 60 bp, Xenorhabdus bovienii
  Promoter sequence Name=Xb4151_4152.C441.promoter97; Position on contig=153625..153684bp; Strand=+; Gene name=HisG
cggaagattttccgagggttttttttattgccaatttatacgatttatatattgaatatt

SEQ ID NO: 12412 - DNA, 60 bp, Xenorhabdus bovienii
  Promoter sequence Name=Xb4151_4152.C441.promoter98; Position on contig=162640..162699bp; Strand=-
ttaaattttgatgaatgttgctagttcaggcatcgctatacctattttaaaattttacaa

SEQ ID NO: 12413 - DNA, 60 bp, Xenorhabdus bovienii
  Promoter sequence Name=Xb4151_4152.C441.promoter99; Position on contig=162394..162453bp; Strand=+
aatctcgtttaacactcggtcagtgacaatcaaagcctgtctgtagccataatttttcat

SEQ ID NO: 12414 - DNA, 60 bp, Xenorhabdus bovienii
  Promoter sequence Name=Xb4151_4152.C441.promoter100; Position on contig=162597..162656bp; Strand=+
acttatctacctcagcaattttgatcgatatcaataatcgcctttgtaaaattttaaaat

SEQ ID NO: 12415 - DNA, 60 bp, Xenorhabdus bovienii
  Promoter sequence Name=Xb4151_4152.C441.promoter101; Position on contig=164459..164518bp; Strand=-
attttgttgtatatgacattatttgattgacatagtgttgagttaggcatcttggtgggc

SEQ ID NO: 12416 - DNA, 60 bp, Xenorhabdus bovienii
  Promoter sequence Name=Xb4151_4152.C441.promoter102; Position on contig=164317..164376bp; Strand=+
tttatcgctggagcggttgaaaatggatacagagtaaccacggctttctatattcaacgc

SEQ ID NO: 12417 - DNA, 60 bp, Xenorhabdus bovienii
  Promoter sequence Name=Xb4151_4152.C441.promoter103; Position on contig=164625..164684bp; Strand=+
tttccaactggaataaatcacctattgatatttctgataccaatccgcattattcaagta

SEQ ID NO: 12418 - DNA, 60 bp, Xenorhabdus bovienii
  Promoter sequence Name=Xb4151_4152.C441.promoter104; Position on contig=166890..166949bp; Strand=-
cgatgcttttcattaatcagtttggattgggtgacgtttgggatgggtaagctgccaccg

SEQ ID NO: 12419 - DNA, 60 bp, Xenorhabdus bovienii
  Promoter sequence Name=Xb4151_4152.C441.promoter105; Position on contig=166670..166729bp; Strand=+
gggcggagaagtcaccaccgccttcatattgcccgggaactttttaacaaaatttcctgt

SEQ ID NO: 12420 - DNA, 60 bp, Xenorhabdus bovienii
  Promoter sequence Name=Xb4151_4152.C441.promoter106; Position on contig=173410..173469bp; Strand=-
cctataatccgccaaacatagcattactgaatgctacgtccccactttattttttctttt

SEQ ID NO: 12421 - DNA, 60 bp, Xenorhabdus bovienii
  Promoter sequence Name=Xb4151_4152.C441.promoter107; Position on contig=174873..174932bp; Strand=-
cggcgtcgatttcaattttggtcttatcccaagccgccggcttctgctatgatggacgaa

SEQ ID NO: 12422 - DNA, 60 bp, Xenorhabdus bovienii
  Promoter sequence Name=Xb4151_4152.C441.promoter108; Position on contig=177129..177188bp; Strand=+
aagtccgctttttaatgtgatgtatggcacatttacagagttagtcgtatgataaaaccc

SEQ ID NO: 12423 - DNA, 60 bp, Xenorhabdus bovienii
  Promoter sequence Name=Xb4151_4152.C441.promoter109; Position on contig=178383..178442bp; Strand=+; Gene name=Cdd
aacggtgaaaaaattcataaaaatagtaaaaatttgatataagtcactaaaataacgtat

SEQ ID NO: 12424 - DNA, 60 bp, Xenorhabdus bovienii
  Promoter sequence Name=Xb4151_4152.C441.promoter110; Position on contig=179604..179663bp; Strand=+; Gene name=SfcA
aattaaataatatttactgtacttattttttttatcttcttaggatctataattttgtta

SEQ ID NO: 12425 - DNA, 60 bp, Xenorhabdus bovienii
  Promoter sequence Name=Xb4151_4152.C441.promoter111; Position on contig=181432..181491bp; Strand=+; Gene name=SanA
caggcttttattaccgcacgaaagcttgcttcaatatttcaagtaaagtagcctttaaga

SEQ ID NO: 12426 - DNA, 60 bp, Xenorhabdus bovienii
  Promoter sequence Name=Xb4151_4152.C441.promoter112; Position on contig=184279..184338bp; Strand=-
atttggcgcattgatattgataacgtgcagatagagttgtacacagatacaatgtaaaca

SEQ ID NO: 12427 - DNA, 60 bp, Xenorhabdus bovienii
  Promoter sequence Name=Xb4151_4152.C441.promoter113; Position on contig=185581..185640bp; Strand=-; Gene name=MoeA
aattgttgccacatcagagaaagaacgaaatgttacgaaaaaaggtgtattatatttatg

SEQ ID NO: 12428 - DNA, 60 bp, Xenorhabdus bovienii
  Promoter sequence Name=Xb4151_4152.C441.promoter114; Position on contig=185504..185563bp; Strand=+; Gene name=MoeA
tgataatttgatttctcatagtgattaaaaataatgggattaattgttttaattgacatt

SEQ ID NO: 12429 - DNA, 60 bp, Xenorhabdus bovienii
  Promoter sequence Name=Xb4151_4152.C441.promoter115; Position on contig=187824..187883bp; Strand=+
taacgttgtctgatgaaaatcaaattttcttacccgtctactcatgttataatcacataa

SEQ ID NO: 12430 - DNA, 60 bp, Xenorhabdus bovienii
  Promoter sequence Name=Xb4151_4152.C441.promoter116; Position on contig=188702..188761bp; Strand=+
ttgtggttaagataataagttttctcaaaaaaatattcgaaactcgttatatatacagtt

SEQ ID NO: 12431 - DNA, 60 bp, Xenorhabdus bovienii
  Promoter sequence Name=Xb4151_4152.C441.promoter117; Position on contig=192534..192593bp; Strand=-; Gene name=MviM
tgttttcttagcgggcaattcaggttgtttcataagaaaattttatttatttttttatgt

SEQ ID NO: 12432 - DNA, 60 bp, Xenorhabdus bovienii
  Promoter sequence Name=Xb4151_4152.C441.promoter118; Position on contig=192536..192595bp; Strand=+; Gene name=MviM
ataaaaaaataaataaaattttcttatgaaacaacctgaattgcccgctaagaaaacata

SEQ ID NO: 12433 - DNA, 60 bp, Xenorhabdus bovienii
  Promoter sequence Name=Xb4151_4152.C441.promoter119; Position on contig=194434..194493bp; Strand=+; Gene name=RhaT
tttaattataagttacacaactgataatacagttgagttgcgcctgtttcgctgcgaaga

SEQ ID NO: 12434 - DNA, 60 bp, Xenorhabdus bovienii
  Promoter sequence Name=Xb4151_4152.C441.promoter120; Position on contig=196156..196215bp; Strand=+; Gene name=PhnA
acaatgtcaaagattagactaacctttaaaaaaatcatttttctctctataatctctttt

SEQ ID NO: 12435 - DNA, 60 bp, Xenorhabdus bovienii
  Promoter sequence Name=Xb4151_4152.C441.promoter121; Position on contig=196536..196595bp; Strand=+
tttcatgaagaaacataataatattcaaacaataacattagaaaatttataattaagact

SEQ ID NO: 12436 - DNA, 60 bp, Xenorhabdus bovienii
  Promoter sequence Name=Xb4151_4152.C441.promoter122; Position on contig=199548..199607bp; Strand=-
ttcatctttagttctcaataagatttttaatcagaatttttagccgctatatttttaaaa

SEQ ID NO: 12437 - DNA, 60 bp, Xenorhabdus bovienii
  Promoter sequence Name=Xb4151_4152.C441.promoter123; Position on contig=199302..199361bp; Strand=+
ttgcgctggaaagtgccatgagttttgctacataaaaattggagggctattctcccatag

SEQ ID NO: 12438 - DNA, 60 bp, Xenorhabdus bovienii
  Promoter sequence Name=Xb4151_4152.C441.promoter124; Position on contig=201100..201159bp; Strand=-
taatttttatataaatatggctaatgacttataaatatcttttcttttactatttgcaat

SEQ ID NO: 12439 - DNA, 60 bp, Xenorhabdus bovienii
  Promoter sequence Name=Xb4151_4152.C441.promoter125; Position on contig=203803..203862bp; Strand=-
aagtcaattattcttttcttctatgctgcttagaaaaacatatctgttataatgccgcct

SEQ ID NO: 12440 - DNA, 60 bp, Xenorhabdus bovienii
  Promoter sequence Name=Xb4151_4152.C441.promoter126; Position on contig=203602..203661bp; Strand=+
tgctgaataggggtgggttccacgtaaccttgttcttcaacggcacgtaaaatatcagcc

SEQ ID NO: 12441 - DNA, 60 bp, Xenorhabdus bovienii
  Promoter sequence Name=Xb4151_4152.C441.promoter127; Position on contig=203879..203938bp; Strand=+; Gene name=AcrR
gtgtctattggcagaaaaggtttgcaggaaatgacaaaaaataggcatattatttttttt

SEQ ID NO: 12442 - DNA, 60 bp, Xenorhabdus bovienii
  unsure (1)..(60): unsure at all n locations
  Promoter sequence Name=Xb4151_4152.C441.promoter128; Position on contig=210863..210922bp; Strand=-; Gene name=MoaE
tgccattaatcggcggggtggttntgttaatgttctatgctaatgtataacatttgaata

SEQ ID NO: 12443 - DNA, 60 bp, Xenorhabdus bovienii
  Promoter sequence Name=Xb4151_4152.C441.promoter129; Position on contig=213395..213454bp; Strand=-
aactcgttgtataataaaatatatattgaaggttggtgttagctttttattatcttaaac

SEQ ID NO: 12444 - DNA, 60 bp, Xenorhabdus bovienii
  Promoter sequence Name=Xb4151_4152.C441.promoter130; Position on contig=213392..213451bp; Strand=+
aacgtttaagataataaaaagctaacaccaaccttcaatatatattttattatacaacga

SEQ ID NO: 12445 - DNA, 60 bp, Xenorhabdus bovienii
  Promoter sequence Name=Xb4151_4152.C441.promoter131; Position on contig=218628..218687bp; Strand=-
gaaaattataattacaacaataaaagttattttacttactttcttgatattattttttat

SEQ ID NO: 12446 - DNA, 60 bp, Xenorhabdus bovienii
  Promoter sequence Name=Xb4151_4152.C441.promoter132; Position on contig=219415..219474bp; Strand=-
ggagatagggttcagtgacattgattgaaatgatgggacgcataaggcaaaatctcctgt

SEQ ID NO: 12447 - DNA, 60 bp, Xenorhabdus bovienii
  Promoter sequence Name=Xb4151_4152.C441.promoter133; Position on contig=219305..219364bp; Strand=+
gacaaaaaaatatagaaattccgttgacacttcgcctaagacgaattatctttcgtatca

SEQ ID NO: 12448 - DNA, 60 bp, Xenorhabdus bovienii
  Promoter sequence Name=Xb4151_4152.C441.promoter134; Position on contig=223987..224046bp; Strand=+
taaactatttctaaactaaattactttctttattaattgtattattttatgctgtttatg

SEQ ID NO: 12449 - DNA, 60 bp, Xenorhabdus bovienii
  Promoter sequence Name=Xb4151_4152.C441.promoter135; Position on contig=227383..227442bp; Strand=+
catatccttaagcatccttgtcctttcatgccctcattatgcagggctaattttctcctt

SEQ ID NO: 12450 - DNA, 60 bp, Xenorhabdus bovienii
  Promoter sequence Name=Xb4151_4152.C441.promoter136; Position on contig=234533..234592bp; Strand=+
atgtattaattgattattctgccttatatggacattgtgccgcccggcataatcaattgg

SEQ ID NO: 12451 - DNA, 60 bp, Xenorhabdus bovienii
  Promoter sequence Name=Xb4151_4152.C441.promoter137; Position on contig=234908..234967bp; Strand=+
aggcgattgagaatagtctgtttgaacacgccttaatattacgccgtcattatttaccga

SEQ ID NO: 12452 - DNA, 60 bp, Xenorhabdus bovienii
  Promoter sequence Name=Xb4151_4152.C441.promoter138; Position on contig=244899..244958bp; Strand=-
ttctatatatactgcgcgcggccagttcgcttgtctaaccaacagagtagattataagtt

SEQ ID NO: 12453 - DNA, 60 bp, Xenorhabdus bovienii
  Promoter sequence Name=Xb4151_4152.C441.promoter139; Position on contig=245199..245258bp; Strand=-
ctcagctacgtttccgttatctattacaaaaatgcacggatcaattctaaaagcgcaact

SEQ ID NO: 12454 - DNA, 60 bp, Xenorhabdus bovienii
  Promoter sequence Name=Xb4151_4152.C441.promoter140; Position on contig=244856..244915bp; Strand=+
tcttcctatctatcacgttaattgattgaatgattttaaaatcaacttataatctactct

SEQ ID NO: 12455 - DNA, 60 bp, Xenorhabdus bovienii
  Promoter sequence Name=Xb4151_4152.C442.promoter1; Position on contig= 811..870bp; Strand=-
attttgtgatggaatgtatctaatgccttcatttttcactaccttgtttataatatcaaa

SEQ ID NO: 12456 - DNA, 60 bp, Xenorhabdus bovienii; identical to SEQ ID NO: 12208
  Promoter sequence Name=Xb4151_4152.C442.promoter2; Position on contig= 8771..8830bp; Strand=-

SEQ ID NO: 12457 - DNA, 60 bp, Xenorhabdus bovienii
  Promoter sequence Name=Xb4151_4152.C442.promoter3; Position on contig= 8687..8746bp; Strand=+
gatttcaggatgccgaggatgcggggttttttagggcagatcagcaataaactctttatg

SEQ ID NO: 12458 - DNA, 60 bp, Xenorhabdus bovienii
  Promoter sequence Name=Xb4151_4152.C442.promoter4; Position on contig= 10380..10439bp; Strand=-
caaatgtcgctgtggattttattgaattaatttgattaaagaatttttgtcatcttgcct

SEQ ID NO: 12459 - DNA, 60 bp, Xenorhabdus bovienii
  Promoter sequence Name=Xb4151_4152.C442.promoter5; Position on contig= 15135..15194bp; Strand=-
gcgtaaaacggtttcagcagaatcttcagagcaataagcgataacgtttttatttcctaa

SEQ ID NO: 12460 - DNA, 60 bp, Xenorhabdus bovienii
  Promoter sequence Name=Xb4151_4152.C442.promoter6; Position on contig= 15720..15779bp; Strand=-
atgcgcaaataggcgggtttttttatgtgttaaattgatgcagaaggcataatccaacaa

SEQ ID NO: 12461 - DNA, 60 bp, Xenorhabdus bovienii
  Promoter sequence Name=Xb4151_4152.C442.promoter7; Position on contig= 15607..15666bp; Strand=+
tttatgaggcctgagattcctcactatcggattttgccgatagcttttttactttaacga

SEQ ID NO: 12462 - DNA, 60 bp, Xenorhabdus bovienii
  Promoter sequence Name=Xb4151_4152.C442.promoter8; Position on contig= 19095..19154bp; Strand=-
ctgcccacctttgaaagcagatattgtcagtccagtggcagtgaaggtttttttattctt

SEQ ID NO: 12463 - DNA, 60 bp, Xenorhabdus bovienii; identical to SEQ ID NO: 11084
  Promoter sequence Name=Xb4151_4152.C442.promoter9; Position on contig= 22062..22121bp; Strand=-

SEQ ID NO: 12464 - DNA, 60 bp, Xenorhabdus bovienii
  Promoter sequence Name=Xb4151_4152.C442.promoter10; Position on contig=28918..28977bp; Strand=-
cccatcgtaagttaataaaatgtaaaactagctaatttgacaatttgtacacttaactaa

SEQ ID NO: 12465 - DNA, 60 bp, Xenorhabdus bovienii
  Promoter sequence Name=Xb4151_4152.C442.promoter11; Position on contig=30435..30494bp; Strand=-
tgacgcttacaaataaaataatttaacgtgttaattaatttgcagtttattaatgggacg

SEQ ID NO: 12466 - DNA, 60 bp, Xenorhabdus bovienii
  Promoter sequence Name=Xb4151_4152.C442.promoter12; Position on contig=32858..32917bp; Strand=-
tatccaaatgcaccgcatcagtgccggaatgccttgtttccgcaatgtataaaaggtcac

SEQ ID NO: 12467 - DNA, 60 bp, Xenorhabdus bovienii
  Promoter sequence Name=Xb4151_4152.C442.promoter13; Position on contig=33988..34047bp; Strand=-
ttcggggcgctttttttttgtttttaaatggcgttaatacaaggggttatggtgaaaatt

SEQ ID NO: 12468 - DNA, 60 bp, Xenorhabdus bovienii
  Promoter sequence Name=Xb4151_4152.C442.promoter14; Position on contig=37747..37806bp; Strand=+
gggcacaatggccggcggtgtattttgttgcatggtattcctcctgataaaacaacgggg

SEQ ID NO: 12469 - DNA, 60 bp, Xenorhabdus bovienii
  Promoter sequence Name=Xb4151_4152.C442.promoter15; Position on contig=39644..39703bp; Strand=-
tcattcactccttttaaataaaatcattgacgggcaaatggaaaatctataaatctattt

SEQ ID NO: 12470 - DNA, 60 bp, Xenorhabdus bovienii
  Promoter sequence Name=Xb4151_4152.C442.promoter16; Position on contig=40107..40166bp; Strand=-
gatataatgagaacattatatgtttctcgcatcctctacacgatatatatagtacataaa

SEQ ID NO: 12471 - DNA, 60 bp, Xenorhabdus bovienii
  Promoter sequence Name=Xb4151_4152.C442.promoter17; Position on contig=40576..40635bp; Strand=-
ttattatataaaagatgtctcagaaagttgggtagacaatattttgtaaactactttcct

SEQ ID NO: 12472 - DNA, 60 bp, Xenorhabdus bovienii
  Promoter sequence Name=Xb4151_4152.C442.promoter18; Position on contig=40494..40553bp; Strand=+
cttatccatctgttttaacagaaacttataattttcatactgaagggcataataagtgcc

SEQ ID NO: 12473 - DNA, 60 bp, Xenorhabdus bovienii
  Promoter sequence Name=Xb4151_4152.C442.promoter19; Position on contig=55797..55856bp; Strand=+; Gene name=PinR
ttctcaatccggagttggctggcataactcatccaggccagtcatgacataatcgaaggg

SEQ ID NO: 12474 - DNA, 60 bp, Xenorhabdus bovienii
  Promoter sequence Name=Xb4151_4152.C442.promoter20; Position on contig=57098..57157bp; Strand=-
tcctcattctgttgggagccttatttaaagcaaaaagtgtgactttgtgagataaagtta

SEQ ID NO: 12475 - DNA, 60 bp, Xenorhabdus bovienii
  Promoter sequence Name=Xb4151_4152.C442.promoter21; Position on contig=57532..57591bp; Strand=-
gagattgaggatcagcgcgagggtgttggagcgttttttttcggggtgatattcagccgt

SEQ ID NO: 12476 - DNA, 60 bp, Xenorhabdus bovienii
  Promoter sequence Name=Xb4151_4152.C442.promoter22; Position on contig=57163..57222bp; Strand=+
tagtacactaaacattggtgtcagtttgaactatagctaaatcatattaatatgacataa

SEQ ID NO: 12477 - DNA, 60 bp, Xenorhabdus bovienii
  Promoter sequence Name=Xb4151_4152.C442.promoter23; Position on contig=59721..59780bp; Strand=-
tttttattcccttgaatatatattgaatatataactataatcccttgttgtagtattagg

SEQ ID NO: 12478 - DNA, 60 bp, Xenorhabdus bovienii
  Promoter sequence Name=Xb4151_4152.C442.promoter24; Position on contig=59526..59585bp; Strand=+
tatcctaataaaagcgtatttatacctttacagattaatgttcatcttaaaatcgatgaa

SEQ ID NO: 12479 - DNA, 60 bp, Xenorhabdus bovienii
  Promoter sequence Name=Xb4151_4152.C442.promoter25; Position on contig=60997..61056bp; Strand=-
agatttctcgttgcagccgacaaagctgcaatcggacagataaagggtatatataaccca

SEQ ID NO: 12480 - DNA, 60 bp, Xenorhabdus bovienii
  Promoter sequence Name=Xb4151_4152.C442.promoter26; Position on contig=63747..63806bp; Strand=-
atataaataagtaaggaaaattcagttaagaaataaaatttatttatttaatatcaagtg

SEQ ID NO: 12481 - DNA, 60 bp, Xenorhabdus bovienii
  Promoter sequence Name=Xb4151_4152.C442.promoter27; Position on contig=64544..64603bp; Strand=-
cgtcctcatgtttccgcaagtttagacctcctatgctgaggtctttttattatatttttc

SEQ ID NO: 12482 - DNA, 60 bp, Xenorhabdus bovienii
  Promoter sequence Name=Xb4151_4152.C442.promoter28; Position on contig=66154..66213bp; Strand=-
acacctccaagtagtgcataatttttttattatggtgtgactgaaattaaaattaagtaa

SEQ ID NO: 12483 - DNA, 60 bp, Xenorhabdus bovienii
  Promoter sequence Name=Xb4151_4152.C442.promoter29; Position on contig=65986..66045bp; Strand=+
attctccatagcactcaatatcaaattaataattgattgacttgtgtcaagattcccgat

SEQ ID NO: 12484 - DNA, 60 bp, Xenorhabdus bovienii; identical to SEQ ID NO: 11334
  Promoter sequence Name=Xb4151_4152.C442.promoter30; Position on contig=67574..67633bp; Strand=-; Gene name=MarC

SEQ ID NO: 12485 - DNA, 60 bp, Xenorhabdus bovienii
  Promoter sequence Name=Xb4151_4152.C442.promoter31; Position on contig=67622..67681bp; Strand=+; Gene name=MarC
atgcgaatccaagtatctatttaactttaatggcacaattgattaactaaatttttatag

SEQ ID NO: 12486 - DNA, 60 bp, Xenorhabdus bovienii
  Promoter sequence Name=Xb4151_4152.C442.promoter32; Position on contig=68698..68757bp; Strand=+; Gene name=OppA
ttcttttttggtagaattgtgtggatccaagacgataaaaataaaaataaaatcaatgat

SEQ ID NO: 12487 - DNA, 60 bp, Xenorhabdus bovienii
  Promoter sequence Name=Xb4151_4152.C442.promoter33; Position on contig=70659..70718bp; Strand=+; Gene name=OppA
tcttttggatacggaaaacaaccattccaaaaaatgaatatggcttttaaaagtcggatg

SEQ ID NO: 12488 - DNA, 60 bp, Xenorhabdus bovienii
  Promoter sequence Name=Xb4151_4152.C442.promoter34; Position on contig=76796..76855bp; Strand=-; Gene name=Cls
tggggctgtgattagcagtaagggtattcaatcactacagatcatgttttaatttctctc

SEQ ID NO: 12489 - DNA, 60 bp, Xenorhabdus bovienii
  Promoter sequence Name=Xb4151_4152.C442.promoter35; Position on contig=78561..78620bp; Strand=-
ggtttaacacaatgcggtattgaatctaagtcattagttaatagatatataattgattca

SEQ ID NO: 12490 - DNA, 60 bp, Xenorhabdus bovienii
  Promoter sequence Name=Xb4151_4152.C442.promoter36; Position on contig=78151..78210bp; Strand=+
cagatgaacgcatttgtttggcttgttcgactctgcgtttgcctagatacaattcgccaa

SEQ ID NO: 12491 - DNA, 60 bp, Xenorhabdus bovienii
  Promoter sequence Name=Xb4151_4152.C442.promoter37; Position on contig=78920..78979bp; Strand=-; Gene name=TonB
agcatgatagtcagttttcggatagtactagtttaaatgcaaatgactatcatattcaat

SEQ ID NO: 12492 - DNA, 60 bp, Xenorhabdus bovienii
  Promoter sequence Name=Xb4151_4152.C442.promoter38; Position on contig=78895..78954bp; Strand=+; Gene name=TonB
atgatacagatgtttttgaatcatgattgaatatgatagtcatttgcatttaaactagta

SEQ ID NO: 12493 - DNA, 60 bp, Xenorhabdus bovienii
  Promoter sequence Name=Xb4151_4152.C442.promoter39; Position on contig=81184..81243bp; Strand=-; Gene name=SUL1
actctttacggtaataacaaaaattctccaaccccggcatccagcgatataatcttttcc

SEQ ID NO: 12494 - DNA, 60 bp, Xenorhabdus bovienii
  Promoter sequence Name=Xb4151_4152.C442.promoter40; Position on contig=81095..81154bp; Strand=+; Gene name=SUL1
gctgagaggtcacggataggattgtgagtttttattgaacatcgcattataatgcgctcc

SEQ ID NO: 12495 - DNA, 60 bp, Xenorhabdus bovienii
  Promoter sequence Name=Xb4151_4152.C442.promoter41; Position on contig=83763..83822bp; Strand=+
ttgatttatagctgtaattatttgcttaaatcgcaattgatattggttatcattttgata

SEQ ID NO: 12496 - DNA, 60 bp, Xenorhabdus bovienii
  Promoter sequence Name=Xb4151_4152.C442.promoter42; Position on contig=92662..92721bp; Strand=-
taaacgaagctgaagttaacacagaattaatagaaccatcatttggttaaaaataatcca

SEQ ID NO: 12497 - DNA, 60 bp, Xenorhabdus bovienii
  Promoter sequence Name=Xb4151_4152.C442.promoter43; Position on contig=94003..94062bp; Strand=-; Gene name=ZnuB
gctatttaaatcactttttaacttgttcaattgttacatctgtctgtaatatgagcatgg

SEQ ID NO: 12498 - DNA, 60 bp, Xenorhabdus bovienii
  Promoter sequence Name=Xb4151_4152.C442.promoter44; Position on contig=97733..97792bp; Strand=-; Gene name=MltE
atcattaattttgtgcaatatagccttgactttgaataagtgatattgataatcattatc

SEQ ID NO: 12499 - DNA, 60 bp, Xenorhabdus bovienii
  Promoter sequence Name=Xb4151_4152.C442.promoter45; Position on contig=99260..99319bp; Strand=-; Gene name=Rnd
aatattatttaaatacattacgttacgcagccattaaagctagaaaatataataatgtac

SEQ ID NO: 12500 - DNA, 60 bp, Xenorhabdus bovienii
  Promoter sequence Name=Xb4151_4152.C442.promoter46; Position on contig=99219..99278bp; Strand=+; Gene name=Rnd
taaaggatgtttagagatttttattgtttgtacataattgtgtacattattatattttct

SEQ ID NO: 12501 - DNA, 60 bp, Xenorhabdus bovienii
  Promoter sequence Name=Xb4151_4152.C442.promoter47; Position on contig=100502..100561bp; Strand=+
gggcagggaagattgaagttaactttgtgtcatcacttcagcagcggtatcatttttatc

SEQ ID NO: 12502 - DNA, 60 bp, Xenorhabdus bovienii
  Promoter sequence Name=Xb4151_4152.C442.promoter48; Position on contig=101536..101595bp; Strand=+; Gene name=AcrR
aattcgacagaatccttatttgcaacagtgccctatttttaagtgtgtaacataaatgtt

SEQ ID NO: 12503 - DNA, 60 bp, Xenorhabdus bovienii
  Promoter sequence Name=Xb4151_4152.C442.promoter49; Position on contig=102241..102300bp; Strand=+; Gene name=MmsB
agcctaccgtagtatgtaggctccggtttttatttactccattttggaacgatcattcca

SEQ ID NO: 12504 - DNA, 60 bp, Xenorhabdus bovienii; identical to SEQ ID NO: 11022
  Promoter sequence Name=Xb4151_4152.C442.promoter50; Position on contig=104137..104196bp; Strand=+

SEQ ID NO: 12505 - DNA, 60 bp, Xenorhabdus bovienii
  Promoter sequence Name=Xb4151_4152.C442.promoter51; Position on contig=105870..105929bp; Strand=-
aactattaatgattaaccttatatcttgatcatcgctctgtaaaagtgataattaatata

SEQ ID NO: 12506 - DNA, 60 bp, Xenorhabdus bovienii
  Promoter sequence Name=Xb4151_4152.C442.promoter52; Position on contig=105860..105919bp; Strand=+
attaaccttatatattaattatcacttttacagagcgatgatcaagatataaggttaatc

SEQ ID NO: 12507 - DNA, 60 bp, Xenorhabdus bovienii
  Promoter sequence Name=Xb4151_4152.C442.promoter53; Position on contig=106554..106613bp; Strand=+
agtggctgcggttactcactccagttacatagttaaccagaattcagtaagttacggctt

SEQ ID NO: 12508 - DNA, 60 bp, Xenorhabdus bovienii
  Promoter sequence Name=Xb4151_4152.C442.promoter54; Position on contig=107804..107863bp; Strand=-
gcttgttcagagtctttaaaatttcttttaaaaccctttacattaggtagtattcataaa

SEQ ID NO: 12509 - DNA, 60 bp, Xenorhabdus bovienii
  Promoter sequence Name=Xb4151_4152.C442.promoter55; Position on contig=108846..108905bp; Strand=-
ttgattaaacttaattccgtcgattcgccgaaattgaaaaagtcctttaaaatcattatc

SEQ ID NO: 12510 - DNA, 60 bp, Xenorhabdus bovienii
  Promoter sequence Name=Xb4151_4152.C442.promoter56; Position on contig=108659..108718bp; Strand=+
ctgccccaatgcgatagtattttttgcatgtctctatacatggtttttttatccgcctca

SEQ ID NO: 12511 - DNA, 60 bp, Xenorhabdus bovienii
  Promoter sequence Name=Xb4151_4152.C442.promoter57; Position on contig=109424..109483bp; Strand=-
aatttttaataaataattaacctttgaaactaaagtcaatatttctttacccatcccctt

SEQ ID NO: 12512 - DNA, 60 bp, Xenorhabdus bovienii
  Promoter sequence Name=Xb4151_4152.C442.promoter58; Position on contig=109447..109506bp; Strand=+
gactttagtttcaaaggttaattatttattaaaaattattcgcttgttattatatacgca

SEQ ID NO: 12513 - DNA, 60 bp, Xenorhabdus bovienii
  Promoter sequence Name=Xb4151_4152.C442.promoter59; Position on contig=113931..113990bp; Strand=-; Gene name=SmtA
aatcttcggccaccacagttccaattgacgttccagagcgacgcggtaatactctcccca

SEQ ID NO: 12514 - DNA, 60 bp, Xenorhabdus bovienii
  Promoter sequence Name=Xb4151_4152.C442.promoter60; Position on contig=113774..113833bp; Strand=+; Gene name=SmtA
atcacaaagtaaccaaatgtagttgtctgaaagggcagggatcctgataagctccattat

SEQ ID NO: 12515 - DNA, 60 bp, Xenorhabdus bovienii
  Promoter sequence Name=Xb4151_4152.C442.promoter61; Position on contig=115138..115197bp; Strand=-; Gene name=DnaQ
gggtaattgcagtgctcatagtgtttttttgtgtcagacttagagtttagattgaagttg

SEQ ID NO: 12516 - DNA, 60 bp, Xenorhabdus bovienii
  Promoter sequence Name=Xb4151_4152.C442.promoter62; Position on contig=115075..115134bp; Strand=+; Gene name=DnaQ
aggcaagatccatcggtgaaaatttctacctttttgctcatatttggtagactcttccta

SEQ ID NO: 12517 - DNA, 60 bp, Xenorhabdus bovienii
  Promoter sequence Name=Xb4151_4152.C442.promoter63; Position on contig=116068..116127bp; Strand=+
gtgcggtagttcagttggttagaataccggcctgtcacgccgggggtcgcgggttcgagc

SEQ ID NO: 12518 - DNA, 60 bp, Xenorhabdus bovienii
  Promoter sequence Name=Xb4151_4152.C442.promoter64; Position on contig=117510..117569bp; Strand=-
tttaattgatattgaggcttatttgaattgaaatattgatgattttgtatagtatttggt

SEQ ID NO: 12519 - DNA, 60 bp, Xenorhabdus bovienii
  Promoter sequence Name=Xb4151_4152.C442.promoter65; Position on contig=117385..117444bp; Strand=+
agtaagttaataagctcatcacgttttgcatggatagaatccaatagtatgatggccgga

SEQ ID NO: 12520 - DNA, 60 bp, Xenorhabdus bovienii
  Promoter sequence Name=Xb4151_4152.C442.promoter66; Position on contig=120192..120251bp; Strand=-; Gene name=GapA
gcgatcaccgaaatttcagtttgacgcccggattcgtagagagcacgtaagatactgcgc

SEQ ID NO: 12521 - DNA, 60 bp, Xenorhabdus bovienii
  Promoter sequence Name=Xb4151_4152.C442.promoter67; Position on contig=119889..119948bp; Strand=+; Gene name=GapA
gataagcgcattcgcatcaatatctgagcgaatgcgctctttttttatacaatatttact

SEQ ID NO: 12522 - DNA, 60 bp, Xenorhabdus bovienii
  Promoter sequence Name=Xb4151_4152.C442.promoter68; Position on contig=126443..126502bp; Strand=-
taatcaaaatctaataaatatcatcctgcctattcgctgtatcatgctagggtagttctc

SEQ ID NO: 12523 - DNA, 60 bp, Xenorhabdus bovienii
  Promoter sequence Name=Xb4151_4152.C442.promoter69; Position on contig=126738..126797bp; Strand=-; Gene name=AmpC
ggtaatgctatagatataacattgctgtaatgctttcatttccgttttattttcaaactg

SEQ ID NO: 12524 - DNA, 60 bp, Xenorhabdus bovienii
  Promoter sequence Name=Xb4151_4152.C442.promoter70; Position on contig=126513..126572bp; Strand=+; Gene name=AmpC
gcgaaaaaaatatacccttcatcttttaatttgaaatctattgggtatatatttgttgca

SEQ ID NO: 12525 - DNA, 60 bp, Xenorhabdus bovienii
  Promoter sequence Name=Xb4151_4152.C442.promoter71; Position on contig=127701..127760bp; Strand=+; Gene name=UhpC
gcaaggaaaaatgagatttgtttttcctacggtgggtttataccgtttaaaataaccgaa

SEQ ID NO: 12526 - DNA, 60 bp, Xenorhabdus bovienii
  Promoter sequence Name=Xb4151_4152.C442.promoter72; Position on contig=129388..129447bp; Strand=+; Gene name=CitB
aagaaatacattgacgccattgcctgaacgcagtggcgttttctgcttatcttttatctc

SEQ ID NO: 12527 - DNA, 60 bp, Xenorhabdus bovienii
  Promoter sequence Name=Xb4151_4152.C442.promoter73; Position on contig=130791..130850bp; Strand=-
cacatttcctgagaataaaaccggatgaatctattattttttccagtttaatattgttgt

SEQ ID NO: 12528 - DNA, 60 bp, Xenorhabdus bovienii
  Promoter sequence Name=Xb4151_4152.C442.promoter74; Position on contig=130647..130706bp; Strand=+
cggaatccggcctaccgatgttttttttctcctacccccgcaatatcaatcataacaata

SEQ ID NO: 12529 - DNA, 60 bp, Xenorhabdus bovienii
  Promoter sequence Name=Xb4151_4152.C442.promoter75; Position on contig=132769..132828bp; Strand=-; Gene name=PpiB
ctggcttttcatattctagtttatttatatcgctgataaagaagtctataatcagcagat

SEQ ID NO: 12530 - DNA, 60 bp, Xenorhabdus bovienii
  Promoter sequence Name=Xb4151_4152.C442.promoter76; Position on contig=132734..132793bp; Strand=+; Gene name=PpiB
gtaaaaagtgacgtacgtgtaataaaaacgaacgaatctgctgattatagacttctttat

SEQ ID NO: 12531 - DNA, 60 bp, Xenorhabdus bovienii
  Promoter sequence Name=Xb4151_4152.C442.promoter77; Position on contig=134471..134530bp; Strand=-; Gene name=PurE
cggtgtgccgaaacgatctcaacgtgaaagggaatatcgagtgacgtcaaaatatcagcg

SEQ ID NO: 12532 - DNA, 60 bp, Xenorhabdus bovienii
  Promoter sequence Name=Xb4151_4152.C442.promoter78; Position on contig=134249..134308bp; Strand=+; Gene name=PurE
tcgataaatcaaacaacgcaaacgttttccttgtaccattctcatgatatgatccgcctc

SEQ ID NO: 12533 - DNA, 60 bp, Xenorhabdus bovienii
  Promoter sequence Name=Xb4151_4152.C442.promoter79; Position on contig=136537..136596bp; Strand=-
aatgagtaaaaaccaatcaatattaaaaagtgtagtctctttcacaataaaattggaata

SEQ ID NO: 12534 - DNA, 60 bp, Xenorhabdus bovienii
  Promoter sequence Name=Xb4151_4152.C442.promoter80; Position on contig=136341..136400bp; Strand=+
gacagaaccacttcctaagtacaaattcctgaaatcatcagggctcgaaaaatcaatagc

SEQ ID NO: 12535 - DNA, 60 bp, Xenorhabdus bovienii
  Promoter sequence Name=Xb4151_4152.C442.promoter81; Position on contig=138216..138275bp; Strand=-
tcatcagaaagtaaccgaatggattttgcctgccaggcataaatcgacataattggtgaa

SEQ ID NO: 12536 - DNA, 60 bp, Xenorhabdus bovienii
  Promoter sequence Name=Xb4151_4152.C442.promoter82; Position on contig=137972..138031bp; Strand=+
attatcctatcgggatcactgctcagtgtattcgcgggtacctcgcttatactttgagcc

SEQ ID NO: 12537 - DNA, 60 bp, Xenorhabdus bovienii
  Promoter sequence Name=Xb4151_4152.C442.promoter83; Position on contig=138618..138677bp; Strand=+
ccatatcaggcgaggtggttctgctactccccagcaacaaaatcgattagaataaatttc

SEQ ID NO: 12538 - DNA, 60 bp, Xenorhabdus bovienii
  Promoter sequence Name=Xb4151_4152.C442.promoter84; Position on contig=139565..139624bp; Strand=-
ggctgcttccagccagttaccctttaaatgccaactgggatgctgttgagaataactttt

SEQ ID NO: 12539 - DNA, 60 bp, Xenorhabdus bovienii
  Promoter sequence Name=Xb4151_4152.C442.promoter85; Position on contig=139180..139239bp; Strand=+
ttccatctcaacttataacgttgtcgtgagttcatatgtcctccgcaaataattgtcact

SEQ ID NO: 12540 - DNA, 60 bp, Xenorhabdus bovienii
  Promoter sequence Name=Xb4151_4152.C442.promoter86; Position on contig=142820..142879bp; Strand=-
gatttggtaattatatggtttttaattttaacgactataaattattttattataaatttt

SEQ ID NO: 12541 - DNA, 60 bp, Xenorhabdus bovienii
  Promoter sequence Name=Xb4151_4152.C442.promoter87; Position on contig=143998..144057bp; Strand=-; Gene name=RtcB
ctggtagtgacatatttatattattacaaacagatatagccatctgttttcatagatgac

SEQ ID NO: 12542 - DNA, 60 bp, Xenorhabdus bovienii; identical to SEQ ID NO: 10819
  Promoter sequence Name=Xb4151_4152.C442.promoter88; Position on contig=143876..143935bp; Strand=+; Gene name=RtcB

SEQ ID NO: 12543 - DNA, 60 bp, Xenorhabdus bovienii
  Promoter sequence Name=Xb4151_4152.C442.promoter89; Position on contig=145441..145500bp; Strand=-
cataaccaaggcacccagttttccaccggaattcggggcaagccatgaataatgtactat

SEQ ID NO: 12544 - DNA, 60 bp, Xenorhabdus bovienii
  Promoter sequence Name=Xb4151_4152.C442.promoter90; Position on contig=146168..146227bp; Strand=-
atattacgaaatattttcttgttatttatagtcaataaccacacttttaatattaaaata

SEQ ID NO: 12545 - DNA, 60 bp, Xenorhabdus bovienii
  Promoter sequence Name=Xb4151_4152.C442.promoter91; Position on contig=146209..146268bp; Strand=+
agaaaatatttcgtaatatggttttttttgatatggatgctgaattttattctaattgag

SEQ ID NO: 12546 - DNA, 60 bp, Xenorhabdus bovienii
  Promoter sequence Name=Xb4151_4152.C442.promoter92; Position on contig=146807..146866bp; Strand=-; Gene name=AlsT (BS)
gtagcaataactctatttattaaaaataataaaataattacaaaatttaatattgaaatt

SEQ ID NO: 12547 - DNA, 60 bp, Xenorhabdus bovienii
  Promoter sequence Name=Xb4151_4152.C442.promoter93; Position on contig=147297..147356bp; Strand=+; Gene name=AlsT (BS)
taattataaaggatattgagcacaataaattttgcaggatactgatttatggtcagctaa

SEQ ID NO: 12548 - DNA, 60 bp, Xenorhabdus bovienii
  Promoter sequence Name=Xb4151_4152.C442.promoter94; Position on contig=149120..149179bp; Strand=-; Gene name=AmpD
tgaatcgataccttgcttagtcgaataagaatacgagtgatcaacgatataatcatttct

SEQ ID NO: 12549 - DNA, 60 bp, Xenorhabdus bovienii
  Promoter sequence Name=Xb4151_4152.C442.promoter95; Position on contig=150399..150458bp; Strand=-
gaaaatacctatgctgatgggttttgtcatcttgaaaggaagttgtgtatactccttaaa

SEQ ID NO: 12550 - DNA, 60 bp, Xenorhabdus bovienii
  Promoter sequence Name=Xb4151_4152.C442.promoter96; Position on contig=150870..150929bp; Strand=-
aagctccgcgaatcatcttcacgtgctaccccttaagaaactacgtttatactccggttt

SEQ ID NO: 12551 - DNA, 60 bp, Xenorhabdus bovienii
  Promoter sequence Name=Xb4151_4152.C442.promoter97; Position on contig=150455..150514bp; Strand=+
tttcagtaatcaaacgtgaaatttaatttttccacataaaaactctctataatattttat

SEQ ID NO: 12552 - DNA, 60 bp, Xenorhabdus bovienii
  Promoter sequence Name=Xb4151_4152.C442.promoter98; Position on contig=151183..151242bp; Strand=-; Gene name=AnsP
cttaagcgtagattgttctgcttgttctaccatctagtcctcttaattataatgcttaga

SEQ ID NO: 12553 - DNA, 60 bp, Xenorhabdus bovienii
  Promoter sequence Name=Xb4151_4152.C442.promoter99; Position on contig=150995..151054bp; Strand=+; Gene name=AnsP
aaagtgataaataagatagcttaatggggttagtttaaatgttgcgctaaaatcagagct

SEQ ID NO: 12554 - DNA, 60 bp, Xenorhabdus bovienii
  Promoter sequence Name=Xb4151_4152.C442.promoter100; Position on contig=152617..152676bp; Strand=+
tttccggctggtcttatgattagttttattaaacttcctatagccagtatcatattcagc

SEQ ID NO: 12555 - DNA, 60 bp, Xenorhabdus bovienii
  Promoter sequence Name=Xb4151_4152.C442.promoter101; Position on contig=153046..153105bp; Strand=+
tgaataatatttaataaaggataaataaaatataacttagttatgtttaaaataattata

SEQ ID NO: 12556 - DNA, 60 bp, Xenorhabdus bovienii
  Promoter sequence Name=Xb4151_4152.C442.promoter102; Position on contig=154108..154167bp; Strand=-; Gene name=ThiD
agcgacaaagcggggatcaatgtcataaactgattggactcccattgtattttgagcaac

SEQ ID NO: 12557 - DNA, 60 bp, Xenorhabdus bovienii
  Promoter sequence Name=Xb4151_4152.C442.promoter103; Position on contig=153785..153844bp; Strand=+; Gene name=ThiD
gtttggcttcttgacgataactgattgcaaaaatcactctattgcgttactaatagagtg

SEQ ID NO: 12558 - DNA, 60 bp, Xenorhabdus bovienii
  Promoter sequence Name=Xb4151_4152.C442.promoter104; Position on contig=157043..157102bp; Strand=-
acaaatctattcccacaataaatttgtgccatagatagattaaacgttaaaattcttgtt

SEQ ID NO: 12559 - DNA, 60 bp, Xenorhabdus bovienii
  Promoter sequence Name=Xb4151_4152.C442.promoter105; Position on contig=156729..156788bp; Strand=+
aggtttcaaatcgcggatgaacgttttcagctttgcattgtggggagcaatattgacgac

SEQ ID NO: 12560 - DNA, 60 bp, Xenorhabdus bovienii
  Promoter sequence Name=Xb4151_4152.C442.promoter106; Position on contig=162447..162506bp; Strand=-; Gene name=AcrB
cacgacgctactgagtttagccattactttatgtggcgcactcagttttattctgctgcc

SEQ ID NO: 12561 - DNA, 60 bp, Xenorhabdus bovienii
  Promoter sequence Name=Xb4151_4152.C442.promoter107; Position on contig=167021..167080bp; Strand=-
cttccatattttctccatcattggctatttccctttggttacactattaatatatgttta

SEQ ID NO: 12562 - DNA, 60 bp, Xenorhabdus bovienii
  Promoter sequence Name=Xb4151_4152.C442.promoter108; Position on contig=167671..167730bp; Strand=-
atggtattagctttttgccagttaattctcgagttatatattcattgtataattcagaat

SEQ ID NO: 12563 - DNA, 60 bp, Xenorhabdus bovienii
  Promoter sequence Name=Xb4151_4152.C442.promoter109; Position on contig=167286..167345bp; Strand=+
gcaagacaataaatatcactgtcttgcgtttttattttttcgctatttaacattcatata

SEQ ID NO: 12564 - DNA, 60 bp, Xenorhabdus bovienii
  Promoter sequence Name=Xb4151_4152.C442.promoter110; Position on contig=169922..169981bp; Strand=+
aatattaaccaatgagtatgttaaagcggtatgaaaacaatgatagctatccgttgatat

SEQ ID NO: 12565 - DNA, 60 bp, Xenorhabdus bovienii
  Promoter sequence Name=Xb4151_4152.C442.promoter111; Position on contig=173654..173713bp; Strand=+
gtaatcaaaaaaagttatcaattgataattttttttgattagtgttttatttttttatgc

SEQ ID NO: 12566 - DNA, 60 bp, Xenorhabdus bovienii
  Promoter sequence Name=Xb4151_4152.C442.promoter112; Position on contig=175937..175996bp; Strand=+
taatatatcaaggagtaaggaaatgtttggaagatagttatatttttattttatatataa

SEQ ID NO: 12567 - DNA, 60 bp, Xenorhabdus bovienii
  Promoter sequence Name=Xb4151_4152.C442.promoter113; Position on contig=180682..180741bp; Strand=+
tacagccgtaattgctctataagcctatgatctcaccagcagggaggttttatcgattga

SEQ ID NO: 12568 - DNA, 60 bp, Xenorhabdus bovienii
  Promoter sequence Name=Xb4151_4152.C442.promoter114; Position on contig=189961..190020bp; Strand=-
tcagtccgccggatatcttgacccgcattaataacataccgatttttattttgaaacggt

SEQ ID NO: 12569 - DNA, 60 bp, Xenorhabdus bovienii
  Promoter sequence Name=Xb4151_4152.C442.promoter115; Position on contig=189718..189777bp; Strand=+
ctcatagtccttaagctgtttgccaatcgcggtcatttcccgctcggcaaactggttgaa

SEQ ID NO: 12570 - DNA, 60 bp, Xenorhabdus bovienii
  Promoter sequence Name=Xb4151_4152.C442.promoter116; Position on contig=213631..213690bp; Strand=-
tcttagcctattttttttagggagatgttttgtatttgttatatgggtaaaattagaata

SEQ ID NO: 12571 - DNA, 60 bp, Xenorhabdus bovienii
  Promoter sequence Name=Xb4151_4152.C442.promoter117; Position on contig=214155..214214bp; Strand=+
gaaaaatatttcattaaaaaatgaaaaacatataaatattaattagttaaatttaattaa

SEQ ID NO: 12572 - DNA, 60 bp, Xenorhabdus bovienii
  Promoter sequence Name=Xb4151_4152.C442.promoter118; Position on contig=215613..215672bp; Strand=-; Gene name=FhaC
gtttaagtatgatttgttaattaaatattaaagcatagaaaatattttatttttctccga

SEQ ID NO: 12573 - DNA, 60 bp, Xenorhabdus bovienii
  Promoter sequence Name=Xb4151_4152.C442.promoter119; Position on contig=215596..215655bp; Strand=+; Gene name=FhaC
caaaatatatacatcaatcggagaaaaataaaatattttctatgctttaatatttaatta

SEQ ID NO: 12574 - DNA, 60 bp, Xenorhabdus bovienii
  Promoter sequence Name=Xb4151_4152.C442.promoter120; Position on contig=222195..222254bp; Strand=-; Gene name=Rbn
ggcgatggcaaaagagagcatcaagattgggatgagagatagaaatgaaaaataagtaat

SEQ ID NO: 12575 - DNA, 60 bp, Xenorhabdus bovienii
  Promoter sequence Name=Xb4151_4152.C442.promoter121; Position on contig=221977..222036bp; Strand=+; Gene name=Rbn
gcccatcatgcggctaccgtatttgttgccttttctgttttgcctgttactctttttcca

SEQ ID NO: 12576 - DNA, 60 bp, Xenorhabdus bovienii
  Promoter sequence Name=Xb4151_4152.C442.promoter122; Position on contig=225074..225133bp; Strand=-; Gene name=LysR
attggttattcatcatggttaattacagctaaacggaatgttcaatttatattcatagtc

SEQ ID NO: 12577 - DNA, 60 bp, Xenorhabdus bovienii
  Promoter sequence Name=Xb4151_4152.C442.promoter123; Position on contig=224811..224870bp; Strand=+; Gene name=LysR
atgatttggcgggtaccaaaccgacttgccaaccagttactgataggaataatgagagtc

SEQ ID NO: 12578 - DNA, 60 bp, Xenorhabdus bovienii
  Promoter sequence Name=Xb4151_4152.C442.promoter124; Position on contig=227612..227671bp; Strand=-
gccttgttgattagtagtgggcattaatggtttggcatgaatagttaaactgtggcaggt

SEQ ID NO: 12579 - DNA, 60 bp, Xenorhabdus bovienii
  Promoter sequence Name=Xb4151_4152.C442.promoter125; Position on contig=227438..227497bp; Strand=+
ctgaatccattttcaagtttaccttgttgccaagccggatcaggctgcaaaatctctgcc

SEQ ID NO: 12580 - DNA, 60 bp, Xenorhabdus bovienii
  Promoter sequence Name=Xb4151_4152.C442.promoter126; Position on contig=228432..228491bp; Strand=-
ttctgttttgaactcatcaaaataagacgaccgccagaaaaatcaagtatactcagtcac

SEQ ID NO: 12581 - DNA, 60 bp, Xenorhabdus bovienii
  Promoter sequence Name=Xb4151_4152.C442.promoter127; Position on contig=228201..228260bp; Strand=+
tgccagaggaacttgaacctgtgcagccgcattattgagctggctgatataatcatcttt

SEQ ID NO: 12582 - DNA, 60 bp, Xenorhabdus bovienii
  Promoter sequence Name=Xb4151_4152.C442.promoter128; Position on contig=232271..232330bp; Strand=+
gcggctttttagagaaatgcccaaatcaccatgaaatatgccattaatataatgaaaata

SEQ ID NO: 12583 - DNA, 60 bp, Xenorhabdus bovienii
  Promoter sequence Name=Xb4151_4152.C442.promoter129; Position on contig=234440..234499bp; Strand=-
atatgccgactgtcatatttttacatcgcaagtgttaattatttttttattttatgtttt

SEQ ID NO: 12584 - DNA, 60 bp, Xenorhabdus bovienii
  Promoter sequence Name=Xb4151_4152.C443.promoter1; Position on contig= 4179..4238bp; Strand=-; Gene name=FadB
tgtagagcggatcacaggtaagatttatgatggatgacaatattttttattatagttatg

SEQ ID NO: 12585 - DNA, 60 bp, Xenorhabdus bovienii
  Promoter sequence Name=Xb4151_4152.C443.promoter2; Position on contig= 4138..4197bp; Strand=+; Gene name=FadB
atctcaccttagtgcggttgactgacaatatttatatttttcataactataataaaaaat

SEQ ID NO: 12586 - DNA, 60 bp, Xenorhabdus bovienii
  Promoter sequence Name=Xb4151_4152.C443.promoter3; Position on contig= 10136..10195bp; Strand=-
aggcattagttgattggataccattttgctgcatctgagcagttaaactcacaaaatata

SEQ ID NO: 12587 - DNA, 60 bp, Xenorhabdus bovienii
  Promoter sequence Name=Xb4151_4152.C443.promoter4; Position on contig= 10335..10394bp; Strand=+; Gene name=NusG
ttacacacattctgactttattgatgatcctgaagccttggttttgttatgctagacata

SEQ ID NO: 12588 - DNA, 60 bp, Xenorhabdus bovienii
  Promoter sequence Name=Xb4151_4152.C443.promoter5; Position on contig= 12010..12069bp; Strand=-; Gene name=TatC
gatggtgttaagattattagcggagcgatgacaacattaacccggcgtattgtcgctggg

SEQ ID NO: 12589 - DNA, 60 bp, Xenorhabdus bovienii
  Promoter sequence Name=Xb4151_4152.C443.promoter6; Position on contig= 18155..18214bp; Strand=-; Gene name=DedA
ctgaaagaaactcattaaagaatctggacatctatacagcatctatttaacttacattaa

SEQ ID NO: 12590 - DNA, 60 bp, Xenorhabdus bovienii
  Promoter sequence Name=Xb4151_4152.C443.promoter7; Position on contig= 19679..19738bp; Strand=-; Gene name=Udp
ggccagaacactctggctcgatctttctgcttatctttctttcattctaaaatctgataa

SEQ ID NO: 12591 - DNA, 60 bp, Xenorhabdus bovienii
  Promoter sequence Name=Xb4151_4152.C443.promoter8; Position on contig= 20651..20710bp; Strand=-
acggagtaataagtattggccttatttgaatcttatactcagtccgtcattttggattat

SEQ ID NO: 12592 - DNA, 60 bp, Xenorhabdus bovienii
  Promoter sequence Name=Xb4151_4152.C443.promoter9; Position on contig= 23400..23459bp; Strand=-; Gene name=LysR
aagttgatgatgaataatttgcgcttgtggtttatacagtacctgttgattatagaagtg

SEQ ID NO: 12593 - DNA, 60 bp, Xenorhabdus bovienii
  Promoter sequence Name=Xb4151_4152.C443.promoter10; Position on contig=23359..23418bp; Strand=+; Gene name=LysR
gtcatgtcgtcacccgcaaattttagccgtctagatgtttacacttctataatcaacagg

SEQ ID NO: 12594 - DNA, 60 bp, Xenorhabdus bovienii
  Promoter sequence Name=Xb4151_4152.C443.promoter11; Position on contig=26942..27001bp; Strand=-
atcattgattcacaatgtgattgttttttgattttctttaataactttaatatttatggt

SEQ ID NO: 12595 - DNA, 60 bp, Xenorhabdus bovienii
  Promoter sequence Name=Xb4151_4152.C443.promoter12; Position on contig=29136..29195bp; Strand=-
atccgaatcattataatttgtccattgatgatataccagcaaatccctatagtgtgcgca

SEQ ID NO: 12596 - DNA, 60 bp, Xenorhabdus bovienii
  Promoter sequence Name=Xb4151_4152.C443.promoter13; Position on contig=31782..31841bp; Strand=+
tttattaataaataatactgtttttttgttatcaaaaaaattcattttaaaattaataat

SEQ ID NO: 12597 - DNA, 60 bp, Xenorhabdus bovienii
  Promoter sequence Name=Xb4151_4152.C443.promoter14; Position on contig=33977..34036bp; Strand=+; Gene name=MdlB
tgacaaaataaaataaaaataacaaatgactgggtaaataaatcgtttttgcttcagtta

SEQ ID NO: 12598 - DNA, 60 bp, Xenorhabdus bovienii
  Promoter sequence Name=Xb4151_4152.C443.promoter15; Position on contig=38962..39021bp; Strand=-
atataaaagcaaagtgtgatttcaatgttgaatgagctttgcttttttattatttaacct

SEQ ID NO: 12599 - DNA, 60 bp, Xenorhabdus bovienii
  Promoter sequence Name=Xb4151_4152.C443.promoter16; Position on contig=39850..39909bp; Strand=+
atacaccaataacctctattattttgtcaatcagcaataaattttgttgtaatttaatta

SEQ ID NO: 12600 - DNA, 60 bp, Xenorhabdus bovienii
  Promoter sequence Name=Xb4151_4152.C443.promoter17; Position on contig=42527..42586bp; Strand=-
gtaaattaacaaaatgatgaaattttactgagtctttataaaaaatataaaattaattat

SEQ ID NO: 12601 - DNA, 60 bp, Xenorhabdus bovienii
  Promoter sequence Name=Xb4151_4152.C443.promoter18; Position on contig=42807..42866bp; Strand=+
aatttaattcataatactgattattaaattatactatattaacaatataaaataattcat

SEQ ID NO: 12602 - DNA, 60 bp, Xenorhabdus bovienii
  Promoter sequence Name=Xb4151_4152.C443.promoter19; Position on contig=45250..45309bp; Strand=-
tttcttattcatgaaaaaatcccctaaatgtaaaaaaacaggctgactataatatcaaat

SEQ ID NO: 12603 - DNA, 60 bp, Xenorhabdus bovienii
  Promoter sequence Name=Xb4151_4152.C443.promoter20; Position on contig=45209..45268bp; Strand=+
tggatacaccagacaacttagagtgtatcccaataggagatatttgatattatagtcagc

SEQ ID NO: 12604 - DNA, 60 bp, Xenorhabdus bovienii
  Promoter sequence Name=Xb4151_4152.C443.promoter21; Position on contig=46381..46440bp; Strand=-; Gene name=RtcB
tttcattttttaataaaataatttttgaaataaaaaactgtattcttaatatgtaaaaag

SEQ ID NO: 12605 - DNA, 60 bp, Xenorhabdus bovienii
  Promoter sequence Name=Xb4151_4152.C443.promoter22; Position on contig=48152..48211bp; Strand=-
aaccattaaataaaatgtgaatctgtctgctagagtcattctggtggtaatttaccttat

SEQ ID NO: 12606 - DNA, 60 bp, Xenorhabdus bovienii
  Promoter sequence Name=Xb4151_4152.C443.promoter23; Position on contig=47845..47904bp; Strand=+
aggcagtagaacttcagcttcaatctgctctttattgaaacgatagatattattttcgta

SEQ ID NO: 12607 - DNA, 60 bp, Xenorhabdus bovienii
  Promoter sequence Name=Xb4151_4152.C443.promoter24; Position on contig=48249..48308bp; Strand=+
attaatgggtgttttttaatatcttgaattaacgagattagatcgcttaaaattcaaata

SEQ ID NO: 12608 - DNA, 60 bp, Xenorhabdus bovienii
  Promoter sequence Name=Xb4151_4152.C443.promoter25; Position on contig=51803..51862bp; Strand=-; Gene name=PotC
gttgatttgggcgtggtcacaagctggccacgtcttcactttatttgtaacatcgctttt

SEQ ID NO: 12609 - DNA, 60 bp, Xenorhabdus bovienii
  Promoter sequence Name=Xb4151_4152.C443.promoter26; Position on contig=54862..54921bp; Strand=-
cgtgtctgaaggatcttattgaaagtaaagaaaattaaaagtgattgtaaaatgcccgat

SEQ ID NO: 12610 - DNA, 60 bp, Xenorhabdus bovienii
  Promoter sequence Name=Xb4151_4152.C443.promoter27; Position on contig=54727..54786bp; Strand=+
gcgcgcataataaacgcagtaagctgaaattgaaagccgaaacaataacaatatgtcatt

SEQ ID NO: 12611 - DNA, 60 bp, Xenorhabdus bovienii
  Promoter sequence Name=Xb4151_4152.C443.promoter28; Position on contig=57898..57957bp; Strand=-
attttgcttagtttggtgtccattatttgtgagtaaaatcacaatactataataaagttt

SEQ ID NO: 12612 - DNA, 60 bp, Xenorhabdus bovienii
  Promoter sequence Name=Xb4151_4152.C443.promoter29; Position on contig=57624..57683bp; Strand=+
gttatatactctctattctctcttgctaaaatcgctttacttatataatagtcaggatgt

SEQ ID NO: 12613 - DNA, 60 bp, Xenorhabdus bovienii
  Promoter sequence Name=Xb4151_4152.C443.promoter30; Position on contig=58413..58472bp; Strand=-
gacaaaacagtatcagcaaatgcaacaggatttccatgtcacagtgctaaactagaaata

SEQ ID NO: 12614 - DNA, 60 bp, Xenorhabdus bovienii
  Promoter sequence Name=Xb4151_4152.C443.promoter31; Position on contig=59004..59063bp; Strand=+
atcagccacaacgtatgacattcgtagtgatcggcaagctcccgcggtaatatagcaagc

SEQ ID NO: 12615 - DNA, 60 bp, Xenorhabdus bovienii; identical to SEQ ID NO: 11145
  Promoter sequence Name=Xb4151_4152.C443.promoter32; Position on contig=60958..61017bp; Strand=-

SEQ ID NO: 12616 - DNA, 60 bp, Xenorhabdus bovienii
  Promoter sequence Name=Xb4151_4152.C443.promoter33; Position on contig=60654..60713bp; Strand=+
ggctgttgacgttttatgaggagaatttgaacagcatgatgctctggtatcattgtcttc

SEQ ID NO: 12617 - DNA, 60 bp, Xenorhabdus bovienii
  Promoter sequence Name=Xb4151_4152.C443.promoter34; Position on contig=61447..61506bp; Strand=+
atgtgggttgagtaaatgatgaactcaaaacgtcaacagcccctaatataattaataggc

SEQ ID NO: 12618 - DNA, 60 bp, Xenorhabdus bovienii
  Promoter sequence Name=Xb4151_4152.C443.promoter35; Position on contig=62259..62318bp; Strand=+
ttctactgacgtctgattatgtttgctgaacctttatcgctcccaatgataatgatcggt

SEQ ID NO: 12619 - DNA, 60 bp, Xenorhabdus bovienii
  Promoter sequence Name=Xb4151_4152.C443.promoter36; Position on contig=69790..69849bp; Strand=-
ttgaacaagattgaaaggataagtgttgcgaatggacttctgacaggtataatgacctcc

SEQ ID NO: 12620 - DNA, 60 bp, Xenorhabdus bovienii
  Promoter sequence Name=Xb4151_4152.C443.promoter37; Position on contig=69595..69654bp; Strand=+
tgaatggaaaagcgggaagagctttacggggactggatttcagacgtaaaaaaagacgct

SEQ ID NO: 12621 - DNA, 60 bp, Xenorhabdus bovienii
  Promoter sequence Name=Xb4151_4152.C443.promoter38; Position on contig=70291..70350bp; Strand=-; Gene name=AmpC
gattgactgtgcatactggtcgaccagagatgaggccattttcttggtattatcattacc

SEQ ID NO: 12622 - DNA, 60 bp, Xenorhabdus bovienii
  Promoter sequence Name=Xb4151_4152.C443.promoter39; Position on contig=70015..70074bp; Strand=+; Gene name=AmpC
acaatcatgtctattatcggctatatttttataggtatccttgtgggtatcattattggc

SEQ ID NO: 12623 - DNA, 60 bp, Xenorhabdus bovienii
  Promoter sequence Name=Xb4151_4152.C443.promoter40; Position on contig=73870..73929bp; Strand=-
ctccatgcgttctcctgaatcttaaagacaaagacggatacaatcgctaaaatatcacgt

SEQ ID NO: 12624 - DNA, 60 bp, Xenorhabdus bovienii
  Promoter sequence Name=Xb4151_4152.C443.promoter41; Position on contig=73405..73464bp; Strand=+
tagagtttgctgaacgtcattaataccccaagaaacagactcaggggtaaaataagctgc

SEQ ID NO: 12625 - DNA, 60 bp, Xenorhabdus bovienii
  Promoter sequence Name=Xb4151_4152.C443.promoter42; Position on contig=73804..73863bp; Strand=+; Gene name=PepB
gtaccaaaaaataatgcggtgagcttaacataacagtgaattttctttgggatgaattaa

SEQ ID NO: 12626 - DNA, 60 bp, Xenorhabdus bovienii
  Promoter sequence Name=Xb4151_4152.C443.promoter43; Position on contig=75609..75668bp; Strand=-; Gene name=HolC
gtggctgtaattcatcagaagacgataattgttcctgtgagagcttttccaataaataga

SEQ ID NO: 12627 - DNA, 60 bp, Xenorhabdus bovienii
  Promoter sequence Name=Xb4151_4152.C443.promoter44; Position on contig=75506..75565bp; Strand=+; Gene name=HolC
ggaattaagggtattgcggctgcaatacccttttgtatcgcttttcccatcatttttctg

SEQ ID NO: 12628 - DNA, 60 bp, Xenorhabdus bovienii
  Promoter sequence Name=Xb4151_4152.C443.promoter45; Position on contig=79364..79423bp; Strand=-; Gene name=MazE
tctacagtaatttcaacagtatcatcgacgttcagagacgctgctttcataattgaaacc

SEQ ID NO: 12629 - DNA, 60 bp, Xenorhabdus bovienii
  Promoter sequence Name=Xb4151_4152.C443.promoter46; Position on contig=79224..79283bp; Strand=+; Gene name=MazE
aacaaactataatgtatcgacaatgttgacacgttcggtttattgtttaatatataaaaa

SEQ ID NO: 12630 - DNA, 60 bp, Xenorhabdus bovienii
  Promoter sequence Name=Xb4151_4152.C443.promoter47; Position on contig=80028..80087bp; Strand=+
cgcttagagtgctttaaactccattccctgaggtaaccccttatccgggaatatcctatt

SEQ ID NO: 12631 - DNA, 60 bp, Xenorhabdus bovienii
  Promoter sequence Name=Xb4151_4152.C443.promoter48; Position on contig=81659..81718bp; Strand=+; Gene name=ArtI
aataagatataacattattttatatacgaaaattctatcattcccattatcatagtaagt

SEQ ID NO: 12632 - DNA, 60 bp, Xenorhabdus bovienii; identical to SEQ ID NO: 11334
  Promoter sequence Name=Xb4151_4152.C443.promoter49; Position on contig=82582..82641bp; Strand=+; Gene name=Tra8

SEQ ID NO: 12633 - DNA, 60 bp, Xenorhabdus bovienii
  Promoter sequence Name=Xb4151_4152.C443.promoter50; Position on contig=86562..86621bp; Strand=+; Gene name=WecD
ttatcctccttgagtcatatctccccccaacaagctgcctgtttcgggagaattttaagt

SEQ ID NO: 12634 - DNA, 60 bp, Xenorhabdus bovienii
  Promoter sequence Name=Xb4151_4152.C443.promoter51; Position on contig=87850..87909bp; Strand=-
aaaatggattcatgctgtattttctccattagagtgatattgaatttatattcaatatat

SEQ ID NO: 12635 - DNA, 60 bp, Xenorhabdus bovienii
  Promoter sequence Name=Xb4151_4152.C443.promoter52; Position on contig=87517..87576bp; Strand=+
ggctttttccaaaagatcgaagttttccgccgaaaaatggtgctcaataatataaagcgc

SEQ ID NO: 12636 - DNA, 60 bp, Xenorhabdus bovienii
  Promoter sequence Name=Xb4151_4152.C443.promoter53; Position on contig=87804..87863bp; Strand=+; Gene name=ArgF
atgacaaatacacatcacaggggttgtaattgaattttttatcgatatatattgaatata

SEQ ID NO: 12637 - DNA, 60 bp, Xenorhabdus bovienii
  Promoter sequence Name=Xb4151_4152.C443.promoter54; Position on contig=90203..90262bp; Strand=-
aatgtaataattttagaataaaatctaataacctagatggatttttttatcatgctgatt

SEQ ID NO: 12638 - DNA, 60 bp, Xenorhabdus bovienii
  Promoter sequence Name=Xb4151_4152.C443.promoter55; Position on contig=90574..90633bp; Strand=-
tgagtctaattcattttctgaacctttaaaagcgttgctggtagggctagaagcctttac

SEQ ID NO: 12639 - DNA, 60 bp, Xenorhabdus bovienii
  Promoter sequence Name=Xb4151_4152.C443.promoter56; Position on contig=91630..91689bp; Strand=-
ttaacttttttaagcacggccgccctgaattacactcaggccattggtaagagtttcttt

SEQ ID NO: 12640 - DNA, 60 bp, Xenorhabdus bovienii
  Promoter sequence Name=Xb4151_4152.C443.promoter57; Position on contig=91227..91286bp; Strand=+
ttcttagccagttgtgcgggaataatttccatacatcacctaccgtctaaaatggctcaa

SEQ ID NO: 12641 - DNA, 60 bp, Xenorhabdus bovienii
  Promoter sequence Name=Xb4151_4152.C443.promoter58; Position on contig=92206..92265bp; Strand=-; Gene name=RhtB
ttcaaggatgaaacaccccataaattaacgtcttgtaaacgctttttttaatgatatttc

SEQ ID NO: 12642 - DNA, 60 bp, Xenorhabdus bovienii
  Promoter sequence Name=Xb4151_4152.C443.promoter59; Position on contig=97195..97254bp; Strand=+
ggcgcaagtgttctgccagttttgcttcaatttcgttgctattaagttcaaataccgtca

SEQ ID NO: 12643 - DNA, 60 bp, Xenorhabdus bovienii
  Promoter sequence Name=Xb4151_4152.C443.promoter60; Position on contig=97826..97885bp; Strand=+; Gene name=PspF
ttttatttgaatctgttttagtgattgtttttacagtcgattttttttatcttttcatat

SEQ ID NO: 12644 - DNA, 60 bp, Xenorhabdus bovienii
  Promoter sequence Name=Xb4151_4152.C443.promoter61; Position on contig=100771..100830bp; Strand=+
aataatatatatactgaaggaaattataaataaaaattaacattaaataaattaactaac

SEQ ID NO: 12645 - DNA, 60 bp, Xenorhabdus bovienii
  Promoter sequence Name=Xb4151_4152.C443.promoter62; Position on contig=106285..106344bp; Strand=-; Gene name=CaiC
gcaatatgactactgagatcgccattcacaaaaataggaaacgagcctatattgttcagt

SEQ ID NO: 12646 - DNA, 60 bp, Xenorhabdus bovienii
  Promoter sequence Name=Xb4151_4152.C443.promoter63; Position on contig=105894..105953bp; Strand=+; Gene name=CaiC
atcagtagctatatacttgccataaattatatagtcttacaaataatcataatgtaataa

SEQ ID NO: 12647 - DNA, 60 bp, Xenorhabdus bovienii
  Promoter sequence Name=Xb4151_4152.C443.promoter64; Position on contig=111417..111476bp; Strand=+
aaagatagttgcttgattaatctgttgaataatatgtttcctggattatttcttccagga

SEQ ID NO: 12648 - DNA, 60 bp, Xenorhabdus bovienii
  Promoter sequence Name=Xb4151_4152.C443.promoter65; Position on contig=112062..112121bp; Strand=+
ttacacttagttattacaatataaattaatatccccatatcaatttttaaactaaaaata

SEQ ID NO: 12649 - DNA, 60 bp, Xenorhabdus bovienii
  Promoter sequence Name=Xb4151_4152.C443.promoter66; Position on contig=113427..113486bp; Strand=-; Gene name=Cof
ttatcttcaaaaaatagtatgtggctgtatctcttgtgagccaataataaaattggaatt

SEQ ID NO: 12650 - DNA, 60 bp, Xenorhabdus bovienii
  Promoter sequence Name=Xb4151_4152.C443.promoter67; Position on contig=114337..114396bp; Strand=-
taactaaactagttcgcataatatgttgttgccttccattttttttgttatctttttttc

SEQ ID NO: 12651 - DNA, 60 bp, Xenorhabdus bovienii
  Promoter sequence Name=Xb4151_4152.C443.promoter68; Position on contig=114383..114442bp; Strand=+
aactagtttagttatattcaaattaaaactaattgtggattaattttctgtaaaataatt

SEQ ID NO: 12652 - DNA, 60 bp, Xenorhabdus bovienii
  Promoter sequence Name=Xb4151_4152.C443.promoter69; Position on contig=118442..118501bp; Strand=-
aatagcaatagatcggtttttccgttgcctaagaacggaataagtatcacaatggatcat

SEQ ID NO: 12653 - DNA, 60 bp, Xenorhabdus bovienii
  Promoter sequence Name=Xb4151_4152.C443.promoter70; Position on contig=118238..118297bp; Strand=+
tgataaggttctatttttgatttgaatttcataaaaatctctatttttaacctagtggtc

SEQ ID NO: 12654 - DNA, 60 bp, Xenorhabdus bovienii
  Promoter sequence Name=Xb4151_4152.C443.promoter71; Position on contig=120952..121011bp; Strand=-
atttgaatatgtagaaaataagaattgatgggatgtgtttttgttgctaatctgtaaata

SEQ ID NO: 12655 - DNA, 60 bp, Xenorhabdus bovienii
  Promoter sequence Name=Xb4151_4152.C443.promoter72; Position on contig=121285..121344bp; Strand=-; Gene name=PyrI
tgagccggaatgtgatcgataacggtgccacatttaatagcttctacttgtaattgatgg

SEQ ID NO: 12656 - DNA, 60 bp, Xenorhabdus bovienii
  Promoter sequence Name=Xb4151_4152.C443.promoter73; Position on contig=121052..121111bp; Strand=+; Gene name=PyrI
catgtgtttttctaatattattgagacaaataagtggggcttttaattaatattttttta

SEQ ID NO: 12657 - DNA, 60 bp, Xenorhabdus bovienii
  Promoter sequence Name=Xb4151_4152.C443.promoter74; Position on contig=121782..121841bp; Strand=+; Gene name=TdcF
aagggtataagctgtcctgtaccagttgaagcaggactggaggtcactataatggttggc

SEQ ID NO: 12658 - DNA, 60 bp, Xenorhabdus bovienii
  Promoter sequence Name=Xb4151_4152.C443.promoter75; Position on contig=122851..122910bp; Strand=-
attatataaatatcagaacacgtggctggctgaatatccagttgtgttctgatatgaaca

SEQ ID NO: 12659 - DNA, 60 bp, Xenorhabdus bovienii
  Promoter sequence Name=Xb4151_4152.C443.promoter76; Position on contig=123423..123482bp; Strand=-
tgggttgatttcatatcattatttattttaaataatttgcatgcttttattatcctatga

SEQ ID NO: 12660 - DNA, 60 bp, Xenorhabdus bovienii
  Promoter sequence Name=Xb4151_4152.C443.promoter77; Position on contig=123299..123358bp; Strand=+
ttcaattattttgaacaaataatactgtaattccatgccagatagaatataatttaaaat

SEQ ID NO: 12661 - DNA, 60 bp, Xenorhabdus bovienii
  Promoter sequence Name=Xb4151_4152.C443.promoter78; Position on contig=127033..127092bp; Strand=-
aaaatgttaaatctggtttgatctttgaaatttatataagtaatgtacaattgtctgatt

SEQ ID NO: 12662 - DNA, 60 bp, Xenorhabdus bovienii
  Promoter sequence Name=Xb4151_4152.C443.promoter79; Position on contig=127312..127371bp; Strand=-; Gene name=AraJ
ctctcccccagcatattatttgccgacctctgtactatagggtcggctttaatcaataga

SEQ ID NO: 12663 - DNA, 60 bp, Xenorhabdus bovienii
  Promoter sequence Name=Xb4151_4152.C443.promoter80; Position on contig=128620..128679bp; Strand=-
ataagtttttatccattatgaatatttattgcactaaatggaagcctgatactggtgact

SEQ ID NO: 12664 - DNA, 60 bp, Xenorhabdus bovienii
  Promoter sequence Name=Xb4151_4152.C443.promoter81; Position on contig=131579..131638bp; Strand=-
catttattattatcttattttttatttttatatagagtcttgtgatgtatattcatgacg

SEQ ID NO: 12665 - DNA, 60 bp, Xenorhabdus bovienii
  Promoter sequence Name=Xb4151_4152.C443.promoter82; Position on contig=131618..131677bp; Strand=+
aaaataagataataataaatggttatgaaataatgagatcataaatttaaaatcatcata

SEQ ID NO: 12666 - DNA, 60 bp, Xenorhabdus bovienii
  Promoter sequence Name=Xb4151_4152.C443.promoter83; Position on contig=133275..133334bp; Strand=-
cataaaaaaatttttgttgtgctgacattctgctcaaacagaatgtatttaattaaagta

SEQ ID NO: 12667 - DNA, 60 bp, Xenorhabdus bovienii
  Promoter sequence Name=Xb4151_4152.C443.promoter84; Position on contig=133834..133893bp; Strand=-
tttgatggttttatgaagagtatcttttgatggtaaagatatgtttttttaattaattta

SEQ ID NO: 12668 - DNA, 60 bp, Xenorhabdus bovienii
  Promoter sequence Name=Xb4151_4152.C443.promoter85; Position on contig=137217..137276bp; Strand=+
ttgacgggcttaaatttaacctttgataatggcgctctaaatttatttataaaaattaat

SEQ ID NO: 12669 - DNA, 60 bp, Xenorhabdus bovienii
  Promoter sequence Name=Xb4151_4152.C443.promoter86; Position on contig=141904..141963bp; Strand=-; Gene name=NrfG
cagatttttaagtccacatcttgataggtgggggcttgtttgttcgtttaataacataat

SEQ ID NO: 12670 - DNA, 60 bp, Xenorhabdus bovienii
  Promoter sequence Name=Xb4151_4152.C443.promoter87; Position on contig=142913..142972bp; Strand=-; Gene name=Pnp
gtaaaaagggcgccgtttagtcaattttgggcaggacgcctgaaatatacaatgtgggtg

SEQ ID NO: 12671 - DNA, 60 bp, Xenorhabdus bovienii
  Promoter sequence Name=Xb4151_4152.C443.promoter88; Position on contig=145305..145364bp; Strand=-
tgaaaaggggcctaatagggccccttttcttctaggaagcggaacgttaaaaacttaagt

SEQ ID NO: 12672 - DNA, 60 bp, Xenorhabdus bovienii
  Promoter sequence Name=Xb4151_4152.C443.promoter89; Position on contig=144990..145049bp; Strand=+
ttcatttttttctggccaacaacggtaacaaataccgcagtgtcatccatatttaccata

SEQ ID NO: 12673 - DNA, 60 bp, Xenorhabdus bovienii
  Promoter sequence Name=Xb4151_4152.C443.promoter90; Position on contig=145668..145727bp; Strand=-; Gene name=TruB
tagaatagcgcgtctatatgtgagttgctgaattagagatcggcactcatgatttttaat

SEQ ID NO: 12674 - DNA, 60 bp, Xenorhabdus bovienii
  Promoter sequence Name=Xb4151_4152.C443.promoter91; Position on contig=152082..152141bp; Strand=-
ccccgagtatcggggttttttgttatttgacagcagaactactgggctaatatagccctt

SEQ ID NO: 12675 - DNA, 60 bp, Xenorhabdus bovienii
  Promoter sequence Name=Xb4151_4152.C443.promoter92; Position on contig=152065..152124bp; Strand=+
cccccaagacataaaaaaagggctatattagcccagtagttctgctgtcaaataacaaaa

SEQ ID NO: 12676 - DNA, 60 bp, Xenorhabdus bovienii
  Promoter sequence Name=Xb4151_4152.C443.promoter93; Position on contig=153043..153102bp; Strand=-
aacgccagtatttgaaattaaccttgcttgtctgaaacgctttggttagtattcacaccc

SEQ ID NO: 12677 - DNA, 60 bp, Xenorhabdus bovienii
  Promoter sequence Name=Xb4151_4152.C443.promoter94; Position on contig=158157..158216bp; Strand=-
tgttaagagtcatcgtttttttgcttatgttgggattgaaaacggcctattctaccgcca

SEQ ID NO: 12678 - DNA, 60 bp, Xenorhabdus bovienii
  Promoter sequence Name=Xb4151_4152.C443.promoter95; Position on contig=158052..158111bp; Strand=+
gcgttttttattggccattgttctttccaactatacgaatagagagctatatttttgcac

SEQ ID NO: 12679 - DNA, 60 bp, Xenorhabdus bovienii
  Promoter sequence Name=Xb4151_4152.C443.promoter96; Position on contig=159241..159300bp; Strand=-; Gene name=DacB
gttagaataatagattagcaggcaaaatagatatgtgaacttcagggtatactgtagttt

SEQ ID NO: 12680 - DNA, 60 bp, Xenorhabdus bovienii
  Promoter sequence Name=Xb4151_4152.C443.promoter97; Position on contig=159225..159284bp; Strand=+; Gene name=DacB
acaataaaaagagagcaaactacagtataccctgaagttcacatatctattttgcctgct

SEQ ID NO: 12681 - DNA, 60 bp, Xenorhabdus bovienii
  Promoter sequence Name=Xb4151_4152.C443.promoter98; Position on contig=162151..162210bp; Strand=-
agtctcaatcgaatcggaagccctgcaatgtgtgttgcggggctttttatattctgaatt

SEQ ID NO: 12682 - DNA, 60 bp, Xenorhabdus bovienii
  Promoter sequence Name=Xb4151_4152.C443.promoter99; Position on contig=162874..162933bp; Strand=-; Gene name=IspA
ttctcatctgttctaattctgcacttgtcttcgaatcggtttttgcgtagaattcgcgcc

SEQ ID NO: 12683 - DNA, 60 bp, Xenorhabdus bovienii
  Promoter sequence Name=Xb4151_4152.C443.promoter100; Position on contig=162810..162869bp; Strand=+; Gene name=IspA
actccgctttccgcgcacccccttaaatatctttccagagcgcgctataaaatattcaca

SEQ ID NO: 12684 - DNA, 60 bp, Xenorhabdus bovienii
  Promoter sequence Name=Xb4151_4152.C443.promoter101; Position on contig=164993..165052bp; Strand=-; Gene name=Nlp
atcatttttttaatcctttcctattaaatttgaagccacattagtggtataactaaagcg

SEQ ID NO: 12685 - DNA, 60 bp, Xenorhabdus bovienii
  Promoter sequence Name=Xb4151_4152.C443.promoter102; Position on contig=164811..164870bp; Strand=+; Gene name=Nlp
aactcacctacaccggtcaactccattgccgtataccactcttttttcataatgtttctc

SEQ ID NO: 12686 - DNA, 60 bp, Xenorhabdus bovienii
  Promoter sequence Name=Xb4151_4152.C443.promoter103; Position on contig=166807..166866bp; Strand=+; Gene name=ArgR
tattttagttttttcttctcttccttgaataaaaattcactctttcgcataatcatagct

SEQ ID NO: 12687 - DNA, 60 bp, Xenorhabdus bovienii
  Promoter sequence Name=Xb4151_4152.C443.promoter104; Position on contig=168888..168947bp; Strand=-; Gene name=Fbp
tgggatgattgataggctattgcatttctaatctcagcattgatggttagaatagtgaca

SEQ ID NO: 12688 - DNA, 60 bp, Xenorhabdus bovienii
  Promoter sequence Name=Xb4151_4152.C443.promoter105; Position on contig=170182..170241bp; Strand=+; Gene name=Ppa
attatctatattgttcccttaagttctatacatactctttttctatttatatttgttcac

SEQ ID NO: 12689 - DNA, 60 bp, Xenorhabdus bovienii
  Promoter sequence Name=Xb4151_4152.C443.promoter106; Position on contig=176968..177027bp; Strand=-; Gene name=MsrA
tatagattttatggttattagttgcttgtatatctttcaaactttaccagaattaattta

SEQ ID NO: 12690 - DNA, 60 bp, Xenorhabdus bovienii
  Promoter sequence Name=Xb4151_4152.C443.promoter107; Position on contig=176934..176993bp; Strand=+; Gene name=MsrA
gggggtaaaatccaacgatataaaaatgctgcaataaattaattctggtaaagtttgaaa

SEQ ID NO: 12691 - DNA, 60 bp, Xenorhabdus bovienii
  Promoter sequence Name=Xb4151_4152.C443.promoter108; Position on contig=177701..177760bp; Strand=+
gtcagctcagtgttataatcattagactaaatttatatatcttacggtaaaatgccgtaa

SEQ ID NO: 12692 - DNA, 60 bp, Xenorhabdus bovienii
  Promoter sequence Name=Xb4151_4152.C443.promoter109; Position on contig=179657..179716bp; Strand=+
attatgttgctttaacatggaattgccttatattttgtttcaaatgttatcaatttgttt

SEQ ID NO: 12693 - DNA, 60 bp, Xenorhabdus bovienii
  Promoter sequence Name=Xb4151_4152.C443.promoter110; Position on contig=181247..181306bp; Strand=-
ctatttttttgcgcgttttttgagataaagtattcgctattccagtacaaaatacgctaa

SEQ ID NO: 12694 - DNA, 60 bp, Xenorhabdus bovienii
  Promoter sequence Name=Xb4151_4152.C443.promoter111; Position on contig=180858..180917bp; Strand=+
gacgcccatcaccggaacaccatcctcaatcaatgcaatattaacggtaaattcaccgtt

SEQ ID NO: 12695 - DNA, 60 bp, Xenorhabdus bovienii
  Promoter sequence Name=Xb4151_4152.C443.promoter112; Position on contig=182029..182088bp; Strand=-
gcaatgccagcgttttttgtttgtattttttcattacctatctcgattaaaatccttcgc

SEQ ID NO: 12696 - DNA, 60 bp, Xenorhabdus bovienii
  Promoter sequence Name=Xb4151_4152.C443.promoter113; Position on contig=183665..183724bp; Strand=-; Gene name=SpoU
acgcgttttttctttcacccgtaccttagttttttttattgtgcgggtatagttacgcgt

SEQ ID NO: 12697 - DNA, 60 bp, Xenorhabdus bovienii
  Promoter sequence Name=Xb4151_4152.C443.promoter114; Position on contig=184542..184601bp; Strand=-; Gene name=VacB
aaatacagagaatcagggcggcttctgctgccctccatttttcaggtatcatttaagata

SEQ ID NO: 12698 - DNA, 60 bp, Xenorhabdus bovienii
  Promoter sequence Name=Xb4151_4152.C443.promoter115; Position on contig=187551..187610bp; Strand=-
tgcccacataatgtgaacagataatgataaaccaataaacatatattttatttcttggtt

SEQ ID NO: 12699 - DNA, 60 bp, Xenorhabdus bovienii
  Promoter sequence Name=Xb4151_4152.C443.promoter116; Position on contig=189054..189113bp; Strand=-
aaataacagaagtgagaaaaaatactgaaaggtgctaaatgagatggtagaatccatttt

SEQ ID NO: 12700 - DNA, 60 bp, Xenorhabdus bovienii
  Promoter sequence Name=Xb4151_4152.C443.promoter117; Position on contig=191773..191832bp; Strand=-; Gene name=HflX
tcaggaagacaaacaaggtatcattttgtcagccatttcaaggcgtttatagtcgtgtag

SEQ ID NO: 12701 - DNA, 60 bp, Xenorhabdus bovienii
  Promoter sequence Name=Xb4151_4152.C443.promoter118; Position on contig=193156..193215bp; Strand=-; Gene name=Hfq
gtgtccgtgcctgacgtaaataaaaacataggtagggagactttacctatgttttttcct

SEQ ID NO: 12702 - DNA, 60 bp, Xenorhabdus bovienii
  Promoter sequence Name=Xb4151_4152.C443.promoter119; Position on contig=198363..198422bp; Strand=-
gttatggttattggttaaactatttaactgataaacctaaatctcattaggctctaattc

SEQ ID NO: 12703 - DNA, 60 bp, Xenorhabdus bovienii
  Promoter sequence Name=Xb4151_4152.C443.promoter120; Position on contig=200099..200158bp; Strand=-
ataaataaattgtcgataaagcacttgctatccagatacaacaagtccataatgccgcct

SEQ ID NO: 12704 - DNA, 60 bp, Xenorhabdus bovienii
  Promoter sequence Name=Xb4151_4152.C443.promoter121; Position on contig=199816..199875bp; Strand=+
taaatgaaataaattattttaatttatcaataagttaaatatgatttattattttaaata

SEQ ID NO: 12705 - DNA, 60 bp, Xenorhabdus bovienii
  Promoter sequence Name=Xb4151_4152.C443.promoter122; Position on contig=200686..200745bp; Strand=-
ccaatatcttatctataaacttctactgatttcttgcatgtctctgaaataatagcctga

SEQ ID NO: 12706 - DNA, 60 bp, Xenorhabdus bovienii
  Promoter sequence Name=Xb4151_4152.C443.promoter123; Position on contig=200645..200704bp; Strand=+
tattaaatttcgatgaactttgttgagataggaaatatgggtcaggctattatttcagag

SEQ ID NO: 12707 - DNA, 60 bp, Xenorhabdus bovienii
  Promoter sequence Name=Xb4151_4152.C443.promoter124; Position on contig=201028..201087bp; Strand=+; Gene name=PorB
taacactaaacatacaactaacctctaataagatttgtgcttgtcggaataattttaggg

SEQ ID NO: 12708 - DNA, 60 bp, Xenorhabdus bovienii
  Promoter sequence Name=Xb4151_4152.C443.promoter125; Position on contig=213256..213315bp; Strand=-
tcgcataaaaggacacttatgtaatagttaactaatgatactatcagtaaaatgtcattt

SEQ ID NO: 12709 - DNA, 60 bp, Xenorhabdus bovienii
  Promoter sequence Name=Xb4151_4152.C443.promoter126; Position on contig=213229..213288bp; Strand=+
atatgtcaccgcgtgacatattgtgtcaaatgacattttactgatagtatcattagttaa

SEQ ID NO: 12710 - DNA, 60 bp, Xenorhabdus bovienii
  Promoter sequence Name=Xb4151_4152.C443.promoter127; Position on contig=216652..216711bp; Strand=-; Gene name=InsB
taatacacgacccaacaatcagttagagtatatcaggcttattctgctactattgctgac

SEQ ID NO: 12711 - DNA, 60 bp, Xenorhabdus bovienii
  Promoter sequence Name=Xb4151_4152.C443.promoter128; Position on contig=217249..217308bp; Strand=-
ttcagttggcatacacctatcaagcttgcaaaccgggagtcaaagagcagactattgata

SEQ ID NO: 12712 - DNA, 60 bp, Xenorhabdus bovienii
  Promoter sequence Name=Xb4151_4152.C443.promoter129; Position on contig=217625..217684bp; Strand=-
taatccaaaagccggaatgatcggtcatgtattaaatggttagttgctgtgatatgcttc

SEQ ID NO: 12713 - DNA, 60 bp, Xenorhabdus bovienii
  Promoter sequence Name=Xb4151_4152.C443.promoter130; Position on contig=218655..218714bp; Strand=-
gatactggaattcaaaaaaacctagaagatagaaaaggaaaaacgaataaattctggatc

SEQ ID NO: 12714 - DNA, 60 bp, Xenorhabdus bovienii
  Promoter sequence Name=Xb4151_4152.C443.promoter131; Position on contig=218189..218248bp; Strand=+
tttgtctattatatgaccattaaattcaaatgcacatatcccattgatataataggatat

SEQ ID NO: 12715 - DNA, 60 bp, Xenorhabdus bovienii
  Promoter sequence Name=Xb4151_4152.C443.promoter132; Position on contig=219186..219245bp; Strand=-
ggcacgcccgccgaagatcagcgtatccgctggctgtacgaaccgggtaaacttacgccg

SEQ ID NO: 12716 - DNA, 60 bp, Xenorhabdus bovienii
  Promoter sequence Name=Xb4151_4152.C443.promoter133; Position on contig=218984..219043bp; Strand=+
tcatactgccccacaaaacgcaggttgcagctaacgtgataatccgcatcattggaggcc

SEQ ID NO: 12717 - DNA, 60 bp, Xenorhabdus bovienii
  Promoter sequence Name=Xb4151_4152.C443.promoter134; Position on contig=221966..222025bp; Strand=+
tcatagaatccgcccgaaccttcagccttcattgtaataccagctggtattctggaaggg

SEQ ID NO: 12718 - DNA, 60 bp, Xenorhabdus bovienii; identical to SEQ ID NO: 11022
  Promoter sequence Name=Xb4151_4152.C443.promoter135; Position on contig=224468..224527bp; Strand=-; Gene name=InsB

SEQ ID NO: 12719 - DNA, 60 bp, Xenorhabdus bovienii
  Promoter sequence Name=Xb4151_4152.C443.promoter136; Position on contig=227218..227277bp; Strand=-
acacaacaaataaaaatcacccaattaatgaggtaagttaataatattattatgcattaa

SEQ ID NO: 12720 - DNA, 60 bp, Xenorhabdus bovienii
  Promoter sequence Name=Xb4151_4152.C443.promoter137; Position on contig=228896..228955bp; Strand=-
aaactgcggacacggcgcaaagccctgccattttcatcatattccggtgaaattacgtta

SEQ ID NO: 12721 - DNA, 60 bp, Xenorhabdus bovienii
  Promoter sequence Name=Xb4151_4152.C443.promoter138; Position on contig=228645..228704bp; Strand=+
tagaataattgtctttatagatgatcattgtttcgtgaacaggattgcaacatagtgtaa

SEQ ID NO: 12722 - DNA, 60 bp, Xenorhabdus bovienii
  Promoter sequence Name=Xb4151_4152.C443.promoter139; Position on contig=229935..229994bp; Strand=+; Gene name=GlsA
acgctattgcataaaaatagtgttttatacagaaataacgttgtatacaagggctccttt

SEQ ID NO: 12723 - DNA, 60 bp, Xenorhabdus bovienii
  Promoter sequence Name=Xb4151_4152.C443.promoter140; Position on contig=231769..231828bp; Strand=+; Gene name=FecB
taaaaataagaatcaatatgaaattgattcttatttaattgacatagtaatgttgccact

SEQ ID NO: 12724 - DNA, 60 bp, Xenorhabdus bovienii
  Promoter sequence Name=Xb4151_4152.C443.promoter141; Position on contig=236957..237016bp; Strand=-
accggaactttcccgacacaaagatgcagatcagaagcattatgctttacactaagagcc

SEQ ID NO: 12725 - DNA, 60 bp, Xenorhabdus bovienii
  Promoter sequence Name=Xb4151_4152.C443.promoter142; Position on contig=238981..239040bp; Strand=-; Gene name=RimK
catttgccatttataatgttggctcacatactgtgagccaaatcacgctaacattgccaa

SEQ ID NO: 12726 - DNA, 60 bp, Xenorhabdus bovienii
  Promoter sequence Name=Xb4151_4152.C443.promoter143; Position on contig=240914..240973bp; Strand=-; Gene name=PppA
taatttatcactaaaaggattagcaataaaaaatcaattaaaacagtcattatgaaataa

SEQ ID NO: 12727 - DNA, 60 bp, Xenorhabdus bovienii
  Promoter sequence Name=Xb4151_4152.C443.promoter144; Position on contig=240873..240932bp; Strand=+; Gene name=PppA
catagaaagcacgatatgcacttgcgagccggctcgcatatttatttcataatgactgtt

SEQ ID NO: 12728 - DNA, 60 bp, Xenorhabdus bovienii
  Promoter sequence Name=Xb4151_4152.C443.promoter145; Position on contig=243517..243576bp; Strand=-
aacaaataattgcagattttgcggtttttaaatcgaaatatgcaacttattatacgtgcc

SEQ ID NO: 12729 - DNA, 60 bp, Xenorhabdus bovienii
  Promoter sequence Name=Xb4151_4152.C443.promoter146; Position on contig=243248..243307bp; Strand=+
tccggtttgctggatcatttttaccagctcttgggcatcactctttttaaattgcgcatc

SEQ ID NO: 12730 - DNA, 60 bp, Xenorhabdus bovienii
  Promoter sequence Name=Xb4151_4152.C443.promoter147; Position on contig=245528..245587bp; Strand=-; Gene name=LysA
caataaggcaggaaggaaaatatccatttagctgtagtctatttatttatgatatcgttt

SEQ ID NO: 12731 - DNA, 60 bp, Xenorhabdus bovienii
  Promoter sequence Name=Xb4151_4152.C443.promoter148; Position on contig=245487..245546bp; Strand=+; Gene name=LysA
atgctttatctacatcacatgattagtttgaaaaataatcaaaacgatatcataaataaa

SEQ ID NO: 12732 - DNA, 60 bp, Xenorhabdus bovienii
  Promoter sequence Name=Xb4151_4152.C443.promoter149; Position on contig=249476..249535bp; Strand=-
gattgtaattaagatgtaaatatattgataaatacgttttcctcatctaaaaagaaggac

SEQ ID NO: 12733 - DNA, 60 bp, Xenorhabdus bovienii
  Promoter sequence Name=Xb4151_4152.C443.promoter150; Position on contig=249389..249448bp; Strand=+
actaaaaacaaaataatgctgagagcggtcatagtaaaaactcctgttaatctcaggtga

SEQ ID NO: 12734 - DNA, 60 bp, Xenorhabdus bovienii; identical to SEQ ID NO: 11537
  Promoter sequence Name=Xb4151_4152.C443.promoter151; Position on contig=251275..251334bp; Strand=-

SEQ ID NO: 12735 - DNA, 60 bp, Xenorhabdus bovienii
  Promoter sequence Name=Xb4151_4152.C443.promoter152; Position on contig=251078..251137bp; Strand=+
ggattttgtactcacaatatattgcccgtctattacgttgacagtggtaggtttgctatt

SEQ ID NO: 12736 - DNA, 60 bp, Xenorhabdus bovienii
  Promoter sequence Name=Xb4151_4152.C443.promoter153; Position on contig=253059..253118bp; Strand=-
gcgtttattggccgctccaccatttcactgatgccaaacatcgctgctatatttgtattc

SEQ ID NO: 12737 - DNA, 60 bp, Xenorhabdus bovienii
  Promoter sequence Name=Xb4151_4152.C443.promoter154; Position on contig=253343..253402bp; Strand=-; Gene name=NqrA
atcagttaaatcatatgctacagattacccgatggtattccttggggtaatatagcgact

SEQ ID NO: 12738 - DNA, 60 bp, Xenorhabdus bovienii
  Promoter sequence Name=Xb4151_4152.C443.promoter155; Position on contig=253329..253388bp; Strand=+; Gene name=NqrA
ttttttattactgaagtcgctatattaccccaaggaataccatcgggtaatctgtagcat

SEQ ID NO: 12739 - DNA, 60 bp, Xenorhabdus bovienii; identical to SEQ ID NO: 10698
  Promoter sequence Name=Xb4151_4152.C443.promoter156; Position on contig=260982..261041bp; Strand=-

SEQ ID NO: 12740 - DNA, 60 bp, Xenorhabdus bovienii; identical to SEQ ID NO: 12218
  Promoter sequence Name=Xb4151_4152.C443.promoter157; Position on contig=261519..261578bp; Strand=-; Gene name=InsB

SEQ ID NO: 12741 - DNA, 60 bp, Xenorhabdus bovienii
  Promoter sequence Name=Xb4151_4152.C443.promoter158; Position on contig=261662..261721bp; Strand=+
ttaatacatgacctgaatttgtgccataccagccattaatcaatatatagatttggctga

SEQ ID NO: 12742 - DNA, 60 bp, Xenorhabdus bovienii; identical to SEQ ID NO: 10698
  Promoter sequence Name=Xb4151_4152.C443.promoter159; Position on contig=263479..263538bp; Strand=-

SEQ ID NO: 12743 - DNA, 60 bp, Xenorhabdus bovienii; identical to SEQ ID NO: 11022
  Promoter sequence Name=Xb4151_4152.C443.promoter160; Position on contig=264089..264148bp; Strand=-; Gene name=InsB

SEQ ID NO: 12744 - DNA, 60 bp, Xenorhabdus bovienii
  Promoter sequence Name=Xb4151_4152.C443.promoter161; Position on contig=268228..268287bp; Strand=-
tttccttcccgtgtcgcatcaaaaataatgttgttcagctccgttgttagaatatcgttc

SEQ ID NO: 12745 - DNA, 60 bp, Xenorhabdus bovienii
  Promoter sequence Name=Xb4151_4152.C443.promoter162; Position on contig=267725..267784bp; Strand=+
gttaacacaggcaggacgctctgctttgtgccatttgcacgccttgtcaaaatattccgc

SEQ ID NO: 12746 - DNA, 60 bp, Xenorhabdus bovienii
  Promoter sequence Name=Xb4151_4152.C443.promoter163; Position on contig=268871..268930bp; Strand=-; Gene name=PurM
gtagcccccaggcggttgcatttgaatgaataaaacagaacggtggcaattctaacagtc

SEQ ID NO: 12747 - DNA, 60 bp, Xenorhabdus bovienii
  Promoter sequence Name=Xb4151_4152.C443.promoter164; Position on contig=268630..268689bp; Strand=+; Gene name=PurM
aattcatatccgggtgctatttctcagcaccccaatagaaccccagttaatattaattag

SEQ ID NO: 12748 - DNA, 60 bp, Xenorhabdus bovienii
  Promoter sequence Name=Xb4151_4152.C443.promoter165; Position on contig=270756..270815bp; Strand=+; Gene name=RimL
acccagtaaatcggctatttattcatctaacaaaatattaatctggcaataattatgtat

SEQ ID NO: 12749 - DNA, 60 bp, Xenorhabdus bovienii
  Promoter sequence Name=Xb4151_4152.C443.promoter166; Position on contig=277272..277331bp; Strand=-
cttttaattcaatccttccgtttcaaatggaatgcctactttggttttatactcacgggt

SEQ ID NO: 12750 - DNA, 60 bp, Xenorhabdus bovienii
  Promoter sequence Name=Xb4151_4152.C443.promoter167; Position on contig=277593..277652bp; Strand=-
atcaggctttttatcttgcataatttattccctcatttaatcaacaataacattgctaaa

SEQ ID NO: 12751 - DNA, 60 bp, Xenorhabdus bovienii; identical to SEQ ID NO: 12223
  Promoter sequence Name=Xb4151_4152.C443.promoter168; Position on contig=277394..277453bp; Strand=+

SEQ ID NO: 12752 - DNA, 60 bp, Xenorhabdus bovienii
  Promoter sequence Name=Xb4151_4152.C444.promoter1; Position on contig= 32..91bp; Strand=+
aacagagttccaggctcttttttttgctttccattgattttatccgttctcatcactttc

SEQ ID NO: 12753 - DNA, 60 bp, Xenorhabdus bovienii
  Promoter sequence Name=Xb4151_4152.C444.promoter2; Position on contig= 2966..3025bp; Strand=-; Gene name=DnaG
atatggcaatttgtgattattgcaatatagcctgatgaaataggttctaaaccaaaattt

SEQ ID NO: 12754 - DNA, 60 bp, Xenorhabdus bovienii
  Promoter sequence Name=Xb4151_4152.C444.promoter3; Position on contig= 4828..4887bp; Strand=-; Gene name=RpsU
aaactactgcagttaaaggccgtgctttccccaaaggaagcgcggcttattctcgttcat

SEQ ID NO: 12755 - DNA, 60 bp, Xenorhabdus bovienii
  Promoter sequence Name=Xb4151_4152.C444.promoter4; Position on contig= 5357..5416bp; Strand=-; Gene name=QRI7
gataaatctgtctctatttacatgctgactattttttctgtttagtctataatcagtccc

SEQ ID NO: 12756 - DNA, 60 bp, Xenorhabdus bovienii
  Promoter sequence Name=Xb4151_4152.C444.promoter5; Position on contig= 5468..5527bp; Strand=+; Gene name=QRI7
gatgatggtacactgacgcccgtttaggggaatacagtatatgcgaatagaatagttgca

SEQ ID NO: 12757 - DNA, 60 bp, Xenorhabdus bovienii
  Promoter sequence Name=Xb4151_4152.C444.promoter6; Position on contig= 7716..7775bp; Strand=-
tgatgatatccgccatttttatattaaataaaaatggcggatatcaatattatctgatag

SEQ ID NO: 12758 - DNA, 60 bp, Xenorhabdus bovienii
  Promoter sequence Name=Xb4151_4152.C444.promoter7; Position on contig= 9042..9101bp; Strand=-; Gene name=FolB
cgttcaatcaccacaccaacactttttgcctgagcaacagcacccggtttactgacttta

SEQ ID NO: 12759 - DNA, 60 bp, Xenorhabdus bovienii
  Promoter sequence Name=Xb4151_4152.C444.promoter8; Position on contig= 15209..15268bp; Strand=+; Gene name=RfaE
accgagcttttcctgctggatcttgctggcattcagttaggttatggtaatatccgcaac

SEQ ID NO: 12760 - DNA, 60 bp, Xenorhabdus bovienii
  Promoter sequence Name=Xb4151_4152.C444.promoter9; Position on contig= 17149..17208bp; Strand=-
ttatgaaacctggcccgcaatcatttatgctttcgctatcaggtattaaaatagcgacaa

SEQ ID NO: 12761 - DNA, 60 bp, Xenorhabdus bovienii
  Promoter sequence Name=Xb4151_4152.C444.promoter10; Position on contig=17658..17717bp; Strand=-; Gene name=RibB
gcagcgaaaatcatatcaccttcattttcacgattttcgtcatccagtaccatcactccg

SEQ ID NO: 12762 - DNA, 60 bp, Xenorhabdus bovienii
  Promoter sequence Name=Xb4151_4152.C444.promoter11; Position on contig=17457..17516bp; Strand=+; Gene name=RibB
ataacagcatcaatcaagtgcttgcgcttgcctgttgttttgttgcgtattttttgcagc

SEQ ID NO: 12763 - DNA, 60 bp, Xenorhabdus bovienii
  Promoter sequence Name=Xb4151_4152.C444.promoter12; Position on contig=18558..18617bp; Strand=-
tctgggcaatttttttcccagttcaaaccaagcacgtgagtagcggttatcttcaagggc

SEQ ID NO: 12764 - DNA, 60 bp, Xenorhabdus bovienii
  Promoter sequence Name=Xb4151_4152.C444.promoter13; Position on contig=18387..18446bp; Strand=+
atcatttttgattggctgtattcaaggaagaaaagtcgtaatcttgccataatatttttg

SEQ ID NO: 12765 - DNA, 60 bp, Xenorhabdus bovienii
  Promoter sequence Name=Xb4151_4152.C444.promoter14; Position on contig=21270..21329bp; Strand=-; Gene name=TolC
ttaatgagctatcgttcctgattaaaaaacgttatattaaaaacgctatactataaagaa

SEQ ID NO: 12766 - DNA, 60 bp, Xenorhabdus bovienii
  Promoter sequence Name=Xb4151_4152.C444.promoter15; Position on contig=22858..22917bp; Strand=-; Gene name=MutT
ctcataaagtctcctaaatatttttttaattgcctatcattaaaatgtatttttccagat

SEQ ID NO: 12767 - DNA, 60 bp, Xenorhabdus bovienii
  Promoter sequence Name=Xb4151_4152.C444.promoter16; Position on contig=22783..22842bp; Strand=+; Gene name=MutT
ttagggaggctgtttgtgccatcttgccttatttttcggcgtgtttgtatcatcaaagcg

SEQ ID NO: 12768 - DNA, 60 bp, Xenorhabdus bovienii
  Promoter sequence Name=Xb4151_4152.C444.promoter17; Position on contig=23568..23627bp; Strand=+; Gene name=Icc
aacgggaagtgtgtcccagtcagcagatcttttttgtaaagaagcgctagaataattctt

SEQ ID NO: 12769 - DNA, 60 bp, Xenorhabdus bovienii
  Promoter sequence Name=Xb4151_4152.C444.promoter18; Position on contig=29388..29447bp; Strand=+; Gene name=PlsC
ggcagtaacaaaacgatttttgttacacaacaatcacaatagcaggccagatttattctg

SEQ ID NO: 12770 - DNA, 60 bp, Xenorhabdus bovienii
  Promoter sequence Name=Xb4151_4152.C444.promoter19; Position on contig=30385..30444bp; Strand=+; Gene name=SufI
ttgggtaattcatcccagtaattatttgaattgtgaagtgcttgcgttcatataagcaat

SEQ ID NO: 12771 - DNA, 60 bp, Xenorhabdus bovienii
  Promoter sequence Name=Xb4151_4152.C444.promoter20; Position on contig=32065..32124bp; Strand=+; Gene name=FolA
gttctgaataaattgctaatcttatcgactgagagtagccctttccgtatagtgtccaaa

SEQ ID NO: 12772 - DNA, 60 bp, Xenorhabdus bovienii
  Promoter sequence Name=Xb4151_4152.C444.promoter21; Position on contig=39616..39675bp; Strand=-; Gene name=DjlA
aattcctcaatgccctgagcgcaattttgcattatcatactattcattaagctccgtgcc

SEQ ID NO: 12773 - DNA, 60 bp, Xenorhabdus bovienii
  Promoter sequence Name=Xb4151_4152.C444.promoter22; Position on contig=39545..39604bp; Strand=+; Gene name=DjlA
aacgctcagagactaacgcacttgataaatatgcgccagagtaaagttaaactttactaa

SEQ ID NO: 12774 - DNA, 60 bp, Xenorhabdus bovienii
  Promoter sequence Name=Xb4151_4152.C444.promoter23; Position on contig=41184..41243bp; Strand=-; Gene name=HepA
atgagatgcccctgtattttaatctcacaccgtaaatcatatgctgataaaatctgcccc

SEQ ID NO: 12775 - DNA, 60 bp, Xenorhabdus bovienii
  Promoter sequence Name=Xb4151_4152.C444.promoter24; Position on contig=44352..44411bp; Strand=-; Gene name=PolB
acttttgcaggtgacggcttgctcctcttgaattaacatatcgcccctctaatgggcaat

SEQ ID NO: 12776 - DNA, 60 bp, Xenorhabdus bovienii
  Promoter sequence Name=Xb4151_4152.C444.promoter25; Position on contig=49265..49324bp; Strand=-; Gene name=InsB
tttgaaaacacgtatgaattcgcagtgcagtatcagcgaagtactgataaagtatcgcaa

SEQ ID NO: 12777 - DNA, 60 bp, Xenorhabdus bovienii
  Promoter sequence Name=Xb4151_4152.C444.promoter26; Position on contig=49644..49703bp; Strand=+; Gene name=InsB
aaatgtattttttcattgtgattgaatatgattatggtgtttttatttattattattaat

SEQ ID NO: 12778 - DNA, 60 bp, Xenorhabdus bovienii
  Promoter sequence Name=Xb4151_4152.C444.promoter27; Position on contig=51606..51665bp; Strand=-
agactatacataattcaataaattgatgtcacgacctatttttgatttatatatggatga

SEQ ID NO: 12779 - DNA, 60 bp, Xenorhabdus bovienii
  Promoter sequence Name=Xb4151_4152.C444.promoter28; Position on contig=51450..51509bp; Strand=+
catataaatataattaatatttctttgcggtatagaaaagtttaatttacattccttact

SEQ ID NO: 12780 - DNA, 60 bp, Xenorhabdus bovienii
  Promoter sequence Name=Xb4151_4152.C444.promoter29; Position on contig=52530..52589bp; Strand=+; Gene name=XerC
tttaattttgttatcaatttttcatatgttctattatgggaatgttattatggtttttta

SEQ ID NO: 12781 - DNA, 60 bp, Xenorhabdus bovienii
  Promoter sequence Name=Xb4151_4152.C444.promoter30; Position on contig=54767..54826bp; Strand=-; Gene name=TerC
atatacccaaatagatttcaagctgccgcccacaaagcagcaacttaaaaaataagggta

SEQ ID NO: 12782 - DNA, 60 bp, Xenorhabdus bovienii
  Promoter sequence Name=Xb4151_4152.C444.promoter31; Position on contig=58313..58372bp; Strand=-
atgattttttatcacaaaatttgtttgacttttggtcttggaaaagaaatcataaaaaaa

SEQ ID NO: 12783 - DNA, 60 bp, Xenorhabdus bovienii
  Promoter sequence Name=Xb4151_4152.C444.promoter32; Position on contig=58272..58331bp; Strand=+
aatattgttgttaagtctatgatagaaaacaatctgatttctttttttatgatttctttt

SEQ ID NO: 12784 - DNA, 60 bp, Xenorhabdus bovienii
  Promoter sequence Name=Xb4151_4152.C444.promoter33; Position on contig=62547..62606bp; Strand=+
ttgatttacttgtggtaggagctatgctggacgctatgcctatgattaacattagggatt

SEQ ID NO: 12785 - DNA, 60 bp, Xenorhabdus bovienii
  Promoter sequence Name=Xb4151_4152.C444.promoter34; Position on contig=63713..63772bp; Strand=-; Gene name=WecD
atccagataaccgcgatatgtatttcgtagctgtcatattcttgatctatactatcgccc

SEQ ID NO: 12786 - DNA, 60 bp, Xenorhabdus bovienii
  Promoter sequence Name=Xb4151_4152.C444.promoter35; Position on contig=64773..64832bp; Strand=-
taatttaattttttctaaatcctgatttaaataattttaaaagaagttataaattgaaaa

SEQ ID NO: 12787 - DNA, 60 bp, Xenorhabdus bovienii
  Promoter sequence Name=Xb4151_4152.C444.promoter36; Position on contig=65152..65211bp; Strand=-; Gene name=AprE (BS)
cgggttaacgccatcgcggggatcgttccctgaaagcagaagcaggctaaaacggtaaat

SEQ ID NO: 12788 - DNA, 60 bp, Xenorhabdus bovienii
  Promoter sequence Name=Xb4151_4152.C444.promoter37; Position on contig=65302..65361bp; Strand=+; Gene name=AprE (BS)
gaaaaaaccggtcgctggcggctgtcttgcacattgctcataaatgatatttttgcaaat

SEQ ID NO: 12789 - DNA, 60 bp, Xenorhabdus bovienii
  Promoter sequence Name=Xb4151_4152.C444.promoter38; Position on contig=69265..69324bp; Strand=+
gacatttggcttccaatattattacattcaataaattcattgaatgcaataatatcaaag

SEQ ID NO: 12790 - DNA, 60 bp, Xenorhabdus bovienii
  unsure (1)..(60): unsure at all n locations
  Promoter sequence Name=Xb4151_4152.C444.promoter39; Position on contig=71160..71219bp; Strand=-; Gene name=AraJ
nnnnnnnnnnnnnnnnnnnnnnnnnnnnnnnnnnnnntaatttctgatataacagatttc

SEQ ID NO: 12791 - DNA, 60 bp, Xenorhabdus bovienii; identical to SEQ ID NO: 10698
  Promoter sequence Name=Xb4151_4152.C444.promoter40; Position on contig=70700..70759bp; Strand=+; Gene name=AraJ

SEQ ID NO: 12792 - DNA, 60 bp, Xenorhabdus bovienii
  Promoter sequence Name=Xb4151_4152.C444.promoter41; Position on contig=71394..71453bp; Strand=-
ttttaatgcgacagagctgaaagtcctaacggtggggtttacgtcagtatcatttagacc

SEQ ID NO: 12793 - DNA, 60 bp, Xenorhabdus bovienii
  Promoter sequence Name=Xb4151_4152.C444.promoter42; Position on contig=71481..71540bp; Strand=+
tatcgagtcagttgcccatgtctttaattcgaaagccttcaaacggctacactatcctgt

SEQ ID NO: 12794 - DNA, 60 bp, Xenorhabdus bovienii
  Promoter sequence Name=Xb4151_4152.C444.promoter43; Position on contig=72210..72269bp; Strand=+
tttcattcaaactttcgctgttaattcgacagaaccttccagtgtgctatatacccgtcg

SEQ ID NO: 12795 - DNA, 60 bp, Xenorhabdus bovienii
  Promoter sequence Name=Xb4151_4152.C444.promoter44; Position on contig=75453..75512bp; Strand=-
aattaacactgcgacttgcttgaataattcagtaactataacatgcttattatatttaag

SEQ ID NO: 12796 - DNA, 60 bp, Xenorhabdus bovienii
  Promoter sequence Name=Xb4151_4152.C444.promoter45; Position on contig=75426..75485bp; Strand=+
gttccccagaatctgggatgcgttattcttaaatataataagcatgttatagttactgaa

SEQ ID NO: 12797 - DNA, 60 bp, Xenorhabdus bovienii
  Promoter sequence Name=Xb4151_4152.C444.promoter46; Position on contig=78313..78372bp; Strand=-
ttgtaaataattaaaataattaaaataattaaaataattaaaataattaaaataattggg

SEQ ID NO: 12798 - DNA, 60 bp, Xenorhabdus bovienii
  Promoter sequence Name=Xb4151_4152.C444.promoter47; Position on contig=78322..78381bp; Strand=+
tttaattattttaattattttaattattttaattattttaattatttacaatatttaatt

SEQ ID NO: 12799 - DNA, 60 bp, Xenorhabdus bovienii
  Promoter sequence Name=Xb4151_4152.C444.promoter48; Position on contig=79169..79228bp; Strand=+
taaaatgatttttattttatattttttggtcattggtactatatccgtaataaacattgc

SEQ ID NO: 12800 - DNA, 60 bp, Xenorhabdus bovienii
  Promoter sequence Name=Xb4151_4152.C444.promoter49; Position on contig=81926..81985bp; Strand=-
tcattacatccttatctcttattttcaatctatgcacaacatcctgttatgatagtttca

SEQ ID NO: 12801 - DNA, 60 bp, Xenorhabdus bovienii
  Promoter sequence Name=Xb4151_4152.C444.promoter50; Position on contig=81852..81911bp; Strand=+
cactactcgaacaaaccgactaataagctattcatgataatagcccgtataataaaccag

SEQ ID NO: 12802 - DNA, 60 bp, Xenorhabdus bovienii
  Promoter sequence Name=Xb4151_4152.C444.promoter51; Position on contig=86004..86063bp; Strand=-; Gene name=HrpA
cggtagattaataggataggttcttattgattgaaatattagaagtgtaacatatcttga

SEQ ID NO: 12803 - DNA, 60 bp, Xenorhabdus bovienii
  Promoter sequence Name=Xb4151_4152.C444.promoter52; Position on contig=85968..86027bp; Strand=+; Gene name=HrpA
acggatttgcggttcagatggatttcatcggggtgatcaagatatgttacacttctaata

SEQ ID NO: 12804 - DNA, 60 bp, Xenorhabdus bovienii
  Promoter sequence Name=Xb4151_4152.C444.promoter53; Position on contig=101792..101851bp; Strand=-; Gene name=FimA
gtcagcaacaaaatatcgacaccagggtttaatttagttaatttatctataattactcat

SEQ ID NO: 12805 - DNA, 60 bp, Xenorhabdus bovienii
  Promoter sequence Name=Xb4151_4152.C444.promoter54; Position on contig=107309..107368bp; Strand=-
ttcatctcgggtggagaaacattccattttctgaataacaatgctattaatatttactta

SEQ ID NO: 12806 - DNA, 60 bp, Xenorhabdus bovienii
  Promoter sequence Name=Xb4151_4152.C444.promoter55; Position on contig=107595..107654bp; Strand=+
aaagttaactctttgttaataataactagttcagcatgataaaaagttattttttgttta

SEQ ID NO: 12807 - DNA, 60 bp, Xenorhabdus bovienii
  Promoter sequence Name=Xb4151_4152.C444.promoter56; Position on contig=109552..109611bp; Strand=-
taatctgttattgatggaaaaggtacaaatcatcatttgtgcctttttattattgccaaa

SEQ ID NO: 12808 - DNA, 60 bp, Xenorhabdus bovienii
  Promoter sequence Name=Xb4151_4152.C444.promoter57; Position on contig=109267..109326bp; Strand=+
agatgtgaggcctaattttttttccaaagataggttcctgaaagtaatataatcgacacg

SEQ ID NO: 12809 - DNA, 60 bp, Xenorhabdus bovienii
  Promoter sequence Name=Xb4151_4152.C444.promoter58; Position on contig=110812..110871bp; Strand=-; Gene name=PntA
taaggttgattttattactgctatcaataaaacctaccaataaaaaataaaatagtcact

SEQ ID NO: 12810 - DNA, 60 bp, Xenorhabdus bovienii
  Promoter sequence Name=Xb4151_4152.C444.promoter59; Position on contig=110776..110835bp; Strand=+; Gene name=PntA
aggtcactttattttttcctgatattgttttcaattagtgactattttattttttattgg

SEQ ID NO: 12811 - DNA, 60 bp, Xenorhabdus bovienii
  Promoter sequence Name=Xb4151_4152.C444.promoter60; Position on contig=114552..114611bp; Strand=-; Gene name=XerC
gcattccaagtacagtcctgtacattttgatacccaagcatttttgccacaatattaaga

SEQ ID NO: 12812 - DNA, 60 bp, Xenorhabdus bovienii
  Promoter sequence Name=Xb4151_4152.C444.promoter61; Position on contig=114188..114247bp; Strand=+; Gene name=XerC
attgtattggtaatgagccacattttttacatagcgaaatcataattatgctcaaaaata

SEQ ID NO: 12813 - DNA, 60 bp, Xenorhabdus bovienii
  Promoter sequence Name=Xb4151_4152.C444.promoter62; Position on contig=116513..116572bp; Strand=-; Gene name=Crp
taagccggatcgctatattttgctgatctggctttcttttaccctgttatagttggtcat

SEQ ID NO: 12814 - DNA, 60 bp, Xenorhabdus bovienii
  Promoter sequence Name=Xb4151_4152.C444.promoter63; Position on contig=117821..117880bp; Strand=-; Gene name=GadB
tgttttataatatttttcaatttatgcgtttataaatttgttaatgttataatttttgtt

SEQ ID NO: 12815 - DNA, 60 bp, Xenorhabdus bovienii
  Promoter sequence Name=Xb4151_4152.C444.promoter64; Position on contig=117646..117705bp; Strand=+; Gene name=GadB
tttattaacttatgattaatattttaaaaagtatgttttatatcgattaaaatagattaa

SEQ ID NO: 12816 - DNA, 60 bp, Xenorhabdus bovienii
  Promoter sequence Name=Xb4151_4152.C444.promoter65; Position on contig=119972..120031bp; Strand=+
acgcttccaagccttttttattacttaataacactaaaaattaacgcaataatgataatt

SEQ ID NO: 12817 - DNA, 60 bp, Xenorhabdus bovienii; identical to SEQ ID NO: 10819
  Promoter sequence Name=Xb4151_4152.C444.promoter66; Position on contig=121236..121295bp; Strand=+; Gene name=UraA

SEQ ID NO: 12818 - DNA, 60 bp, Xenorhabdus bovienii
  Promoter sequence Name=Xb4151_4152.C444.promoter67; Position on contig=151491..151550bp; Strand=-; Gene name=TfoX
acgataaataatgccgaaacccattaaattcacatcatggtatgggataaaaacaggtaa

SEQ ID NO: 12819 - DNA, 60 bp, Xenorhabdus bovienii
  Promoter sequence Name=Xb4151_4152.C444.promoter68; Position on contig=153024..153083bp; Strand=-
gaactgtatatttatacagtatatcgctatttacttaaaagcaagcctattttttttcaa

SEQ ID NO: 12820 - DNA, 60 bp, Xenorhabdus bovienii
  Promoter sequence Name=Xb4151_4152.C444.promoter69; Position on contig=153014..153073bp; Strand=+
gcgaagcgctttgaaaaaaaataggcttgcttttaagtaaatagcgatatactgtataaa

SEQ ID NO: 12821 - DNA, 60 bp, Xenorhabdus bovienii
  Promoter sequence Name=Xb4151_4152.C444.promoter70; Position on contig=153847..153906bp; Strand=+; Gene name=OmpA
ttttgtgccacgagtcacagtgtacttgtaagtttttaagttcgttgtagactttactca

SEQ ID NO: 12822 - DNA, 60 bp, Xenorhabdus bovienii
  Promoter sequence Name=Xb4151_4152.C444.promoter71; Position on contig=155855..155914bp; Strand=-; Gene name=LonB (BS)
ttatattcgtcaaagtgatagctacatatagtgaaaagggaaacgtttattatacaagat

SEQ ID NO: 12823 - DNA, 60 bp, Xenorhabdus bovienii
  Promoter sequence Name=Xb4151_4152.C444.promoter72; Position on contig=155728..155787bp; Strand=+; Gene name=LonB (BS)
aagcatagcaattatttcccttaattgctcacagcaacacagtatattagaatattttat

SEQ ID NO: 12824 - DNA, 60 bp, Xenorhabdus bovienii
  Promoter sequence Name=Xb4151_4152.C444.promoter73; Position on contig=157634..157693bp; Strand=+; Gene name=FabA
tcagttttatctgatcggagttgttcagcgtacaagtgtacgctatcctctgaccttaca

SEQ ID NO: 12825 - DNA, 60 bp, Xenorhabdus bovienii
  Promoter sequence Name=Xb4151_4152.C444.promoter74; Position on contig=158525..158584bp; Strand=-
catataagggtatcacttagaaccatgtggatgaaaaacgatcattgttttatttacatg

SEQ ID NO: 12826 - DNA, 60 bp, Xenorhabdus bovienii
  Promoter sequence Name=Xb4151_4152.C444.promoter75; Position on contig=162140..162199bp; Strand=-; Gene name=Uup
caagaaaatggccttgttgattttgctacaggagaaacactttgtgttccaataatcatc

SEQ ID NO: 12827 - DNA, 60 bp, Xenorhabdus bovienii
  Promoter sequence Name=Xb4151_4152.C444.promoter76; Position on contig=166399..166458bp; Strand=-
attttttattttttgataaggtgtgcaactttatgacatgtggctggtattagctataat

SEQ ID NO: 12828 - DNA, 60 bp, Xenorhabdus bovienii
  Promoter sequence Name=Xb4151_4152.C444.promoter77; Position on contig=166379..166438bp; Strand=+
caccaaaaaaattgctgcacattatagctaataccagccacatgtcataaagttgcacac

SEQ ID NO: 12829 - DNA, 60 bp, Xenorhabdus bovienii
  Promoter sequence Name=Xb4151_4152.C444.promoter78; Position on contig=168457..168516bp; Strand=-; Gene name=PyrD
tttctactctcaactcgtctatattttgtctgacagattaaaatttttatcattttttct

SEQ ID NO: 12830 - DNA, 60 bp, Xenorhabdus bovienii
  Promoter sequence Name=Xb4151_4152.C444.promoter79; Position on contig=169608..169667bp; Strand=-; Gene name=PepN
aattgaaaaatatcttcccgcacatttacattttgacaggatctctttaagatgctcggc

SEQ ID NO: 12831 - DNA, 60 bp, Xenorhabdus bovienii
  Promoter sequence Name=Xb4151_4152.C444.promoter80; Position on contig=172530..172589bp; Strand=-
aatatcatgttacatgagatatgagatgacaattcgcacgaaagcattaatatcctgctt

SEQ ID NO: 12832 - DNA, 60 bp, Xenorhabdus bovienii
  Promoter sequence Name=Xb4151_4152.C444.promoter81; Position on contig=174081..174140bp; Strand=+; Gene name=AsnS
aagatctgctcctgatgtggggcatttacagtaaatctatctaactatctaattcactat

SEQ ID NO: 12833 - DNA, 60 bp, Xenorhabdus bovienii
  Promoter sequence Name=Xb4151_4152.C444.promoter82; Position on contig=175618..175677bp; Strand=+; Gene name=OmpC
tggcttttttcattttatgattcaaaccatacgaaaaaagttccctgtaatttacatttt

SEQ ID NO: 12834 - DNA, 60 bp, Xenorhabdus bovienii
  Promoter sequence Name=Xb4151_4152.C444.promoter83; Position on contig=177066..177125bp; Strand=+; Gene name=TyrB
ttttttacgttttactttactgttttttatgacatttttttcactccgtaaactacttca

SEQ ID NO: 12835 - DNA, 60 bp, Xenorhabdus bovienii
  Promoter sequence Name=Xb4151_4152.C444.promoter84; Position on contig=179971..180030bp; Strand=-
ataattaccttttgttaatgtgattttttctctgctattgataaatttatcatgattcag

SEQ ID NO: 12836 - DNA, 60 bp, Xenorhabdus bovienii
  Promoter sequence Name=Xb4151_4152.C444.promoter85; Position on contig=182028..182087bp; Strand=-; Gene name=AphA
acttaaggtgcctttttcttttttagtgctaacataagctaatttattataataaaaaat

SEQ ID NO: 12837 - DNA, 60 bp, Xenorhabdus bovienii
  Promoter sequence Name=Xb4151_4152.C444.promoter86; Position on contig=182894..182953bp; Strand=-; Gene name=WbbJ
taatgagtttatgaataaattgtaaccttgtgttattgtgtagtgtgtctcattttagtg

SEQ ID NO: 12838 - DNA, 60 bp, Xenorhabdus bovienii
  Promoter sequence Name=Xb4151_4152.C444.promoter87; Position on contig=183708..183767bp; Strand=-; Gene name=MukB
caatttagaataaccaatcgtttttcgatttgggttttataatcgggtatgatggggaaa

SEQ ID NO: 12839 - DNA, 60 bp, Xenorhabdus bovienii
  Promoter sequence Name=Xb4151_4152.C444.promoter88; Position on contig=191199..191258bp; Strand=-
tgattactgtgccaaaataacagtagccagcattattactcaataaataaattaaactta

SEQ ID NO: 12840 - DNA, 60 bp, Xenorhabdus bovienii
  Promoter sequence Name=Xb4151_4152.C444.promoter89; Position on contig=191158..191217bp; Strand=+
gaaattgcgatcccgcatgaaaaactgcctcactgataagctaagtttaatttatttatt

SEQ ID NO: 12841 - DNA, 60 bp, Xenorhabdus bovienii
  Promoter sequence Name=Xb4151_4152.C444.promoter90; Position on contig=193190..193249bp; Strand=-; Gene name=LpxK
cagcattcaacaaaataacagagttaacggtgatacatagcttgtggtattctgaaccgc

SEQ ID NO: 12842 - DNA, 60 bp, Xenorhabdus bovienii
  Promoter sequence Name=Xb4151_4152.C444.promoter91; Position on contig=198455..198514bp; Strand=-; Gene name=HimA
tcttttcttaaccgacgaactaatttgcgaagtgattctatattagaatttatctgtctg

SEQ ID NO: 12843 - DNA, 60 bp, Xenorhabdus bovienii
  Promoter sequence Name=Xb4151_4152.C444.promoter92; Position on contig=200757..200816bp; Strand=-
gttttcgcatgttgtactcttgcaacagcgcaccaagaagatgtatatagaatcctggta

SEQ ID NO: 12844 - DNA, 60 bp, Xenorhabdus bovienii
  Promoter sequence Name=Xb4151_4152.C444.promoter93; Position on contig=200421..200480bp; Strand=+
cgtcgatttcgtcgccaacttggatttccagctcgccctgagcatttttgaattgttcta

SEQ ID NO: 12845 - DNA, 60 bp, Xenorhabdus bovienii
  Promoter sequence Name=Xb4151_4152.C444.promoter94; Position on contig=201599..201658bp; Strand=-; Gene name=AroA
tcgtcaggtaatcatgatgtgcttattccactcatctgcggagtgcgtataataagagat

SEQ ID NO: 12846 - DNA, 60 bp, Xenorhabdus bovienii
  Promoter sequence Name=Xb4151_4152.C444.promoter95; Position on contig=203021..203080bp; Strand=-; Gene name=SerC
aaacctcccgatgtgaatattcctcacttatttcaatagattaaagcgaaaattacaaat

SEQ ID NO: 12847 - DNA, 60 bp, Xenorhabdus bovienii
  Promoter sequence Name=Xb4151_4152.C444.promoter96; Position on contig=204284..204343bp; Strand=-; Gene name=AnsB
ggtgttttatatccatattattaataattcagtctatcaaccagttatacaataggttgc

SEQ ID NO: 12848 - DNA, 60 bp, Xenorhabdus bovienii
  Promoter sequence Name=Xb4151_4152.C444.promoter97; Position on contig=205722..205781bp; Strand=-
cccaaaaattattgttaattagagtttatttatttccagtttacataataaaatgacttt

SEQ ID NO: 12849 - DNA, 60 bp, Xenorhabdus bovienii
  Promoter sequence Name=Xb4151_4152.C444.promoter98; Position on contig=205764..205823bp; Strand=+
ttaacaataatttttgggaattgatagagcagacaaaaaaaacgccgtatgatatgcggc

SEQ ID NO: 12850 - DNA, 60 bp, Xenorhabdus bovienii
  Promoter sequence Name=Xb4151_4152.C444.promoter99; Position on contig=207859..207918bp; Strand=+; Gene name=FocA
ccatatcaaatttaggtcaatgatcgtttgttactatcattacgtgctaaaattaattaa

SEQ ID NO: 12851 - DNA, 60 bp, Xenorhabdus bovienii
  Promoter sequence Name=Xb4151_4152.C444.promoter100; Position on contig=211160..211219bp; Strand=+; Gene name=PflA
gtcattattctctattgaaataaaatgacatagactaaaggccccttcacaattggggcc

SEQ ID NO: 12852 - DNA, 60 bp, Xenorhabdus bovienii
  Promoter sequence Name=Xb4151_4152.C444.promoter101; Position on contig=212804..212863bp; Strand=-
aaaagcaataaaagtgaaaccagagatagaaatgtggatcaaacagttaatttagcaaga

SEQ ID NO: 12853 - DNA, 60 bp, Xenorhabdus bovienii
  Promoter sequence Name=Xb4151_4152.C444.promoter102; Position on contig=213091..213150bp; Strand=-
ttggattcgcataataagtgcaatttctaagaaaggcagtcagttgctatagtaggcatc

SEQ ID NO: 12854 - DNA, 60 bp, Xenorhabdus bovienii
  Promoter sequence Name=Xb4151_4152.C444.promoter103; Position on contig=213331..213390bp; Strand=-
cagcgcattagcactgccacgtattacagccgtacgccccattgtggcatgataacccct

SEQ ID NO: 12855 - DNA, 60 bp, Xenorhabdus bovienii
  Promoter sequence Name=Xb4151_4152.C444.promoter104; Position on contig=213088..213147bp; Strand=+
aaagatgcctactatagcaactgactgcctttcttagaaattgcacttattatgcgaatc

SEQ ID NO: 12856 - DNA, 60 bp, Xenorhabdus bovienii
  Promoter sequence Name=Xb4151_4152.C444.promoter105; Position on contig=213691..213750bp; Strand=-; Gene name=Tra5
ctggacttaatgtttaaggaatttctaactatcgtatttatttatctcataatttagtgt

SEQ ID NO: 12857 - DNA, 60 bp, Xenorhabdus bovienii
  Promoter sequence Name=Xb4151_4152.C444.promoter106; Position on contig=215093..215152bp; Strand=+
aagttaattgagcataaagatttttcttttttatttcttattcattctaaattagcttta

SEQ ID NO: 12858 - DNA, 60 bp, Xenorhabdus bovienii
  Promoter sequence Name=Xb4151_4152.C444.promoter107; Position on contig=217395..217454bp; Strand=-
ttcatcacaaaaattgaatttaccaagaatttttcggtgattggatgcatcatttttcaa

SEQ ID NO: 12859 - DNA, 60 bp, Xenorhabdus bovienii
  Promoter sequence Name=Xb4151_4152.C444.promoter108; Position on contig=217539..217598bp; Strand=+
gctatcttacggctgcacaaaaggctttattttgcgaaatggtgtaataaaatttattta

SEQ ID NO: 12860 - DNA, 60 bp, Xenorhabdus bovienii
  Promoter sequence Name=Xb4151_4152.C444.promoter109; Position on contig=221310..221369bp; Strand=+; Gene name=PckA
aaagtaatgcaatttcaattttttgataacaatcgctgttaattagtcataattatttat

SEQ ID NO: 12861 - DNA, 60 bp, Xenorhabdus bovienii
  Promoter sequence Name=Xb4151_4152.C444.promoter110; Position on contig=223922..223981bp; Strand=-; Gene name=Hcp
cttccagtgtttatttttatagccaacttgaatgttggcttttttttatacttaactcaa

SEQ ID NO: 12862 - DNA, 60 bp, Xenorhabdus bovienii
  Promoter sequence Name=Xb4151_4152.C444.promoter111; Position on contig=224389..224448bp; Strand=+; Gene name=Hcp
aacgctggccatccgctagccccttgacgtatctattgcaatttttttaatatgttaacg

SEQ ID NO: 12863 - DNA, 60 bp, Xenorhabdus bovienii
  Promoter sequence Name=Xb4151_4152.C444.promoter112; Position on contig=226713..226772bp; Strand=+; Gene name=DnaA
ggcttgatgatggaaaaataggctttgatgctaatctggatgtcaattctaattctaatc

SEQ ID NO: 12864 - DNA, 60 bp, Xenorhabdus bovienii
  Promoter sequence Name=Xb4151_4152.C444.promoter113; Position on contig=229619..229678bp; Strand=-
ttttactaaatttattacgatggactgattttaagttatgatttgctatcatacacacat

SEQ ID NO: 12865 - DNA, 60 bp, Xenorhabdus bovienii
  Promoter sequence Name=Xb4151_4152.C444.promoter114; Position on contig=230004..230063bp; Strand=-; Gene name=Bcp
gaatttcgctatctacattaacgtcgtgcctgaaatgtcaatacaattattattctgatc

SEQ ID NO: 12866 - DNA, 60 bp, Xenorhabdus bovienii
  Promoter sequence Name=Xb4151_4152.C444.promoter115; Position on contig=231198..231257bp; Strand=+; Gene name=DapA
aaatgatcaggagaaggtcaatcgtatttgtgaagggaagtgcgattataatctctgttt

SEQ ID NO: 12867 - DNA, 60 bp, Xenorhabdus bovienii
  Promoter sequence Name=Xb4151_4152.C444.promoter116; Position on contig=233350..233409bp; Strand=+; Gene name=PurC
acataaaggggccaaggcccctttatagtttgggtaaaattttttcgtttaatttttttg

SEQ ID NO: 12868 - DNA, 60 bp, Xenorhabdus bovienii
  Promoter sequence Name=Xb4151_4152.C444.promoter117; Position on contig=234774..234833bp; Strand=-
ttagttcaacatcaagctacattaaccatactacacaaacacacgttaatacttttaaca

SEQ ID NO: 12869 - DNA, 60 bp, Xenorhabdus bovienii
  Promoter sequence Name=Xb4151_4152.C444.promoter118; Position on contig=236171..236230bp; Strand=-
gaaccttcttttgcgactaagagtgtatcccaataggagatatttgatattatagtcagc

SEQ ID NO: 12870 - DNA, 60 bp, Xenorhabdus bovienii; identical to SEQ ID NO: 12602
  Promoter sequence Name=Xb4151_4152.C444.promoter119; Position on contig=236130..236189bp; Strand=+

SEQ ID NO: 12871 - DNA, 60 bp, Xenorhabdus bovienii
  Promoter sequence Name=Xb4151_4152.C444.promoter120; Position on contig=242160..242219bp; Strand=+
tgttttccagccggaataaatgttattgcccagaatcaactcaatggtattagccattaa

SEQ ID NO: 12872 - DNA, 60 bp, Xenorhabdus bovienii
  Promoter sequence Name=Xb4151_4152.C444.promoter121; Position on contig=246499..246558bp; Strand=+
atccgaaatatgggtttgttacccctcccgcacgattttttgttgtgcggtatactgatg

SEQ ID NO: 12873 - DNA, 60 bp, Xenorhabdus bovienii; identical to SEQ ID NO: 11184
  Promoter sequence Name=Xb4151_4152.C444.promoter122; Position on contig=247220..247279bp; Strand=-

SEQ ID NO: 12874 - DNA, 60 bp, Xenorhabdus bovienii
  Promoter sequence Name=Xb4151_4152.C444.promoter123; Position on contig=250922..250981bp; Strand=-
ataaataatatatttccttatttttcaattcattaataaaaaccattcattatacacatg

SEQ ID NO: 12875 - DNA, 60 bp, Xenorhabdus bovienii
  Promoter sequence Name=Xb4151_4152.C444.promoter124; Position on contig=251620..251679bp; Strand=-
gcctccgctaatttcataacacttttacacccaactaatggaatcttaataataagtaga

SEQ ID NO: 12876 - DNA, 60 bp, Xenorhabdus bovienii
  Promoter sequence Name=Xb4151_4152.C444.promoter125; Position on contig=254197..254256bp; Strand=-; Gene name=XerC
gaataaaagatgattttttagactttgttggtagtgccaataaagtctattttttataca

SEQ ID NO: 12877 - DNA, 60 bp, Xenorhabdus bovienii; identical to SEQ ID NO: 10698
  Promoter sequence Name=Xb4151_4152.C444.promoter126; Position on contig=254647..254706bp; Strand=-

SEQ ID NO: 12878 - DNA, 60 bp, Xenorhabdus bovienii; identical to SEQ ID NO: 12218
  Promoter sequence Name=Xb4151_4152.C444.promoter127; Position on contig=255184..255243bp; Strand=-; Gene name=Tsx

SEQ ID NO: 12879 - DNA, 60 bp, Xenorhabdus bovienii
  Promoter sequence Name=Xb4151_4152.C444.promoter128; Position on contig=255478..255537bp; Strand=+; Gene name=Tsx
ataaatatctcaataaaataaaaaccaataaattcactaatccattataaaatttcttat

SEQ ID NO: 12880 - DNA, 60 bp, Xenorhabdus bovienii
  Promoter sequence Name=Xb4151_4152.C444.promoter129; Position on contig=266623..266682bp; Strand=-; Gene name=ZntA
aatagttgttgtggacataacaaaatctccttcctgatacggagtgatatacttagcttt

SEQ ID NO: 12881 - DNA, 60 bp, Xenorhabdus bovienii
  Promoter sequence Name=Xb4151_4152.C444.promoter130; Position on contig=266551..266610bp; Strand=+; Gene name=ZntA
tagccttgatgatatggccgctatttttcttgagttatcaatatcactatctttgtatca

SEQ ID NO: 12882 - DNA, 60 bp, Xenorhabdus bovienii
  Promoter sequence Name=Xb4151_4152.C444.promoter131; Position on contig=269483..269542bp; Strand=+
ttcgtctataacaatcttcccactttcttgttaatctttaacacgttagcatatcgatga

SEQ ID NO: 12883 - DNA, 60 bp, Xenorhabdus bovienii
  Promoter sequence Name=Xb4151_4152.C444.promoter132; Position on contig=272991..273050bp; Strand=-
aaaatttttacttacattgatataatttgatacttatcccataaaaataaaataaaaccc

SEQ ID NO: 12884 - DNA, 60 bp, Xenorhabdus bovienii
  Promoter sequence Name=Xb4151_4152.C444.promoter133; Position on contig=272620..272679bp; Strand=+
atcgttctgccaaaagtggccatgatgatcgttagtatgcagaattgtaatatcgtaagt

SEQ ID NO: 12885 - DNA, 60 bp, Xenorhabdus bovienii
  Promoter sequence Name=Xb4151_4152.C444.promoter134; Position on contig=272995..273054bp; Strand=+; Gene name=ProP
tttattttatttttatgggataagtatcaaattatatcaatgtaagtaaaaattttatta

SEQ ID NO: 12886 - DNA, 60 bp, Xenorhabdus bovienii
  Promoter sequence Name=Xb4151_4152.C444.promoter135; Position on contig=274499..274558bp; Strand=+; Gene name=KefB
ctttgttttaaatgatttatacaatacattattacctcatttaaccctaaaatcgatatt

SEQ ID NO: 12887 - DNA, 60 bp, Xenorhabdus bovienii
  Promoter sequence Name=Xb4151_4152.C444.promoter136; Position on contig=277706..277765bp; Strand=-
gttgttcgttatggcgctacgttttttgttttgctacggtattgtgttaacatgccgcat

SEQ ID NO: 12888 - DNA, 60 bp, Xenorhabdus bovienii
  Promoter sequence Name=Xb4151_4152.C444.promoter137; Position on contig=279069..279128bp; Strand=-; Gene name=HemH
tgagatgttattttacattttgactggcgagtattggtagctatgggtattttggtggta

SEQ ID NO: 12889 - DNA, 60 bp, Xenorhabdus bovienii
  Promoter sequence Name=Xb4151_4152.C444.promoter138; Position on contig=280137..280196bp; Strand=-; Gene name=Adk
tttgaatgtcactccatgaaatgttagatgtgactataactcatgtttatactaggttat

SEQ ID NO: 12890 - DNA, 60 bp, Xenorhabdus bovienii
  Promoter sequence Name=Xb4151_4152.C444.promoter139; Position on contig=280938..280997bp; Strand=-; Gene name=HtpG
tttcttgagccataccctattcaaatggtatggtggctcgttttatttaaaatacgaaaa

SEQ ID NO: 12891 - DNA, 60 bp, Xenorhabdus bovienii
  Promoter sequence Name=Xb4151_4152.C444.promoter140; Position on contig=283061..283120bp; Strand=-
ataacgccaccatccatagctgatttgtacattcatcaaaccaattttatattcttctga

SEQ ID NO: 12892 - DNA, 60 bp, Xenorhabdus bovienii
  Promoter sequence Name=Xb4151_4152.C444.promoter141; Position on contig=282779..282838bp; Strand=+
caccatcattttcatacaattcaggttttgacaatgcacggaagcgtaatttatccgcag

SEQ ID NO: 12893 - DNA, 60 bp, Xenorhabdus bovienii
  Promoter sequence Name=Xb4151_4152.C444.promoter142; Position on contig=286157..286216bp; Strand=-; Gene name=Apt
tttgcataattgatacatcagcctcgccgttcatggtgaggctgtgctagcatgatactc

SEQ ID NO: 12894 - DNA, 60 bp, Xenorhabdus bovienii
  Promoter sequence Name=Xb4151_4152.C444.promoter143; Position on contig=286804..286863bp; Strand=-
tgcaatttgctttgcggttgcttttttcccatagtttgaatagattttagcgttttcgtt

SEQ ID NO: 12895 - DNA, 60 bp, Xenorhabdus bovienii
  Promoter sequence Name=Xb4151_4152.C444.promoter144; Position on contig=286730..286789bp; Strand=+
gtttcgatactatctttaataaattgtagtttttgcgcattagcggtcataatcgatgcc

SEQ ID NO: 12896 - DNA, 60 bp, Xenorhabdus bovienii
  Promoter sequence Name=Xb4151_4152.C444.promoter145; Position on contig=291268..291327bp; Strand=-; Gene name=AcrR
cttagtgttatcattttaaattgacgttattaggaaagtttgaaccataaactcggtcag

SEQ ID NO: 12897 - DNA, 60 bp, Xenorhabdus bovienii
  Promoter sequence Name=Xb4151_4152.C444.promoter146; Position on contig=292119..292178bp; Strand=-; Gene name=AcrA
tctgttttttcgcataagtaaacctcaatttttcaatgtagacgctttaaaatctagcta

SEQ ID NO: 12898 - DNA, 60 bp, Xenorhabdus bovienii
  Promoter sequence Name=Xb4151_4152.C444.promoter147; Position on contig=291912..291971bp; Strand=+; Gene name=AcrA
gaagtagcagaaactccacgttcagaaaatacctttatcgcggcttctataatctgttgg

SEQ ID NO: 12899 - DNA, 60 bp, Xenorhabdus bovienii
  Promoter sequence Name=Xb4151_4152.C444.promoter148; Position on contig=297025..297084bp; Strand=+
aataaataataatcatgttttgataggccatattctaaaagaatggctataataattgtt

SEQ ID NO: 12900 - DNA, 60 bp, Xenorhabdus bovienii
  Promoter sequence Name=Xb4151_4152.C444.promoter149; Position on contig=298064..298123bp; Strand=+
caaaaatgtcactaacgaactaaaattgacacaaactcaaagacttttatttttccacaa

SEQ ID NO: 12901 - DNA, 60 bp, Xenorhabdus bovienii
  Promoter sequence Name=Xb4151_4152.C444.promoter150; Position on contig=300553..300612bp; Strand=-; Gene name=MdlB
aaggagtgactgctctagtcactccttttttactttcctttcccagctatgttctctgat

SEQ ID NO: 12902 - DNA, 60 bp, Xenorhabdus bovienii
  Promoter sequence Name=Xb4151_4152.C444.promoter151; Position on contig=304128..304187bp; Strand=-; Gene name=Lrp
ttaatgctaattctttcatttttactttgggaatcggttcgtgagattattttctcaatt

SEQ ID NO: 12903 - DNA, 60 bp, Xenorhabdus bovienii
  Promoter sequence Name=Xb4151_4152.C444.promoter152; Position on contig=304717..304776bp; Strand=-; Gene name=CysK
actttagtgatatatagattacttttatattgggggaaatagattgttatttttctacat

SEQ ID NO: 12904 - DNA, 60 bp, Xenorhabdus bovienii
  Promoter sequence Name=Xb4151_4152.C444.promoter153; Position on contig=304709..304768bp; Strand=+; Gene name=CysK
aataataaatgtagaaaaataacaatctatttcccccaatataaaagtaatctatatatc

SEQ ID NO: 12905 - DNA, 60 bp, Xenorhabdus bovienii
  Promoter sequence Name=Xb4151_4152.C444.promoter154; Position on contig=307096..307155bp; Strand=-; Gene name=ComEA (BS)
taaagagtcaagagggctgtgatattgatcaagaataactcattaaatagcattgtaatt

SEQ ID NO: 12906 - DNA, 60 bp, Xenorhabdus bovienii
  Promoter sequence Name=Xb4151_4152.C444.promoter155; Position on contig=309702..309761bp; Strand=-; Gene name=HimA
ttggccattacagttaaacttaaactgacggggcggggttgataggttagaatgtaagcg

SEQ ID NO: 12907 - DNA, 60 bp, Xenorhabdus bovienii
  Promoter sequence Name=Xb4151_4152.C444.promoter156; Position on contig=310128..310187bp; Strand=-; Gene name=Lon
aatattttgctgttccatgattttttgctaatactggaagggattgatataacggcacgg

SEQ ID NO: 12908 - DNA, 60 bp, Xenorhabdus bovienii
  Promoter sequence Name=Xb4151_4152.C444.promoter157; Position on contig=312798..312857bp; Strand=-; Gene name=ClpX
gtaggaaatactgattatcaatatgtattgaaaaaataaaaatgagggattctccctcat

SEQ ID NO: 12909 - DNA, 60 bp, Xenorhabdus bovienii
  Promoter sequence Name=Xb4151_4152.C444.promoter158; Position on contig=314164..314223bp; Strand=-; Gene name=ClpP
cgccttactcggcggagtaatgacagcgtattttctgttatgccagataaactgggataa

SEQ ID NO: 12910 - DNA, 60 bp, Xenorhabdus bovienii
  Promoter sequence Name=Xb4151_4152.C444.promoter159; Position on contig=315042..315101bp; Strand=-; Gene name=Tig
gcttgcgggtttttttattgtccttgaaaaaaacagatttaacctcatatcctttcttac

SEQ ID NO: 12911 - DNA, 60 bp, Xenorhabdus bovienii
  Promoter sequence Name=Xb4151_4152.C444.promoter160; Position on contig=316775..316834bp; Strand=-; Gene name=BolA
atatcctgcttaattttttattttattaatctgattttaattttagacttcagccttcgg

SEQ ID NO: 12912 - DNA, 60 bp, Xenorhabdus bovienii
  Promoter sequence Name=Xb4151_4152.C444.promoter161; Position on contig=317375..317434bp; Strand=-
attttttttagcatgtagattttctcattcaggatacggatacccgatatattaataccg

SEQ ID NO: 12913 - DNA, 60 bp, Xenorhabdus bovienii
  Promoter sequence Name=Xb4151_4152.C444.promoter162; Position on contig=317201..317260bp; Strand=+
gttatttatcaaccatataattgattctagtttatttcccgtgagttataacatcagagt

SEQ ID NO: 12914 - DNA, 60 bp, Xenorhabdus bovienii
  Promoter sequence Name=Xb4151_4152.C444.promoter163; Position on contig=319626..319685bp; Strand=+
agccaaaggttggcagggttcaacctttggctgccttattttagtgataaacttcacaat

SEQ ID NO: 12915 - DNA, 60 bp, Xenorhabdus bovienii
  Promoter sequence Name=Xb4151_4152.C444.promoter164; Position on contig=320125..320184bp; Strand=+
tcaaaaccacaggtcgtttttatctaggtgatactgggttcaacctttatggtcatgttt

SEQ ID NO: 12916 - DNA, 60 bp, Xenorhabdus bovienii
  Promoter sequence Name=Xb4151_4152.C444.promoter165; Position on contig=320701..320760bp; Strand=+; Gene name=CyoA
cctttggttttcgtcaatttttcctttttaaaaatagtaagttattttaaaataaatact

SEQ ID NO: 12917 - DNA, 60 bp, Xenorhabdus bovienii
  Promoter sequence Name=Xb4151_4152.C444.promoter166; Position on contig=325802..325861bp; Strand=+; Gene name=ProP
ttaattcatttacaacttgtttatttataaacgttattttttattcatataatttaatta

SEQ ID NO: 12918 - DNA, 60 bp, Xenorhabdus bovienii
  Promoter sequence Name=Xb4151_4152.C444.promoter167; Position on contig=329056..329115bp; Strand=-
ttcccttaataaatttcccatcaaataaacttgattatttttatttaaaataatttccga

SEQ ID NO: 12919 - DNA, 60 bp, Xenorhabdus bovienii
  Promoter sequence Name=Xb4151_4152.C444.promoter168; Position on contig=329712..329771bp; Strand=-; Gene name=ApbA
cgcagaacctcccgagtatagatcttttgccaataatggaaagcggttatcatgccaact

SEQ ID NO: 12920 - DNA, 60 bp, Xenorhabdus bovienii
  Promoter sequence Name=Xb4151_4152.C444.promoter169; Position on contig=329542..329601bp; Strand=+; Gene name=ApbA
aactgattcgttcttctcgtttaattcaaaactcgcattgacgttgcgaaaatcccagcg

SEQ ID NO: 12921 - DNA, 60 bp, Xenorhabdus bovienii
  Promoter sequence Name=Xb4151_4152.C444.promoter170; Position on contig=332605..332664bp; Strand=-; Gene name=XseB
cattcgttaccgctgtttttttacagtcgatatagtgagattggtgttatactctacgcc

SEQ ID NO: 12922 - DNA, 60 bp, Xenorhabdus bovienii
  Promoter sequence Name=Xb4151_4152.C444.promoter171; Position on contig=332643..332702bp; Strand=+; Gene name=XseB
aaaaaaacagcggtaacgaatgatttatttcttccagtgtagtagggtactctgcaattc

SEQ ID NO: 12923 - DNA, 60 bp, Xenorhabdus bovienii
  Promoter sequence Name=Xb4151_4152.C444.promoter172; Position on contig=333947..334006bp; Strand=+; Gene name=Dxs
ataacaatcagcaatcatattagttactagttacattaatcactggttatattattcgtc

SEQ ID NO: 12924 - DNA, 60 bp, Xenorhabdus bovienii
  Promoter sequence Name=Xb4151_4152.C444.promoter173; Position on contig=340467..340526bp; Strand=-
tttgtttttagcattattgggatgtaatttttaacaatatctatttatgttataattgtg

SEQ ID NO: 12925 - DNA, 60 bp, Xenorhabdus bovienii
  Promoter sequence Name=Xb4151_4152.C444.promoter174; Position on contig=340695..340754bp; Strand=+
caatccaattcgaattttctttgcttaatccttaatcacaatctatttattgttcaacaa

SEQ ID NO: 12926 - DNA, 60 bp, Xenorhabdus bovienii
  Promoter sequence Name=Xb4151_4152.C444.promoter175; Position on contig=347600..347659bp; Strand=-; Gene name=SecF
ccctgtgagtacttactgacagggtgtttttcattatcacttcaaggtaaactgtcttcc

SEQ ID NO: 12927 - DNA, 60 bp, Xenorhabdus bovienii
  Promoter sequence Name=Xb4151_4152.C444.promoter176; Position on contig=353397..353456bp; Strand=-
agccacggacaaaatccgccattaaattgcccagtaaggaactttccgataatgcagcca

SEQ ID NO: 12928 - DNA, 60 bp, Xenorhabdus bovienii
  Promoter sequence Name=Xb4151_4152.C444.promoter177; Position on contig=353201..353260bp; Strand=+
ctgcggctggggataatgagcaatcagctcttccggcagttcaaatgtaaaatcagcgac

SEQ ID NO: 12929 - DNA, 60 bp, Xenorhabdus bovienii
  Promoter sequence Name=Xb4151_4152.C444.promoter178; Position on contig=353997..354056bp; Strand=+; Gene name=AhpC
tttatcttatttaggctaaaaggaattaaaagcaaattattgataggcaaaatctattat

SEQ ID NO: 12930 - DNA, 60 bp, Xenorhabdus bovienii
  Promoter sequence Name=Xb4151_4152.C444.promoter179; Position on contig=354796..354855bp; Strand=+; Gene name=Ggt
atgaattcccctaaaccagccactctgtcggctggttttttcttagctaaaatttctcat

SEQ ID NO: 12931 - DNA, 60 bp, Xenorhabdus bovienii
  Promoter sequence Name=Xb4151_4152.C444.promoter180; Position on contig=358474..358533bp; Strand=-; Gene name=BaeS
agaaaaatgatttattaatcaatatgagcgaaaaaagtgcaaatcatatagtgtgtattc

SEQ ID NO: 12932 - DNA, 60 bp, Xenorhabdus bovienii
  Promoter sequence Name=Xb4151_4152.C444.promoter181; Position on contig=360657..360716bp; Strand=-; Gene name=SbcD
ggattttcataaatttgtcataaaattgactcataatgacttaaggtgaatattgctggc

SEQ ID NO: 12933 - DNA, 60 bp, Xenorhabdus bovienii
  Promoter sequence Name=Xb4151_4152.C444.promoter182; Position on contig=360632..360691bp; Strand=+; Gene name=SbcD
ggttgatcccattaatattattgaagccagcaatattcaccttaagtcattatgagtcaa

SEQ ID NO: 12934 - DNA, 60 bp, Xenorhabdus bovienii
  Promoter sequence Name=Xb4151_4152.C444.promoter183; Position on contig=365826..365885bp; Strand=+
taacacgttgatttaaaatataaatttattgatgcgtatggtgtgtatatgataaagcac

SEQ ID NO: 12935 - DNA, 60 bp, Xenorhabdus bovienii
  Promoter sequence Name=Xb4151_4152.C444.promoter184; Position on contig=371322..371381bp; Strand=-; Gene name=OppA
gttattacatgaatagattaatttaagtcgtaattacaataaaatggtaatgtgatgtaa

SEQ ID NO: 12936 - DNA, 60 bp, Xenorhabdus bovienii
  Promoter sequence Name=Xb4151_4152.C444.promoter185; Position on contig=373087..373146bp; Strand=-; Gene name=UshA
gaaggcattaactgtaatagccatgatcattaaggtaatagtgatatatgtaatatttat

SEQ ID NO: 12937 - DNA, 60 bp, Xenorhabdus bovienii
  Promoter sequence Name=Xb4151_4152.C444.promoter186; Position on contig=377024..377083bp; Strand=-; Gene name=NagC
atcataaaaatggagtaaaacaaattcctttatttgtcatcagttgataaaaaatgtttt

SEQ ID NO: 12938 - DNA, 60 bp, Xenorhabdus bovienii
  Promoter sequence Name=Xb4151_4152.C444.promoter187; Position on contig=378515..378574bp; Strand=-; Gene name=RdgC
gagcataaagagtggctataacgcttgattgtcagtgcggctcaggcaatgattatgcag

SEQ ID NO: 12939 - DNA, 60 bp, Xenorhabdus bovienii
  Promoter sequence Name=Xb4151_4152.C444.promoter188; Position on contig=378568..378627bp; Strand=+; Gene name=RdgC
tatgctctgaaattgatgaagttctagggcttcgtcacatgattcgttattatgcccctt

SEQ ID NO: 12940 - DNA, 60 bp, Xenorhabdus bovienii
  Promoter sequence Name=Xb4151_4152.C444.promoter189; Position on contig=381006..381065bp; Strand=-
aatttatacctgctatgtgatttccttcacaggatggcattttttgttaatttttgttag

SEQ ID NO: 12941 - DNA, 60 bp, Xenorhabdus bovienii
  Promoter sequence Name=Xb4151_4152.C444.promoter190; Position on contig=383139..383198bp; Strand=-
attgatctgattttttataaatgtggtgatttataaaaatctctccgtatcaatcaactc

SEQ ID NO: 12942 - DNA, 60 bp, Xenorhabdus bovienii
  Promoter sequence Name=Xb4151_4152.C444.promoter191; Position on contig=389323..389382bp; Strand=-; Gene name=MetC
tttgtcaaatagtaatgataattactatcaaatcgctcaatgtctgatatcatttgcgtc

SEQ ID NO: 12943 - DNA, 60 bp, Xenorhabdus bovienii
  Promoter sequence Name=Xb4151_4152.C444.promoter192; Position on contig=389353..389412bp; Strand=+; Gene name=MetC
tgatagtaattatcattactatttgacaaaaaagtgatcattaaaggaataattttatca

SEQ ID NO: 12944 - DNA, 60 bp, Xenorhabdus bovienii
  Promoter sequence Name=Xb4151_4152.C444.promoter193; Position on contig=390857..390916bp; Strand=+; Gene name=DedA
tcaaatcaactccccttccgcgtttttccggtacactggttggcatgtatttttaatgac

SEQ ID NO: 12945 - DNA, 60 bp, Xenorhabdus bovienii
  Promoter sequence Name=Xb4151_4152.C444.promoter194; Position on contig=391711..391770bp; Strand=+; Gene name=ARA1
gataataaacaataccttgaatcacgttttatttatcccgaagtcgttatactcgatcca

SEQ ID NO: 12946 - DNA, 60 bp, Xenorhabdus bovienii
  Promoter sequence Name=Xb4151_4152.C444.promoter195; Position on contig=392876..392935bp; Strand=+
taagtaacatgcataaaaaatgcgtccttcatgatagtaacttatattaatattcacaac

SEQ ID NO: 12947 - DNA, 60 bp, Xenorhabdus bovienii
  Promoter sequence Name=Xb4151_4152.C444.promoter196; Position on contig=398070..398129bp; Strand=-; Gene name=DapB
cgatttatttggtttttattatgatagcctgaatttttattcgtttttatagtgataatt

SEQ ID NO: 12948 - DNA, 60 bp, Xenorhabdus bovienii
  Promoter sequence Name=Xb4151_4152.C444.promoter197; Position on contig=399222..399281bp; Strand=-; Gene name=LytB
tttattttaattaatattcttcccaaaatattaaagggtctaccataatcaacttacttt

SEQ ID NO: 12949 - DNA, 60 bp, Xenorhabdus bovienii
  Promoter sequence Name=Xb4151_4152.C444.promoter198; Position on contig=400723..400782bp; Strand=-; Gene name=LspA
ccggtcaacggtactggggctgataatttcatctatacccaatcagttttaatgggtata

SEQ ID NO: 12950 - DNA, 60 bp, Xenorhabdus bovienii
  Promoter sequence Name=Xb4151_4152.C444.promoter199; Position on contig=405179..405238bp; Strand=-; Gene name=RpsT
aaagaagtgagataaattaaatatttttcgggcatctggcctgtttttattgtaagaatc

SEQ ID NO: 12951 - DNA, 60 bp, Xenorhabdus bovienii
  Promoter sequence Name=Xb4151_4152.C444.promoter200; Position on contig=408007..408066bp; Strand=-; Gene name=RhaT
cttatagcaatgtacccatctctgaaaaaatgttactttctcaatgttataattcgaata

SEQ ID NO: 12952 - DNA, 60 bp, Xenorhabdus bovienii
  Promoter sequence Name=Xb4151_4152.C444.promoter201; Position on contig=408036..408095bp; Strand=+; Gene name=RhaT
attttttcagagatgggtacattgctataagcatcaaaagctgtttttatcattaatcca

SEQ ID NO: 12953 - DNA, 60 bp, Xenorhabdus bovienii
  Promoter sequence Name=Xb4151_4152.C444.promoter202; Position on contig=411739..411798bp; Strand=-
cttggagaaatcttttatttcaaattgacggagaatcaaccgtgatgtaaaaaataaaag

SEQ ID NO: 12954 - DNA, 60 bp, Xenorhabdus bovienii
  Promoter sequence Name=Xb4151_4152.C444.promoter203; Position on contig=411348..411407bp; Strand=+
tgagtcgatggataaggacttttgacacgttcagaaattgatgctggtaaaatgtcacgg

SEQ ID NO: 12955 - DNA, 60 bp, Xenorhabdus bovienii
  Promoter sequence Name=Xb4151_4152.C444.promoter204; Position on contig=411631..411690bp; Strand=+
tttccttttgaaagaaaggaaatataaataagaaaatcagcgagggtgacaatcaataat

SEQ ID NO: 12956 - DNA, 60 bp, Xenorhabdus bovienii
  Promoter sequence Name=Xb4151_4152.C444.promoter205; Position on contig=413172..413231bp; Strand=+
aaacattcattaaatataaataaatagtttaaatcgatattaaattgaataatttattcg

SEQ ID NO: 12957 - DNA, 60 bp, Xenorhabdus bovienii
  Promoter sequence Name=Xb4151_4152.C444.promoter206; Position on contig=415148..415207bp; Strand=-
acgtctcgactgaaattttttagccatatttacataagattagtttttattatgcgaaac

SEQ ID NO: 12958 - DNA, 60 bp, Xenorhabdus bovienii
  Promoter sequence Name=Xb4151_4152.C444.promoter207; Position on contig=415020..415079bp; Strand=+
gggcgaacgtcgtataccagccattgactatcaggagtccagatatttatattagttatc

SEQ ID NO: 12959 - DNA, 60 bp, Xenorhabdus bovienii
  Promoter sequence Name=Xb4151_4152.C444.promoter208; Position on contig=417743..417802bp; Strand=-; Gene name=Gmk
tttcgcaaattagtcttttcctgcttggtaaaagttccactgttttttattctttgctcg

SEQ ID NO: 12960 - DNA, 60 bp, Xenorhabdus bovienii
  Promoter sequence Name=Xb4151_4152.C444.promoter209; Position on contig=417771..417830bp; Strand=+; Gene name=Gmk
tttaccaagcaggaaaagactaatttgcgaaacgcttcgaaaaatacataatcattttct

SEQ ID NO: 12961 - DNA, 60 bp, Xenorhabdus bovienii
  Promoter sequence Name=Xb4151_4152.C444.promoter210; Position on contig=424811..424870bp; Strand=-; Gene name=UraA
tttttataatgaataacgatttgatttcgtcacattcttaaattttttaacttgtgttta

SEQ ID NO: 12962 - DNA, 60 bp, Xenorhabdus bovienii
  Promoter sequence Name=Xb4151_4152.C444.promoter211; Position on contig=424860..424919bp; Strand=+; Gene name=UraA
cattataaaaatttagcgcaaacgattgccttaataaggcagatcattaaaatagttttt

SEQ ID NO: 12963 - DNA, 60 bp, Xenorhabdus bovienii
  Promoter sequence Name=Xb4151_4152.C444.promoter212; Position on contig=426361..426420bp; Strand=+
cccgctttttcagtgggagttttttcatttttttgcataacccctcgcaatatcaacatg

SEQ ID NO: 12964 - DNA, 60 bp, Xenorhabdus bovienii
  Promoter sequence Name=Xb4151_4152.C444.promoter213; Position on contig=430563..430622bp; Strand=-; Gene name=TypA
taattttttcaacaacttttaatcaaaagcgtaatttgtctgtttttttatcatttcact

SEQ ID NO: 12965 - DNA, 60 bp, Xenorhabdus bovienii
  Promoter sequence Name=Xb4151_4152.C444.promoter214; Position on contig=432667..432726bp; Strand=-
ctagggtgatgagcttcacatttatttcactctgtagatataacgtgtaaaataacagca

SEQ ID NO: 12966 - DNA, 60 bp, Xenorhabdus bovienii
  Promoter sequence Name=Xb4151_4152.C444.promoter215; Position on contig=435974..436033bp; Strand=-; Gene name=AmyA
attctctggaaaaaacccagacaatggcacggcgacaaaacctgtgccatacttttttta

SEQ ID NO: 12967 - DNA, 60 bp, Xenorhabdus bovienii
  Promoter sequence Name=Xb4151_4152.C444.promoter216; Position on contig=439443..439502bp; Strand=-
atcaataaaataaatataaaaagccttttagtttcaaaccaatagaataaaatgtgatcc

SEQ ID NO: 12968 - DNA, 60 bp, Xenorhabdus bovienii
  Promoter sequence Name=Xb4151_4152.C444.promoter217; Position on contig=439791..439850bp; Strand=+
cggcatcacctgctccgggattaatcattttcttaaatatcaaatgttagcataaactca

SEQ ID NO: 12969 - DNA, 60 bp, Xenorhabdus bovienii
  Promoter sequence Name=Xb4151_4152.C444.promoter218; Position on contig=440931..440990bp; Strand=-; Gene name=FolA
atcacggtcacttttatttaatttatgttgggtgcgaattcagttcataagattcaacat

SEQ ID NO: 12970 - DNA, 60 bp, Xenorhabdus bovienii
  Promoter sequence Name=Xb4151_4152.C444.promoter219; Position on contig=442225..442284bp; Strand=+
aagatgtatcttactggacaggggtttgatttatcaataaaatatttttattatggcatg

SEQ ID NO: 12971 - DNA, 60 bp, Xenorhabdus bovienii
  Promoter sequence Name=Xb4151_4152.C444.promoter220; Position on contig=447289..447348bp; Strand=-
aatattcaccactataaatacttatagaaacaattaataattatttttattttttctttt

SEQ ID NO: 12972 - DNA, 60 bp, Xenorhabdus bovienii
  Promoter sequence Name=Xb4151_4152.C444.promoter221; Position on contig=447632..447691bp; Strand=-
aaatagggggttatcgtaatttttttcccattaagttcacaatcatttatcatttgaata

SEQ ID NO: 12973 - DNA, 60 bp, Xenorhabdus bovienii
  Promoter sequence Name=Xb4151_4152.C444.promoter222; Position on contig=447295..447354bp; Strand=+
aaaaataaaaataattattaattgtttctataagtatttatagtggtgaatatttataag

SEQ ID NO: 12974 - DNA, 60 bp, Xenorhabdus bovienii
  Promoter sequence Name=Xb4151_4152.C444.promoter223; Position on contig=448969..449028bp; Strand=-
tttcaaatagttgtttaacgcaggttcaccacagtcaaaattatttctatcgtgtttatt

SEQ ID NO: 12975 - DNA, 60 bp, Xenorhabdus bovienii
  Promoter sequence Name=Xb4151_4152.C444.promoter224; Position on contig=448575..448634bp; Strand=+
tttggcgtcattttggcacgtatattgatttttgttaaagaaaatgttaaattagaccgt

SEQ ID NO: 12976 - DNA, 60 bp, Xenorhabdus bovienii
  Promoter sequence Name=Xb4151_4152.C444.promoter225; Position on contig=449837..449896bp; Strand=-; Gene name=PaaX
ccgctgtcttaatcagtgttgtgctttaataaattcggacactttggtaaaggaatagaa

SEQ ID NO: 12977 - DNA, 60 bp, Xenorhabdus bovienii
  Promoter sequence Name=Xb4151_4152.C444.promoter226; Position on contig=450862..450921bp; Strand=-; Gene name=PaaK
tcgccaccgctgagactatttcaagttgcagggtatatttctccggttatgctaatggca

SEQ ID NO: 12978 - DNA, 60 bp, Xenorhabdus bovienii
  Promoter sequence Name=Xb4151_4152.C444.promoter227; Position on contig=452253..452312bp; Strand=-; Gene name=PaaJ
cgggtattagcaaataacccacacctgcacataaaaacaacaacctgttacaaacaaatc

SEQ ID NO: 12979 - DNA, 60 bp, Xenorhabdus bovienii
  Promoter sequence Name=Xb4151_4152.C444.promoter228; Position on contig=453624..453683bp; Strand=-
ggaaaaaccacgggcttgtatgacgtcagaattatcaatcaggacggcaaaatcgtggcc

SEQ ID NO: 12980 - DNA, 60 bp, Xenorhabdus bovienii
  Promoter sequence Name=Xb4151_4152.C444.promoter229; Position on contig=460936..460995bp; Strand=-; Gene name=PutA
tacgttatcaatttgtagatttacagttatgtaaaatgattcatttttatattaaaaata

SEQ ID NO: 12981 - DNA, 60 bp, Xenorhabdus bovienii
  Promoter sequence Name=Xb4151_4152.C444.promoter230; Position on contig=461031..461090bp; Strand=+; Gene name=PutA
catcacaatatgaatttttatttttttaaaaacaataagttaatttttattattggatag

SEQ ID NO: 12982 - DNA, 60 bp, Xenorhabdus bovienii
  Promoter sequence Name=Xb4151_4152.C444.promoter231; Position on contig=468213..468272bp; Strand=-
tccaatcaaagtattacagttaatatcacttatcccttaaataatgttattttcgctcca

SEQ ID NO: 12983 - DNA, 60 bp, Xenorhabdus bovienii
  Promoter sequence Name=Xb4151_4152.C444.promoter232; Position on contig=469484..469543bp; Strand=-
actataaatattcaaaaaaatgaatatttgaatttctcagtctttttaattttcacacag

SEQ ID NO: 12984 - DNA, 60 bp, Xenorhabdus bovienii
  Promoter sequence Name=Xb4151_4152.C444.promoter233; Position on contig=470974..471033bp; Strand=-
taaatatacattcaagatattgataatatttatatttattgcttttttaaattttcattt

SEQ ID NO: 12985 - DNA, 60 bp, Xenorhabdus bovienii
  Promoter sequence Name=Xb4151_4152.C444.promoter234; Position on contig=471875..471934bp; Strand=-; Gene name=GlpA
actttctactgagatttcttaatttttaattttattcaactggttatttaaatcatcata

SEQ ID NO: 12986 - DNA, 60 bp, Xenorhabdus bovienii
  Promoter sequence Name=Xb4151_4152.C444.promoter235; Position on contig=473728..473787bp; Strand=-; Gene name=GlpR
tgctcccaaatttctgccctcaatttgcttcccgcaaattccttattaatcttatacata

SEQ ID NO: 12987 - DNA, 60 bp, Xenorhabdus bovienii
  Promoter sequence Name=Xb4151_4152.C444.promoter236; Position on contig=476003..476062bp; Strand=-
cttgatttgtattttttgaccctttttctgttcttagcatttttagccagtatttccacg

SEQ ID NO: 12988 - DNA, 60 bp, Xenorhabdus bovienii
  Promoter sequence Name=Xb4151_4152.C444.promoter237; Position on contig=477344..477403bp; Strand=+; Gene name=MhpC
gcaaaatacaaactttgatggcatagccaacagtatccaaccattgttagcataggttcc

SEQ ID NO: 12989 - DNA, 60 bp, Xenorhabdus bovienii
  Promoter sequence Name=Xb4151_4152.C444.promoter238; Position on contig=478740..478799bp; Strand=-
aaaacctcactcctcaaacataaattgaaaaataaaaattattctcttattatctgggtg

SEQ ID NO: 12990 - DNA, 60 bp, Xenorhabdus bovienii
  Promoter sequence Name=Xb4151_4152.C444.promoter239; Position on contig=479188..479247bp; Strand=+; Gene name=InsB
gtatcaatacggtgatgcggacattaaaaaactctcgccaaaaaaagtaacatcgcgaca

SEQ ID NO: 12991 - DNA, 60 bp, Xenorhabdus bovienii
  Promoter sequence Name=Xb4151_4152.C444.promoter240; Position on contig=481191..481250bp; Strand=-
cagaccagtcaattaagcctttttcatcaagaacagacagtaatcggttaaatattttgt

SEQ ID NO: 12992 - DNA, 60 bp, Xenorhabdus bovienii
  Promoter sequence Name=Xb4151_4152.C444.promoter241; Position on contig=480882..480941bp; Strand=+
ggctgcccagtagaaacagggagaaattcccacattagttaccgctgcaaaatttgctca

SEQ ID NO: 12993 - DNA, 60 bp, Xenorhabdus bovienii
  Promoter sequence Name=Xb4151_4152.C444.promoter242; Position on contig=481896..481955bp; Strand=+
taagataaaacaaaaaatgtgatttcacatttatgaaacagtttttatatacttgcatta

SEQ ID NO: 12994 - DNA, 60 bp, Xenorhabdus bovienii
  Promoter sequence Name=Xb4151_4152.C444.promoter243; Position on contig=486695..486754bp; Strand=-; Gene name=AraJ
agaatagacataataaaaataaatttatattgcatatgatataagtattttaatatcatt

SEQ ID NO: 12995 - DNA, 60 bp, Xenorhabdus bovienii
  Promoter sequence Name=Xb4151_4152.C444.promoter244; Position on contig=486707..486766bp; Strand=+; Gene name=AraJ
atacttatatcatatgcaatataaatttatttttattatgtctattctatatttattatg

SEQ ID NO: 12996 - DNA, 60 bp, Xenorhabdus bovienii
  Promoter sequence Name=Xb4151_4152.C444.promoter245; Position on contig=488036..488095bp; Strand=+; Gene name=InsB
actttgatagataggatggttgtgtattcaaagcgttgttcttaagttataatcaccatt

SEQ ID NO: 12997 - DNA, 60 bp, Xenorhabdus bovienii
  Promoter sequence Name=Xb4151_4152.C444.promoter246; Position on contig=492347..492406bp; Strand=-
ctttcaattaaataaccattaatttgattaatatcaatttcttccataaaaattcagtga

SEQ ID NO: 12998 - DNA, 60 bp, Xenorhabdus bovienii
  Promoter sequence Name=Xb4151_4152.C444.promoter247; Position on contig=493161..493220bp; Strand=-
cgtataatctatcattcaataaatttcatattcatgaaatcctattgaataatataaaaa

SEQ ID NO: 12999 - DNA, 60 bp, Xenorhabdus bovienii
  Promoter sequence Name=Xb4151_4152.C444.promoter248; Position on contig=493118..493177bp; Strand=+
atatctgtatatcagagcattatggaattattaatttgttatatttttatattattcaat

SEQ ID NO: 13000 - DNA, 60 bp, Xenorhabdus bovienii
  Promoter sequence Name=Xb4151_4152.C444.promoter249; Position on contig=493559..493618bp; Strand=+
cgtgtcaccagccgccattttgactacggaagttcaagacgagcattcatattgagtcga

SEQ ID NO: 13001 - DNA, 60 bp, Xenorhabdus bovienii
  Promoter sequence Name=Xb4151_4152.C444.promoter250; Position on contig=493959..494018bp; Strand=+
acggtttcatcttgttgttggtgtggtcactttttatatgaatgtgttatattaattttt

SEQ ID NO: 13002 - DNA, 60 bp, Xenorhabdus bovienii
  Promoter sequence Name=Xb4151_4152.C444.promoter251; Position on contig=495801..495860bp; Strand=-
ttttttttatgttaagttactttttttagcctaaatatctatcgagttaacatcatttga

SEQ ID NO: 13003 - DNA, 60 bp, Xenorhabdus bovienii
  Promoter sequence Name=Xb4151_4152.C444.promoter252; Position on contig=496650..496709bp; Strand=-
cagacttaatttgacagttgcccactttgatttagtgcctgtcagattaaattcgggtta

SEQ ID NO: 13004 - DNA, 60 bp, Xenorhabdus bovienii
  Promoter sequence Name=Xb4151_4152.C444.promoter253; Position on contig=497518..497577bp; Strand=-
tcagacttaatctgacagttgcccactttgatttaggcctgtcagattaaattcggttga

SEQ ID NO: 13005 - DNA, 60 bp, Xenorhabdus bovienii
  Promoter sequence Name=Xb4151_4152.C444.promoter254; Position on contig=498379..498438bp; Strand=-
cagacttaatctgacagtcgcccactttgatttagggcctgtcaggttaaattcggttga

SEQ ID NO: 13006 - DNA, 60 bp, Xenorhabdus bovienii
  Promoter sequence Name=Xb4151_4152.C444.promoter255; Position on contig=505712..505771bp; Strand=-
tggcaggatactgattttatataaactttacgcataacatgccgatgaattattcatcgg

SEQ ID NO: 13007 - DNA, 60 bp, Xenorhabdus bovienii
  Promoter sequence Name=Xb4151_4152.C444.promoter256; Position on contig=505758..505817bp; Strand=+
tcagtatcctgccagaggttgggggtttattgtacgggcttatcaattatcattcttaat

SEQ ID NO: 13008 - DNA, 60 bp, Xenorhabdus bovienii
  Promoter sequence Name=Xb4151_4152.C444.promoter257; Position on contig=508830..508889bp; Strand=-; Gene name=GreA
cgggtaatgtagttactcttcgccatgaaaaaacccacttgagaaaatatgattaatggc

SEQ ID NO: 13009 - DNA, 60 bp, Xenorhabdus bovienii
  Promoter sequence Name=Xb4151_4152.C444.promoter258; Position on contig=508768..508827bp; Strand=+; Gene name=GreA
atatttcggtcatgttgagacagatttcatcgaatatcttatgggttaagatatagtact

SEQ ID NO: 13010 - DNA, 60 bp, Xenorhabdus bovienii
  Promoter sequence Name=Xb4151_4152.C444.promoter259; Position on contig=511248..511307bp; Strand=+; Gene name=PstS
tcataaaaatgtcataattaatacattttgctgtcattgaattaacttatttttcccctg

SEQ ID NO: 13011 - DNA, 60 bp, Xenorhabdus bovienii
  Promoter sequence Name=Xb4151_4152.C444.promoter260; Position on contig=516007..516066bp; Strand=+; Gene name=ArtI
cggcgtttttggctttcttattcctaaaaatgataaacatatcattttatattatttcaa

SEQ ID NO: 13012 - DNA, 60 bp, Xenorhabdus bovienii
  Promoter sequence Name=Xb4151_4152.C444.promoter261; Position on contig=518729..518788bp; Strand=+
ttttcattaatagatatttaataatttcttctaatatatcaagatggaataatagcatta

SEQ ID NO: 13013 - DNA, 60 bp, Xenorhabdus bovienii
  Promoter sequence Name=Xb4151_4152.C444.promoter262; Position on contig=523050..523109bp; Strand=-
tttaatcttcaaaaaaataatgtttatttaaataaacattagcactttaagataatatat

SEQ ID NO: 13014 - DNA, 60 bp, Xenorhabdus bovienii
  Promoter sequence Name=Xb4151_4152.C444.promoter263; Position on contig=522895..522954bp; Strand=+
attatatttttttaatttaatattgcatattgtgtgttaaattttgataaaattaataat

SEQ ID NO: 13015 - DNA, 34 bp, Xenorhabdus bovienii
  Terminator sequence Name=Xb4151_4152.C3.trmnator1; Position on contig= 390..423bp; Strand=-
ctggatagcctgctgtctcagcgctttatcggca

SEQ ID NO: 13016 - DNA, 30 bp, Xenorhabdus bovienii
  Terminator sequence Name=Xb4151_4152.C6.trmnator1; Position on contig= 746..775bp; Strand=+
cgggggaaaaaacccccggtttttttaaaa

SEQ ID NO: 13017 - DNA, 58 bp, Xenorhabdus bovienii
  unsure (1)..(58): unsure at all n locations
  Terminator sequence Name=Xb4151_4152.C11.trmnator1; Position on contig=137..194bp; Strand=-
ggggggagggggggggagatagagatatcttcattcttctcttcttctttttttntna

SEQ ID NO: 13018 - DNA, 59 bp, Xenorhabdus bovienii
  unsure (1)..(59): unsure at all n locations
  Terminator sequence Name=Xb4151_4152.C20.trmnator1; Position on contig=218..276bp; Strand=-
gggaagttttttttttttttngggggggggaaaaaaaaaatttttttttttttttncgg

SEQ ID NO: 13019 - DNA, 58 bp, Xenorhabdus bovienii
  Terminator sequence Name=Xb4151_4152.C40.trmnator1; Position on contig=711..768bp; Strand=+
ccccccccccccccccggggggggggaggagggagggggttggggggttttttttttt

SEQ ID NO: 13020 - DNA, 37 bp, Xenorhabdus bovienii
  unsure (1)..(37): unsure at all n locations
  Terminator sequence Name=Xb4151_4152.C44.trmnator1; Position on contig=75..111bp; Strand=-
ttcctnngctctcggggggggggggtcttcccttncg

SEQ ID NO: 13021 - DNA, 53 bp, Xenorhabdus bovienii
  Terminator sequence Name=Xb4151_4152.C67.trmnator1; Position on contig=312..364bp; Strand=-
tttggggggggggggagagaaccccccccccccccccagattgtctaaatagg

SEQ ID NO: 13022 - DNA, 38 bp, Xenorhabdus bovienii
  Terminator sequence Name=Xb4151_4152.C69.trmnator1; Position on contig=275..312bp; Strand=-
gtaaaatggattaatcccatttgtgttttcctaggctc

SEQ ID NO: 13023 - DNA, 50 bp, Xenorhabdus bovienii
  unsure (1)..(50): unsure at all n locations
  Terminator sequence Name=Xb4151_4152.C73.trmnator1; Position on contig=540..589bp; Strand=+
ggggggaaaaacggggggggntttccttttttccttttnnttttnctttt

SEQ ID NO: 13024 - DNA, 28 bp, Xenorhabdus bovienii
  Terminator sequence Name=Xb4151_4152.C89.trmnator1; Position on contig=43..70bp; Strand=-
cccccatccgggggaggtcttgatgcgc

SEQ ID NO: 13025 - DNA, 64 bp, Xenorhabdus bovienii
  unsure (1)..(64): unsure at all n locations
  Terminator sequence Name=Xb4151_4152.C89.trmnator2; Position on contig=645..708bp; Strand=+
ttccccccaaattttttttctcccccnggaaaaaaaaaaaaaggggggggggttgttttttttt

SEQ ID NO: 13026 - DNA, 44 bp, Xenorhabdus bovienii
  Terminator sequence Name=Xb4151_4152.C98.trmnator1; Position on contig=240..283bp; Strand=-
gggattttttttaaaaaaaaaaatttaccccccattttttaaag

SEQ ID NO: 13027 - DNA, 35 bp, Xenorhabdus bovienii
  Terminator sequence Name=Xb4151_4152.C104.trmnator1; Position on contig=492..526bp; Strand=+
ggggggtttccggaaccccccgggttttttaaaaa

SEQ ID NO: 13028 - DNA, 56 bp, Xenorhabdus bovienii
  unsure (1)..(56): unsure at all n locations
  Terminator sequence Name=Xb4151_4152.C108.trmnator1; Position on contig=208..263bp; Strand=-
tttttttttttccccccccccccccggggggagaaaaaaaaattttttttttttnt

SEQ ID NO: 13029 - DNA, 45 bp, Xenorhabdus bovienii
  unsure (1)..(45): unsure at all n locations
  Terminator sequence Name=Xb4151_4152.C117.trmnator1; Position on contig=519..563bp; Strand=-
ccccatatatggggcggggcccccaaaggggcattattttttnca

SEQ ID NO: 13030 - DNA, 48 bp, Xenorhabdus bovienii
  unsure (1)..(48): unsure at all n locations
  Terminator sequence Name=Xb4151_4152.C142.trmnator1; Position on contig=950..997bp; Strand=+
gggcgcggcccgggggggggggggnngggcgcccaacattttttgggg

SEQ ID NO: 13031 - DNA, 31 bp, Xenorhabdus bovienii
  unsure (1)..(31): unsure at all n locations
  Terminator sequence Name=Xb4151_4152.C162.trmnator1; Position on contig=380..410bp; Strand=-
ncccccnccngggggggttttttttcctccc

SEQ ID NO: 13032 - DNA, 47 bp, Xenorhabdus bovienii
  unsure (1)..(47): unsure at all n locations
  Terminator sequence Name=Xb4151_4152.C174.trmnator1; Position on contig=386..432bp; Strand=-
gagaggataaaaaggattttttttttttttttnnntttttttttttt

SEQ ID NO: 13033 - DNA, 31 bp, Xenorhabdus bovienii
  unsure (1)..(31): unsure at all n locations
  Terminator sequence Name=Xb4151_4152.C174.trmnator2; Position on contig=888..918bp; Strand=-
ggggggttggttgnnctccctttttattttt

SEQ ID NO: 13034 - DNA, 38 bp, Xenorhabdus bovienii
  Terminator sequence Name=Xb4151_4152.C176.trmnator1; Position on contig=603..640bp; Strand=+
ggggggtgggggaaaaggccccccttttttcgggcccc

SEQ ID NO: 13035 - DNA, 49 bp, Xenorhabdus bovienii
  Terminator sequence Name=Xb4151_4152.C183.trmnator1; Position on contig=334..382bp; Strand=-
ccgtcccccccccccaccccacggggggggtgtggtgtgtttgttgtaa

SEQ ID NO: 13036 - DNA, 31 bp, Xenorhabdus bovienii
  unsure (1)..(31): unsure at all n locations
  Terminator sequence Name=Xb4151_4152.C189.trmnator1; Position on contig=621..651bp; Strand=+
ccacccccntttngggtggttgttttttttt

SEQ ID NO: 13037 - DNA, 50 bp, Xenorhabdus bovienii
  Terminator sequence Name=Xb4151_4152.C196.trmnator1; Position on contig=602..651bp; Strand=+
gaaaaaaaaaaaccccccgggggggggcttttttttttttttataaaaac

SEQ ID NO: 13038 - DNA, 63 bp, Xenorhabdus bovienii
  Terminator sequence Name=Xb4151_4152.C200.trmnator1; Position on contig=774..836bp; Strand=+
ttccccgcgggttttttttaaaggggggggaaaaaccccggtggggggggggtttttttttcc

SEQ ID NO: 13039 - DNA, 48 bp, Xenorhabdus bovienii
  unsure (1)..(48): unsure at all n locations
  Terminator sequence Name=Xb4151_4152.C207.trmnator1; Position on contig=405..452bp; Strand=-
nnnnggggggggggggggnnnnnnnnnnggngggnnnntttttttttt

SEQ ID NO: 13040 - DNA, 27 bp, Xenorhabdus bovienii
  Terminator sequence Name=Xb4151_4152.C221.trmnator1; Position on contig=190..216bp; Strand=-
tccgcccccgcggaaatattttttggc

SEQ ID NO: 13041 - DNA, 61 bp, Xenorhabdus bovienii
  Terminator sequence Name=Xb4151_4152.C226.trmnator1; Position on contig=638..698bp; Strand=-
tatattctcctccccgcccccccggcggggtggggggggggggtgtatttttttgttaatt

SEQ ID NO: 13042 - DNA, 69 bp, Xenorhabdus bovienii
  Terminator sequence Name=Xb4151_4152.C232.trmnator1; Position on contig=1000..1068bp; Strand=+
ggggtttttttttttttttttttttttaaaaaaaaaaaaaaagaaaaagaaattttttttttgtttttt

SEQ ID NO: 13043 - DNA, 46 bp, Xenorhabdus bovienii
  unsure (1)..(46): unsure at all n locations
  Terminator sequence Name=Xb4151_4152.C256.trmnator1; Position on contig=282..327bp; Strand=-
gggggttttcccaaaccccccgggnaaacccccccctttgggtttt

SEQ ID NO: 13044 - DNA, 40 bp, Xenorhabdus bovienii
  unsure (1)..(40): unsure at all n locations
  Terminator sequence Name=Xb4151_4152.C261.trmnator1; Position on contig=1062..1101bp; Strand=+
nttcgcgcgctgagcggcgcgtgctaggtttatggttaga

SEQ ID NO: 13045 - DNA, 35 bp, Xenorhabdus bovienii
  Terminator sequence Name=Xb4151_4152.C314.trmnator1; Position on contig=35..69bp; Strand=-
tttttttttgaaatgggaaaaaatttcgggtggtc

SEQ ID NO: 13046 - DNA, 29 bp, Xenorhabdus bovienii
  Terminator sequence Name=Xb4151_4152.C323.trmnator1; Position on contig=549..577bp; Strand=+
cggtgtagattacatcgtttgcgtcctcc

SEQ ID NO: 13047 - DNA, 48 bp, Xenorhabdus bovienii
  Terminator sequence Name=Xb4151_4152.C324.trmnator1; Position on contig=525..572bp; Strand=+
tagcggcgtggcatccggcatgtcattgtccgctgtcatttacctgag

SEQ ID NO: 13048 - DNA, 51 bp, Xenorhabdus bovienii
  Terminator sequence Name=Xb4151_4152.C327.trmnator1; Position on contig=462..512bp; Strand=+
tgctggcgcaggccagatgatggcctcgggtgccggtggcttgtatccaag

SEQ ID NO: 13049 - DNA, 35 bp, Xenorhabdus bovienii
  Terminator sequence Name=Xb4151_4152.C348.trmnator1; Position on contig=128..162bp; Strand=-
tttaagcccccccgggggttaaaattattgggggg

SEQ ID NO: 13050 - DNA, 51 bp, Xenorhabdus bovienii
  Terminator sequence Name=Xb4151_4152.C353.trmnator1; Position on contig=392..442bp; Strand=-
tgactgtctaggatgtgtgatgattgctagatggtctactgtctgctctgc

SEQ ID NO: 13051 - DNA, 37 bp, Xenorhabdus bovienii
  Terminator sequence Name=Xb4151_4152.C353.trmnator2; Position on contig=1158..1194bp; Strand=+
cgcagaaagaaactctttctggtgtatattctgaccg

SEQ ID NO: 13052 - DNA, 49 bp, Xenorhabdus bovienii
  Terminator sequence Name=Xb4151_4152.C389.trmnator1; Position on contig=1436..1484bp; Strand=+
ctgtaccttaaatattttatacatccaaggtacagtttttatttataaa

SEQ ID NO: 13053 - DNA, 36 bp, Xenorhabdus bovienii
  Terminator sequence Name=Xb4151_4152.C390.trmnator1; Position on contig=1896..1931bp; Strand=+; Gene name=ZnuB
ggcgaaatggcgatgaatttcgccttatccgtcgat

SEQ ID NO: 13054 - DNA, 51 bp, Xenorhabdus bovienii
  Terminator sequence Name=Xb4151_4152.C390.trmnator2; Position on contig=5924..5974bp; Strand=+
gaaaactggcgtgatattattttattacgctggttttttccttttttcacc

SEQ ID NO: 13055 - DNA, 45 bp, Xenorhabdus bovienii
  Terminator sequence Name=Xb4151_4152.C391.trmnator1; Position on contig=1638..1682bp; Strand=+; Gene name=TufB
tgaaaaaagagaagctatagcttctctttcaaattttgaaccacc

SEQ ID NO: 13056 - DNA, 56 bp, Xenorhabdus bovienii
  Terminator sequence Name=Xb4151_4152.C392.trmnator1; Position on contig=1106..1161bp; Strand=+; Gene name=InsB
tattaaaaaactcatcattttaccgtgatgagtttttattaatgatatttatggag

SEQ ID NO: 13057 - DNA, 45 bp, Xenorhabdus bovienii
  Terminator sequence Name=Xb4151_4152.C394.trmnator1; Position on contig=5880..5924bp; Strand=+
tttgcgttgttttcaatgaaaatatgcagtgaattacttagagga

SEQ ID NO: 13058 - DNA, 41 bp, Xenorhabdus bovienii
  Terminator sequence Name=Xb4151_4152.C394.trmnator2; Position on contig=7037..7077bp; Strand=+
caccctgtgagcggatgcctgccagggtgttctttcaggag

SEQ ID NO: 13059 - DNA, 30 bp, Xenorhabdus bovienii
  Terminator sequence Name=Xb4151_4152.C395.trmnator1; Position on contig=1225..1254bp; Strand=+; Gene name=CoaA
gccggaactatttccggctttgcattcaac

SEQ ID NO: 13060 - DNA, 51 bp, Xenorhabdus bovienii
  Terminator sequence Name=Xb4151_4152.C396.trmnator1; Position on contig=2961..3011bp; Strand=+
tagcacgggggcaggaaataatttcttgcccccgtgctatttagtatgtat

SEQ ID NO: 13061 - DNA, 38 bp, Xenorhabdus bovienii
  Terminator sequence Name=Xb4151_4152.C396.trmnator2; Position on contig=4714..4751bp; Strand=+
gccttttttcacgttggaagaaggcttttattttattg

SEQ ID NO: 13062 - DNA, 32 bp, Xenorhabdus bovienii
  Terminator sequence Name=Xb4151_4152.C397.trmnator1; Position on contig=7790..7821bp; Strand=-
cccgcgctcaatcgtggggatgtctcgctgta

SEQ ID NO: 13063 - DNA, 29 bp, Xenorhabdus bovienii
  Terminator sequence Name=Xb4151_4152.C397.trmnator2; Position on contig=8577..8605bp; Strand=-
cctcgccaatgcgaggttttttattacct

SEQ ID NO: 13064 - DNA, 48 bp, Xenorhabdus bovienii
  Terminator sequence Name=Xb4151_4152.C397.trmnator3; Position on contig=8864..8911bp; Strand=-
ctaactccagctcatttacgagtgggctgtggtgagttaataatagga

SEQ ID NO: 13065 - DNA, 31 bp, Xenorhabdus bovienii
  Terminator sequence Name=Xb4151_4152.C397.trmnator4; Position on contig=10105..10135bp; Strand=-
gccctccccgcgagggcttttttgtgcctgt

SEQ ID NO: 13066 - DNA, 44 bp, Xenorhabdus bovienii
  Terminator sequence Name=Xb4151_4152.C398.trmnator1; Position on contig=646..689bp; Strand=-; Gene name=CsrA
cggcaccatgaaagtgttttttatggtgccggatgtttttttgt

SEQ ID NO: 13067 - DNA, 46 bp, Xenorhabdus bovienii
  Terminator sequence Name=Xb4151_4152.C398.trmnator2; Position on contig=3575..3620bp; Strand=-; Gene name=AlaS
gaagaaccacatcctgtcgggatgtggtttttgtttttataggagt

SEQ ID NO: 13068 - DNA, 39 bp, Xenorhabdus bovienii
  Terminator sequence Name=Xb4151_4152.C398.trmnator3; Position on contig=4798..4836bp; Strand=-; Gene name=RecA
ttgatgctgtatgattatacagtataattaattccagca

SEQ ID NO: 13069 - DNA, 56 bp, Xenorhabdus bovienii
  Terminator sequence Name=Xb4151_4152.C399.trmnator1; Position on contig=12223..12278bp; Strand=-
tattttctgattaaggccagcgccttaatcagaaggctcgaaaaatattgtcatcc

SEQ ID NO: 13070 - DNA, 40 bp, Xenorhabdus bovienii
  Terminator sequence Name=Xb4151_4152.C400.trmnator1; Position on contig=1555..1594bp; Strand=+
tttgccttcatcggcggtgcggggcgaattatgcgtatat

SEQ ID NO: 13071 - DNA, 51 bp, Xenorhabdus bovienii
  Terminator sequence Name=Xb4151_4152.C401.trmnator1; Position on contig=1056..1106bp; Strand=+; Gene name=SdaC
taaaattatccgcattgatgaacgatgcggataatctcgattatactttcc

SEQ ID NO: 13072 - DNA, 45 bp, Xenorhabdus bovienii
  Terminator sequence Name=Xb4151_4152.C401.trmnator2; Position on contig=1047..1091bp; Strand=-; Gene name=SdaC
gattatccgcatcgttcatcaatgcggataattttatgaattacc

SEQ ID NO: 13073 - DNA, 44 bp, Xenorhabdus bovienii
  Terminator sequence Name=Xb4151_4152.C401.trmnator3; Position on contig=1780..1823bp; Strand=-
gtatacatattttgataaattgagatatttacttatgtacacta

SEQ ID NO: 13074 - DNA, 40 bp, Xenorhabdus bovienii
  Terminator sequence Name=Xb4151_4152.C401.trmnator4; Position on contig=7797..7836bp; Strand=-; Gene name=MenD
ccagccataatctccttttatggctgggctttaccctttc

SEQ ID NO: 13075 - DNA, 30 bp, Xenorhabdus bovienii
  Terminator sequence Name=Xb4151_4152.C401.trmnator5; Position on contig=13892..13921bp; Strand=-
cccgcaactttctgcgggttcatatcaatc

SEQ ID NO: 13076 - DNA, 46 bp, Xenorhabdus bovienii
  Terminator sequence Name=Xb4151_4152.C402.trmnator1; Position on contig=34..79bp; Strand=-
gtaaaaaagaggtggaaaaaccacttctttttacattttttagtct

SEQ ID NO: 13077 - DNA, 38 bp, Xenorhabdus bovienii
  Terminator sequence Name=Xb4151_4152.C402.trmnator2; Position on contig=5575..5612bp; Strand=+; Gene name=NrfG
tcaacagcagctacggctgctgttatttttcatagttc

SEQ ID NO: 13078 - DNA, 29 bp, Xenorhabdus bovienii
  Terminator sequence Name=Xb4151_4152.C402.trmnator3; Position on contig=6272..6300bp; Strand=+
cgcgctcaatgagcgcgtttttattgccc

SEQ ID NO: 13079 - DNA, 44 bp, Xenorhabdus bovienii
  Terminator sequence Name=Xb4151_4152.C402.trmnator4; Position on contig=7713..7756bp; Strand=+; Gene name=PheA
tagaaaaccggatgttttcatccggtttcacaatttggaatcga

SEQ ID NO: 13080 - DNA, 38 bp, Xenorhabdus bovienii
  Terminator sequence Name=Xb4151_4152.C402.trmnator5; Position on contig=7704..7741bp; Strand=-; Gene name=PheA
gaaaccggatgaaaacatccggttttctattttaacag

SEQ ID NO: 13081 - DNA, 43 bp, Xenorhabdus bovienii
  Terminator sequence Name=Xb4151_4152.C402.trmnator6; Position on contig=11030..11072bp; Strand=-; Gene name=AroG
tatagaggcctgcatatgcaggcctctaattatttattacaag

SEQ ID NO: 13082 - DNA, 52 bp, Xenorhabdus bovienii
  Terminator sequence Name=Xb4151_4152.C402.trmnator7; Position on contig=13138..13189bp; Strand=-; Gene name=RpsP
gaatagccggacttcattcctcgatgaagtctggttgttttgttaactaatg

SEQ ID NO: 13083 - DNA, 37 bp, Xenorhabdus bovienii
  Terminator sequence Name=Xb4151_4152.C403.trmnator1; Position on contig=5007..5043bp; Strand=+; Gene name=BioA
gccagcattaataacatgctggccttatttatcattc

SEQ ID NO: 13084 - DNA, 40 bp, Xenorhabdus bovienii
  Terminator sequence Name=Xb4151_4152.C403.trmnator2; Position on contig=5893..5932bp; Strand=+
ttgccgcgctaaaaatagcgcggctcaagtttacaatgcc

SEQ ID NO: 13085 - DNA, 36 bp, Xenorhabdus bovienii
  Terminator sequence Name=Xb4151_4152.C403.trmnator3; Position on contig=5881..5916bp; Strand=-
gccgcgctatttttagcgcggcaatattttcccttt

SEQ ID NO: 13086 - DNA, 32 bp, Xenorhabdus bovienii
  Terminator sequence Name=Xb4151_4152.C403.trmnator4; Position on contig=7985..8016bp; Strand=+; Gene name=Cof
ttgacctgaccgcaggttaagttcttcccgcg

SEQ ID NO: 13087 - DNA, 47 bp, Xenorhabdus bovienii
  Terminator sequence Name=Xb4151_4152.C403.trmnator5; Position on contig=7875..7921bp; Strand=-; Gene name=Cof
ttgaaggagcgcggttgtctggcgctccgtttaatttgatttaaccg

SEQ ID NO: 13088 - DNA, 33 bp, Xenorhabdus bovienii
  Terminator sequence Name=Xb4151_4152.C403.trmnator6; Position on contig=10676..10708bp; Strand=-; Gene name=ModA
ttacccggttctgccgggtaatttctttttccc

SEQ ID NO: 13089 - DNA, 43 bp, Xenorhabdus bovienii
  Terminator sequence Name=Xb4151_4152.C403.trmnator7; Position on contig=11906..11948bp; Strand=+; Gene name=ModE
gtgtcagggggaatgacaactcatctgatgcattctgtaacca

SEQ ID NO: 13090 - DNA, 63 bp, Xenorhabdus bovienii
  Terminator sequence Name=Xb4151_4152.C403.trmnator8; Position on contig=13558..13620bp; Strand=+; Gene name=ModF
tcagtgcaagtcctctcccgatttaacgtcgaaagagggctttcactcgaacctttttactaa

SEQ ID NO: 13091 - DNA, 54 bp, Xenorhabdus bovienii
  Terminator sequence Name=Xb4151_4152.C403.trmnator9; Position on contig=15512..15565bp; Strand=+; Gene name=GpmA
gtaatactaaaaagccggaaatcactccggcttttttatgctgctttatcccct

SEQ ID NO: 13092 - DNA, 43 bp, Xenorhabdus bovienii
  Terminator sequence Name=Xb4151_4152.C403.trmnator10; Position on contig=15507..15549bp; Strand=-; Gene name=GpmA
taaaaaagccggagtgatttccggctttttagtattacgtttc

SEQ ID NO: 13093 - DNA, 45 bp, Xenorhabdus bovienii
  Terminator sequence Name=Xb4151_4152.C403.trmnator11; Position on contig=16801..16845bp; Strand=-; Gene name=AroG
caggtcataggtagtcaatctatctacggcctgttattgagtgtt

SEQ ID NO: 13094 - DNA, 48 bp, Xenorhabdus bovienii
  Terminator sequence Name=Xb4151_4152.C404.trmnator1; Position on contig=4152..4199bp; Strand=+; Gene name=CitB
taaaaaaatcggtaattgttgttaccgatttttttattatccaatggg

SEQ ID NO: 13095 - DNA, 54 bp, Xenorhabdus bovienii
  Terminator sequence Name=Xb4151_4152.C404.trmnator2; Position on contig=7141..7194bp; Strand=-; Gene name=BaeS
tattaaaaaagcaggcattttaatgcctgctttttttgtgcaatttttttacaa

SEQ ID NO: 13096 - DNA, 31 bp, Xenorhabdus bovienii
  Terminator sequence Name=Xb4151_4152.C404.trmnator3; Position on contig=14617..14647bp; Strand=+; Gene name=NrdF
ccctgccgtcacggcagggtttatccgtcta

SEQ ID NO: 13097 - DNA, 43 bp, Xenorhabdus bovienii
  Terminator sequence Name=Xb4151_4152.C404.trmnator4; Position on contig=16142..16184bp; Strand=+
cctgaactctttaaatcatagggttcaggattttttatataaa

SEQ ID NO: 13098 - DNA, 62 bp, Xenorhabdus bovienii
  Terminator sequence Name=Xb4151_4152.C404.trmnator5; Position on contig=17034..17095bp; Strand=-
tatttttttcaggcttatcaagcccaaatttgatgagtcttaacatgataattatcttacgt

SEQ ID NO: 13099 - DNA, 33 bp, Xenorhabdus bovienii
  Terminator sequence Name=Xb4151_4152.C404.trmnator6; Position on contig=17549..17581bp; Strand=-
gtgctagctgcttgctagcacatttagctaaat

SEQ ID NO: 13100 - DNA, 48 bp, Xenorhabdus bovienii
  Terminator sequence Name=Xb4151_4152.C404.trmnator7; Position on contig=19631..19678bp; Strand=+; Gene name=CspC
tataaaagcctcgcagaaatgcgaggctttttcgtatctatcagtcgt

SEQ ID NO: 13101 - DNA, 33 bp, Xenorhabdus bovienii
  Terminator sequence Name=Xb4151_4152.C404.trmnator8; Position on contig=19625..19657bp; Strand=-; Gene name=CspC
gcctcgcatttctgcgaggcttttataataacc

SEQ ID NO: 13102 - DNA, 35 bp, Xenorhabdus bovienii
  Terminator sequence Name=Xb4151_4152.C405.trmnator1; Position on contig=5448..5482bp; Strand=-
tggtggcggatatcgccaccgtttttcactggtca

SEQ ID NO: 13103 - DNA, 44 bp, Xenorhabdus bovienii
  Terminator sequence Name=Xb4151_4152.C405.trmnator2; Position on contig=9296..9339bp; Strand=+
tagtattcaggggctcttgcccctgaatactaatttggcttttt

SEQ ID NO: 13104 - DNA, 39 bp, Xenorhabdus bovienii
  Terminator sequence Name=Xb4151_4152.C405.trmnator3; Position on contig=9286..9324bp; Strand=-
tattcaggggcaagagcccctgaatactatattatataa

SEQ ID NO: 13105 - DNA, 55 bp, Xenorhabdus bovienii
  Terminator sequence Name=Xb4151_4152.C405.trmnator4; Position on contig=11723..11777bp; Strand=-; Gene name=Tra5
taatggattgagttctgtactcaaccggactcaatccattcaatttaattttgat

SEQ ID NO: 13106 - DNA, 58 bp, Xenorhabdus bovienii
  Terminator sequence Name=Xb4151_4152.C405.trmnator5; Position on contig=13438..13495bp; Strand=+
cctttgattccctaggtaattaaatcacctaggggtcattagaggaatattttacttc

SEQ ID NO: 13107 - DNA, 34 bp, Xenorhabdus bovienii
  Terminator sequence Name=Xb4151_4152.C405.trmnator6; Position on contig=13380..13413bp; Strand=-
cgttctgcctattgggtaaatgttactccatctt

SEQ ID NO: 13108 - DNA, 46 bp, Xenorhabdus bovienii
  Terminator sequence Name=Xb4151_4152.C406.trmnator1; Position on contig=823..868bp; Strand=+
taacctcgtcttgtgcagtgatacgacgaggttatattctgaaata

SEQ ID NO: 13109 - DNA, 55 bp, Xenorhabdus bovienii
  Terminator sequence Name=Xb4151_4152.C406.trmnator2; Position on contig=807..861bp; Strand=-
gaatataacctcgtcgtatcactgcacaagacgaggttatttcttcattcttctg

SEQ ID NO: 13110 - DNA, 32 bp, Xenorhabdus bovienii
  Terminator sequence Name=Xb4151_4152.C406.trmnator3; Position on contig=2625..2656bp; Strand=-; Gene name=AnsB
gcctgatccttacatcaggctttttttattcc

SEQ ID NO: 13111 - DNA, 39 bp, Xenorhabdus bovienii
  Terminator sequence Name=Xb4151_4152.C406.trmnator4; Position on contig=7891..7929bp; Strand=+; Gene name=TopA
cacagcaccgttattgaaggtgctgtgttttcatgtctg

SEQ ID NO: 13112 - DNA, 64 bp, Xenorhabdus bovienii
  Terminator sequence Name=Xb4151_4152.C406.trmnator5; Position on contig=7867..7930bp; Strand=-; Gene name=TopA
tcagacatgaaaacacagcaccttcaataacggtgctgtgttttcattctggttactcttactc

SEQ ID NO: 13113 - DNA, 31 bp, Xenorhabdus bovienii
  Terminator sequence Name=Xb4151_4152.C406.trmnator6; Position on contig=13575..13605bp; Strand=+; Gene name=CheY
cgcctgcttacgcgggcgattttcttcacac

SEQ ID NO: 13114 - DNA, 42 bp, Xenorhabdus bovienii
  Terminator sequence Name=Xb4151_4152.C406.trmnator7; Position on contig=17010..17051bp; Strand=+; Gene name=WcaG
taaaaaggagcgaaccgctccttttttataattctatgttaa

SEQ ID NO: 13115 - DNA, 41 bp, Xenorhabdus bovienii
  Terminator sequence Name=Xb4151_4152.C406.trmnator8; Position on contig=17170..17210bp; Strand=-; Gene name=WcaG
caaaaataccctatcaagggtatttttgttttatgattaat

SEQ ID NO: 13116 - DNA, 37 bp, Xenorhabdus bovienii
  Terminator sequence Name=Xb4151_4152.C406.trmnator9; Position on contig=18939..18975bp; Strand=+; Gene name=Tdk
ggcgcagaggatggtttctgcaccttttaaattacat

SEQ ID NO: 13117 - DNA, 50 bp, Xenorhabdus bovienii
  Terminator sequence Name=Xb4151_4152.C406.trmnator10; Position on contig=18919..18968bp; Strand=-; Gene name=Tdk
ttaaaaggtgcagaaaccatcctctgcgcctttttataatttcattttct

SEQ ID NO: 13118 - DNA, 58 bp, Xenorhabdus bovienii
  Terminator sequence Name=Xb4151_4152.C406.trmnator11; Position on contig=21858..21915bp; Strand=-; Gene name=EutG
tcataaaggcatatagctgaatggagtcagctatatgttttagtgatttagatcacta

SEQ ID NO: 13119 - DNA, 37 bp, Xenorhabdus bovienii
  Terminator sequence Name=Xb4151_4152.C407.trmnator1; Position on contig=1697..1733bp; Strand=+; Gene name=Hmp
gggcgtatctttactacatacgcccgttatcacttca

SEQ ID NO: 13120 - DNA, 44 bp, Xenorhabdus bovienii
  Terminator sequence Name=Xb4151_4152.C407.trmnator2; Position on contig=8304..8347bp; Strand=-
cctttatataagtccctgaagatttattagggtcttaagttaaa

SEQ ID NO: 13121 - DNA, 25 bp, Xenorhabdus bovienii
  Terminator sequence Name=Xb4151_4152.C407.trmnator3; Position on contig=14214..14238bp; Strand=+; Gene name=MltE
ccggctgcgccggttttcatatcac

SEQ ID NO: 13122 - DNA, 45 bp, Xenorhabdus bovienii
  Terminator sequence Name=Xb4151_4152.C407.trmnator4; Position on contig=13904..13948bp; Strand=-; Gene name=MltE
gaggcacgatgatcttatcaatcggtgtttcatattctgctttct

SEQ ID NO: 13123 - DNA, 43 bp, Xenorhabdus bovienii
  Terminator sequence Name=Xb4151_4152.C407.trmnator5; Position on contig=18350..18392bp; Strand=-
tgggcgtgagaatattattttctcacgcccactattattcagg

SEQ ID NO: 13124 - DNA, 30 bp, Xenorhabdus bovienii; identical to SEQ ID NO: 13075
  Terminator sequence Name=Xb4151_4152.C407.trmnator6; Position on contig=22255..22284bp; Strand=+

SEQ ID NO: 13125 - DNA, 38 bp, Xenorhabdus bovienii
  Terminator sequence Name=Xb4151_4152.C407.trmnator7; Position on contig=24332..24369bp; Strand=+
gtgtcattccgtttatggaaaggcgcattatccatcac

SEQ ID NO: 13126 - DNA, 29 bp, Xenorhabdus bovienii
  Terminator sequence Name=Xb4151_4152.C408.trmnator1; Position on contig=310..338bp; Strand=+
gccaccgttacggtggcttttatggatga

SEQ ID NO: 13127 - DNA, 53 bp, Xenorhabdus bovienii
  Terminator sequence Name=Xb4151_4152.C408.trmnator2; Position on contig=399..451bp; Strand=-
ctttaacgcctgcttctttgacaagcaggcgttacatgaggattgttaattca

SEQ ID NO: 13128 - DNA, 46 bp, Xenorhabdus bovienii
  Terminator sequence Name=Xb4151_4152.C408.trmnator3; Position on contig=1458..1503bp; Strand=+
caacctgggttttataaatatctgactcaggttgttatgtttatta

SEQ ID NO: 13129 - DNA, 39 bp, Xenorhabdus bovienii
  Terminator sequence Name=Xb4151_4152.C408.trmnator4; Position on contig=1424..1462bp; Strand=-
ggttgttgatttacctaatcaataatttatctgattact

SEQ ID NO: 13130 - DNA, 44 bp, Xenorhabdus bovienii
  Terminator sequence Name=Xb4151_4152.C408.trmnator5; Position on contig=2451..2494bp; Strand=+; Gene name=GlpF
tgaacagccatgctattgcgtggctttttatcatatttatggta

SEQ ID NO: 13131 - DNA, 57 bp, Xenorhabdus bovienii
  Terminator sequence Name=Xb4151_4152.C408.trmnator6; Position on contig=3028..3084bp; Strand=+; Gene name=WecD
tgggtggatcataaaaatgaagatttttatcagatccgcgttgacttcttgcagaac

SEQ ID NO: 13132 - DNA, 66 bp, Xenorhabdus bovienii
  Terminator sequence Name=Xb4151_4152.C408.trmnator7; Position on contig=10891..10956bp; Strand=-; Gene name=Gst
tatttggtatggcctgtttgacaaagattcattatcgataggccatactaggtattctctccagcg

SEQ ID NO: 13133 - DNA, 35 bp, Xenorhabdus bovienii
  Terminator sequence Name=Xb4151_4152.C408.trmnator8; Position on contig=12909..12943bp; Strand=-; Gene name=Acs
gcggttctgcctgcaagaaccgcttctcatctgca

SEQ ID NO: 13134 - DNA, 39 bp, Xenorhabdus bovienii
  Terminator sequence Name=Xb4151_4152.C408.trmnator9; Position on contig=18517..18555bp; Strand=+; Gene name=PspF
ctattgggataattatcaccaatgtgacattttaaaatg

SEQ ID NO: 13135 - DNA, 41 bp, Xenorhabdus bovienii
  Terminator sequence Name=Xb4151_4152.C408.trmnator10; Position on contig=18848..18888bp; Strand=-; Gene name=PspF
gtgaggacaggtaatattctgtcttttactctgtgatctgc

SEQ ID NO: 13136 - DNA, 37 bp, Xenorhabdus bovienii
  Terminator sequence Name=Xb4151_4152.C408.trmnator11; Position on contig=23549..23585bp; Strand=+
ccgtgtggaatgattcgtcccacggtctatttgtttt

SEQ ID NO: 13137 - DNA, 53 bp, Xenorhabdus bovienii
  Terminator sequence Name=Xb4151_4152.C409.trmnator1; Position on contig=620..672bp; Strand=+; Gene name=InfC
gtaatgggctccagtcagtttttggttggagtctattcgccttactaattcgt

SEQ ID NO: 13138 - DNA, 35 bp, Xenorhabdus bovienii
  Terminator sequence Name=Xb4151_4152.C409.trmnator2; Position on contig=1309..1343bp; Strand=+; Gene name=RplT
gaagagggagcaagctccctcttttactttccccc

SEQ ID NO: 13139 - DNA, 50 bp, Xenorhabdus bovienii
  Terminator sequence Name=Xb4151_4152.C409.trmnator3; Position on contig=5295..5344bp; Strand=+; Gene name=HimA
taaaaaaggccgcatttttgtgcggtctttttcttacctttaatatcctg

SEQ ID NO: 13140 - DNA, 36 bp, Xenorhabdus bovienii
  Terminator sequence Name=Xb4151_4152.C409.trmnator4; Position on contig=7265..7300bp; Strand=+; Gene name=FepC
tgatgtttcgttgaacaaacgtcatttaaaattttt

SEQ ID NO: 13141 - DNA, 42 bp, Xenorhabdus bovienii
  Terminator sequence Name=Xb4151_4152.C409.trmnator5; Position on contig=13816..13857bp; Strand=-
cggtattggctgtcaggataggcaagaccgtattctaactcg

SEQ ID NO: 13142 - DNA, 32 bp, Xenorhabdus bovienii
  Terminator sequence Name=Xb4151_4152.C409.trmnator6; Position on contig=14990..15021bp; Strand=-; Gene name=RhaT
caccttacctacggagggtgttgtctgccctc

SEQ ID NO: 13143 - DNA, 42 bp, Xenorhabdus bovienii
  Terminator sequence Name=Xb4151_4152.C409.trmnator7; Position on contig=15993..16034bp; Strand=+
ttaagttgttgcactatccgacgatttaaatttgacgctctc

SEQ ID NO: 13144 - DNA, 39 bp, Xenorhabdus bovienii
  Terminator sequence Name=Xb4151_4152.C409.trmnator8; Position on contig=18122..18160bp; Strand=-; Gene name=LplA
tggtcaacttccctattgttgaccatttttttgccttca

SEQ ID NO: 13145 - DNA, 45 bp, Xenorhabdus bovienii
  Terminator sequence Name=Xb4151_4152.C409.trmnator9; Position on contig=20168..20212bp; Strand=+
ggcaaattttgtgaataccaacaaaatttgccttttcaatatggt

SEQ ID NO: 13146 - DNA, 42 bp, Xenorhabdus bovienii
  Terminator sequence Name=Xb4151_4152.C409.trmnator10; Position on contig=26344..26385bp; Strand=-; Gene name=CirA
gataattattctcgatattagaatagttattattaagatttg

SEQ ID NO: 13147 - DNA, 49 bp, Xenorhabdus bovienii
  Terminator sequence Name=Xb4151_4152.C409.trmnator11; Position on contig=31243..31291bp; Strand=+; Gene name=PpsA
ttaaaaagcctgttggaatatttacaggcttttttgttttgtgtagcac

SEQ ID NO: 13148 - DNA, 39 bp, Xenorhabdus bovienii
  Terminator sequence Name=Xb4151_4152.C409.trmnator12; Position on contig=31645..31683bp; Strand=-; Gene name=PpsA
tgcgcgaaaatattattttttcgcgcaattatcatattg

SEQ ID NO: 13149 - DNA, 45 bp, Xenorhabdus bovienii
  Terminator sequence Name=Xb4151_4152.C410.trmnator1; Position on contig=2656..2700bp; Strand=-; Gene name=SUA5
gttcgtcctctaaagactcaaggagatggacatattgttaaagaa

SEQ ID NO: 13150 - DNA, 38 bp, Xenorhabdus bovienii
  Terminator sequence Name=Xb4151_4152.C410.trmnator2; Position on contig=5590..5627bp; Strand=+; Gene name=Fmt
gcctgtatactctgagcatacgggcgtcttccttttta

SEQ ID NO: 13151 - DNA, 35 bp, Xenorhabdus bovienii
  Terminator sequence Name=Xb4151_4152.C410.trmnator3; Position on contig=8232..8266bp; Strand=-; Gene name=TrkA
tggtggtagtctaatatcaccaatcttgcgtccaa

SEQ ID NO: 13152 - DNA, 62 bp, Xenorhabdus bovienii
  Terminator sequence Name=Xb4151_4152.C410.trmnator4; Position on contig=9274..9335bp; Strand=-; Gene name=SoxR
tagaagcataaaaaaccgggataacacccggttttttattgctctttatttttccttccaat

SEQ ID NO: 13153 - DNA, 44 bp, Xenorhabdus bovienii
  Terminator sequence Name=Xb4151_4152.C410.trmnator5; Position on contig=12291..12334bp; Strand=-; Gene name=RpsM
ggttgagctggctaaattagccagccaatcttttttatctgaca

SEQ ID NO: 13154 - DNA, 43 bp, Xenorhabdus bovienii
  Terminator sequence Name=Xb4151_4152.C410.trmnator6; Position on contig=18007..18049bp; Strand=-; Gene name=RplN
taaacggctcaaaaagtaacgggccgtttatttttctgtccat

SEQ ID NO: 13155 - DNA, 36 bp, Xenorhabdus bovienii
  Terminator sequence Name=Xb4151_4152.C410.trmnator7; Position on contig=23286..23321bp; Strand=-; Gene name=RpsJ
cgccctataaatttgcatagggcgttttcccctcct

SEQ ID NO: 13156 - DNA, 38 bp, Xenorhabdus bovienii
  Terminator sequence Name=Xb4151_4152.C411.trmnator1; Position on contig=16667..16704bp; Strand=-
gtaccctcattgaatatgagggtgccttattaatacga

SEQ ID NO: 13157 - DNA, 36 bp, Xenorhabdus bovienii
  Terminator sequence Name=Xb4151_4152.C411.trmnator2; Position on contig=17731..17766bp; Strand=-; Gene name=PurR
gaaccctactgtaaagtagggttttttcatcatctt

SEQ ID NO: 13158 - DNA, 36 bp, Xenorhabdus bovienii
  Terminator sequence Name=Xb4151_4152.C411.trmnator3; Position on contig=20157..20192bp; Strand=-; Gene name=IlvB
ctaacgttagtctctaacgttatgttaattaatctg

SEQ ID NO: 13159 - DNA, 39 bp, Xenorhabdus bovienii
  Terminator sequence Name=Xb4151_4152.C411.trmnator4; Position on contig=28635..28673bp; Strand=+; Gene name=MutH
ttgcttcgcttgcagtgtgaagtgaaatttagtgttatc

SEQ ID NO: 13160 - DNA, 42 bp, Xenorhabdus bovienii
  Terminator sequence Name=Xb4151_4152.C411.trmnator5; Position on contig=29084..29125bp; Strand=-
tttgagtacggcgtcttgtgccgttttaaattattgtgataa

SEQ ID NO: 13161 - DNA, 48 bp, Xenorhabdus bovienii
  Terminator sequence Name=Xb4151_4152.C412.trmnator1; Position on contig=5916..5963bp; Strand=-; Gene name=FcbC
tgatggataaggggcctctgagggcccttatcctcattatggctctgg

SEQ ID NO: 13162 - DNA, 44 bp, Xenorhabdus bovienii
  Terminator sequence Name=Xb4151_4152.C412.trmnator2; Position on contig=9424..9467bp; Strand=-; Gene name=CydA
gaaaaaggtcacctttgggtgacctttatatttatatttatatt

SEQ ID NO: 13163 - DNA, 43 bp, Xenorhabdus bovienii
  Terminator sequence Name=Xb4151_4152.C412.trmnator3; Position on contig=15856..15898bp; Strand=-; Gene name=SucA
cttttagaaactgatatccagtttttaaaggttccttgaaggg

SEQ ID NO: 13164 - DNA, 38 bp, Xenorhabdus bovienii
  Terminator sequence Name=Xb4151_4152.C412.trmnator4; Position on contig=23374..23411bp; Strand=-; Gene name=ProP
cgaggctatcagaacggtagccccgttgttttttccca

SEQ ID NO: 13165 - DNA, 44 bp, Xenorhabdus bovienii
  Terminator sequence Name=Xb4151_4152.C412.trmnator5; Position on contig=24300..24343bp; Strand=-
gacaccttgcctgtttatgctggcgaggtgttttgcttttatcg

SEQ ID NO: 13166 - DNA, 43 bp, Xenorhabdus bovienii
  Terminator sequence Name=Xb4151_4152.C412.trmnator6; Position on contig=32646..32688bp; Strand=-; Gene name=OmpR
cgctgttggtcagcaattcggtcagcagacgatattccgtcgg

SEQ ID NO: 13167 - DNA, 61 bp, Xenorhabdus bovienii
  Terminator sequence Name=Xb4151_4152.C412.trmnator7; Position on contig=39312..39372bp; Strand=-; Gene name=MhpC
tgattttattatcagtccacatagagtgtggactgatattgtaattatttttttgctaaaa

SEQ ID NO: 13168 - DNA, 50 bp, Xenorhabdus bovienii
  Terminator sequence Name=Xb4151_4152.C413.trmnator1; Position on contig=510..559bp; Strand=-
ttatgaacatattaatgtgataattaatatgttcataattatcacattta

SEQ ID NO: 13169 - DNA, 41 bp, Xenorhabdus bovienii
  Terminator sequence Name=Xb4151_4152.C413.trmnator2; Position on contig=7445..7485bp; Strand=+
gttgacagtttggtactaattgtcaactgttttcgttttcc

SEQ ID NO: 13170 - DNA, 32 bp, Xenorhabdus bovienii
  Terminator sequence Name=Xb4151_4152.C413.trmnator3; Position on contig=30469..30500bp; Strand=+
tggctcacgaaagtgagccatttttttgcgat

SEQ ID NO: 13171 - DNA, 52 bp, Xenorhabdus bovienii
  Terminator sequence Name=Xb4151_4152.C413.trmnator4; Position on contig=37351..37402bp; Strand=+
tatcatctatatttatatgatgttaattatatggatgatgttttggtcatga

SEQ ID NO: 13172 - DNA, 39 bp, Xenorhabdus bovienii
  Terminator sequence Name=Xb4151_4152.C414.trmnator1; Position on contig=916..954bp; Strand=+; Gene name=GapA
taaagccaccttaaacaggcggctttatttttatctatt

SEQ ID NO: 13173 - DNA, 31 bp, Xenorhabdus bovienii
  Terminator sequence Name=Xb4151_4152.C414.trmnator2; Position on contig=1960..1990bp; Strand=+
tgaagagttcagcttttcatctttcttgaca

SEQ ID NO: 13174 - DNA, 52 bp, Xenorhabdus bovienii
  Terminator sequence Name=Xb4151_4152.C414.trmnator3; Position on contig=2963..3014bp; Strand=-
caggcatttttccgtaccgaaatttggaataatgcctgtatttttttataac

SEQ ID NO: 13175 - DNA, 35 bp, Xenorhabdus bovienii
  Terminator sequence Name=Xb4151_4152.C414.trmnator4; Position on contig=5863..5897bp; Strand=-; Gene name=DadA
gcgtactagcttagttagtgcgctcttttacatta

SEQ ID NO: 13176 - DNA, 40 bp, Xenorhabdus bovienii
  Terminator sequence Name=Xb4151_4152.C414.trmnator5; Position on contig=8486..8525bp; Strand=+; Gene name=NhaB
ccggatggtggaaatgtgcactgtccggttttttattgcc

SEQ ID NO: 13177 - DNA, 28 bp, Xenorhabdus bovienii
  Terminator sequence Name=Xb4151_4152.C414.trmnator6; Position on contig=9242..9269bp; Strand=+; Gene name=DsbB
cagcccttacgggctgtttcttaagaaa

SEQ ID NO: 13178 - DNA, 51 bp, Xenorhabdus bovienii
  Terminator sequence Name=Xb4151_4152.C414.trmnator7; Position on contig=9274..9324bp; Strand=-; Gene name=DsbB
gtaaacacaccgacggcgatgttggagtctgtgtttgctattttgtacgat

SEQ ID NO: 13179 - DNA, 43 bp, Xenorhabdus bovienii
  Terminator sequence Name=Xb4151_4152.C414.trmnator8; Position on contig=11094..11136bp; Strand=+; Gene name=MesJ
tagccgatgtaaaaactgacatcggcaataattaatcaattat

SEQ ID NO: 13180 - DNA, 38 bp, Xenorhabdus bovienii
  Terminator sequence Name=Xb4151_4152.C414.trmnator9; Position on contig=11082..11119bp; Strand=-; Gene name=MesJ
gccgatgtcagtttttacatcggctatttttttcgcta

SEQ ID NO: 13181 - DNA, 43 bp, Xenorhabdus bovienii
  Terminator sequence Name=Xb4151_4152.C414.trmnator10; Position on contig=14706..14748bp; Strand=+; Gene name=Tpx
ttggcggcgagctatttgtagttgccgccaacttattttatca

SEQ ID NO: 13182 - DNA, 42 bp, Xenorhabdus bovienii
  Terminator sequence Name=Xb4151_4152.C414.trmnator11; Position on contig=16130..16171bp; Strand=-; Gene name=SPS1
gctccatcaaatattttatctgatggggccaatttttggact

SEQ ID NO: 13183 - DNA, 47 bp, Xenorhabdus bovienii
  Terminator sequence Name=Xb4151_4152.C414.trmnator12; Position on contig=23230..23276bp; Strand=+; Gene name=PspF
ttctcaatagtatttgtaaagtattttattgagaatttttctcatta

SEQ ID NO: 13184 - DNA, 45 bp, Xenorhabdus bovienii
  Terminator sequence Name=Xb4151_4152.C414.trmnator13; Position on contig=29723..29767bp; Strand=+; Gene name=FabI
taagcctggtgataactgtatttctgggcttatttttttccctcc

SEQ ID NO: 13185 - DNA, 40 bp, Xenorhabdus bovienii
  Terminator sequence Name=Xb4151_4152.C414.trmnator14; Position on contig=30148..30187bp; Strand=-; Gene name=FabI
tatttttttggcgcaccggaagcgataattctcagattta

SEQ ID NO: 13186 - DNA, 43 bp, Xenorhabdus bovienii
  Terminator sequence Name=Xb4151_4152.C414.trmnator15; Position on contig=35298..35340bp; Strand=+; Gene name=SlyB
tcgcggcttgccagtatctactggaccgcgattttctctttat

SEQ ID NO: 13187 - DNA, 68 bp, Xenorhabdus bovienii
  Terminator sequence Name=Xb4151_4152.C414.trmnator16; Position on contig=35272..35339bp; Strand=-; Gene name=SlyB
taaagagaaaatcgcggtccagtagatactggcaagccgcgatttttttggtttgattgtacgtgaac

SEQ ID NO: 13188 - DNA, 29 bp, Xenorhabdus bovienii
  Terminator sequence Name=Xb4151_4152.C414.trmnator17; Position on contig=37414..37442bp; Strand=+; Gene name=GloA
gggcattccccatgcccttcatttctaaa

SEQ ID NO: 13189 - DNA, 41 bp, Xenorhabdus bovienii
  Terminator sequence Name=Xb4151_4152.C414.trmnator18; Position on contig=38180..38220bp; Strand=+; Gene name=DnaQ
gccccatacctactgaagatgtatggggctttaaccattat

SEQ ID NO: 13190 - DNA, 50 bp, Xenorhabdus bovienii
  Terminator sequence Name=Xb4151_4152.C414.trmnator19; Position on contig=38164..38213bp; Strand=-; Gene name=DnaQ
ttaaagccccatacatcttcagtaggtatggggcttgatttatcaggatt

SEQ ID NO: 13191 - DNA, 53 bp, Xenorhabdus bovienii
  Terminator sequence Name=Xb4151_4152.C414.trmnator20; Position on contig=43329..43381bp; Strand=+; Gene name=ProP
tcatctaaaggttgcgtcataaatgtgacctttagatgattgtttaaatatta

SEQ ID NO: 13192 - DNA, 36 bp, Xenorhabdus bovienii
  Terminator sequence Name=Xb4151_4152.C414.trmnator21; Position on contig=44783..44818bp; Strand=+; Gene name=Cfa
gctacagaaccatatttctgtagctttcccctgtaa

SEQ ID NO: 13193 - DNA, 54 bp, Xenorhabdus bovienii
  Terminator sequence Name=Xb4151_4152.C414.trmnator22; Position on contig=44760..44813bp; Strand=-; Gene name=Cfa
ggggaaagctacagaaatatggttctgtagctttttgtacaacctttttaggtt

SEQ ID NO: 13194 - DNA, 69 bp, Xenorhabdus bovienii
  Terminator sequence Name=Xb4151_4152.C414.trmnator23; Position on contig=47273..47341bp; Strand=+; Gene name=NorM
gagcaccaccttgacatggtgggggtcggtggttcgagtccactcggacgcaccatatatctgtctgac

SEQ ID NO: 13195 - DNA, 50 bp, Xenorhabdus bovienii
  Terminator sequence Name=Xb4151_4152.C414.trmnator24; Position on contig=49365..49414bp; Strand=+; Gene name=PykF
gaataagctgcccagacattgggcagtcttgttagcgatgttaataacta

SEQ ID NO: 13196 - DNA, 38 bp, Xenorhabdus bovienii
  Terminator sequence Name=Xb4151_4152.C414.trmnator25; Position on contig=50145..50182bp; Strand=+
tggcgtaccaagtaaggtacgccatttttatattcgcc

SEQ ID NO: 13197 - DNA, 49 bp, Xenorhabdus bovienii
  Terminator sequence Name=Xb4151_4152.C414.trmnator26; Position on contig=50126..50174bp; Strand=-
taaaaatggcgtaccttacttggtacgccatttttgttatctgctgcaa

SEQ ID NO: 13198 - DNA, 38 bp, Xenorhabdus bovienii
  Terminator sequence Name=Xb4151_4152.C415.trmnator1; Position on contig=4537..4574bp; Strand=+
gaatggcgatataaatcgccattctttttaatggaaat

SEQ ID NO: 13199 - DNA, 37 bp, Xenorhabdus bovienii
  Terminator sequence Name=Xb4151_4152.C415.trmnator2; Position on contig=4524..4560bp; Strand=-
gaatggcgatttatatcgccattcttatgtgtttacc

SEQ ID NO: 13200 - DNA, 37 bp, Xenorhabdus bovienii
  Terminator sequence Name=Xb4151_4152.C415.trmnator3; Position on contig=8269..8305bp; Strand=+
tgacaggggcacgtagctcctgatagttattctggtt

SEQ ID NO: 13201 - DNA, 39 bp, Xenorhabdus bovienii
  Terminator sequence Name=Xb4151_4152.C415.trmnator4; Position on contig=10949..10987bp; Strand=+; Gene name=DnaQ
ggtcagaacggttagcgtactgacctatttcatctcact

SEQ ID NO: 13202 - DNA, 38 bp, Xenorhabdus bovienii
  Terminator sequence Name=Xb4151_4152.C415.trmnator5; Position on contig=14329..14366bp; Strand=-; Gene name=AroK
gtcacactttatcgtaagtgtggctctttgcttgatga

SEQ ID NO: 13203 - DNA, 49 bp, Xenorhabdus bovienii
  Terminator sequence Name=Xb4151_4152.C415.trmnator6; Position on contig=20848..20896bp; Strand=+; Gene name=PepD
gtgcctcccctgctcatcagccgtaggggagcttccctttcagcattac

SEQ ID NO: 13204 - DNA, 59 bp, Xenorhabdus bovienii
  Terminator sequence Name=Xb4151_4152.C415.trmnator7; Position on contig=23936..23994bp; Strand=-
tttatgttatggcaaaggcgacttctacgcttttgccatgctagattttttatttgatc

SEQ ID NO: 13205 - DNA, 41 bp, Xenorhabdus bovienii
  Terminator sequence Name=Xb4151_4152.C415.trmnator8; Position on contig=30092..30132bp; Strand=-; Gene name=BetA
ggttgtgcaaacagtattgcatatatccaattttctcgtac

SEQ ID NO: 13206 - DNA, 30 bp, Xenorhabdus bovienii
  Terminator sequence Name=Xb4151_4152.C415.trmnator9; Position on contig=34276..34305bp; Strand=-; Gene name=CirA
ggcagacattattctgccttatccagttgc

SEQ ID NO: 13207 - DNA, 52 bp, Xenorhabdus bovienii
  Terminator sequence Name=Xb4151_4152.C415.trmnator10; Position on contig=36453..36504bp; Strand=-
ggagggattgttataattgtggatataataaaccctacaacatttacatcat

SEQ ID NO: 13208 - DNA, 36 bp, Xenorhabdus bovienii
  Terminator sequence Name=Xb4151_4152.C416.trmnator1; Position on contig=4062..4097bp; Strand=+; Gene name=TrmA
cgccacagcgatcaatttgtggcgttattccttcag

SEQ ID NO: 13209 - DNA, 35 bp, Xenorhabdus bovienii
  Terminator sequence Name=Xb4151_4152.C416.trmnator2; Position on contig=4050..4084bp; Strand=-; Gene name=TrmA
gccacaaattgatcgctgtggcgttttggtctccc

SEQ ID NO: 13210 - DNA, 52 bp, Xenorhabdus bovienii
  Terminator sequence Name=Xb4151_4152.C416.trmnator3; Position on contig=6658..6709bp; Strand=-; Gene name=Lpd
gaaggttgtattaacgaaatattcgatagtattgccttctcctttttgttcc

SEQ ID NO: 13211 - DNA, 30 bp, Xenorhabdus bovienii
  Terminator sequence Name=Xb4151_4152.C416.trmnator4; Position on contig=7871..7900bp; Strand=-; Gene name=LysR
cctgcccaatccggcaggtttttctatatt

SEQ ID NO: 13212 - DNA, 33 bp, Xenorhabdus bovienii
  Terminator sequence Name=Xb4151_4152.C416.trmnator5; Position on contig=13742..13774bp; Strand=+; Gene name=ArgE
ccccgataagtgcgtcggggtttatcgctattt

SEQ ID NO: 13213 - DNA, 55 bp, Xenorhabdus bovienii
  Terminator sequence Name=Xb4151_4152.C416.trmnator6; Position on contig=15683..15737bp; Strand=-
gaatgaaaaatgccgaatggggaactgttcggcttttttatttttgattaagaat

SEQ ID NO: 13214 - DNA, 34 bp, Xenorhabdus bovienii
  Terminator sequence Name=Xb4151_4152.C416.trmnator7; Position on contig=22983..23016bp; Strand=+; Gene name=MetJ
cgcccgatgcaaacatcgggcgtttttgtttcaa

SEQ ID NO: 13215 - DNA, 62 bp, Xenorhabdus bovienii
  Terminator sequence Name=Xb4151_4152.C416.trmnator8; Position on contig=22955..23016bp; Strand=-; Gene name=MetJ
ttgaaacaaaaacgcccgatgtttgcatcgggcgtttttgtttgcatcagtattcccatgtt

SEQ ID NO: 13216 - DNA, 40 bp, Xenorhabdus bovienii
  Terminator sequence Name=Xb4151_4152.C416.trmnator9; Position on contig=25832..25871bp; Strand=+; Gene name=PriA
caaagtaacagattgatctgttactttgtttaaaatgcac

SEQ ID NO: 13217 - DNA, 48 bp, Xenorhabdus bovienii
  Terminator sequence Name=Xb4151_4152.C416.trmnator10; Position on contig=29918..29965bp; Strand=+; Gene name=HslU
tgaagaaatgggaggcttgcctcccatttcttcattttcattgcaata

SEQ ID NO: 13218 - DNA, 45 bp, Xenorhabdus bovienii
  Terminator sequence Name=Xb4151_4152.C416.trmnator11; Position on contig=30926..30970bp; Strand=+; Gene name=MenA
tatcagttttacacataagttttaagattgatgattttgccaaca

SEQ ID NO: 13219 - DNA, 48 bp, Xenorhabdus bovienii
  Terminator sequence Name=Xb4151_4152.C416.trmnator12; Position on contig=31542..31589bp; Strand=-; Gene name=MenG
tgttgagaagggcgatgaatacgccctctttaacattttgacataata

SEQ ID NO: 13220 - DNA, 42 bp, Xenorhabdus bovienii
  Terminator sequence Name=Xb4151_4152.C416.trmnator13; Position on contig=34568..34609bp; Strand=+; Gene name=GlpK
gctctgacaagcataccgctctgtcagagccttttagcggga

SEQ ID NO: 13221 - DNA, 44 bp, Xenorhabdus bovienii
  Terminator sequence Name=Xb4151_4152.C416.trmnator14; Position on contig=34555..34598bp; Strand=-; Gene name=GlpK
ggctctgacagagcggtatgcttgtcagagctttgatttccgta

SEQ ID NO: 13222 - DNA, 39 bp, Xenorhabdus bovienii
  Terminator sequence Name=Xb4151_4152.C416.trmnator15; Position on contig=37018..37056bp; Strand=+; Gene name=Hmp
ccgtttctgccatctcaccaaaacggtttgatccttcca

SEQ ID NO: 13223 - DNA, 42 bp, Xenorhabdus bovienii
  Terminator sequence Name=Xb4151_4152.C416.trmnator16; Position on contig=36875..36916bp; Strand=-; Gene name=Hmp
cggcgcaggtgttttgccatattgcgttgttctttcagaagc

SEQ ID NO: 13224 - DNA, 50 bp, Xenorhabdus bovienii
  Terminator sequence Name=Xb4151_4152.C416.trmnator17; Position on contig=38156..38205bp; Strand=+
cttatagggaatggcacaaatgctattccctataagcgtgttaattcaga

SEQ ID NO: 13225 - DNA, 33 bp, Xenorhabdus bovienii
  Terminator sequence Name=Xb4151_4152.C417.trmnator1; Position on contig=1157..1189bp; Strand=+
ggcgataaacccgtcatcgcctttgatggaaaa

SEQ ID NO: 13226 - DNA, 54 bp, Xenorhabdus bovienii
  Terminator sequence Name=Xb4151_4152.C417.trmnator2; Position on contig=2152..2205bp; Strand=+
taaatgatatttattatcatcctcattgagatgtattatttattttccaataat

SEQ ID NO: 13227 - DNA, 47 bp, Xenorhabdus bovienii
  Terminator sequence Name=Xb4151_4152.C417.trmnator3; Position on contig=2090..2136bp; Strand=-
gtaaataactgcgataataatatcgtggttatttctttgagatatca

SEQ ID NO: 13228 - DNA, 37 bp, Xenorhabdus bovienii
  Terminator sequence Name=Xb4151_4152.C417.trmnator4; Position on contig=14530..14566bp; Strand=+
tcagggatacgcagttatccctgaattgtcgtttggg

SEQ ID NO: 13229 - DNA, 38 bp, Xenorhabdus bovienii
  Terminator sequence Name=Xb4151_4152.C417.trmnator5; Position on contig=17334..17371bp; Strand=+
tgagttaaagcatttgtttaatttagcattttccgaat

SEQ ID NO: 13230 - DNA, 48 bp, Xenorhabdus bovienii
  Terminator sequence Name=Xb4151_4152.C417.trmnator6; Position on contig=17254..17301bp; Strand=-
tgagtaatcagctaagtgtcaacgttggtttgctcgtgttctaatgag

SEQ ID NO: 13231 - DNA, 55 bp, Xenorhabdus bovienii
  Terminator sequence Name=Xb4151_4152.C417.trmnator7; Position on contig=19445..19499bp; Strand=+; Gene name=AtoC
catgatttgataatttaattcatttaaattattgatattattgttttttaaaagt

SEQ ID NO: 13232 - DNA, 41 bp, Xenorhabdus bovienii
  Terminator sequence Name=Xb4151_4152.C417.trmnator8; Position on contig=28822..28862bp; Strand=+
caccctgtgagcggtatgctggcagggtgtttctttcagga

SEQ ID NO: 13233 - DNA, 59 bp, Xenorhabdus bovienii
  Terminator sequence Name=Xb4151_4152.C417.trmnator9; Position on contig=45775..45833bp; Strand=+
ctcagctcgtcttgatgatgactataaccattaagacgggctgagttatttttcattaa

SEQ ID NO: 13234 - DNA, 29 bp, Xenorhabdus bovienii
  Terminator sequence Name=Xb4151_4152.C417.trmnator10; Position on contig=46454..46482bp; Strand=+
gtcacctctcggtgactttctcatatatc

SEQ ID NO: 13235 - DNA, 37 bp, Xenorhabdus bovienii
  Terminator sequence Name=Xb4151_4152.C417.trmnator11; Position on contig=46530..46566bp; Strand=-
ggcagtctttcactgacaaactgccctttacgtaatc

SEQ ID NO: 13236 - DNA, 41 bp, Xenorhabdus bovienii
  Terminator sequence Name=Xb4151_4152.C418.trmnator1; Position on contig=3155..3195bp; Strand=+; Gene name=LuxS
cggggttggcttattttttgctaaccctgtattaaattcat

SEQ ID NO: 13237 - DNA, 45 bp, Xenorhabdus bovienii
  Terminator sequence Name=Xb4151_4152.C418.trmnator2; Position on contig=3941..3985bp; Strand=+
cgtaacttattagtcaatttgatacgttacgttaatttggttttt

SEQ ID NO: 13238 - DNA, 49 bp, Xenorhabdus bovienii
  Terminator sequence Name=Xb4151_4152.C418.trmnator3; Position on contig=4447..4495bp; Strand=+
ctatccctgataggaacatatttccttcaggggagtatgttcctatcag

SEQ ID NO: 13239 - DNA, 37 bp, Xenorhabdus bovienii
  Terminator sequence Name=Xb4151_4152.C418.trmnator4; Position on contig=62438..62474bp; Strand=+; Gene name=FadB
cagcgaccaaatatctggtcgctggtttgtgcgcaaa

SEQ ID NO: 13240 - DNA, 44 bp, Xenorhabdus bovienii
  Terminator sequence Name=Xb4151_4152.C418.trmnator5; Position on contig=62725..62768bp; Strand=+
tccgcgggtgataatccatcactttgtggatgttgatattgccc

SEQ ID NO: 13241 - DNA, 41 bp, Xenorhabdus bovienii
  Terminator sequence Name=Xb4151_4152.C418.trmnator6; Position on contig=62422..62462bp; Strand=-
ccagcgaccagatatttggtcgctgctgctgtctcgctgaa

SEQ ID NO: 13242 - DNA, 33 bp, Xenorhabdus bovienii
  Terminator sequence Name=Xb4151_4152.C418.trmnator7; Position on contig=65447..65479bp; Strand=-
cccccttctatgaagggggatttttacttaaca

SEQ ID NO: 13243 - DNA, 47 bp, Xenorhabdus bovienii
  Terminator sequence Name=Xb4151_4152.C419.trmnator1; Position on contig=1401..1447bp; Strand=+; Gene name=FabB
tatgaagagcctcaacatttgttgaggcttttttattcctgatttta

SEQ ID NO: 13244 - DNA, 51 bp, Xenorhabdus bovienii
  Terminator sequence Name=Xb4151_4152.C419.trmnator2; Position on contig=5899..5949bp; Strand=+; Gene name=TatD
tttatgttttagtttagtatttagacttaatcatgagtcatctttaatggc

SEQ ID NO: 13245 - DNA, 64 bp, Xenorhabdus bovienii
  Terminator sequence Name=Xb4151_4152.C419.trmnator3; Position on contig=8917..8980bp; Strand=+; Gene name=BglX
taataaaattgggaatggagttgctagttggcaattctatcccttttttgtatttcttctcgat

SEQ ID NO: 13246 - DNA, 63 bp, Xenorhabdus bovienii
  Terminator sequence Name=Xb4151_4152.C419.trmnator4; Position on contig=10619..10681bp; Strand=+; Gene name=Ndh
tgaaaaatggctcatctgaatttaattaacacagatgagccatttatttacctgttatattta

SEQ ID NO: 13247 - DNA, 59 bp, Xenorhabdus bovienii
  Terminator sequence Name=Xb4151_4152.C419.trmnator5; Position on contig=11388..11446bp; Strand=-
gattgcactgtttcgccgatacagttccaagcgaaatagtgcaatcatcttctgaaaaa

SEQ ID NO: 13248 - DNA, 58 bp, Xenorhabdus bovienii
  Terminator sequence Name=Xb4151_4152.C419.trmnator6; Position on contig=19725..19782bp; Strand=+; Gene name=SIR2
ctatagaaaatccatctgcatagcagatggattttctactcatagattaatcattaaa

SEQ ID NO: 13249 - DNA, 35 bp, Xenorhabdus bovienii
  Terminator sequence Name=Xb4151_4152.C419.trmnator7; Position on contig=19721..19755bp; Strand=-; Gene name=SIR2
tccatctgctatgcagatggattttctataggtca

SEQ ID NO: 13250 - DNA, 43 bp, Xenorhabdus bovienii
  Terminator sequence Name=Xb4151_4152.C419.trmnator8; Position on contig=29145..29187bp; Strand=+; Gene name=Icd
gataacgggggcttaacagttcccgtttgttttttgtacatcg

SEQ ID NO: 13251 - DNA, 37 bp, Xenorhabdus bovienii
  Terminator sequence Name=Xb4151_4152.C419.trmnator9; Position on contig=30146..30182bp; Strand=+
gagggggtgagattttctttctcagatatttaatcgg

SEQ ID NO: 13252 - DNA, 43 bp, Xenorhabdus bovienii
  Terminator sequence Name=Xb4151_4152.C419.trmnator10; Position on contig=31905..31947bp; Strand=-; Gene name=XerC
gataacgggggcttaatggttcccgtttattttttgtacatcg

SEQ ID NO: 13253 - DNA, 41 bp, Xenorhabdus bovienii
  Terminator sequence Name=Xb4151_4152.C419.trmnator11; Position on contig=32354..32394bp; Strand=-; Gene name=Icd
tcttaagggcaggtttctgacctttgggattactctgcttt

SEQ ID NO: 13254 - DNA, 62 bp, Xenorhabdus bovienii
  Terminator sequence Name=Xb4151_4152.C419.trmnator12; Position on contig=36471..36532bp; Strand=-
tggtggcctcggttaattcagctaactatctgaaattagcgaggccgtcactttggttcagc

SEQ ID NO: 13255 - DNA, 35 bp, Xenorhabdus bovienii
  Terminator sequence Name=Xb4151_4152.C419.trmnator13; Position on contig=37633..37667bp; Strand=-
gcaggagccatcctgtctcctgcttgattgttatt

SEQ ID NO: 13256 - DNA, 34 bp, Xenorhabdus bovienii
  Terminator sequence Name=Xb4151_4152.C419.trmnator14; Position on contig=40014..40047bp; Strand=-
gcctcactaaatcaagtggggctttttcatatct

SEQ ID NO: 13257 - DNA, 41 bp, Xenorhabdus bovienii
  Terminator sequence Name=Xb4151_4152.C420.trmnator1; Position on contig=1248..1288bp; Strand=+; Gene name=GlyA
cccgactcataacattagttttgagcgggtttttttacatt

SEQ ID NO: 13258 - DNA, 31 bp, Xenorhabdus bovienii
  Terminator sequence Name=Xb4151_4152.C420.trmnator2; Position on contig=2546..2576bp; Strand=-; Gene name=ProP
gggcaccatctggtgcccttttttgttgtta

SEQ ID NO: 13259 - DNA, 37 bp, Xenorhabdus bovienii
  Terminator sequence Name=Xb4151_4152.C420.trmnator3; Position on contig=6642..6678bp; Strand=+; Gene name=IscU
ggtggatattgattcaatatccacctttactagtttt

SEQ ID NO: 13260 - DNA, 44 bp, Xenorhabdus bovienii
  Terminator sequence Name=Xb4151_4152.C420.trmnator4; Position on contig=6627..6670bp; Strand=-; Gene name=IscU
taaaggtggatattgaatcaatatccaccagaattatgtcttct

SEQ ID NO: 13261 - DNA, 49 bp, Xenorhabdus bovienii
  Terminator sequence Name=Xb4151_4152.C420.trmnator5; Position on contig=9764..9812bp; Strand=-; Gene name=Fdx
tatttggggatttcaacaatcaaatcctcatcagtgactttggcctgac

SEQ ID NO: 13262 - DNA, 54 bp, Xenorhabdus bovienii
  Terminator sequence Name=Xb4151_4152.C420.trmnator6; Position on contig=11548..11601bp; Strand=+; Gene name=PepB
tttattcatagtctcccttaaaaagggaagactatgattgaacctttcaatagt

SEQ ID NO: 13263 - DNA, 30 bp, Xenorhabdus bovienii
  Terminator sequence Name=Xb4151_4152.C420.trmnator7; Position on contig=11815..11844bp; Strand=-
cccaattaatagattgggtttctcatccag

SEQ ID NO: 13264 - DNA, 66 bp, Xenorhabdus bovienii
  Terminator sequence Name=Xb4151_4152.C420.trmnator8; Position on contig=19751..19816bp; Strand=+; Gene name=MrcA
tatttttatcgtaaaacaataaaaaattattgttttacgataatttaaagctataatttgatcacg

SEQ ID NO: 13265 - DNA, 47 bp, Xenorhabdus bovienii
  Terminator sequence Name=Xb4151_4152.C420.trmnator9; Position on contig=21036..21082bp; Strand=+
tgcctatttgggattttatcgcctgaataggtattattttatagaat

SEQ ID NO: 13266 - DNA, 40 bp, Xenorhabdus bovienii
  Terminator sequence Name=Xb4151_4152.C420.trmnator10; Position on contig=20868..20907bp; Strand=-
gatagtttaaattcccctttgaactgcttattggcctctt

SEQ ID NO: 13267 - DNA, 40 bp, Xenorhabdus bovienii
  Terminator sequence Name=Xb4151_4152.C420.trmnator11; Position on contig=21879..21918bp; Strand=+; Gene name=Ndk
cgcctcactgatttgatttagtggggtgtttattatttta

SEQ ID NO: 13268 - DNA, 47 bp, Xenorhabdus bovienii
  Terminator sequence Name=Xb4151_4152.C420.trmnator12; Position on contig=26050..26096bp; Strand=+; Gene name=GcpE
tgatactggctcatgctatcatgagccagtattgtttctgattgctg

SEQ ID NO: 13269 - DNA, 43 bp, Xenorhabdus bovienii
  Terminator sequence Name=Xb4151_4152.C420.trmnator13; Position on contig=29296..29338bp; Strand=+
cggctcctgtgctgacagtaacaggagccgtttcgtcttttta

SEQ ID NO: 13270 - DNA, 53 bp, Xenorhabdus bovienii
  Terminator sequence Name=Xb4151_4152.C420.trmnator14; Position on contig=30926..30978bp; Strand=+
catgaaataaagggctatttttagccctttattgttactgatatatatgattt

SEQ ID NO: 13271 - DNA, 36 bp, Xenorhabdus bovienii
  Terminator sequence Name=Xb4151_4152.C420.trmnator15; Position on contig=30921..30956bp; Strand=-
taaagggctaaaaatagccctttatttcatgcatat

SEQ ID NO: 13272 - DNA, 41 bp, Xenorhabdus bovienii
  Terminator sequence Name=Xb4151_4152.C420.trmnator16; Position on contig=31419..31459bp; Strand=+
gtagaaatgtaaatttattgtatttctatgtttttttatta

SEQ ID NO: 13273 - DNA, 36 bp, Xenorhabdus bovienii
  Terminator sequence Name=Xb4151_4152.C420.trmnator17; Position on contig=31509..31544bp; Strand=-
gaaagggctaaggatagccctttcttaatatttata

SEQ ID NO: 13274 - DNA, 42 bp, Xenorhabdus bovienii
  Terminator sequence Name=Xb4151_4152.C420.trmnator18; Position on contig=32847..32888bp; Strand=+
caggaatataggtgttatccgatattcctgattttaattatc

SEQ ID NO: 13275 - DNA, 42 bp, Xenorhabdus bovienii
  Terminator sequence Name=Xb4151_4152.C420.trmnator19; Position on contig=32835..32876bp; Strand=-
caggaatatcggataacacctatattcctgttctatatcaga

SEQ ID NO: 13276 - DNA, 45 bp, Xenorhabdus bovienii
  Terminator sequence Name=Xb4151_4152.C420.trmnator20; Position on contig=33959..34003bp; Strand=-; Gene name=HemF
caaggtcagaacgcttagcgtactgaccttgttttattgatctca

SEQ ID NO: 13277 - DNA, 47 bp, Xenorhabdus bovienii
  Terminator sequence Name=Xb4151_4152.C420.trmnator21; Position on contig=36342..36388bp; Strand=+; Gene name=VacJ
tcaaaaaaggatagcacccgctatccttttttcgatttcagtattcg

SEQ ID NO: 13278 - DNA, 31 bp, Xenorhabdus bovienii
  Terminator sequence Name=Xb4151_4152.C420.trmnator22; Position on contig=36337..36367bp; Strand=-; Gene name=VacJ
ggatagcgggtgctatccttttttgatcatg

SEQ ID NO: 13279 - DNA, 36 bp, Xenorhabdus bovienii
  Terminator sequence Name=Xb4151_4152.C420.trmnator23; Position on contig=42055..42090bp; Strand=+; Gene name=FadB
tcggctcttgtcatcggagccgatttttttatgaaa

SEQ ID NO: 13280 - DNA, 47 bp, Xenorhabdus bovienii
  Terminator sequence Name=Xb4151_4152.C420.trmnator24; Position on contig=41999..42045bp; Strand=-; Gene name=FadB
ttttgcgaatgaaactgttatttatttgtagaatttctttttctgtt

SEQ ID NO: 13281 - DNA, 42 bp, Xenorhabdus bovienii
  Terminator sequence Name=Xb4151_4152.C420.trmnator25; Position on contig=42762..42803bp; Strand=-; Gene name=SixA
gagaggtttgccataacaggcgacctttctctgtttgaggat

SEQ ID NO: 13282 - DNA, 39 bp, Xenorhabdus bovienii
  Terminator sequence Name=Xb4151_4152.C420.trmnator26; Position on contig=46648..46686bp; Strand=+; Gene name=PhnF
tctccctttgtttttaatatagggagattttttcacaaa

SEQ ID NO: 13283 - DNA, 41 bp, Xenorhabdus bovienii
  Terminator sequence Name=Xb4151_4152.C420.trmnator27; Position on contig=50186..50226bp; Strand=+; Gene name=HutH (BS)
ctaaggccggtttctgcccggccttatcgttgtatttatct

SEQ ID NO: 13284 - DNA, 34 bp, Xenorhabdus bovienii
  Terminator sequence Name=Xb4151_4152.C420.trmnator28; Position on contig=51647..51680bp; Strand=+; Gene name=AnsP
ccaccctgtgaatacagggtggttttcttaccct

SEQ ID NO: 13285 - DNA, 33 bp, Xenorhabdus bovienii
  Terminator sequence Name=Xb4151_4152.C420.trmnator29; Position on contig=55853..55885bp; Strand=+
ggggttattcatatagcccctttattttttctg

SEQ ID NO: 13286 - DNA, 47 bp, Xenorhabdus bovienii
  Terminator sequence Name=Xb4151_4152.C420.trmnator30; Position on contig=60133..60179bp; Strand=+; Gene name=FabB
gaaagccaatccattgattagatgggttggttttttattatattgtt

SEQ ID NO: 13287 - DNA, 34 bp, Xenorhabdus bovienii
  Terminator sequence Name=Xb4151_4152.C421.trmnator1; Position on contig=905..938bp; Strand=+; Gene name=InsB
gctgttatagctgctgtaaggtctttcagttggc

SEQ ID NO: 13288 - DNA, 38 bp, Xenorhabdus bovienii
  Terminator sequence Name=Xb4151_4152.C421.trmnator2; Position on contig=24655..24692bp; Strand=+
tgacgataatgacattgttgtgcatagtattggtgtcg

SEQ ID NO: 13289 - DNA, 47 bp, Xenorhabdus bovienii
  Terminator sequence Name=Xb4151_4152.C421.trmnator3; Position on contig=31685..31731bp; Strand=-
taaggcgatgagtagtagacaaccatcgccttattcatttttccatg

SEQ ID NO: 13290 - DNA, 47 bp, Xenorhabdus bovienii
  Terminator sequence Name=Xb4151_4152.C421.trmnator4; Position on contig=34829..34875bp; Strand=-
tgccgattccattttatcctcaatggaatcgctgcttactgtgcgag

SEQ ID NO: 13291 - DNA, 36 bp, Xenorhabdus bovienii
  Terminator sequence Name=Xb4151_4152.C421.trmnator5; Position on contig=39229..39264bp; Strand=+
tcgtggggaattatccccacggtttttgttagtgac

SEQ ID NO: 13292 - DNA, 54 bp, Xenorhabdus bovienii
  Terminator sequence Name=Xb4151_4152.C421.trmnator6; Position on contig=45733..45786bp; Strand=+
cctgtgctaatgaaatttttctcgaattttcattaatactggctttgagtgttc

SEQ ID NO: 13293 - DNA, 56 bp, Xenorhabdus bovienii
  Terminator sequence Name=Xb4151_4152.C421.trmnator7; Position on contig=47150..47205bp; Strand=+; Gene name=SmtA
ttgattcggaatagatataggaagatatctattccggaaagataattatgctgcat

SEQ ID NO: 13294 - DNA, 38 bp, Xenorhabdus bovienii
  Terminator sequence Name=Xb4151_4152.C421.trmnator8; Position on contig=48074..48111bp; Strand=-
gaggcgaataattaatattagcttcatttctcaatcat

SEQ ID NO: 13295 - DNA, 41 bp, Xenorhabdus bovienii
  Terminator sequence Name=Xb4151_4152.C421.trmnator9; Position on contig=50298..50338bp; Strand=-
tattgcaggcatggattccattcttgatgaatttcaattcc

SEQ ID NO: 13296 - DNA, 37 bp, Xenorhabdus bovienii
  Terminator sequence Name=Xb4151_4152.C421.trmnator10; Position on contig=56317..56353bp; Strand=+
cgggatactgggagtgtatcccgttttatttaaccag

SEQ ID NO: 13297 - DNA, 45 bp, Xenorhabdus bovienii
  Terminator sequence Name=Xb4151_4152.C421.trmnator11; Position on contig=57322..57366bp; Strand=+; Gene name=MhpC
gagataaccacccacttaagtggtggttatcttctttgtcccatc

SEQ ID NO: 13298 - DNA, 51 bp, Xenorhabdus bovienii
  Terminator sequence Name=Xb4151_4152.C421.trmnator12; Position on contig=57305..57355bp; Strand=-; Gene name=MhpC
gaagataaccaccacttaagtgggtggttatctctgctattttccagcaaa

SEQ ID NO: 13299 - DNA, 40 bp, Xenorhabdus bovienii
  Terminator sequence Name=Xb4151_4152.C421.trmnator13; Position on contig=60581..60620bp; Strand=+
ggccgagtagaggagtatactcggcctttttttattttct

SEQ ID NO: 13300 - DNA, 46 bp, Xenorhabdus bovienii
  Terminator sequence Name=Xb4151_4152.C421.trmnator14; Position on contig=61506..61551bp; Strand=+
gtggcatttatcagtaaggctattataatgtcgcctgttcatgcct

SEQ ID NO: 13301 - DNA, 32 bp, Xenorhabdus bovienii
  Terminator sequence Name=Xb4151_4152.C421.trmnator15; Position on contig=64428..64459bp; Strand=+; Gene name=Prc
ggccgacttggtagtcggccttttttgtgaca

SEQ ID NO: 13302 - DNA, 59 bp, Xenorhabdus bovienii
  Terminator sequence Name=Xb4151_4152.C421.trmnator16; Position on contig=65510..65568bp; Strand=+; Gene name=HtpX
cagtgaaaaaagccggtattcatcatgaatgccggcttttttattgctcttgtgagcga

SEQ ID NO: 13303 - DNA, 31 bp, Xenorhabdus bovienii
  Terminator sequence Name=Xb4151_4152.C422.trmnator1; Position on contig=1319..1349bp; Strand=-
gccacccggtggggtggcttctctggctaaa

SEQ ID NO: 13304 - DNA, 50 bp, Xenorhabdus bovienii
  Terminator sequence Name=Xb4151_4152.C422.trmnator2; Position on contig=6532..6581bp; Strand=+; Gene name=SodA
tcaataatgctggtcaatgctatggccagcattttgactattcgatatta

SEQ ID NO: 13305 - DNA, 50 bp, Xenorhabdus bovienii
  Terminator sequence Name=Xb4151_4152.C422.trmnator3; Position on contig=18938..18987bp; Strand=+; Gene name=MrcA
gaaaaaagccctgtcgggaaacggacggggctttttattattatcagctt

SEQ ID NO: 13306 - DNA, 39 bp, Xenorhabdus bovienii
  Terminator sequence Name=Xb4151_4152.C422.trmnator4; Position on contig=25918..25956bp; Strand=-; Gene name=FabH
cgagattgggatgagcctgatgcttgattatagggtgct

SEQ ID NO: 13307 - DNA, 30 bp, Xenorhabdus bovienii
  Terminator sequence Name=Xb4151_4152.C422.trmnator5; Position on contig=29378..29407bp; Strand=-; Gene name=IlvB
cccagcaaatatgctgggtttttttattta

SEQ ID NO: 13308 - DNA, 41 bp, Xenorhabdus bovienii
  Terminator sequence Name=Xb4151_4152.C422.trmnator6; Position on contig=34087..34127bp; Strand=+
ggaaggctgatatattccacagccttccacttctctacaaa

SEQ ID NO: 13309 - DNA, 29 bp, Xenorhabdus bovienii
  Terminator sequence Name=Xb4151_4152.C422.trmnator7; Position on contig=43305..43333bp; Strand=+
cagggtgcagccctgacattatttttaca

SEQ ID NO: 13310 - DNA, 38 bp, Xenorhabdus bovienii
  Terminator sequence Name=Xb4151_4152.C423.trmnator1; Position on contig=3130..3167bp; Strand=+
ttgttggccagcgcacaggccacaacatttgagtgttt

SEQ ID NO: 13311 - DNA, 42 bp, Xenorhabdus bovienii
  Terminator sequence Name=Xb4151_4152.C423.trmnator2; Position on contig=13413..13454bp; Strand=+
gccggaaagatccccgtgatcttccggctttgttttttgaga

SEQ ID NO: 13312 - DNA, 40 bp, Xenorhabdus bovienii
  Terminator sequence Name=Xb4151_4152.C423.trmnator3; Position on contig=13401..13440bp; Strand=-
gccggaagatcacggggatctttccggcattatttaagct

SEQ ID NO: 13313 - DNA, 59 bp, Xenorhabdus bovienii
  Terminator sequence Name=Xb4151_4152.C423.trmnator4; Position on contig=22662..22720bp; Strand=+
gataattaagctgggaagatcacagggatcttcccagctttgttctttttaagatctgc

SEQ ID NO: 13314 - DNA, 38 bp, Xenorhabdus bovienii
  Terminator sequence Name=Xb4151_4152.C423.trmnator5; Position on contig=24313..24350bp; Strand=+
tcggaaagatctcagtgatcttccggctttgttctgtt

SEQ ID NO: 13315 - DNA, 42 bp, Xenorhabdus bovienii
  Terminator sequence Name=Xb4151_4152.C423.trmnator6; Position on contig=24935..24976bp; Strand=+
ggccggaaagatccccgtgatcttccggcttattgttatgta

SEQ ID NO: 13316 - DNA, 52 bp, Xenorhabdus bovienii
  Terminator sequence Name=Xb4151_4152.C423.trmnator7; Position on contig=25511..25562bp; Strand=+
ttgggttaagctcctgtgaaatgcagtttcaaacccagtacttttgatattt

SEQ ID NO: 13317 - DNA, 44 bp, Xenorhabdus bovienii
  Terminator sequence Name=Xb4151_4152.C423.trmnator8; Position on contig=25436..25479bp; Strand=-
gataaattacatcattgagatgtaatttatctttttttaacaag

SEQ ID NO: 13318 - DNA, 47 bp, Xenorhabdus bovienii
  Terminator sequence Name=Xb4151_4152.C423.trmnator9; Position on contig=26126..26172bp; Strand=-
gcgttggtgtgttaaccatggttgacacaccgtgttattgacataca

SEQ ID NO: 13319 - DNA, 37 bp, Xenorhabdus bovienii
  Terminator sequence Name=Xb4151_4152.C423.trmnator10; Position on contig=30224..30260bp; Strand=-
cggtagcgtaagtttacttactgtgtttcataaggca

SEQ ID NO: 13320 - DNA, 46 bp, Xenorhabdus bovienii
  Terminator sequence Name=Xb4151_4152.C423.trmnator11; Position on contig=39448..39493bp; Strand=+
gccggacagtgccagcaccattgtcgcggtgcgcttattcggcagg

SEQ ID NO: 13321 - DNA, 46 bp, Xenorhabdus bovienii
  Terminator sequence Name=Xb4151_4152.C423.trmnator12; Position on contig=46837..46882bp; Strand=+
gggggcgagaggggtagggattttacccgccctcctcttgtgacta

SEQ ID NO: 13322 - DNA, 37 bp, Xenorhabdus bovienii
  Terminator sequence Name=Xb4151_4152.C423.trmnator13; Position on contig=47328..47364bp; Strand=-
tgttacccgttgacgctggtggcatttttattgagta

SEQ ID NO: 13323 - DNA, 45 bp, Xenorhabdus bovienii
  Terminator sequence Name=Xb4151_4152.C423.trmnator14; Position on contig=49776..49820bp; Strand=-
tgaagtagttcggcaataccgaaccacttcatcattatagatgtg

SEQ ID NO: 13324 - DNA, 30 bp, Xenorhabdus bovienii
  Terminator sequence Name=Xb4151_4152.C423.trmnator15; Position on contig=51080..51109bp; Strand=+
ggggttcaggcagccccattaatttagaca

SEQ ID NO: 13325 - DNA, 28 bp, Xenorhabdus bovienii
  Terminator sequence Name=Xb4151_4152.C423.trmnator16; Position on contig=50936..50963bp; Strand=-
gccggtgaatgccggcttttcgtgttgt

SEQ ID NO: 13326 - DNA, 29 bp, Xenorhabdus bovienii
  Terminator sequence Name=Xb4151_4152.C423.trmnator17; Position on contig=51294..51322bp; Strand=+
ccttgcacggggcaaggtttaagctgtct

SEQ ID NO: 13327 - DNA, 29 bp, Xenorhabdus bovienii
  Terminator sequence Name=Xb4151_4152.C423.trmnator18; Position on contig=51282..51310bp; Strand=-
ccttgccccgtgcaaggtttttttacgcc

SEQ ID NO: 13328 - DNA, 35 bp, Xenorhabdus bovienii
  Terminator sequence Name=Xb4151_4152.C423.trmnator19; Position on contig=55716..55750bp; Strand=+
gatactgtttttaatgcagtatctttagttccatt

SEQ ID NO: 13329 - DNA, 49 bp, Xenorhabdus bovienii
  Terminator sequence Name=Xb4151_4152.C423.trmnator20; Position on contig=55745..55793bp; Strand=-
tatcatctgaatgattttggatctttagggtgataataatttcaatgga

SEQ ID NO: 13330 - DNA, 50 bp, Xenorhabdus bovienii
  Terminator sequence Name=Xb4151_4152.C423.trmnator21; Position on contig=57349..57398bp; Strand=+
ttcatgcgcctgttctgtaatcgggcaggcatatgcgcgttctgtctgtg

SEQ ID NO: 13331 - DNA, 43 bp, Xenorhabdus bovienii
  Terminator sequence Name=Xb4151_4152.C424.trmnator1; Position on contig=611..653bp; Strand=-
gggagccgatgaatgaaggattgcggctttcttatgtctttct

SEQ ID NO: 13332 - DNA, 29 bp, Xenorhabdus bovienii
  Terminator sequence Name=Xb4151_4152.C424.trmnator2; Position on contig=6218..6246bp; Strand=-
gcctccctgcgaggctttttttatgggtt

SEQ ID NO: 13333 - DNA, 35 bp, Xenorhabdus bovienii
  Terminator sequence Name=Xb4151_4152.C424.trmnator3; Position on contig=8332..8366bp; Strand=+
gctgattcagcctcctgagcggccttttttcgttt

SEQ ID NO: 13334 - DNA, 27 bp, Xenorhabdus bovienii
  Terminator sequence Name=Xb4151_4152.C424.trmnator4; Position on contig=9454..9480bp; Strand=+
gcagcaatagctgcatgttctgttgct

SEQ ID NO: 13335 - DNA, 31 bp, Xenorhabdus bovienii
  Terminator sequence Name=Xb4151_4152.C424.trmnator5; Position on contig=10473..10503bp; Strand=-
ccctgccacatggcggggttttcttttttaa

SEQ ID NO: 13336 - DNA, 43 bp, Xenorhabdus bovienii
  Terminator sequence Name=Xb4151_4152.C424.trmnator6; Position on contig=11182..11224bp; Strand=-
tttatgctgtttacggttaaatagtgtgaaattgcttgataat

SEQ ID NO: 13337 - DNA, 40 bp, Xenorhabdus bovienii
  Terminator sequence Name=Xb4151_4152.C424.trmnator7; Position on contig=13857..13896bp; Strand=-
ggcgttgaatttatagctttccaatgccttcatcatgggt

SEQ ID NO: 13338 - DNA, 26 bp, Xenorhabdus bovienii
  Terminator sequence Name=Xb4151_4152.C424.trmnator8; Position on contig=14245..14270bp; Strand=-
cccgcttcggcgggtttttcacatct

SEQ ID NO: 13339 - DNA, 34 bp, Xenorhabdus bovienii
  Terminator sequence Name=Xb4151_4152.C424.trmnator9; Position on contig=15344..15377bp; Strand=+
ggtcggaatacgcttccgtaccttcatgtcgttg

SEQ ID NO: 13340 - DNA, 30 bp, Xenorhabdus bovienii
  Terminator sequence Name=Xb4151_4152.C424.trmnator10; Position on contig=15814..15843bp; Strand=-
gggtgcttgcgagcgcccttgataatgttc

SEQ ID NO: 13341 - DNA, 27 bp, Xenorhabdus bovienii
  Terminator sequence Name=Xb4151_4152.C424.trmnator11; Position on contig=25807..25833bp; Strand=-
ccctcttcggagggttttttgctttat

SEQ ID NO: 13342 - DNA, 36 bp, Xenorhabdus bovienii
  Terminator sequence Name=Xb4151_4152.C424.trmnator12; Position on contig=27474..27509bp; Strand=+
gaatggcgatttatatcgccattcttatgtatttac

SEQ ID NO: 13343 - DNA, 36 bp, Xenorhabdus bovienii
  Terminator sequence Name=Xb4151_4152.C424.trmnator13; Position on contig=27462..27497bp; Strand=-
gaatggcgatataaatcgccattctttttaatggaa

SEQ ID NO: 13344 - DNA, 31 bp, Xenorhabdus bovienii
  Terminator sequence Name=Xb4151_4152.C424.trmnator14; Position on contig=31923..31953bp; Strand=-
gccggctgaaaagccggctttttttggtttc

SEQ ID NO: 13345 - DNA, 44 bp, Xenorhabdus bovienii; identical to SEQ ID NO: 13240
  Terminator sequence Name=Xb4151_4152.C424.trmnator15; Position on contig=33714..33757bp; Strand=-

SEQ ID NO: 13346 - DNA, 58 bp, Xenorhabdus bovienii
  Terminator sequence Name=Xb4151_4152.C424.trmnator16; Position on contig=33947..34004bp; Strand=-
ttagtcgcccctacgcctcccccatcgttaacggggtgcgctaaccttactcaattga

SEQ ID NO: 13347 - DNA, 34 bp, Xenorhabdus bovienii
  Terminator sequence Name=Xb4151_4152.C424.trmnator17; Position on contig=37522..37555bp; Strand=-
tcagcttggcaacgaggctgagttttatatcgtc

SEQ ID NO: 13348 - DNA, 39 bp, Xenorhabdus bovienii
  Terminator sequence Name=Xb4151_4152.C424.trmnator18; Position on contig=40152..40190bp; Strand=+
gcaatatccagacaccaatggagttgcgtttctatttgc

SEQ ID NO: 13349 - DNA, 36 bp, Xenorhabdus bovienii
  Terminator sequence Name=Xb4151_4152.C424.trmnator19; Position on contig=41799..41834bp; Strand=-; Gene name=InsB
tttagcctgttacgcaggttcagattttctcgttca

SEQ ID NO: 13350 - DNA, 45 bp, Xenorhabdus bovienii
  Terminator sequence Name=Xb4151_4152.C424.trmnator20; Position on contig=45266..45310bp; Strand=+
gcctgctgggattacgcttaatcctgctcggcaattttgacatac

SEQ ID NO: 13351 - DNA, 46 bp, Xenorhabdus bovienii
  Terminator sequence Name=Xb4151_4152.C424.trmnator21; Position on contig=47679..47724bp; Strand=+
ttattaatcatatatgaaactaattggttggtaattgattgacagt

SEQ ID NO: 13352 - DNA, 44 bp, Xenorhabdus bovienii
  Terminator sequence Name=Xb4151_4152.C424.trmnator22; Position on contig=51318..51361bp; Strand=+; Gene name=SfcA
ctaccctgccaagcataggcttaacagggtagttttatttgtaa

SEQ ID NO: 13353 - DNA, 50 bp, Xenorhabdus bovienii
  Terminator sequence Name=Xb4151_4152.C424.trmnator23; Position on contig=55444..55493bp; Strand=+; Gene name=PtrB
cccaaggcgctgataatttgttatcagtgtcatgggtattttatcgccaa

SEQ ID NO: 13354 - DNA, 52 bp, Xenorhabdus bovienii
  Terminator sequence Name=Xb4151_4152.C424.trmnator24; Position on contig=57811..57862bp; Strand=+; Gene name=CirA
gaatagaaatagcggtaggaaatcaccgctatttctattttttgtatctatt

SEQ ID NO: 13355 - DNA, 47 bp, Xenorhabdus bovienii
  Terminator sequence Name=Xb4151_4152.C424.trmnator25; Position on contig=57801..57847bp; Strand=-; Gene name=CirA
tagaaatagcggtgatttcctaccgctatttctattctattagaagc

SEQ ID NO: 13356 - DNA, 40 bp, Xenorhabdus bovienii
  Terminator sequence Name=Xb4151_4152.C424.trmnator26; Position on contig=60868..60907bp; Strand=+; Gene name=GuaB
ttagggtggcccactatcgggccactgacttctttatttt

SEQ ID NO: 13357 - DNA, 41 bp, Xenorhabdus bovienii
  Terminator sequence Name=Xb4151_4152.C424.trmnator27; Position on contig=62661..62701bp; Strand=-
ccgtcaatttagagtaaaactgtgacggtcttttgagtcaa

SEQ ID NO: 13358 - DNA, 38 bp, Xenorhabdus bovienii; identical to SEQ ID NO: 13125
  Terminator sequence Name=Xb4151_4152.C424.trmnator28; Position on contig=63338..63375bp; Strand=+

SEQ ID NO: 13359 - DNA, 54 bp, Xenorhabdus bovienii
  Terminator sequence Name=Xb4151_4152.C424.trmnator29; Position on contig=65375..65428bp; Strand=+
tggctgtgattgtggctcaagccatgaatcacggcaaccggactttggcctgaa

SEQ ID NO: 13360 - DNA, 30 bp, Xenorhabdus bovienii
  Terminator sequence Name=Xb4151_4152.C424.trmnator30; Position on contig=65198..65227bp; Strand=-
gcccgtttacggcgggctttaattcctgct

SEQ ID NO: 13361 - DNA, 48 bp, Xenorhabdus bovienii
  Terminator sequence Name=Xb4151_4152.C424.trmnator31; Position on contig=65647..65694bp; Strand=-
gtatagaatcaatatttattgaatgttattttatattattcttagcca

SEQ ID NO: 13362 - DNA, 46 bp, Xenorhabdus bovienii
  Terminator sequence Name=Xb4151_4152.C424.trmnator32; Position on contig=67868..67913bp; Strand=-; Gene name=PrpB
tgttgcaggatagaatgccatatttcctgcaacgtattgattatac

SEQ ID NO: 13363 - DNA, 43 bp, Xenorhabdus bovienii
  Terminator sequence Name=Xb4151_4152.C424.trmnator33; Position on contig=68869..68911bp; Strand=-
tggtcgcaggttcgaatcctgcacgacccaccatttagatata

SEQ ID NO: 13364 - DNA, 34 bp, Xenorhabdus bovienii
  Terminator sequence Name=Xb4151_4152.C425.trmnator1; Position on contig=2700..2733bp; Strand=-
ccccattattttatgatgtgggctttaaatattt

SEQ ID NO: 13365 - DNA, 29 bp, Xenorhabdus bovienii
  Terminator sequence Name=Xb4151_4152.C425.trmnator2; Position on contig=11622..11650bp; Strand=+
cctcgcccagtgcggggttttttgctttc

SEQ ID NO: 13366 - DNA, 31 bp, Xenorhabdus bovienii
  Terminator sequence Name=Xb4151_4152.C425.trmnator3; Position on contig=11966..11996bp; Strand=+
ggctgcgcatggcgtggccttttctatatct

SEQ ID NO: 13367 - DNA, 36 bp, Xenorhabdus bovienii
  Terminator sequence Name=Xb4151_4152.C425.trmnator4; Position on contig=12384..12419bp; Strand=-
ccaaatatagacgctctgtattggttactgtatgga

SEQ ID NO: 13368 - DNA, 34 bp, Xenorhabdus bovienii
  Terminator sequence Name=Xb4151_4152.C425.trmnator5; Position on contig=13788..13821bp; Strand=+
gagcctcgcaatcgcggggcttctttttatctgc

SEQ ID NO: 13369 - DNA, 48 bp, Xenorhabdus bovienii
  Terminator sequence Name=Xb4151_4152.C425.trmnator6; Position on contig=15365..15412bp; Strand=-
ttcaaggtagtgatgtctccagcagctacctttgaatattgataaaac

SEQ ID NO: 13370 - DNA, 42 bp, Xenorhabdus bovienii
  Terminator sequence Name=Xb4151_4152.C425.trmnator7; Position on contig=15671..15712bp; Strand=-
tattattcgtttgttgttaggcggaaatgggtttaattgttg

SEQ ID NO: 13371 - DNA, 40 bp, Xenorhabdus bovienii
  Terminator sequence Name=Xb4151_4152.C425.trmnator8; Position on contig=16356..16395bp; Strand=-
ccaaatctttcttagttgaaggatttagttttattgatgg

SEQ ID NO: 13372 - DNA, 43 bp, Xenorhabdus bovienii
  Terminator sequence Name=Xb4151_4152.C425.trmnator9; Position on contig=17736..17778bp; Strand=-
cgttcagtgtggggtgaacaccctcagagtgagtttcaatcac

SEQ ID NO: 13373 - DNA, 55 bp, Xenorhabdus bovienii
  Terminator sequence Name=Xb4151_4152.C425.trmnator10; Position on contig=20317..20371bp; Strand=+
ttgatggcactgcgctggcgggtgtcggggcagtgctggccggctgttaccttaa

SEQ ID NO: 13374 - DNA, 39 bp, Xenorhabdus bovienii
  Terminator sequence Name=Xb4151_4152.C425.trmnator11; Position on contig=24523..24561bp; Strand=-
ttgttggccagcgcacaggccacaacatttgagtgtttt

SEQ ID NO: 13375 - DNA, 55 bp, Xenorhabdus bovienii
  Terminator sequence Name=Xb4151_4152.C425.trmnator12; Position on contig=26360..26414bp; Strand=+
tagcgcttttccaagatgatgatcatcctgatgaagagcgctatttgatcacatt

SEQ ID NO: 13376 - DNA, 49 bp, Xenorhabdus bovienii
  Terminator sequence Name=Xb4151_4152.C425.trmnator13; Position on contig=26350..26398bp; Strand=-
gctcttcatcaggatgatcatcatcttggaaaagcgctatatttaacat

SEQ ID NO: 13377 - DNA, 37 bp, Xenorhabdus bovienii
  Terminator sequence Name=Xb4151_4152.C425.trmnator14; Position on contig=28040..28076bp; Strand=+
gtgtgagaatattatcttctcacacctctttcaggct

SEQ ID NO: 13378 - DNA, 41 bp, Xenorhabdus bovienii
  Terminator sequence Name=Xb4151_4152.C425.trmnator15; Position on contig=30221..30261bp; Strand=+
gggtgtgagaacattatttctcacactcgctatttagaacg

SEQ ID NO: 13379 - DNA, 39 bp, Xenorhabdus bovienii
  Terminator sequence Name=Xb4151_4152.C425.trmnator16; Position on contig=30619..30657bp; Strand=-
ttgggataagagagatttattttaaactatatcaataag

SEQ ID NO: 13380 - DNA, 30 bp, Xenorhabdus bovienii
  Terminator sequence Name=Xb4151_4152.C425.trmnator17; Position on contig=33923..33952bp; Strand=+
gggagtatcagctcccgaattgtattctgt

SEQ ID NO: 13381 - DNA, 27 bp, Xenorhabdus bovienii
  Terminator sequence Name=Xb4151_4152.C425.trmnator18; Position on contig=36872..36898bp; Strand=+; Gene name=XerC
ggcagaaagctgccctttgcaatccgg

SEQ ID NO: 13382 - DNA, 38 bp, Xenorhabdus bovienii; identical to SEQ ID NO: 13310
  Terminator sequence Name=Xb4151_4152.C425.trmnator19; Position on contig=37433..37470bp; Strand=+

SEQ ID NO: 13383 - DNA, 38 bp, Xenorhabdus bovienii; identical to SEQ ID NO: 13310
  Terminator sequence Name=Xb4151_4152.C425.trmnator20; Position on contig=38653..38690bp; Strand=+

SEQ ID NO: 13384 - DNA, 41 bp, Xenorhabdus bovienii
  Terminator sequence Name=Xb4151_4152.C425.trmnator21; Position on contig=39800..39840bp; Strand=+
ttcactagaaaaagattttttttgtaattaattttcatatg

SEQ ID NO: 13385 - DNA, 41 bp, Xenorhabdus bovienii
  Terminator sequence Name=Xb4151_4152.C425.trmnator22; Position on contig=39662..39702bp; Strand=-
tgccccagtcatttcttttgactggggcgtttaatgagatg

SEQ ID NO: 13386 - DNA, 43 bp, Xenorhabdus bovienii
  Terminator sequence Name=Xb4151_4152.C425.trmnator23; Position on contig=40056..40098bp; Strand=-
caaaatagccgcaaaaaaagtggcttttttgttatggtgcaga

SEQ ID NO: 13387 - DNA, 47 bp, Xenorhabdus bovienii
  Terminator sequence Name=Xb4151_4152.C425.trmnator24; Position on contig=46144..46190bp; Strand=-; Gene name=MobB
ggccgtggcgatagagaacgatttttgcaatggcctcttccttgaag

SEQ ID NO: 13388 - DNA, 59 bp, Xenorhabdus bovienii
  Terminator sequence Name=Xb4151_4152.C425.trmnator25; Position on contig=47021..47079bp; Strand=+
cttaactattatttttttctgacatctaatcagaaaaaatatttaagttttaaattaat

SEQ ID NO: 13389 - DNA, 38 bp, Xenorhabdus bovienii
  Terminator sequence Name=Xb4151_4152.C425.trmnator26; Position on contig=48154..48191bp; Strand=-
cagcccgcaacataatctgtgggctgttttctgaaaat

SEQ ID NO: 13390 - DNA, 44 bp, Xenorhabdus bovienii
  Terminator sequence Name=Xb4151_4152.C425.trmnator27; Position on contig=53581..53624bp; Strand=+; Gene name=HipA
tttattgaatatatgaccgtaaatttaataggttatgagtctga

SEQ ID NO: 13391 - DNA, 38 bp, Xenorhabdus bovienii
  Terminator sequence Name=Xb4151_4152.C425.trmnator28; Position on contig=53599..53636bp; Strand=-; Gene name=HipA
ggttatgagttgtcagactcataacctattaaatttac

SEQ ID NO: 13392 - DNA, 34 bp, Xenorhabdus bovienii
  Terminator sequence Name=Xb4151_4152.C425.trmnator29; Position on contig=55045..55078bp; Strand=-; Gene name=Lpd
ttagcttgtactggtaagttaattgattagacgg

SEQ ID NO: 13393 - DNA, 38 bp, Xenorhabdus bovienii
  Terminator sequence Name=Xb4151_4152.C425.trmnator30; Position on contig=58300..58337bp; Strand=-
ggtgaggtatcgcctttacttcaccaagttttatcagt

SEQ ID NO: 13394 - DNA, 39 bp, Xenorhabdus bovienii
  Terminator sequence Name=Xb4151_4152.C425.trmnator31; Position on contig=59909..59947bp; Strand=+; Gene name=InsB
ccgccgatcaaaaattatgatcagcggtttttatattta

SEQ ID NO: 13395 - DNA, 41 bp, Xenorhabdus bovienii
  Terminator sequence Name=Xb4151_4152.C425.trmnator32; Position on contig=59895..59935bp; Strand=-; Gene name=InsB
ccgctgatcataatttttgatcggcggttttatgggtcatg

SEQ ID NO: 13396 - DNA, 35 bp, Xenorhabdus bovienii
  Terminator sequence Name=Xb4151_4152.C426.trmnator1; Position on contig=298..332bp; Strand=-
gacctgattgatttatcaggtctttataagattta

SEQ ID NO: 13397 - DNA, 39 bp, Xenorhabdus bovienii
  Terminator sequence Name=Xb4151_4152.C426.trmnator2; Position on contig=1757..1795bp; Strand=+; Gene name=XerC
tagctcagatttaatctgttagttactcattttttattc

SEQ ID NO: 13398 - DNA, 44 bp, Xenorhabdus bovienii
  Terminator sequence Name=Xb4151_4152.C426.trmnator3; Position on contig=2348..2391bp; Strand=+
tgccaattcgtgaaaatatacgggctggcatatcttccagtgat

SEQ ID NO: 13399 - DNA, 47 bp, Xenorhabdus bovienii
  Terminator sequence Name=Xb4151_4152.C426.trmnator4; Position on contig=6163..6209bp; Strand=-
gttgatgtatagctaaagaataactatacatctattatttcctttta

SEQ ID NO: 13400 - DNA, 31 bp, Xenorhabdus bovienii
  Terminator sequence Name=Xb4151_4152.C426.trmnator5; Position on contig=8628..8658bp; Strand=+
gcctctaagtttcagaggcttttttattatt

SEQ ID NO: 13401 - DNA, 42 bp, Xenorhabdus bovienii
  Terminator sequence Name=Xb4151_4152.C426.trmnator6; Position on contig=13753..13794bp; Strand=+
caccccagtatcatttgcgctggggttgagtattttccattc

SEQ ID NO: 13402 - DNA, 52 bp, Xenorhabdus bovienii
  Terminator sequence Name=Xb4151_4152.C426.trmnator7; Position on contig=14972..15023bp; Strand=+
ggattttcgtggcgggtttatcgcgggtcatgcaaggttctattttattgca

SEQ ID NO: 13403 - DNA, 37 bp, Xenorhabdus bovienii
  Terminator sequence Name=Xb4151_4152.C426.trmnator8; Position on contig=14721..14757bp; Strand=-
ccattgtttatttggatgaaagtggttttgctcaatc

SEQ ID NO: 13404 - DNA, 45 bp, Xenorhabdus bovienii
  Terminator sequence Name=Xb4151_4152.C426.trmnator9; Position on contig=15216..15260bp; Strand=+
taaatctcagcaagttattattgttgagttttgtctatatttcag

SEQ ID NO: 13405 - DNA, 51 bp, Xenorhabdus bovienii
  Terminator sequence Name=Xb4151_4152.C426.trmnator10; Position on contig=15267..15317bp; Strand=-
gacaaacgccttgtccggctaatctgacagggcgtttttttatactgaaac

SEQ ID NO: 13406 - DNA, 41 bp, Xenorhabdus bovienii
  Terminator sequence Name=Xb4151_4152.C426.trmnator11; Position on contig=17906..17946bp; Strand=+
gtccgttcagacaagtcctgaatgtggctttttaccgggtt

SEQ ID NO: 13407 - DNA, 36 bp, Xenorhabdus bovienii
  Terminator sequence Name=Xb4151_4152.C426.trmnator12; Position on contig=26594..26629bp; Strand=-; Gene name=ProP
tcgcgttattactaatgacgctaagttatcgtctaa

SEQ ID NO: 13408 - DNA, 42 bp, Xenorhabdus bovienii
  Terminator sequence Name=Xb4151_4152.C426.trmnator13; Position on contig=26952..26993bp; Strand=+
gcagtgtgaggaatcctcctcaacactgctttcgtcttcttt

SEQ ID NO: 13409 - DNA, 41 bp, Xenorhabdus bovienii
  Terminator sequence Name=Xb4151_4152.C426.trmnator14; Position on contig=26940..26980bp; Strand=-
gcagtgttgaggaggattcctcacactgctttttcaggaaa

SEQ ID NO: 13410 - DNA, 52 bp, Xenorhabdus bovienii
  Terminator sequence Name=Xb4151_4152.C426.trmnator15; Position on contig=31790..31841bp; Strand=-
gactgaagtgtgttcagttgatttacttcacactttagtctttttctaataa

SEQ ID NO: 13411 - DNA, 38 bp, Xenorhabdus bovienii
  Terminator sequence Name=Xb4151_4152.C426.trmnator16; Position on contig=37842..37879bp; Strand=+
ggggctattgtttctacgatagccccatttctcacggt

SEQ ID NO: 13412 - DNA, 42 bp, Xenorhabdus bovienii
  Terminator sequence Name=Xb4151_4152.C426.trmnator17; Position on contig=39366..39407bp; Strand=-
tttattggggcagaataatctgcccttaaaatatttccatgt

SEQ ID NO: 13413 - DNA, 43 bp, Xenorhabdus bovienii
  Terminator sequence Name=Xb4151_4152.C426.trmnator18; Position on contig=41068..41110bp; Strand=-; Gene name=LysR
ctggcgccctagtttcagtagggtgtcagtgacttttctcatc

SEQ ID NO: 13414 - DNA, 44 bp, Xenorhabdus bovienii
  Terminator sequence Name=Xb4151_4152.C426.trmnator19; Position on contig=41938..41981bp; Strand=-
gttacatactactttatagatagtgtgctaatgtttctggaaag

SEQ ID NO: 13415 - DNA, 49 bp, Xenorhabdus bovienii
  Terminator sequence Name=Xb4151_4152.C426.trmnator20; Position on contig=42779..42827bp; Strand=+
gcttggtgtgagaattttcactactcacaccaagctacttttattattc

SEQ ID NO: 13416 - DNA, 55 bp, Xenorhabdus bovienii
  Terminator sequence Name=Xb4151_4152.C426.trmnator21; Position on contig=42761..42815bp; Strand=-
tagcttggtgtgagtagtgaaaattctcacaccaagcttaagcagttttaccgct

SEQ ID NO: 13417 - DNA, 36 bp, Xenorhabdus bovienii
  Terminator sequence Name=Xb4151_4152.C426.trmnator22; Position on contig=44351..44386bp; Strand=+
taaggaggcatctgcctccttattttttgcaatata

SEQ ID NO: 13418 - DNA, 54 bp, Xenorhabdus bovienii
  Terminator sequence Name=Xb4151_4152.C426.trmnator23; Position on contig=44326..44379bp; Strand=-
caaaaaataaggaggcagatgcctccttattttatggtagattttgtgtcagtt

SEQ ID NO: 13419 - DNA, 43 bp, Xenorhabdus bovienii
  Terminator sequence Name=Xb4151_4152.C426.trmnator24; Position on contig=47130..47172bp; Strand=+
ttagcataccaaattttgaatggcatgttaattcattcacata

SEQ ID NO: 13420 - DNA, 39 bp, Xenorhabdus bovienii
  Terminator sequence Name=Xb4151_4152.C426.trmnator25; Position on contig=47418..47456bp; Strand=-
gagcggctcccatttagggggccgtttttaatttatgta

SEQ ID NO: 13421 - DNA, 31 bp, Xenorhabdus bovienii
  Terminator sequence Name=Xb4151_4152.C426.trmnator26; Position on contig=49114..49144bp; Strand=+
ggccggttattcaccggccttcatattacat

SEQ ID NO: 13422 - DNA, 62 bp, Xenorhabdus bovienii
  Terminator sequence Name=Xb4151_4152.C426.trmnator27; Position on contig=55468..55529bp; Strand=-
tttatgaattatgaattatgaattatgaattatgaattatgaattatgaattatgaattatg

SEQ ID NO: 13423 - DNA, 40 bp, Xenorhabdus bovienii
  Terminator sequence Name=Xb4151_4152.C426.trmnator28; Position on contig=62398..62437bp; Strand=+
gtagcgccgattgtattcggcgctaccgttaattatttgt

SEQ ID NO: 13424 - DNA, 50 bp, Xenorhabdus bovienii
  Terminator sequence Name=Xb4151_4152.C426.trmnator29; Position on contig=64703..64752bp; Strand=-; Gene name=Uup
ccctcaaaactcatctctcagagaatgatttgagggtttttttatgaaga

SEQ ID NO: 13425 - DNA, 52 bp, Xenorhabdus bovienii
  Terminator sequence Name=Xb4151_4152.C426.trmnator30; Position on contig=68672..68723bp; Strand=-
ttggctgtactggtaccctctccggccagcgcagccaatctctctaatttcc

SEQ ID NO: 13426 - DNA, 43 bp, Xenorhabdus bovienii
  Terminator sequence Name=Xb4151_4152.C427.trmnator1; Position on contig=12773..12815bp; Strand=+
gaatggcatggggaacttctccatgccattttttgataaaacc

SEQ ID NO: 13427 - DNA, 49 bp, Xenorhabdus bovienii
  Terminator sequence Name=Xb4151_4152.C427.trmnator2; Position on contig=13315..13363bp; Strand=-
tcagtcccttaaccaaaagatctggttaagggactgactattataagaa

SEQ ID NO: 13428 - DNA, 38 bp, Xenorhabdus bovienii
  Terminator sequence Name=Xb4151_4152.C427.trmnator3; Position on contig=27184..27221bp; Strand=+; Gene name=EntF
ggctcggtttattgatgaaccgagccttaataaataac

SEQ ID NO: 13429 - DNA, 42 bp, Xenorhabdus bovienii
  Terminator sequence Name=Xb4151_4152.C427.trmnator4; Position on contig=29991..30032bp; Strand=+; Gene name=SpoVK (BS)
tgtggttattatcacaatcaatgattgcaatatctatcttga

SEQ ID NO: 13430 - DNA, 26 bp, Xenorhabdus bovienii
  Terminator sequence Name=Xb4151_4152.C427.trmnator5; Position on contig=31731..31756bp; Strand=-
gcgccctgaggcgctttttttgtgac

SEQ ID NO: 13431 - DNA, 30 bp, Xenorhabdus bovienii
  Terminator sequence Name=Xb4151_4152.C427.trmnator6; Position on contig=36146..36175bp; Strand=+
cccgcaactttctgcgggttcatatccacc

SEQ ID NO: 13432 - DNA, 38 bp, Xenorhabdus bovienii
  Terminator sequence Name=Xb4151_4152.C427.trmnator7; Position on contig=36130..36167bp; Strand=-
tgaacccgcagaaagttgcgggttagaattttagttat

SEQ ID NO: 13433 - DNA, 39 bp, Xenorhabdus bovienii
  Terminator sequence Name=Xb4151_4152.C427.trmnator8; Position on contig=36796..36834bp; Strand=-
taggacggcaggaatgaaccgtcctgattgatgttattt

SEQ ID NO: 13434 - DNA, 38 bp, Xenorhabdus bovienii
  Terminator sequence Name=Xb4151_4152.C427.trmnator9; Position on contig=39504..39541bp; Strand=+
cagcagtcggacaataggggctgttgatgttttaaggt

SEQ ID NO: 13435 - DNA, 36 bp, Xenorhabdus bovienii
  Terminator sequence Name=Xb4151_4152.C427.trmnator10; Position on contig=42470..42505bp; Strand=-
ctattggttcgcgaatcgaataggattcttgctcca

SEQ ID NO: 13436 - DNA, 35 bp, Xenorhabdus bovienii
  Terminator sequence Name=Xb4151_4152.C427.trmnator11; Position on contig=57031..57065bp; Strand=+
ggtcaggattgtgattcgaccgcgttctgactgta

SEQ ID NO: 13437 - DNA, 35 bp, Xenorhabdus bovienii
  Terminator sequence Name=Xb4151_4152.C428.trmnator1; Position on contig=7028..7062bp; Strand=-
tgccagaagttcgatttctggcatgttacaatgcg

SEQ ID NO: 13438 - DNA, 38 bp, Xenorhabdus bovienii
  Terminator sequence Name=Xb4151_4152.C428.trmnator2; Position on contig=15100..15137bp; Strand=+; Gene name=ThiH
gagagcctatatgattaggctctccgttttatctttat

SEQ ID NO: 13439 - DNA, 55 bp, Xenorhabdus bovienii
  Terminator sequence Name=Xb4151_4152.C428.trmnator3; Position on contig=27933..27987bp; Strand=+; Gene name=MalQ
ttaaaccaccatcgatagaacaactatcgatggtggtttagctttttaactgaac

SEQ ID NO: 13440 - DNA, 43 bp, Xenorhabdus bovienii
  Terminator sequence Name=Xb4151_4152.C428.trmnator4; Position on contig=27926..27968bp; Strand=-; Gene name=MalQ
ccaccatcgatagttgttctatcgatggtggtttaagtgatta

SEQ ID NO: 13441 - DNA, 40 bp, Xenorhabdus bovienii
  Terminator sequence Name=Xb4151_4152.C428.trmnator5; Position on contig=35554..35593bp; Strand=-
gattttttatccttttgataaaggtatctcttgcggttgc

SEQ ID NO: 13442 - DNA, 34 bp, Xenorhabdus bovienii
  Terminator sequence Name=Xb4151_4152.C428.trmnator6; Position on contig=37087..37120bp; Strand=-; Gene name=CDA1
tgccctctcttggtggagggcattttttattgga

SEQ ID NO: 13443 - DNA, 39 bp, Xenorhabdus bovienii
  Terminator sequence Name=Xb4151_4152.C428.trmnator7; Position on contig=41610..41648bp; Strand=+
catctggtggttaccatccacgatgtttttatacatctt

SEQ ID NO: 13444 - DNA, 39 bp, Xenorhabdus bovienii
  Terminator sequence Name=Xb4151_4152.C428.trmnator8; Position on contig=45814..45852bp; Strand=-
ggctggcgatttttaatcgccagcctttttgcgctgtag

SEQ ID NO: 13445 - DNA, 57 bp, Xenorhabdus bovienii
  Terminator sequence Name=Xb4151_4152.C428.trmnator9; Position on contig=47092..47148bp; Strand=+
ttttaagcgtcagattttagacaaatctgacgctaaggtaaagcgttattcactttc

SEQ ID NO: 13446 - DNA, 46 bp, Xenorhabdus bovienii
  Terminator sequence Name=Xb4151_4152.C428.trmnator10; Position on contig=47082..47127bp; Strand=-
ttagcgtcagatttgtctaaaatctgacgcttaaaatttgccttat

SEQ ID NO: 13447 - DNA, 53 bp, Xenorhabdus bovienii
  Terminator sequence Name=Xb4151_4152.C428.trmnator11; Position on contig=48379..48431bp; Strand=-
gcaaagggtgtgaaattatcatacaatttcgcgccttttatttttaagtattg

SEQ ID NO: 13448 - DNA, 49 bp, Xenorhabdus bovienii
  Terminator sequence Name=Xb4151_4152.C428.trmnator12; Position on contig=56401..56449bp; Strand=-
gtgatagcaggggctgatcagatagcccctgttttgttatctcggtatt

SEQ ID NO: 13449 - DNA, 38 bp, Xenorhabdus bovienii
  Terminator sequence Name=Xb4151_4152.C428.trmnator13; Position on contig=57410..57447bp; Strand=-
tagttaatttcgtgtcggaatgattattttaatcaaat

SEQ ID NO: 13450 - DNA, 43 bp, Xenorhabdus bovienii
  Terminator sequence Name=Xb4151_4152.C428.trmnator14; Position on contig=63401..63443bp; Strand=-
tcagttagtaaggcatcgttttactattgatcgtttttctctc

SEQ ID NO: 13451 - DNA, 47 bp, Xenorhabdus bovienii
  Terminator sequence Name=Xb4151_4152.C428.trmnator15; Position on contig=66130..66176bp; Strand=+
tcagtatgagtaatgatgtttttattgcatattgatattggtaaata

SEQ ID NO: 13452 - DNA, 37 bp, Xenorhabdus bovienii
  Terminator sequence Name=Xb4151_4152.C428.trmnator16; Position on contig=66051..66087bp; Strand=-
ttatgatggtgtttaccatttatagttgtatttaata

SEQ ID NO: 13453 - DNA, 38 bp, Xenorhabdus bovienii
  Terminator sequence Name=Xb4151_4152.C428.trmnator17; Position on contig=71131..71168bp; Strand=+
caggtaacaaaaaataacgttgcctgttttacgaaaat

SEQ ID NO: 13454 - DNA, 37 bp, Xenorhabdus bovienii
  Terminator sequence Name=Xb4151_4152.C428.trmnator18; Position on contig=75361..75397bp; Strand=+
ttgttggccagcgcacaggccacaacatttgagtgtt

SEQ ID NO: 13455 - DNA, 39 bp, Xenorhabdus bovienii
  Terminator sequence Name=Xb4151_4152.C429.trmnator1; Position on contig=5818..5856bp; Strand=-; Gene name=WecC
cttaacacaaatggtttgtgcttatggtttttattaaac

SEQ ID NO: 13456 - DNA, 27 bp, Xenorhabdus bovienii
  Terminator sequence Name=Xb4151_4152.C429.trmnator2; Position on contig=8748..8774bp; Strand=+; Gene name=Spy
gcccccttgtggggcttttttttatct

SEQ ID NO: 13457 - DNA, 38 bp, Xenorhabdus bovienii
  Terminator sequence Name=Xb4151_4152.C429.trmnator3; Position on contig=9959..9996bp; Strand=+
tattaaatagttagttgttatgataatcttccggtatt

SEQ ID NO: 13458 - DNA, 37 bp, Xenorhabdus bovienii; identical to SEQ ID NO: 13136
  Terminator sequence Name=Xb4151_4152.C429.trmnator4; Position on contig=15988..16024bp; Strand=+; Gene name=Sbp

SEQ ID NO: 13459 - DNA, 45 bp, Xenorhabdus bovienii
  Terminator sequence Name=Xb4151_4152.C429.trmnator5; Position on contig=15918..15962bp; Strand=-; Gene name=Sbp
taaccgccacggaatatcatccaatggcggttatttctaaacatt

SEQ ID NO: 13460 - DNA, 39 bp, Xenorhabdus bovienii; identical to SEQ ID NO: 13374
  Terminator sequence Name=Xb4151_4152.C429.trmnator6; Position on contig=18096..18134bp; Strand=-

SEQ ID NO: 13461 - DNA, 33 bp, Xenorhabdus bovienii
  Terminator sequence Name=Xb4151_4152.C429.trmnator7; Position on contig=19034..19066bp; Strand=-
cccccttctatgaagggggatttttactggatc

SEQ ID NO: 13462 - DNA, 29 bp, Xenorhabdus bovienii
  Terminator sequence Name=Xb4151_4152.C429.trmnator8; Position on contig=19665..19693bp; Strand=-
ggtcgcatttgcgaccttttttattctta

SEQ ID NO: 13463 - DNA, 43 bp, Xenorhabdus bovienii
  Terminator sequence Name=Xb4151_4152.C429.trmnator9; Position on contig=20904..20946bp; Strand=+
gctgtttggctttcagagaaaactaaaaggcattattcttgtt

SEQ ID NO: 13464 - DNA, 27 bp, Xenorhabdus bovienii
  Terminator sequence Name=Xb4151_4152.C429.trmnator10; Position on contig=20693..20719bp; Strand=-
gccccatcacggggcttttttgttgga

SEQ ID NO: 13465 - DNA, 42 bp, Xenorhabdus bovienii
  Terminator sequence Name=Xb4151_4152.C429.trmnator11; Position on contig=21408..21449bp; Strand=-
caagagaagccccaacgggcttttcttgtgattattttaagc

SEQ ID NO: 13466 - DNA, 36 bp, Xenorhabdus bovienii
  Terminator sequence Name=Xb4151_4152.C429.trmnator12; Position on contig=22227..22262bp; Strand=+
ccctctgataggatgttcgagggatttgcattggca

SEQ ID NO: 13467 - DNA, 32 bp, Xenorhabdus bovienii
  Terminator sequence Name=Xb4151_4152.C429.trmnator13; Position on contig=21964..21995bp; Strand=-
taacctcagttgcgaggttagtttttttactt

SEQ ID NO: 13468 - DNA, 47 bp, Xenorhabdus bovienii
  Terminator sequence Name=Xb4151_4152.C429.trmnator14; Position on contig=30296..30342bp; Strand=+; Gene name=Lnt
gaagataagggtatattatttatacccttatcttctctatgcctaat

SEQ ID NO: 13469 - DNA, 41 bp, Xenorhabdus bovienii
  Terminator sequence Name=Xb4151_4152.C429.trmnator15; Position on contig=31633..31673bp; Strand=+; Gene name=ArtI
gggtgaggtagtcgttccctacctcattttttagcctgttc

SEQ ID NO: 13470 - DNA, 41 bp, Xenorhabdus bovienii
  Terminator sequence Name=Xb4151_4152.C429.trmnator16; Position on contig=33902..33942bp; Strand=+; Gene name=GlnQ
gtcggcggataacacgacttccgccgaccttaatctgctcc

SEQ ID NO: 13471 - DNA, 43 bp, Xenorhabdus bovienii
  Terminator sequence Name=Xb4151_4152.C429.trmnator17; Position on contig=45769..45811bp; Strand=-
catgatttgatgagtttcaccatgaattgtggcttttaaaatg

SEQ ID NO: 13472 - DNA, 31 bp, Xenorhabdus bovienii
  Terminator sequence Name=Xb4151_4152.C429.trmnator18; Position on contig=49625..49655bp; Strand=+; Gene name=CrcB
cccgttgtaataaacgggttttcaaaatacg

SEQ ID NO: 13473 - DNA, 38 bp, Xenorhabdus bovienii
  Terminator sequence Name=Xb4151_4152.C429.trmnator19; Position on contig=49974..50011bp; Strand=+
caaaatgtgaaaaacgcacgttttgctttatttcataa

SEQ ID NO: 13474 - DNA, 48 bp, Xenorhabdus bovienii
  Terminator sequence Name=Xb4151_4152.C429.trmnator20; Position on contig=49956..50003bp; Strand=-
taaagcaaaacgtgcgtttttcacattttgttatatatttcgtgatct

SEQ ID NO: 13475 - DNA, 29 bp, Xenorhabdus bovienii
  Terminator sequence Name=Xb4151_4152.C429.trmnator21; Position on contig=54629..54657bp; Strand=-
tgcgcagattttgcgcgttgatatcagca

SEQ ID NO: 13476 - DNA, 46 bp, Xenorhabdus bovienii
  Terminator sequence Name=Xb4151_4152.C429.trmnator22; Position on contig=56901..56946bp; Strand=+; Gene name=MarR
tttccagtagtgtaaatgcacactactggaggtgtgttctgtctac

SEQ ID NO: 13477 - DNA, 30 bp, Xenorhabdus bovienii
  Terminator sequence Name=Xb4151_4152.C429.trmnator23; Position on contig=59766..59795bp; Strand=-; Gene name=ProP
cgggagcattcactcccgttgataagtagt

SEQ ID NO: 13478 - DNA, 49 bp, Xenorhabdus bovienii
  Terminator sequence Name=Xb4151_4152.C429.trmnator24; Position on contig=60778..60826bp; Strand=-
tgtctcttgattataagtttgactcaagagacagataattatgatgagg

SEQ ID NO: 13479 - DNA, 35 bp, Xenorhabdus bovienii
  Terminator sequence Name=Xb4151_4152.C429.trmnator25; Position on contig=64627..64661bp; Strand=-; Gene name=IucD
tgattgctgaaatggtaatcgaaattataaattca

SEQ ID NO: 13480 - DNA, 37 bp, Xenorhabdus bovienii
  Terminator sequence Name=Xb4151_4152.C429.trmnator26; Position on contig=65763..65799bp; Strand=+
ttgtgggattcaggatcccggataattctgcactcta

SEQ ID NO: 13481 - DNA, 47 bp, Xenorhabdus bovienii
  Terminator sequence Name=Xb4151_4152.C429.trmnator27; Position on contig=74184..74230bp; Strand=-
taataaggctctggttatttaaccagggcctttattttaccactaat

SEQ ID NO: 13482 - DNA, 29 bp, Xenorhabdus bovienii
  Terminator sequence Name=Xb4151_4152.C429.trmnator28; Position on contig=80862..80890bp; Strand=+
gccacccggtgggtggcttctctggctaa

SEQ ID NO: 13483 - DNA, 50 bp, Xenorhabdus bovienii
  Terminator sequence Name=Xb4151_4152.C430.trmnator1; Position on contig=3785..3834bp; Strand=-
caagtaaagaatcactatttctgattctattatctgtgattttatacaga

SEQ ID NO: 13484 - DNA, 68 bp, Xenorhabdus bovienii
  Terminator sequence Name=Xb4151_4152.C430.trmnator2; Position on contig=5376..5443bp; Strand=+
ggatgataagaaaaagccggatatgcactacccggcttttttagttatcgttactgattattttcagg

SEQ ID NO: 13485 - DNA, 33 bp, Xenorhabdus bovienii
  Terminator sequence Name=Xb4151_4152.C430.trmnator3; Position on contig=5379..5411bp; Strand=-
gccgggtagtgcatatccggctttttcttatca

SEQ ID NO: 13486 - DNA, 41 bp, Xenorhabdus bovienii
  Terminator sequence Name=Xb4151_4152.C430.trmnator4; Position on contig=7622..7662bp; Strand=+
ccacagtattagtatgttatttattgtggttattgggtaaa

SEQ ID NO: 13487 - DNA, 32 bp, Xenorhabdus bovienii
  Terminator sequence Name=Xb4151_4152.C430.trmnator5; Position on contig=11779..11810bp; Strand=-
gacccatcttcggatgggtccttttcctgcac

SEQ ID NO: 13488 - DNA, 45 bp, Xenorhabdus bovienii
  Terminator sequence Name=Xb4151_4152.C430.trmnator6; Position on contig=17245..17289bp; Strand=-
tattgatattaaataatttattaatgttggtgcactttttactgt

SEQ ID NO: 13489 - DNA, 46 bp, Xenorhabdus bovienii
  Terminator sequence Name=Xb4151_4152.C430.trmnator7; Position on contig=24236..24281bp; Strand=-
ttccttactccccactgagcgaggagtaagggatctttatgagatt

SEQ ID NO: 13490 - DNA, 63 bp, Xenorhabdus bovienii
  Terminator sequence Name=Xb4151_4152.C430.trmnator8; Position on contig=24973..25035bp; Strand=-
ctaaaagttattttatgggtatggtgatttatctaaaaagctatttttagggttctgttgcat

SEQ ID NO: 13491 - DNA, 47 bp, Xenorhabdus bovienii
  Terminator sequence Name=Xb4151_4152.C430.trmnator9; Position on contig=26328..26374bp; Strand=-
taaaactaagcatatggttacatatgcttagtttgttttttacaata

SEQ ID NO: 13492 - DNA, 34 bp, Xenorhabdus bovienii
  Terminator sequence Name=Xb4151_4152.C430.trmnator10; Position on contig=35461..35494bp; Strand=-
gattggttaggtactagcaatctcttggtgttgt

SEQ ID NO: 13493 - DNA, 51 bp, Xenorhabdus bovienii
  Terminator sequence Name=Xb4151_4152.C430.trmnator11; Position on contig=36773..36823bp; Strand=+
gatactggctgcatacgtagtacatacaaccagtatctttttgatttccag

SEQ ID NO: 13494 - DNA, 46 bp, Xenorhabdus bovienii
  Terminator sequence Name=Xb4151_4152.C430.trmnator12; Position on contig=36595..36640bp; Strand=-
tacgataaaggcagtcattttgtttttatcgtcaattcttggttct

SEQ ID NO: 13495 - DNA, 56 bp, Xenorhabdus bovienii
  Terminator sequence Name=Xb4151_4152.C430.trmnator13; Position on contig=45338..45393bp; Strand=-
ttaattggacagtcctttcttataagaaatgattatccaatagatttcaaattact

SEQ ID NO: 13496 - DNA, 30 bp, Xenorhabdus bovienii; identical to SEQ ID NO: 13075
  Terminator sequence Name=Xb4151_4152.C430.trmnator14; Position on contig=47575..47604bp; Strand=-

SEQ ID NO: 13497 - DNA, 28 bp, Xenorhabdus bovienii
  Terminator sequence Name=Xb4151_4152.C430.trmnator15; Position on contig=48392..48419bp; Strand=-
gggcagaaatctgccctttgacatacgg

SEQ ID NO: 13498 - DNA, 65 bp, Xenorhabdus bovienii
  Terminator sequence Name=Xb4151_4152.C430.trmnator16; Position on contig=50667..50731bp; Strand=+
ccgatatctatttattcgccagatgcattactggcgaataaataaaattccgcgtcttactgatc

SEQ ID NO: 13499 - DNA, 55 bp, Xenorhabdus bovienii
  Terminator sequence Name=Xb4151_4152.C430.trmnator17; Position on contig=54548..54602bp; Strand=+; Gene name=GrpE
ccgtgattacaatgccgccatacacagggcggcatttttgtggttattctattgt

SEQ ID NO: 13500 - DNA, 52 bp, Xenorhabdus bovienii
  Terminator sequence Name=Xb4151_4152.C430.trmnator18; Position on contig=55397..55448bp; Strand=+
tataaattattttgaaaatttataaaaataatttcgtgtttttcttttataa

SEQ ID NO: 13501 - DNA, 29 bp, Xenorhabdus bovienii
  Terminator sequence Name=Xb4151_4152.C430.trmnator19; Position on contig=56818..56846bp; Strand=+
gcgggctgtttgcccgcttttgccagtga

SEQ ID NO: 13502 - DNA, 37 bp, Xenorhabdus bovienii
  Terminator sequence Name=Xb4151_4152.C430.trmnator20; Position on contig=56607..56643bp; Strand=-
gcctgtttttgcatagaaatagccttattttgcatac

SEQ ID NO: 13503 - DNA, 45 bp, Xenorhabdus bovienii
  Terminator sequence Name=Xb4151_4152.C430.trmnator21; Position on contig=62098..62142bp; Strand=+; Gene name=RseC
ttggtcataccgaaaaccacaggcatgactaggttttcacaggtt

SEQ ID NO: 13504 - DNA, 46 bp, Xenorhabdus bovienii
  Terminator sequence Name=Xb4151_4152.C430.trmnator22; Position on contig=61988..62033bp; Strand=-; Gene name=RseC
gtaaaccaatttgtaacacaacgggttggtacacttgctgatcatc

SEQ ID NO: 13505 - DNA, 61 bp, Xenorhabdus bovienii
  Terminator sequence Name=Xb4151_4152.C430.trmnator23; Position on contig=65148..65208bp; Strand=+; Gene name=LepB
caaacgcaacagttttgtaggatctatccccacaggtctgttgcgtgtgcttttttgatga

SEQ ID NO: 13506 - DNA, 41 bp, Xenorhabdus bovienii
  Terminator sequence Name=Xb4151_4152.C430.trmnator24; Position on contig=65024..65064bp; Strand=-; Gene name=LepB
gcttcgctaatatataaatattagtgaattcttccaattcg

SEQ ID NO: 13507 - DNA, 42 bp, Xenorhabdus bovienii
  Terminator sequence Name=Xb4151_4152.C430.trmnator25; Position on contig=68403..68444bp; Strand=-
ttgccaagcgttcaccagaacgctcgacaatttttttaatgc

SEQ ID NO: 13508 - DNA, 39 bp, Xenorhabdus bovienii
  Terminator sequence Name=Xb4151_4152.C430.trmnator26; Position on contig=71908..71946bp; Strand=+; Gene name=RimI
ggctgaacagtattattttattcagccattattgaatta

SEQ ID NO: 13509 - DNA, 39 bp, Xenorhabdus bovienii
  Terminator sequence Name=Xb4151_4152.C430.trmnator27; Position on contig=73173..73211bp; Strand=+
gagagtttgcgctgaagcagagctctcttttcatctgtt

SEQ ID NO: 13510 - DNA, 40 bp, Xenorhabdus bovienii
  Terminator sequence Name=Xb4151_4152.C430.trmnator28; Position on contig=77231..77270bp; Strand=+; Gene name=CysA
cccgtctctcgtcatttgggggagcgggtattttttgttt

SEQ ID NO: 13511 - DNA, 37 bp, Xenorhabdus bovienii
  Terminator sequence Name=Xb4151_4152.C430.trmnator29; Position on contig=80765..80801bp; Strand=-
tccccagataaataaaatttggggatatttatagcct

SEQ ID NO: 13512 - DNA, 37 bp, Xenorhabdus bovienii
  Terminator sequence Name=Xb4151_4152.C430.trmnator30; Position on contig=81623..81659bp; Strand=+
gaggaaattccagcaagaattccttctttttcagtga

SEQ ID NO: 13513 - DNA, 27 bp, Xenorhabdus bovienii
  Terminator sequence Name=Xb4151_4152.C430.trmnator31; Position on contig=81422..81448bp; Strand=-
gcaccttaagggtgcttttttgtgcat

SEQ ID NO: 13514 - DNA, 39 bp, Xenorhabdus bovienii
  Terminator sequence Name=Xb4151_4152.C430.trmnator32; Position on contig=82659..82697bp; Strand=-; Gene name=CysK
ccctgatgtatcaagaatacaccagggttttgtattagc

SEQ ID NO: 13515 - DNA, 29 bp, Xenorhabdus bovienii
  Terminator sequence Name=Xb4151_4152.C430.trmnator33; Position on contig=84675..84703bp; Strand=+; Gene name=ZipA
cccccgctagccgggggtttttcatgtct

SEQ ID NO: 13516 - DNA, 54 bp, Xenorhabdus bovienii
  Terminator sequence Name=Xb4151_4152.C430.trmnator34; Position on contig=86819..86872bp; Strand=+; Gene name=Lig
taaggggggctactgagaatagatcttgatagcaccctatacttgatgtttctt

SEQ ID NO: 13517 - DNA, 45 bp, Xenorhabdus bovienii
  Terminator sequence Name=Xb4151_4152.C430.trmnator35; Position on contig=88101..88145bp; Strand=+
taaaggcactgcaataagttgagtgcctttactattttgtgtcat

SEQ ID NO: 13518 - DNA, 44 bp, Xenorhabdus bovienii
  Terminator sequence Name=Xb4151_4152.C430.trmnator36; Position on contig=87705..87748bp; Strand=-
gaatccctgaagacgcaagttttcagggatttttcttatatgcc

SEQ ID NO: 13519 - DNA, 50 bp, Xenorhabdus bovienii
  Terminator sequence Name=Xb4151_4152.C431.trmnator1; Position on contig=471..520bp; Strand=+; Gene name=TorD
taaaagggcaaattattaatggataatttgcccttttatttcaatgacga

SEQ ID NO: 13520 - DNA, 52 bp, Xenorhabdus bovienii
  Terminator sequence Name=Xb4151_4152.C431.trmnator2; Position on contig=457..508bp; Strand=-; Gene name=TorD
taaaagggcaaattatccattaataatttgcccttttattttatcaattagt

SEQ ID NO: 13521 - DNA, 41 bp, Xenorhabdus bovienii
  Terminator sequence Name=Xb4151_4152.C431.trmnator3; Position on contig=5283..5323bp; Strand=-
cagggcgcgcatagcttgttgcgcctctgttcgtggttgca

SEQ ID NO: 13522 - DNA, 37 bp, Xenorhabdus bovienii; identical to SEQ ID NO: 13454
  Terminator sequence Name=Xb4151_4152.C431.trmnator4; Position on contig=5874..5910bp; Strand=-

SEQ ID NO: 13523 - DNA, 56 bp, Xenorhabdus bovienii
  Terminator sequence Name=Xb4151_4152.C431.trmnator5; Position on contig=10042..10097bp; Strand=+
gaatgttggcgtaaatagtatctcattatttatgccagcattgttattttagaaga

SEQ ID NO: 13524 - DNA, 45 bp, Xenorhabdus bovienii
  Terminator sequence Name=Xb4151_4152.C431.trmnator6; Position on contig=10034..10078bp; Strand=-
tggcataaataatgagatactatttacgccaacattctgattacc

SEQ ID NO: 13525 - DNA, 40 bp, Xenorhabdus bovienii
  Terminator sequence Name=Xb4151_4152.C431.trmnator7; Position on contig=10840..10879bp; Strand=-
ttggacactcagtatgttgagtgtccaatttaaccgtttg

SEQ ID NO: 13526 - DNA, 34 bp, Xenorhabdus bovienii
  Terminator sequence Name=Xb4151_4152.C431.trmnator8; Position on contig=12470..12503bp; Strand=-
ggagtgctgaatcagcatccatcatttttcctct

SEQ ID NO: 13527 - DNA, 38 bp, Xenorhabdus bovienii
  Terminator sequence Name=Xb4151_4152.C431.trmnator9; Position on contig=13322..13359bp; Strand=+
gcccggttagtggaactaaaccgggctttctcgaattt

SEQ ID NO: 13528 - DNA, 38 bp, Xenorhabdus bovienii
  Terminator sequence Name=Xb4151_4152.C431.trmnator10; Position on contig=13123..13160bp; Strand=-
tcgtttcgttctcaggaatgaagcgattcctccatagt

SEQ ID NO: 13529 - DNA, 38 bp, Xenorhabdus bovienii
  Terminator sequence Name=Xb4151_4152.C431.trmnator11; Position on contig=13793..13830bp; Strand=+
tcccgattagcagaactaaatcgggatttctttaattt

SEQ ID NO: 13530 - DNA, 39 bp, Xenorhabdus bovienii
  Terminator sequence Name=Xb4151_4152.C431.trmnator12; Position on contig=13860..13898bp; Strand=-
tagttcagtcggtagaacggcggactgttaatccgtatg

SEQ ID NO: 13531 - DNA, 51 bp, Xenorhabdus bovienii
  Terminator sequence Name=Xb4151_4152.C431.trmnator13; Position on contig=14778..14828bp; Strand=+
gcgacttttttaaatcgataatacataaaaaggttgctattcctgtgcggt

SEQ ID NO: 13532 - DNA, 51 bp, Xenorhabdus bovienii
  Terminator sequence Name=Xb4151_4152.C431.trmnator14; Position on contig=14696..14746bp; Strand=-
tgaataggtacaattataattttatttgatttattcaacttttatcttagc

SEQ ID NO: 13533 - DNA, 39 bp, Xenorhabdus bovienii
  Terminator sequence Name=Xb4151_4152.C431.trmnator15; Position on contig=17516..17554bp; Strand=+
tttcgttatcatccaaatgatgaagcaattttacattca

SEQ ID NO: 13534 - DNA, 35 bp, Xenorhabdus bovienii
  Terminator sequence Name=Xb4151_4152.C431.trmnator16; Position on contig=31263..31297bp; Strand=-; Gene name=CheZ
ctttggccatctggtcagaaggcatattttccatt

SEQ ID NO: 13535 - DNA, 67 bp, Xenorhabdus bovienii
  Terminator sequence Name=Xb4151_4152.C431.trmnator17; Position on contig=31998..32064bp; Strand=+
taaatgattttttattaatgtaaaatcatgttgattcaataaaatatattgtaaatattaatggaat

SEQ ID NO: 13536 - DNA, 47 bp, Xenorhabdus bovienii
  Terminator sequence Name=Xb4151_4152.C431.trmnator18; Position on contig=32446..32492bp; Strand=-
gaatgacattgacataatatgaatcaatgtcatcggtttttggggat

SEQ ID NO: 13537 - DNA, 50 bp, Xenorhabdus bovienii
  Terminator sequence Name=Xb4151_4152.C431.trmnator19; Position on contig=37365..37414bp; Strand=+
ctcaaccttccctgttatatatgcggggaaggttcagacttcttttaacg

SEQ ID NO: 13538 - DNA, 46 bp, Xenorhabdus bovienii
  Terminator sequence Name=Xb4151_4152.C431.trmnator20; Position on contig=43215..43260bp; Strand=+; Gene name=FlhA
tgacaaacctcacacaaacggtgaggtatgtcaggatttttccgat

SEQ ID NO: 13539 - DNA, 38 bp, Xenorhabdus bovienii
  Terminator sequence Name=Xb4151_4152.C431.trmnator21; Position on contig=43632..43669bp; Strand=+
tgtaatccatccaaaggattatcacctattttttttac

SEQ ID NO: 13540 - DNA, 40 bp, Xenorhabdus bovienii
  Terminator sequence Name=Xb4151_4152.C431.trmnator22; Position on contig=51234..51273bp; Strand=+
ccctttatttcactgataaataaagaggtctgtacatatg

SEQ ID NO: 13541 - DNA, 32 bp, Xenorhabdus bovienii
  Terminator sequence Name=Xb4151_4152.C431.trmnator23; Position on contig=53419..53450bp; Strand=-; Gene name=FlgB
cagcctgatatttcaggctgttatctgcgaaa

SEQ ID NO: 13542 - DNA, 43 bp, Xenorhabdus bovienii
  Terminator sequence Name=Xb4151_4152.C431.trmnator24; Position on contig=60268..60310bp; Strand=-; Gene name=FlgJ
tcgttgattgcgcgaccttagcgtaacgcggattttccgtcag

SEQ ID NO: 13543 - DNA, 35 bp, Xenorhabdus bovienii
  Terminator sequence Name=Xb4151_4152.C431.trmnator25; Position on contig=127113..127147bp; Strand=-
ttactcgagtacgctgagtaaacgtctttccagtc

SEQ ID NO: 13544 - DNA, 48 bp, Xenorhabdus bovienii
  Terminator sequence Name=Xb4151_4152.C431.trmnator26; Position on contig=127427..127474bp; Strand=-
ctgattaaggatctgggtgtctgcccattctttcagatctttcatgtc

SEQ ID NO: 13545 - DNA, 39 bp, Xenorhabdus bovienii; identical to SEQ ID NO: 13348
  Terminator sequence Name=Xb4151_4152.C431.trmnator27; Position on contig=132350..132388bp; Strand=+; Gene name=FhaB

SEQ ID NO: 13546 - DNA, 36 bp, Xenorhabdus bovienii
  Terminator sequence Name=Xb4151_4152.C431.trmnator28; Position on contig=132041..132076bp; Strand=-; Gene name=FhaB
cctgattgtcgagatgattacggttttctattgaaa

SEQ ID NO: 13547 - DNA, 54 bp, Xenorhabdus bovienii
  Terminator sequence Name=Xb4151_4152.C431.trmnator29; Position on contig=141682..141735bp; Strand=+; Gene name=FhaB
cattatcaccttcttccagaatatcagggaggtgctgttggagtttttgaatcc

SEQ ID NO: 13548 - DNA, 27 bp, Xenorhabdus bovienii
  Terminator sequence Name=Xb4151_4152.C431.trmnator30; Position on contig=141214..141240bp; Strand=-; Gene name=FhaB
gcgtcagggacgcgggatttttccggt

SEQ ID NO: 13549 - DNA, 67 bp, Xenorhabdus bovienii
  Terminator sequence Name=Xb4151_4152.C431.trmnator31; Position on contig=142954..143020bp; Strand=-
atcgaacctacaactagcccttaggaggggctcgttatatccatttaactaaggggactttttacta

SEQ ID NO: 13550 - DNA, 62 bp, Xenorhabdus bovienii
  Terminator sequence Name=Xb4151_4152.C431.trmnator32; Position on contig=143922..143983bp; Strand=+
tctaatcatttaatacatgaccctactttggtcatgtattaaatggttagttgctgtgatat

SEQ ID NO: 13551 - DNA, 37 bp, Xenorhabdus bovienii
  Terminator sequence Name=Xb4151_4152.C431.trmnator33; Position on contig=144869..144905bp; Strand=+
cttatattggtcaggattaaatgagcattttttacca

SEQ ID NO: 13552 - DNA, 31 bp, Xenorhabdus bovienii
  Terminator sequence Name=Xb4151_4152.C431.trmnator34; Position on contig=145162..145192bp; Strand=-
cccacttaataggtgggttttttattgccct

SEQ ID NO: 13553 - DNA, 62 bp, Xenorhabdus bovienii
  Terminator sequence Name=Xb4151_4152.C431.trmnator35; Position on contig=146893..146954bp; Strand=+
ctgttatgaatattgtttggttaattttttgttaaataattttgtatgggttttcttgattg

SEQ ID NO: 13554 - DNA, 55 bp, Xenorhabdus bovienii
  Terminator sequence Name=Xb4151_4152.C431.trmnator36; Position on contig=150666..150720bp; Strand=+; Gene name=FlgL
tctaaaaaataaggatcggcttgccgatccttattttttaacctttgtcagggac

SEQ ID NO: 13555 - DNA, 36 bp, Xenorhabdus bovienii
  Terminator sequence Name=Xb4151_4152.C431.trmnator37; Position on contig=150663..150698bp; Strand=-; Gene name=FlgL
taaggatcggcaagccgatccttattttttagagat

SEQ ID NO: 13556 - DNA, 48 bp, Xenorhabdus bovienii
  Terminator sequence Name=Xb4151_4152.C431.trmnator38; Position on contig=152203..152250bp; Strand=+
tagaggggaatgcgataataacgcattccccctatattttaattatat

SEQ ID NO: 13557 - DNA, 41 bp, Xenorhabdus bovienii
  Terminator sequence Name=Xb4151_4152.C431.trmnator39; Position on contig=152011..152051bp; Strand=-
tttccggcgtaaactcttgtgctgggtaattgcttgatgtt

SEQ ID NO: 13558 - DNA, 45 bp, Xenorhabdus bovienii
  Terminator sequence Name=Xb4151_4152.C431.trmnator40; Position on contig=158306..158350bp; Strand=+; Gene name=PutP
taaaaagcctctgaacaatcagaggctttttaattagttgtttat

SEQ ID NO: 13559 - DNA, 32 bp, Xenorhabdus bovienii
  Terminator sequence Name=Xb4151_4152.C431.trmnator41; Position on contig=158300..158331bp; Strand=-; Gene name=PutP
gcctctgattgttcagaggctttttatcacag

SEQ ID NO: 13560 - DNA, 39 bp, Xenorhabdus bovienii
  Terminator sequence Name=Xb4151_4152.C432.trmnator1; Position on contig=138..176bp; Strand=-
gagtcagatgatttatcatctaactccttgttttatttg

SEQ ID NO: 13561 - DNA, 50 bp, Xenorhabdus bovienii
  Terminator sequence Name=Xb4151_4152.C432.trmnator2; Position on contig=1080..1129bp; Strand=-
gcataatgcgcctgccactcctggcaggcgtgtttgcttttatggacgat

SEQ ID NO: 13562 - DNA, 38 bp, Xenorhabdus bovienii
  Terminator sequence Name=Xb4151_4152.C432.trmnator3; Position on contig=2381..2418bp; Strand=-; Gene name=RadC
tgccctgccaataaaccggcggggcattatgttttaag

SEQ ID NO: 13563 - DNA, 39 bp, Xenorhabdus bovienii
  Terminator sequence Name=Xb4151_4152.C432.trmnator4; Position on contig=14815..14853bp; Strand=-
gggtggctgcaaaagcagccacaatcaatcttttataat

SEQ ID NO: 13564 - DNA, 33 bp, Xenorhabdus bovienii
  Terminator sequence Name=Xb4151_4152.C432.trmnator5; Position on contig=19763..19795bp; Strand=+
gttttcataagcatgagagccttcctgtttagt

SEQ ID NO: 13565 - DNA, 43 bp, Xenorhabdus bovienii
  Terminator sequence Name=Xb4151_4152.C432.trmnator6; Position on contig=28549..28591bp; Strand=-
gtggttcgagtatgtagtctcgctcaatcacttcctgctgcgc

SEQ ID NO: 13566 - DNA, 36 bp, Xenorhabdus bovienii
  Terminator sequence Name=Xb4151_4152.C432.trmnator7; Position on contig=29626..29661bp; Strand=-
ggggtcgcattttgatgcaaccccttgataattctg

SEQ ID NO: 13567 - DNA, 42 bp, Xenorhabdus bovienii
  Terminator sequence Name=Xb4151_4152.C432.trmnator8; Position on contig=32407..32448bp; Strand=+; Gene name=InsB
caggtaatgattttttcttgttaccctgactatatgatttga

SEQ ID NO: 13568 - DNA, 36 bp, Xenorhabdus bovienii; identical to SEQ ID NO: 13349
  Terminator sequence Name=Xb4151_4152.C432.trmnator9; Position on contig=32117..32152bp; Strand=-; Gene name=InsB

SEQ ID NO: 13569 - DNA, 69 bp, Xenorhabdus bovienii
  Terminator sequence Name=Xb4151_4152.C432.trmnator10; Position on contig=34917..34985bp; Strand=-
ttttaatttatttacatagatgacttcatatccatcatttgttggatagataaaagcatctttattagc

SEQ ID NO: 13570 - DNA, 47 bp, Xenorhabdus bovienii
  Terminator sequence Name=Xb4151_4152.C432.trmnator11; Position on contig=37654..37700bp; Strand=+
tcaacaggctgcgttaatatgtagccttgttgatgttttctgcctga

SEQ ID NO: 13571 - DNA, 46 bp, Xenorhabdus bovienii
  Terminator sequence Name=Xb4151_4152.C432.trmnator12; Position on contig=37608..37653bp; Strand=-
ttgatggtgatttttattcaatggacaccgttaattgatgtccgat

SEQ ID NO: 13572 - DNA, 39 bp, Xenorhabdus bovienii; identical to SEQ ID NO: 13374
  Terminator sequence Name=Xb4151_4152.C432.trmnator13; Position on contig=41635..41673bp; Strand=-

SEQ ID NO: 13573 - DNA, 51 bp, Xenorhabdus bovienii
  Terminator sequence Name=Xb4151_4152.C432.trmnator14; Position on contig=44711..44761bp; Strand=+
gttattcacgctcgcttttccgccgagcgtgaaatgtgcattgttggtggt

SEQ ID NO: 13574 - DNA, 35 bp, Xenorhabdus bovienii
  Terminator sequence Name=Xb4151_4152.C432.trmnator15; Position on contig=45154..45188bp; Strand=+
gttgcggccaatcacgcgcaacatcttctttgata

SEQ ID NO: 13575 - DNA, 50 bp, Xenorhabdus bovienii
  Terminator sequence Name=Xb4151_4152.C432.trmnator16; Position on contig=47641..47690bp; Strand=+
gggacagggctgctctcgctgccaagctgatctgtcccctattgattgag

SEQ ID NO: 13576 - DNA, 38 bp, Xenorhabdus bovienii
  Terminator sequence Name=Xb4151_4152.C432.trmnator17; Position on contig=47398..47435bp; Strand=-
tcaaaggtagataatacattttgaattattctatcttc

SEQ ID NO: 13577 - DNA, 27 bp, Xenorhabdus bovienii
  Terminator sequence Name=Xb4151_4152.C432.trmnator18; Position on contig=50649..50675bp; Strand=-
ccaggtgaccctgggattctgaataaa

SEQ ID NO: 13578 - DNA, 39 bp, Xenorhabdus bovienii
  Terminator sequence Name=Xb4151_4152.C432.trmnator19; Position on contig=52061..52099bp; Strand=+
cgttatcagcccatgaggctgttaacgcttttcttcagc

SEQ ID NO: 13579 - DNA, 47 bp, Xenorhabdus bovienii
  Terminator sequence Name=Xb4151_4152.C432.trmnator20; Position on contig=53056..53102bp; Strand=+
gggggaactgtgccctgggtgggccgttcctcctgtttattcttatc

SEQ ID NO: 13580 - DNA, 47 bp, Xenorhabdus bovienii
  Terminator sequence Name=Xb4151_4152.C432.trmnator21; Position on contig=54083..54129bp; Strand=+
tcaaccgaaaggggaactattcccttttcggggtgtgttttcctttt

SEQ ID NO: 13581 - DNA, 28 bp, Xenorhabdus bovienii
  Terminator sequence Name=Xb4151_4152.C432.trmnator22; Position on contig=54873..54900bp; Strand=+
gcgcctttcggggcgctttttttttgtt

SEQ ID NO: 13582 - DNA, 43 bp, Xenorhabdus bovienii
  Terminator sequence Name=Xb4151_4152.C432.trmnator23; Position on contig=57708..57750bp; Strand=+
cccaatttagagtgattattcagattgggctgctttttattaa

SEQ ID NO: 13583 - DNA, 44 bp, Xenorhabdus bovienii
  Terminator sequence Name=Xb4151_4152.C432.trmnator24; Position on contig=57526..57569bp; Strand=-
cttggttcgattccgagtccgggcaccaagattttatgcgggtt

SEQ ID NO: 13584 - DNA, 42 bp, Xenorhabdus bovienii
  Terminator sequence Name=Xb4151_4152.C432.trmnator25; Position on contig=63100..63141bp; Strand=+
gccatctattattactttaaatagatggccatatttattatt

SEQ ID NO: 13585 - DNA, 45 bp, Xenorhabdus bovienii
  Terminator sequence Name=Xb4151_4152.C432.trmnator26; Position on contig=63086..63130bp; Strand=-
tggccatctatttaaagtaataatagatggctatttgaattcaaa

SEQ ID NO: 13586 - DNA, 50 bp, Xenorhabdus bovienii
  Terminator sequence Name=Xb4151_4152.C432.trmnator27; Position on contig=66193..66242bp; Strand=-; Gene name=LysR
ttgcgggtgtatttattgttatggatacacccgcactgatcttccctgtc

SEQ ID NO: 13587 - DNA, 45 bp, Xenorhabdus bovienii
  Terminator sequence Name=Xb4151_4152.C432.trmnator28; Position on contig=67199..67243bp; Strand=-
caaagaccccccgtggccagcgggggatctttgtttcaagtagcc

SEQ ID NO: 13588 - DNA, 34 bp, Xenorhabdus bovienii
  Terminator sequence Name=Xb4151_4152.C432.trmnator29; Position on contig=68245..68278bp; Strand=-; Gene name=SpeB
ggattatttgtaagagtaatcttttagcgtaatc

SEQ ID NO: 13589 - DNA, 41 bp, Xenorhabdus bovienii
  Terminator sequence Name=Xb4151_4152.C432.trmnator30; Position on contig=74835..74875bp; Strand=-; Gene name=FepC
tcccgtcatcattcattggtgatgggattttctctttttaa

SEQ ID NO: 13590 - DNA, 33 bp, Xenorhabdus bovienii
  Terminator sequence Name=Xb4151_4152.C432.trmnator31; Position on contig=87591..87623bp; Strand=-; Gene name=CirA
gcagtctgtgtcagcattgctttatcaatgccc

SEQ ID NO: 13591 - DNA, 42 bp, Xenorhabdus bovienii
  Terminator sequence Name=Xb4151_4152.C432.trmnator32; Position on contig=90020..90061bp; Strand=-; Gene name=EntB
catttcttctcccctagagaagaaagtgacatttcattgagc

SEQ ID NO: 13592 - DNA, 57 bp, Xenorhabdus bovienii
  Terminator sequence Name=Xb4151_4152.C432.trmnator33; Position on contig=92032..92088bp; Strand=+
tatgctatcatatgaaattgttatacattcatatggttgcatatcattgtgatttag

SEQ ID NO: 13593 - DNA, 54 bp, Xenorhabdus bovienii
  Terminator sequence Name=Xb4151_4152.C432.trmnator34; Position on contig=91904..91957bp; Strand=-
taaaaacaaaatggtacgttcggtatcattttgttttatacttattcgtacatt

SEQ ID NO: 13594 - DNA, 27 bp, Xenorhabdus bovienii
  Terminator sequence Name=Xb4151_4152.C432.trmnator35; Position on contig=94256..94282bp; Strand=-
cccgccccgcgcgggtttttttattaa

SEQ ID NO: 13595 - DNA, 34 bp, Xenorhabdus bovienii
  Terminator sequence Name=Xb4151_4152.C432.trmnator36; Position on contig=95286..95319bp; Strand=-
tcatctatcctaagataggtgattttgtagacgt

SEQ ID NO: 13596 - DNA, 44 bp, Xenorhabdus bovienii
  Terminator sequence Name=Xb4151_4152.C432.trmnator37; Position on contig=100880..100923bp; Strand=+
caacaagcctcgcccagtgcggggctttttgctatctactcgta

SEQ ID NO: 13597 - DNA, 44 bp, Xenorhabdus bovienii
  Terminator sequence Name=Xb4151_4152.C432.trmnator38; Position on contig=100867..100910bp; Strand=-
caaaaagccccgcactgggcgaggcttgttgattctataagctg

SEQ ID NO: 13598 - DNA, 36 bp, Xenorhabdus bovienii; identical to SEQ ID NO: 13367
  Terminator sequence Name=Xb4151_4152.C432.trmnator39; Position on contig=101744..101779bp; Strand=-

SEQ ID NO: 13599 - DNA, 46 bp, Xenorhabdus bovienii
  Terminator sequence Name=Xb4151_4152.C432.trmnator40; Position on contig=103498..103543bp; Strand=-
gatgctttctcggatatcgagaacagttgatccagtttctccagag

SEQ ID NO: 13600 - DNA, 30 bp, Xenorhabdus bovienii
  Terminator sequence Name=Xb4151_4152.C432.trmnator41; Position on contig=111195..111224bp; Strand=+
gcggctgtcacaggccgcttttttgataac

SEQ ID NO: 13601 - DNA, 62 bp, Xenorhabdus bovienii
  Terminator sequence Name=Xb4151_4152.C433.trmnator1; Position on contig=2094..2155bp; Strand=+; Gene name=MetA
tcatttgatttatttaaattaatttacttaagtttaaataatggaaatggtttttgatttat

SEQ ID NO: 13602 - DNA, 36 bp, Xenorhabdus bovienii
  Terminator sequence Name=Xb4151_4152.C433.trmnator2; Position on contig=5195..5230bp; Strand=+; Gene name=AceA
gggggattctgtgaggaattcccctttacgcgtcgg

SEQ ID NO: 13603 - DNA, 32 bp, Xenorhabdus bovienii
  Terminator sequence Name=Xb4151_4152.C433.trmnator3; Position on contig=8447..8478bp; Strand=-; Gene name=Eda
cagggattttaaattccctgtattctaatttg

SEQ ID NO: 13604 - DNA, 50 bp, Xenorhabdus bovienii
  Terminator sequence Name=Xb4151_4152.C433.trmnator4; Position on contig=13036..13085bp; Strand=+; Gene name=Pgi
gcctcgcctccaataaacatggctattgaggtgaggcgcttatgattacg

SEQ ID NO: 13605 - DNA, 40 bp, Xenorhabdus bovienii
  Terminator sequence Name=Xb4151_4152.C433.trmnator5; Position on contig=14678..14717bp; Strand=+; Gene name=UbiA
taacgggcggataaacccgcccgttcagctttatctccag

SEQ ID NO: 13606 - DNA, 33 bp, Xenorhabdus bovienii
  Terminator sequence Name=Xb4151_4152.C433.trmnator6; Position on contig=14668..14700bp; Strand=-; Gene name=UbiA
cgggcgggtttatccgcccgttatgttaaacat

SEQ ID NO: 13607 - DNA, 37 bp, Xenorhabdus bovienii
  Terminator sequence Name=Xb4151_4152.C433.trmnator7; Position on contig=18609..18645bp; Strand=+; Gene name=LexA
tgtgattatgctgacatgtatcgcgttctgtacagga

SEQ ID NO: 13608 - DNA, 38 bp, Xenorhabdus bovienii
  Terminator sequence Name=Xb4151_4152.C433.trmnator8; Position on contig=19368..19405bp; Strand=+
tagcagtttcttaaaagaaaccgctattttgtaaggga

SEQ ID NO: 13609 - DNA, 52 bp, Xenorhabdus bovienii
  Terminator sequence Name=Xb4151_4152.C433.trmnator9; Position on contig=19983..20034bp; Strand=+
gatgataatgataaagtataaggttaatcattatcaatactgtttttattta

SEQ ID NO: 13610 - DNA, 48 bp, Xenorhabdus bovienii
  Terminator sequence Name=Xb4151_4152.C433.trmnator10; Position on contig=20491..20538bp; Strand=+
gctattggggtgccttgatagcagcacccggatagtttttgacgggtt

SEQ ID NO: 13611 - DNA, 34 bp, Xenorhabdus bovienii
  Terminator sequence Name=Xb4151_4152.C433.trmnator11; Position on contig=26616..26649bp; Strand=-
gaaccagctttcgagctggtttttttacgcctaa

SEQ ID NO: 13612 - DNA, 33 bp, Xenorhabdus bovienii
  Terminator sequence Name=Xb4151_4152.C433.trmnator12; Position on contig=32786..32818bp; Strand=+
gcctcgcccagtgcggggctttttcacatctgg

SEQ ID NO: 13613 - DNA, 35 bp, Xenorhabdus bovienii
  Terminator sequence Name=Xb4151_4152.C433.trmnator13; Position on contig=33224..33258bp; Strand=+
gagcgtctatctctgggcgctcgatattgcttatt

SEQ ID NO: 13614 - DNA, 41 bp, Xenorhabdus bovienii
  Terminator sequence Name=Xb4151_4152.C433.trmnator14; Position on contig=33741..33781bp; Strand=+
tgtattggttgtcatccataaccaatacgtttatctgatgg

SEQ ID NO: 13615 - DNA, 46 bp, Xenorhabdus bovienii
  Terminator sequence Name=Xb4151_4152.C433.trmnator15; Position on contig=33496..33541bp; Strand=-
gggcggtaatgattttttgctgtgtaccgtcctttatgtatccagt

SEQ ID NO: 13616 - DNA, 33 bp, Xenorhabdus bovienii
  Terminator sequence Name=Xb4151_4152.C433.trmnator16; Position on contig=35365..35397bp; Strand=+
tgttttattgcgggtaaaacgtttttttcataa

SEQ ID NO: 13617 - DNA, 45 bp, Xenorhabdus bovienii
  Terminator sequence Name=Xb4151_4152.C433.trmnator17; Position on contig=35037..35081bp; Strand=-
gaatgggtatcggtggcaccggaacgtattcggtttgtatgctgc

SEQ ID NO: 13618 - DNA, 41 bp, Xenorhabdus bovienii
  Terminator sequence Name=Xb4151_4152.C433.trmnator18; Position on contig=36461..36501bp; Strand=-
caaatctttcttagttgaaggatttagttttattgatggtt

SEQ ID NO: 13619 - DNA, 30 bp, Xenorhabdus bovienii
  Terminator sequence Name=Xb4151_4152.C433.trmnator19; Position on contig=43287..43316bp; Strand=+
ggcggccaccgtgccgcctttttaccgggg

SEQ ID NO: 13620 - DNA, 26 bp, Xenorhabdus bovienii
  Terminator sequence Name=Xb4151_4152.C433.trmnator20; Position on contig=51585..51610bp; Strand=+
cccgcttcggcgggtttttttatgag

SEQ ID NO: 13621 - DNA, 37 bp, Xenorhabdus bovienii; identical to SEQ ID NO: 13454
  Terminator sequence Name=Xb4151_4152.C433.trmnator21; Position on contig=53245..53281bp; Strand=-

SEQ ID NO: 13622 - DNA, 30 bp, Xenorhabdus bovienii
  Terminator sequence Name=Xb4151_4152.C433.trmnator22; Position on contig=55397..55426bp; Strand=+
ggtggcttattagccgccttctcttttttg

SEQ ID NO: 13623 - DNA, 37 bp, Xenorhabdus bovienii
  Terminator sequence Name=Xb4151_4152.C433.trmnator23; Position on contig=55295..55331bp; Strand=-
ccgccatttctttaagaactggcggtattttctttcc

SEQ ID NO: 13624 - DNA, 44 bp, Xenorhabdus bovienii
  Terminator sequence Name=Xb4151_4152.C433.trmnator24; Position on contig=57904..57947bp; Strand=-
taacacccccctccttgtgatgcggggtgttattttgtattgag

SEQ ID NO: 13625 - DNA, 44 bp, Xenorhabdus bovienii
  Terminator sequence Name=Xb4151_4152.C433.trmnator25; Position on contig=71263..71306bp; Strand=+
cgcccttgtaagtcatcctcttacaagggcgtttttcttggttt

SEQ ID NO: 13626 - DNA, 38 bp, Xenorhabdus bovienii
  Terminator sequence Name=Xb4151_4152.C433.trmnator26; Position on contig=71630..71667bp; Strand=+; Gene name=BolA
gttgtttgcctcgccgcgaacagcacactttgaattaa

SEQ ID NO: 13627 - DNA, 47 bp, Xenorhabdus bovienii
  Terminator sequence Name=Xb4151_4152.C433.trmnator27; Position on contig=75866..75912bp; Strand=+
tgagccgtggtatcaacaggttaccacggcctgagaatttactgttt

SEQ ID NO: 13628 - DNA, 48 bp, Xenorhabdus bovienii
  Terminator sequence Name=Xb4151_4152.C433.trmnator28; Position on contig=75851..75898bp; Strand=-
caggccgtggtaacctgttgataccacggctcattggctttcctggca

SEQ ID NO: 13629 - DNA, 36 bp, Xenorhabdus bovienii
  Terminator sequence Name=Xb4151_4152.C433.trmnator29; Position on contig=77706..77741bp; Strand=-
tgaggaagttttaaatattcctcactttgcatctcc

SEQ ID NO: 13630 - DNA, 43 bp, Xenorhabdus bovienii
  Terminator sequence Name=Xb4151_4152.C433.trmnator30; Position on contig=79161..79203bp; Strand=+
gaatagccgtttttcactgaagggctgttcgttcctttgttta

SEQ ID NO: 13631 - DNA, 38 bp, Xenorhabdus bovienii
  Terminator sequence Name=Xb4151_4152.C433.trmnator31; Position on contig=80384..80421bp; Strand=+; Gene name=SspB
taaaggagattttggtctcctttattatttttagtcgt

SEQ ID NO: 13632 - DNA, 56 bp, Xenorhabdus bovienii
  Terminator sequence Name=Xb4151_4152.C433.trmnator32; Position on contig=80364..80419bp; Strand=-; Gene name=SspB
gactaaaaataataaaggagaccaaaatctcctttattttttatattgtaactgta

SEQ ID NO: 13633 - DNA, 60 bp, Xenorhabdus bovienii
  Terminator sequence Name=Xb4151_4152.C433.trmnator33; Position on contig=87590..87649bp; Strand=+
tgcgatattttaatcttaattcatgcaatataataggattaaattgcatattttatgttg

SEQ ID NO: 13634 - DNA, 38 bp, Xenorhabdus bovienii
  Terminator sequence Name=Xb4151_4152.C433.trmnator34; Position on contig=90346..90383bp; Strand=+; Gene name=BaeS
tgtttaaccctctaaggggttaagcattaatctactac

SEQ ID NO: 13635 - DNA, 32 bp, Xenorhabdus bovienii
  Terminator sequence Name=Xb4151_4152.C433.trmnator35; Position on contig=91790..91821bp; Strand=-; Gene name=MrcA
gcggcacaagtcagtgccgcttttatttgagc

SEQ ID NO: 13636 - DNA, 36 bp, Xenorhabdus bovienii
  Terminator sequence Name=Xb4151_4152.C433.trmnator36; Position on contig=96250..96285bp; Strand=-
ggtttgatatccgatgtataggccttttcacgcacc

SEQ ID NO: 13637 - DNA, 40 bp, Xenorhabdus bovienii
  Terminator sequence Name=Xb4151_4152.C433.trmnator37; Position on contig=98548..98587bp; Strand=+; Gene name=LysR
ccctttactgagaatccacagtcaggggcttttggcaata

SEQ ID NO: 13638 - DNA, 32 bp, Xenorhabdus bovienii
  Terminator sequence Name=Xb4151_4152.C433.trmnator38; Position on contig=101092..101123bp; Strand=+; Gene name=AmpC
gcggtctggtaacaggctgccttatctgacgg

SEQ ID NO: 13639 - DNA, 45 bp, Xenorhabdus bovienii
  Terminator sequence Name=Xb4151_4152.C433.trmnator39; Position on contig=102437..102481bp; Strand=-
ccctgtggtatcgagccaaaacataccacagggtattgaacttcc

SEQ ID NO: 13640 - DNA, 49 bp, Xenorhabdus bovienii
  Terminator sequence Name=Xb4151_4152.C433.trmnator40; Position on contig=103453..103501bp; Strand=+
tgattaattattgggtgaagttttcccaaaatagcatgatttaattatt

SEQ ID NO: 13641 - DNA, 58 bp, Xenorhabdus bovienii
  Terminator sequence Name=Xb4151_4152.C433.trmnator41; Position on contig=105000..105057bp; Strand=+; Gene name=SstT
taaaaacggtggtaatcagcggatagctttttatcaccgtttctacatttaaggtcta

SEQ ID NO: 13642 - DNA, 53 bp, Xenorhabdus bovienii
  Terminator sequence Name=Xb4151_4152.C433.trmnator42; Position on contig=104990..105042bp; Strand=-; Gene name=SstT
gaaacggtgataaaaagctatccgctgattaccaccgtttttatttcagacaa

SEQ ID NO: 13643 - DNA, 59 bp, Xenorhabdus bovienii
  Terminator sequence Name=Xb4151_4152.C433.trmnator43; Position on contig=108077..108135bp; Strand=+; Gene name=RimL
ccagcagttggtaacggcggcgatattcggcgcgtttcttgctggcgatttcttccagg

SEQ ID NO: 13644 - DNA, 39 bp, Xenorhabdus bovienii
  Terminator sequence Name=Xb4151_4152.C433.trmnator44; Position on contig=111226..111264bp; Strand=+
gtcaatgttgggttaaggcgcattgaccttttgctgttc

SEQ ID NO: 13645 - DNA, 68 bp, Xenorhabdus bovienii
  Terminator sequence Name=Xb4151_4152.C434.trmnator1; Position on contig=1758..1825bp; Strand=-
cacccttatcaggggtgcgctctaaccacctgagctacaagcctataccgtgatactctattttcatc

SEQ ID NO: 13646 - DNA, 70 bp, Xenorhabdus bovienii
  Terminator sequence Name=Xb4151_4152.C434.trmnator2; Position on contig=5392..5461bp; Strand=-
cccgcgacccccggcgtgacaggccggtattctaaccaactgaactaccgcaccaccgaattttttttat

SEQ ID NO: 13647 - DNA, 32 bp, Xenorhabdus bovienii
  Terminator sequence Name=Xb4151_4152.C434.trmnator3; Position on contig=7022..7053bp; Strand=-
gaggggctatttcgcccctcttgatggatcat

SEQ ID NO: 13648 - DNA, 48 bp, Xenorhabdus bovienii
  Terminator sequence Name=Xb4151_4152.C434.trmnator4; Position on contig=8798..8845bp; Strand=+
tctgtatgatattattcgttagttattatatatgatttatattaatga

SEQ ID NO: 13649 - DNA, 34 bp, Xenorhabdus bovienii
  Terminator sequence Name=Xb4151_4152.C434.trmnator5; Position on contig=12272..12305bp; Strand=+; Gene name=IlvE
caggcggctcgttccctgcctgttttgattgctg

SEQ ID NO: 13650 - DNA, 34 bp, Xenorhabdus bovienii
  Terminator sequence Name=Xb4151_4152.C434.trmnator6; Position on contig=15752..15785bp; Strand=-
tagcacctgccaaggtgctattttttaagccgat

SEQ ID NO: 13651 - DNA, 38 bp, Xenorhabdus bovienii
  Terminator sequence Name=Xb4151_4152.C434.trmnator7; Position on contig=18342..18379bp; Strand=-
cgcctgatagaatctcatcgggcgttattttatggagg

SEQ ID NO: 13652 - DNA, 56 bp, Xenorhabdus bovienii
  Terminator sequence Name=Xb4151_4152.C434.trmnator8; Position on contig=19616..19671bp; Strand=-; Gene name=AcuC (BS)
tctaattttgtgatatagattgaaattttttttataaaaatagatttattaccttc

SEQ ID NO: 13653 - DNA, 37 bp, Xenorhabdus bovienii
  Terminator sequence Name=Xb4151_4152.C434.trmnator9; Position on contig=22345..22381bp; Strand=-; Gene name=UvrD
ccctgtattcaacgcgaatacagggtattcatcagat

SEQ ID NO: 13654 - DNA, 38 bp, Xenorhabdus bovienii
  Terminator sequence Name=Xb4151_4152.C434.trmnator10; Position on contig=25510..25547bp; Strand=-; Gene name=TrxA
cgaataccatgagcttttggtgtttgttcgtgatcatc

SEQ ID NO: 13655 - DNA, 30 bp, Xenorhabdus bovienii
  Terminator sequence Name=Xb4151_4152.C434.trmnator11; Position on contig=27629..27658bp; Strand=+; Gene name=Rho
cgccacaagaatgtggcgtttttttatcaa

SEQ ID NO: 13656 - DNA, 30 bp, Xenorhabdus bovienii
  Terminator sequence Name=Xb4151_4152.C434.trmnator12; Position on contig=27617..27646bp; Strand=-
cgccacattcttgtggcgttttgacgaaat

SEQ ID NO: 13657 - DNA, 68 bp, Xenorhabdus bovienii
  Terminator sequence Name=Xb4151_4152.C434.trmnator13; Position on contig=42947..43014bp; Strand=+
gtagagccctggattgtgattccagttgtcgtgggttcgagtcccattagccaccccattttttttat

SEQ ID NO: 13658 - DNA, 73 bp, Xenorhabdus bovienii
  Terminator sequence Name=Xb4151_4152.C434.trmnator14; Position on contig=43129..43201bp; Strand=-
tccgacccactggtcccaaaccagttgcgctaccaagctgcgctactcgccgaaatgtacttctcttactctt

SEQ ID NO: 13659 - DNA, 27 bp, Xenorhabdus bovienii
  Terminator sequence Name=Xb4151_4152.C434.trmnator15; Position on contig=43596..43622bp; Strand=-
gcacgtttcgtgccaacttttagtaat

SEQ ID NO: 13660 - DNA, 42 bp, Xenorhabdus bovienii
  Terminator sequence Name=Xb4151_4152.C434.trmnator16; Position on contig=51770..51811bp; Strand=+
gtggtagccaccacttttggttgccaaccagatttgatgaaa

SEQ ID NO: 13661 - DNA, 56 bp, Xenorhabdus bovienii
  Terminator sequence Name=Xb4151_4152.C434.trmnator17; Position on contig=52309..52364bp; Strand=+
tggtcttggcaatgattttatggtcgttgatgcagtgacccagaatgtttattttt

SEQ ID NO: 13662 - DNA, 34 bp, Xenorhabdus bovienii
  Terminator sequence Name=Xb4151_4152.C434.trmnator18; Position on contig=58759..58792bp; Strand=-; Gene name=CorA
ctccgcccaccaatgggcggggattattacagcc

SEQ ID NO: 13663 - DNA, 38 bp, Xenorhabdus bovienii
  Terminator sequence Name=Xb4151_4152.C434.trmnator19; Position on contig=66384..66421bp; Strand=+; Gene name=Cof
gagcagcacctgatggggtgctgtttttttctggccat

SEQ ID NO: 13664 - DNA, 46 bp, Xenorhabdus bovienii
  Terminator sequence Name=Xb4151_4152.C434.trmnator20; Position on contig=67799..67844bp; Strand=-
ggtgcaggtctgctatttcttcttggtctgcacttttttaagtcta

SEQ ID NO: 13665 - DNA, 36 bp, Xenorhabdus bovienii
  Terminator sequence Name=Xb4151_4152.C434.trmnator21; Position on contig=69019..69054bp; Strand=+
tttcggtatgccgtactgttgaaattcttcatcggt

SEQ ID NO: 13666 - DNA, 31 bp, Xenorhabdus bovienii
  Terminator sequence Name=Xb4151_4152.C434.trmnator22; Position on contig=68644..68674bp; Strand=-
gcaattgtaaaacagttgcttgtaagtaatg

SEQ ID NO: 13667 - DNA, 37 bp, Xenorhabdus bovienii; identical to SEQ ID NO: 13136
  Terminator sequence Name=Xb4151_4152.C434.trmnator23; Position on contig=76981..77017bp; Strand=+; Gene name=ARO8

SEQ ID NO: 13668 - DNA, 40 bp, Xenorhabdus bovienii
  Terminator sequence Name=Xb4151_4152.C434.trmnator24; Position on contig=80444..80483bp; Strand=+; Gene name=FabG
cagggagaggaattatgttctctccctgattttttgttgt

SEQ ID NO: 13669 - DNA, 35 bp, Xenorhabdus bovienii
  Terminator sequence Name=Xb4151_4152.C434.trmnator25; Position on contig=82828..82862bp; Strand=-
tggaaaaatctgcgtttttctatttgttcgatcaa

SEQ ID NO: 13670 - DNA, 45 bp, Xenorhabdus bovienii
  Terminator sequence Name=Xb4151_4152.C434.trmnator26; Position on contig=85766..85810bp; Strand=+
ccgccggaaaatgtgtatcattttccggcggtttttattttgacg

SEQ ID NO: 13671 - DNA, 56 bp, Xenorhabdus bovienii
  Terminator sequence Name=Xb4151_4152.C434.trmnator27; Position on contig=86411..86466bp; Strand=+; Gene name=RimL
ttatcaaggttatcccgacaggcaggataaccttgatggaaaccatgttgttaccc

SEQ ID NO: 13672 - DNA, 44 bp, Xenorhabdus bovienii
  Terminator sequence Name=Xb4151_4152.C435.trmnator1; Position on contig=2306..2349bp; Strand=+; Gene name=NlpD
taaaagcggatgattgatatcatccgcttttatattatttttgt

SEQ ID NO: 13673 - DNA, 42 bp, Xenorhabdus bovienii
  Terminator sequence Name=Xb4151_4152.C435.trmnator2; Position on contig=3376..3417bp; Strand=+; Gene name=HtrB
tatcaggggcagcatattctgcccctgatgctattcattggt

SEQ ID NO: 13674 - DNA, 39 bp, Xenorhabdus bovienii
  Terminator sequence Name=Xb4151_4152.C435.trmnator3; Position on contig=4930..4968bp; Strand=-
cccgtcagtatcattcttattacggggttgataatcaag

SEQ ID NO: 13675 - DNA, 52 bp, Xenorhabdus bovienii
  Terminator sequence Name=Xb4151_4152.C435.trmnator4; Position on contig=7788..7839bp; Strand=+; Gene name=Zwf
gttgtacaatcagccgggtttaatgtccggctgaatgactgatttttatcaa

SEQ ID NO: 13676 - DNA, 47 bp, Xenorhabdus bovienii
  Terminator sequence Name=Xb4151_4152.C435.trmnator5; Position on contig=8081..8127bp; Strand=-
gcgttgaattttactgctgtattgaattgtgacgcttttggcgctat

SEQ ID NO: 13677 - DNA, 47 bp, Xenorhabdus bovienii
  Terminator sequence Name=Xb4151_4152.C435.trmnator6; Position on contig=9132..9178bp; Strand=+; Gene name=EmrE
tataaagctgcgataatcttgatttccactttgtattttggattcat

SEQ ID NO: 13678 - DNA, 48 bp, Xenorhabdus bovienii
  Terminator sequence Name=Xb4151_4152.C435.trmnator7; Position on contig=9061..9108bp; Strand=-; Gene name=EmrE
tggcattgagaacctttcaacttactcaatgccattctattaattaaa

SEQ ID NO: 13679 - DNA, 34 bp, Xenorhabdus bovienii
  Terminator sequence Name=Xb4151_4152.C435.trmnator8; Position on contig=11502..11535bp; Strand=+; Gene name=DinG
ggggttatggtagtatagcccccttatttcgaat

SEQ ID NO: 13680 - DNA, 36 bp, Xenorhabdus bovienii
  Terminator sequence Name=Xb4151_4152.C435.trmnator9; Position on contig=13258..13293bp; Strand=+
taaggcagcagaagctgccttattttttggcagcga

SEQ ID NO: 13681 - DNA, 49 bp, Xenorhabdus bovienii
  Terminator sequence Name=Xb4151_4152.C435.trmnator10; Position on contig=15245..15293bp; Strand=+; Gene name=CaiC
tcaacaacgccggtttttaccggcgttgttgtacaagtcttatgaatgg

SEQ ID NO: 13682 - DNA, 36 bp, Xenorhabdus bovienii
  Terminator sequence Name=Xb4151_4152.C435.trmnator11; Position on contig=15237..15272bp; Strand=-; Gene name=CaiC
caacgccggtaaaaaccggcgttgttgatgtgatag

SEQ ID NO: 13683 - DNA, 32 bp, Xenorhabdus bovienii
  Terminator sequence Name=Xb4151_4152.C435.trmnator12; Position on contig=20016..20047bp; Strand=+; Gene name=PotE
ggggctgaaatatcagccccttttttaggtct

SEQ ID NO: 13684 - DNA, 50 bp, Xenorhabdus bovienii
  Terminator sequence Name=Xb4151_4152.C435.trmnator13; Position on contig=23336..23385bp; Strand=+
cagcagtgataacttgaatctgtaagttattttttgagctgttagtcgtc

SEQ ID NO: 13685 - DNA, 32 bp, Xenorhabdus bovienii
  Terminator sequence Name=Xb4151_4152.C435.trmnator14; Position on contig=23250..23281bp; Strand=-
ccgtgcaattccctgcacggttttaggcatgt

SEQ ID NO: 13686 - DNA, 62 bp, Xenorhabdus bovienii
  Terminator sequence Name=Xb4151_4152.C435.trmnator15; Position on contig=24819..24880bp; Strand=+; Gene name=EndA
gtcataactcaacaaccaccgactttagtcggtggttgttgagttaactttttgttttattt

SEQ ID NO: 13687 - DNA, 54 bp, Xenorhabdus bovienii
  Terminator sequence Name=Xb4151_4152.C435.trmnator16; Position on contig=25778..25831bp; Strand=+; Gene name=CutC
ttaaggtgtgaactgccatattggacagttcactcattaatatttgttcaatat

SEQ ID NO: 13688 - DNA, 30 bp, Xenorhabdus bovienii
  Terminator sequence Name=Xb4151_4152.C435.trmnator17; Position on contig=32018..32047bp; Strand=+; Gene name=RuvC
gctggatatacgtccagctttttttatgct

SEQ ID NO: 13689 - DNA, 52 bp, Xenorhabdus bovienii
  Terminator sequence Name=Xb4151_4152.C435.trmnator18; Position on contig=33939..33990bp; Strand=+
tggttaaagccgccttcttattagaaggcggctttttattattattgttggt

SEQ ID NO: 13690 - DNA, 37 bp, Xenorhabdus bovienii
  Terminator sequence Name=Xb4151_4152.C435.trmnator19; Position on contig=34956..34992bp; Strand=+; Gene name=OmpW
cggcggaatcccagatttttccgtcactttagcttaa

SEQ ID NO: 13691 - DNA, 30 bp, Xenorhabdus bovienii
  Terminator sequence Name=Xb4151_4152.C435.trmnator20; Position on contig=43503..43532bp; Strand=-; Gene name=TrpE
cccgctctaaaaagcgggtttttttataac

SEQ ID NO: 13692 - DNA, 46 bp, Xenorhabdus bovienii
  Terminator sequence Name=Xb4151_4152.C435.trmnator21; Position on contig=44802..44847bp; Strand=+
ggctgcataaagtaagaggttatacttgtgagccagtttttttata

SEQ ID NO: 13693 - DNA, 34 bp, Xenorhabdus bovienii
  Terminator sequence Name=Xb4151_4152.C435.trmnator22; Position on contig=52562..52595bp; Strand=+; Gene name=TopA
gccagtcctaattgactggctttttttgttttta

SEQ ID NO: 13694 - DNA, 40 bp, Xenorhabdus bovienii
  Terminator sequence Name=Xb4151_4152.C435.trmnator23; Position on contig=53805..53844bp; Strand=+; Gene name=LysR
gaggaaggcagctgatgttatcttcctctattctttattt

SEQ ID NO: 13695 - DNA, 74 bp, Xenorhabdus bovienii
  Terminator sequence Name=Xb4151_4152.C435.trmnator24; Position on contig=53774..53847bp; Strand=-
tttaaataaagaatagaggaagataacatcagctgccttcctctgattttttcattatagattctttatgctat

SEQ ID NO: 13696 - DNA, 34 bp, Xenorhabdus bovienii
  Terminator sequence Name=Xb4151_4152.C435.trmnator25; Position on contig=57738..57771bp; Strand=+; Gene name=AcnA
ctgcgtctacactgacgcagtttttattcttaac

SEQ ID NO: 13697 - DNA, 33 bp, Xenorhabdus bovienii
  Terminator sequence Name=Xb4151_4152.C435.trmnator26; Position on contig=60942..60974bp; Strand=+
tgtcactattatgagtggcaatatctgcgtgtt

SEQ ID NO: 13698 - DNA, 43 bp, Xenorhabdus bovienii
  Terminator sequence Name=Xb4151_4152.C435.trmnator27; Position on contig=60674..60716bp; Strand=-
ccgcatagttggatggcgttccaactggcggttaatataattt

SEQ ID NO: 13699 - DNA, 57 bp, Xenorhabdus bovienii
  Terminator sequence Name=Xb4151_4152.C435.trmnator28; Position on contig=62107..62163bp; Strand=+; Gene name=SUI1
ttttaacaggctatgcataactggattgtatagcctgttaagtcatctgtagtaaat

SEQ ID NO: 13700 - DNA, 36 bp, Xenorhabdus bovienii
  Terminator sequence Name=Xb4151_4152.C435.trmnator29; Position on contig=63141..63176bp; Strand=-; Gene name=PenP (BS)
ctgccgccaataacaagcggcagttttataatcagc

SEQ ID NO: 13701 - DNA, 56 bp, Xenorhabdus bovienii
  Terminator sequence Name=Xb4151_4152.C435.trmnator30; Position on contig=72128..72183bp; Strand=+
tcattgcagtggttaatacggatatataccacatagtggtgaagtttccgtctact

SEQ ID NO: 13702 - DNA, 45 bp, Xenorhabdus bovienii
  Terminator sequence Name=Xb4151_4152.C435.trmnator31; Position on contig=71816..71860bp; Strand=-
ttgccccgcttgtttcatcgcaaggtggggcaatctctgtcattt

SEQ ID NO: 13703 - DNA, 30 bp, Xenorhabdus bovienii
  Terminator sequence Name=Xb4151_4152.C435.trmnator32; Position on contig=74532..74561bp; Strand=-
gactgctaaaaagcagtctttattgagaag

SEQ ID NO: 13704 - DNA, 36 bp, Xenorhabdus bovienii
  Terminator sequence Name=Xb4151_4152.C435.trmnator33; Position on contig=75589..75624bp; Strand=-; Gene name=Add
gccagtcaatgtgttgactggcttttttgtatatat

SEQ ID NO: 13705 - DNA, 49 bp, Xenorhabdus bovienii
  Terminator sequence Name=Xb4151_4152.C435.trmnator34; Position on contig=80009..80057bp; Strand=+; Gene name=FumC
cgatataagccggaggagaaatcccccggttttttgctttatatttccc

SEQ ID NO: 13706 - DNA, 32 bp, Xenorhabdus bovienii
  Terminator sequence Name=Xb4151_4152.C435.trmnator35; Position on contig=80006..80037bp; Strand=-; Gene name=FumC
ccgggggatttctcctccggcttatatcgtca

SEQ ID NO: 13707 - DNA, 54 bp, Xenorhabdus bovienii
  Terminator sequence Name=Xb4151_4152.C435.trmnator36; Position on contig=81945..81998bp; Strand=+
gaaaaattgccggaatatatttatggataccggcaattttattttatcattttt

SEQ ID NO: 13708 - DNA, 42 bp, Xenorhabdus bovienii
  Terminator sequence Name=Xb4151_4152.C435.trmnator37; Position on contig=81939..81980bp; Strand=-
ttgccggtatccataaatatattccggcaatttttcaccaga

SEQ ID NO: 13709 - DNA, 33 bp, Xenorhabdus bovienii
  Terminator sequence Name=Xb4151_4152.C435.trmnator38; Position on contig=86456..86488bp; Strand=+; Gene name=BioD
ggggagccagacatgctccccagtttaatttta

SEQ ID NO: 13710 - DNA, 33 bp, Xenorhabdus bovienii
  Terminator sequence Name=Xb4151_4152.C435.trmnator39; Position on contig=86444..86476bp; Strand=-; Gene name=BioD
ggggagcatgtctggctccccttttctaatgat

SEQ ID NO: 13711 - DNA, 34 bp, Xenorhabdus bovienii
  Terminator sequence Name=Xb4151_4152.C435.trmnator40; Position on contig=88341..88374bp; Strand=+
cagcaagcagcagcttggctgctatctcttgttg

SEQ ID NO: 13712 - DNA, 53 bp, Xenorhabdus bovienii
  Terminator sequence Name=Xb4151_4152.C435.trmnator41; Position on contig=91665..91717bp; Strand=-; Gene name=AraJ
gtactgcataagacattatttttaataatttattagtacaaatcttattgtag

SEQ ID NO: 13713 - DNA, 42 bp, Xenorhabdus bovienii
  Terminator sequence Name=Xb4151_4152.C435.trmnator42; Position on contig=92009..92050bp; Strand=+
cgacttcactggagttatccagcggagtcgttataagatgag

SEQ ID NO: 13714 - DNA, 44 bp, Xenorhabdus bovienii
  Terminator sequence Name=Xb4151_4152.C435.trmnator43; Position on contig=91995..92038bp; Strand=-
cgactccgctggataactccagtgaagtcgccgttatattatta

SEQ ID NO: 13715 - DNA, 40 bp, Xenorhabdus bovienii
  Terminator sequence Name=Xb4151_4152.C435.trmnator44; Position on contig=95844..95883bp; Strand=+; Gene name=CirA
ttcgccctgacacattagtcagggcgaattttccgtcttt

SEQ ID NO: 13716 - DNA, 36 bp, Xenorhabdus bovienii
  Terminator sequence Name=Xb4151_4152.C435.trmnator45; Position on contig=98334..98369bp; Strand=+
ttcagcatttaaatagatgctagggtttcctaccct

SEQ ID NO: 13717 - DNA, 38 bp, Xenorhabdus bovienii
  Terminator sequence Name=Xb4151_4152.C435.trmnator46; Position on contig=98139..98176bp; Strand=-
tctcggctcagatagttgagccgaggtttatccatcag

SEQ ID NO: 13718 - DNA, 33 bp, Xenorhabdus bovienii
  Terminator sequence Name=Xb4151_4152.C435.trmnator47; Position on contig=98462..98494bp; Strand=-
tgagggggaattttctctcagatttctgcataa

SEQ ID NO: 13719 - DNA, 40 bp, Xenorhabdus bovienii
  Terminator sequence Name=Xb4151_4152.C435.trmnator48; Position on contig=102754..102793bp; Strand=+; Gene name=AprE (BS)
ttcactgctggcaagctggcagtgagtttttttcatccct

SEQ ID NO: 13720 - DNA, 36 bp, Xenorhabdus bovienii
  Terminator sequence Name=Xb4151_4152.C435.trmnator49; Position on contig=102743..102778bp; Strand=-; Gene name=AprE (BS)
tcactgccagcttgccagcagtgaattttttattga

SEQ ID NO: 13721 - DNA, 36 bp, Xenorhabdus bovienii
  Terminator sequence Name=Xb4151_4152.C435.trmnator50; Position on contig=104957..104992bp; Strand=+; Gene name=AraJ
gacgaccttattcagtaaggcgtcttgtatccgata

SEQ ID NO: 13722 - DNA, 44 bp, Xenorhabdus bovienii
  Terminator sequence Name=Xb4151_4152.C435.trmnator51; Position on contig=104839..104882bp; Strand=-; Gene name=AraJ
gaataacccttaacgaaagctaggggttattttttagagtggtt

SEQ ID NO: 13723 - DNA, 38 bp, Xenorhabdus bovienii
  Terminator sequence Name=Xb4151_4152.C435.trmnator52; Position on contig=107856..107893bp; Strand=+
ttttgttgataaaaattatcaaaggatattttaagctt

SEQ ID NO: 13724 - DNA, 57 bp, Xenorhabdus bovienii
  Terminator sequence Name=Xb4151_4152.C435.trmnator53; Position on contig=110128..110184bp; Strand=+
gaatagtattggattgtttttagtgagaataatctgaattttctcatttttatttgt

SEQ ID NO: 13725 - DNA, 33 bp, Xenorhabdus bovienii
  Terminator sequence Name=Xb4151_4152.C435.trmnator54; Position on contig=117089..117121bp; Strand=+
ccacctcctcgggaggtggtgattgttcctgtg

SEQ ID NO: 13726 - DNA, 64 bp, Xenorhabdus bovienii
  Terminator sequence Name=Xb4151_4152.C435.trmnator55; Position on contig=117364..117427bp; Strand=+
gccagagcgggaattttttgttttatttaaagaaatttccgctattacaggcatgtttattttt

SEQ ID NO: 13727 - DNA, 31 bp, Xenorhabdus bovienii
  Terminator sequence Name=Xb4151_4152.C435.trmnator56; Position on contig=117077..117107bp; Strand=-
ccacctcccgaggaggtggtttaaggattac

SEQ ID NO: 13728 - DNA, 38 bp, Xenorhabdus bovienii
  Terminator sequence Name=Xb4151_4152.C435.trmnator57; Position on contig=117635..117672bp; Strand=-
gagcgttcgcaaaagcggacgctctttttatttgcttc

SEQ ID NO: 13729 - DNA, 34 bp, Xenorhabdus bovienii
  Terminator sequence Name=Xb4151_4152.C435.trmnator58; Position on contig=142093..142126bp; Strand=-; Gene name=EntF
gagcctattttaataggctcttttttattaacct

SEQ ID NO: 13730 - DNA, 44 bp, Xenorhabdus bovienii
  Terminator sequence Name=Xb4151_4152.C435.trmnator59; Position on contig=143963..144006bp; Strand=-; Gene name=MdlB
tgctcccacctgccatgcaggtgggtaatgtgattgttatcacg

SEQ ID NO: 13731 - DNA, 41 bp, Xenorhabdus bovienii
  Terminator sequence Name=Xb4151_4152.C435.trmnator60; Position on contig=145935..145975bp; Strand=+
cggtttaacaatagtttaagttaggctgattatagtaatta

SEQ ID NO: 13732 - DNA, 36 bp, Xenorhabdus bovienii
  Terminator sequence Name=Xb4151_4152.C435.trmnator61; Position on contig=146630..146665bp; Strand=+
ttgtgtctattggtagcgcacaactctgtaggtgtt

SEQ ID NO: 13733 - DNA, 34 bp, Xenorhabdus bovienii
  Terminator sequence Name=Xb4151_4152.C435.trmnator62; Position on contig=147674..147707bp; Strand=-; Gene name=AsnS
tgatgttcttaggggcattaattctctcattcgg

SEQ ID NO: 13734 - DNA, 43 bp, Xenorhabdus bovienii
  Terminator sequence Name=Xb4151_4152.C435.trmnator63; Position on contig=154138..154180bp; Strand=+; Gene name=LeuS
ggaataactcttattaaattggagttattccttttgtaggtga

SEQ ID NO: 13735 - DNA, 43 bp, Xenorhabdus bovienii
  Terminator sequence Name=Xb4151_4152.C435.trmnator64; Position on contig=157569..157611bp; Strand=-
gtattgattcccccactgggggaatcaatacttaatacattag

SEQ ID NO: 13736 - DNA, 39 bp, Xenorhabdus bovienii
  Terminator sequence Name=Xb4151_4152.C435.trmnator65; Position on contig=160575..160613bp; Strand=-
ctggctgcccgtcggtgagggggctggttctatcacgca

SEQ ID NO: 13737 - DNA, 31 bp, Xenorhabdus bovienii
  Terminator sequence Name=Xb4151_4152.C435.trmnator66; Position on contig=166216..166246bp; Strand=+
cagcgctttgacggtgctgttgtagtggttg

SEQ ID NO: 13738 - DNA, 37 bp, Xenorhabdus bovienii
  Terminator sequence Name=Xb4151_4152.C435.trmnator67; Position on contig=173915..173951bp; Strand=+
ttgagtggagccccccactcacgatcatttctagtta

SEQ ID NO: 13739 - DNA, 34 bp, Xenorhabdus bovienii
  Terminator sequence Name=Xb4151_4152.C435.trmnator68; Position on contig=179673..179706bp; Strand=+
ctcgcttttgtccagaagcgagttatcgataaca

SEQ ID NO: 13740 - DNA, 34 bp, Xenorhabdus bovienii
  Terminator sequence Name=Xb4151_4152.C435.trmnator69; Position on contig=179661..179694bp; Strand=-
ctcgcttctggacaaaagcgagttagttgtacca

SEQ ID NO: 13741 - DNA, 49 bp, Xenorhabdus bovienii
  Terminator sequence Name=Xb4151_4152.C435.trmnator70; Position on contig=181195..181243bp; Strand=+
ctgatcttttcgcgcaatcgctgtacagagatcaggacgtttattgtca

SEQ ID NO: 13742 - DNA, 38 bp, Xenorhabdus bovienii
  Terminator sequence Name=Xb4151_4152.C435.trmnator71; Position on contig=181681..181718bp; Strand=+
cctcttttccctcagtgagaaagaggtttctgcacctc

SEQ ID NO: 13743 - DNA, 44 bp, Xenorhabdus bovienii
  Terminator sequence Name=Xb4151_4152.C435.trmnator72; Position on contig=183928..183971bp; Strand=+
ctaaaaagccctcaagggagggctgattgggattaatttggtag

SEQ ID NO: 13744 - DNA, 29 bp, Xenorhabdus bovienii
  Terminator sequence Name=Xb4151_4152.C435.trmnator73; Position on contig=183922..183950bp; Strand=-
gccctcccttgagggctttttagcaccca

SEQ ID NO: 13745 - DNA, 34 bp, Xenorhabdus bovienii
  Terminator sequence Name=Xb4151_4152.C435.trmnator74; Position on contig=185508..185541bp; Strand=-
gttgatctctaagagaattaattatgtccataat

SEQ ID NO: 13746 - DNA, 29 bp, Xenorhabdus bovienii
  Terminator sequence Name=Xb4151_4152.C436.trmnator1; Position on contig=1448..1476bp; Strand=-
gccacccggtgggtggcttctctggctaa

SEQ ID NO: 13747 - DNA, 31 bp, Xenorhabdus bovienii
  Terminator sequence Name=Xb4151_4152.C436.trmnator2; Position on contig=8227..8257bp; Strand=-
gcccacaaaaggtgggcttatttattggaga

SEQ ID NO: 13748 - DNA, 38 bp, Xenorhabdus bovienii
  Terminator sequence Name=Xb4151_4152.C436.trmnator3; Position on contig=15079..15116bp; Strand=-
ccgcagtactacttctgatactgcggttacttgaaaaa

SEQ ID NO: 13749 - DNA, 41 bp, Xenorhabdus bovienii
  Terminator sequence Name=Xb4151_4152.C436.trmnator4; Position on contig=17147..17187bp; Strand=-
cagattgtattacgccttatacaatctggtattaccttgat

SEQ ID NO: 13750 - DNA, 38 bp, Xenorhabdus bovienii
  Terminator sequence Name=Xb4151_4152.C436.trmnator5; Position on contig=21097..21134bp; Strand=+
ctgttctggggtgactttaaacggcatattgtgaatag

SEQ ID NO: 13751 - DNA, 38 bp, Xenorhabdus bovienii
  Terminator sequence Name=Xb4151_4152.C436.trmnator6; Position on contig=20813..20850bp; Strand=-
ggcatgcttcttctggagcatgcctgctattaataatg

SEQ ID NO: 13752 - DNA, 54 bp, Xenorhabdus bovienii
  Terminator sequence Name=Xb4151_4152.C436.trmnator7; Position on contig=23505..23558bp; Strand=+; Gene name=SirA
tatggcacttggatagcatcaatcacctcactgggtgccatattttctttttcc

SEQ ID NO: 13753 - DNA, 30 bp, Xenorhabdus bovienii
  Terminator sequence Name=Xb4151_4152.C436.trmnator8; Position on contig=23581..23610bp; Strand=-; Gene name=SirA
ggtgcaaagaatgcaccttttcaaaattac

SEQ ID NO: 13754 - DNA, 60 bp, Xenorhabdus bovienii
  Terminator sequence Name=Xb4151_4152.C436.trmnator9; Position on contig=26276..26335bp; Strand=+
tcttggtctgaagaaaaacagaaaacttttgatctttgggttgggagttttttaatagta

SEQ ID NO: 13755 - DNA, 50 bp, Xenorhabdus bovienii
  Terminator sequence Name=Xb4151_4152.C436.trmnator10; Position on contig=26137..26186bp; Strand=-
gtcagtgatgccgacggtattctgtcggtatcatttattttgattattca

SEQ ID NO: 13756 - DNA, 50 bp, Xenorhabdus bovienii
  Terminator sequence Name=Xb4151_4152.C436.trmnator11; Position on contig=31570..31619bp; Strand=+; Gene name=RpoD
cgaattaaaaagcgataatttatttatcgctttttttgtgtctgctgccc

SEQ ID NO: 13757 - DNA, 47 bp, Xenorhabdus bovienii
  Terminator sequence Name=Xb4151_4152.C436.trmnator12; Position on contig=42913..42959bp; Strand=+
tagcaccgaaaatattataattatctcggtgctaattttaaagtttt

SEQ ID NO: 13758 - DNA, 47 bp, Xenorhabdus bovienii
  Terminator sequence Name=Xb4151_4152.C436.trmnator13; Position on contig=44703..44749bp; Strand=-
tagcaccgagataattataatatttttcggtgctattttttctggaa

SEQ ID NO: 13759 - DNA, 34 bp, Xenorhabdus bovienii
  Terminator sequence Name=Xb4151_4152.C436.trmnator14; Position on contig=45194..45227bp; Strand=+
cgccagcatgttggtactggcgtttatcaatgaa

SEQ ID NO: 13760 - DNA, 38 bp, Xenorhabdus bovienii
  Terminator sequence Name=Xb4151_4152.C436.trmnator15; Position on contig=47166..47203bp; Strand=-; Gene name=ChiA
cagcacaggttcagcttgtgactggcgattttcatgat

SEQ ID NO: 13761 - DNA, 57 bp, Xenorhabdus bovienii
  Terminator sequence Name=Xb4151_4152.C436.trmnator16; Position on contig=59021..59077bp; Strand=+
gagtgtgtttttgtattgaacacttcatttatataagaacactccagtttttacata

SEQ ID NO: 13762 - DNA, 45 bp, Xenorhabdus bovienii
  Terminator sequence Name=Xb4151_4152.C436.trmnator17; Position on contig=59597..59641bp; Strand=+
taccgcgtggagagtctcttctccgaccggtagtttcacatatat

SEQ ID NO: 13763 - DNA, 49 bp, Xenorhabdus bovienii
  Terminator sequence Name=Xb4151_4152.C436.trmnator18; Position on contig=65582..65630bp; Strand=-
ttggtaattaaataacgttgttatttatcattaccaatattaattttca

SEQ ID NO: 13764 - DNA, 53 bp, Xenorhabdus bovienii
  Terminator sequence Name=Xb4151_4152.C436.trmnator19; Position on contig=66036..66088bp; Strand=-
caaaatactgccgaaattaagtggttatggcagtattttgttatttaacctca

SEQ ID NO: 13765 - DNA, 43 bp, Xenorhabdus bovienii
  Terminator sequence Name=Xb4151_4152.C436.trmnator20; Position on contig=67178..67220bp; Strand=+
ggctgattcggatgcaaattcaggttagccatattgctatgga

SEQ ID NO: 13766 - DNA, 40 bp, Xenorhabdus bovienii
  Terminator sequence Name=Xb4151_4152.C436.trmnator21; Position on contig=69529..69568bp; Strand=+
tgaagatgtattataaatattatttttaattatatcgata

SEQ ID NO: 13767 - DNA, 45 bp, Xenorhabdus bovienii
  Terminator sequence Name=Xb4151_4152.C436.trmnator22; Position on contig=70317..70361bp; Strand=+
gagatgtctcacatggatcgtaagatatctctattaatcatggag

SEQ ID NO: 13768 - DNA, 49 bp, Xenorhabdus bovienii
  Terminator sequence Name=Xb4151_4152.C436.trmnator23; Position on contig=70479..70527bp; Strand=-
tttttttactgtggttcctaacagaacagtgaaaggatctattattcag

SEQ ID NO: 13769 - DNA, 50 bp, Xenorhabdus bovienii
  Terminator sequence Name=Xb4151_4152.C436.trmnator24; Position on contig=72406..72455bp; Strand=-; Gene name=FldA
ttacaccgcttatccttccctgcataagcggtgtggcatttattctgtca

SEQ ID NO: 13770 - DNA, 33 bp, Xenorhabdus bovienii
  Terminator sequence Name=Xb4151_4152.C436.trmnator25; Position on contig=72896..72928bp; Strand=-
tagcggataataaatccgctatttttttaatat

SEQ ID NO: 13771 - DNA, 29 bp, Xenorhabdus bovienii
  Terminator sequence Name=Xb4151_4152.C436.trmnator26; Position on contig=77226..77254bp; Strand=-
caggcaatttctgcctgtcttggctatca

SEQ ID NO: 13772 - DNA, 32 bp, Xenorhabdus bovienii
  Terminator sequence Name=Xb4151_4152.C436.trmnator27; Position on contig=78577..78608bp; Strand=+; Gene name=RpsB
gggggcctgtcacggccccctttacatatctg

SEQ ID NO: 13773 - DNA, 41 bp, Xenorhabdus bovienii
  Terminator sequence Name=Xb4151_4152.C436.trmnator28; Position on contig=78309..78349bp; Strand=-; Gene name=RpsB
gcgaatactgggatacccaggttatttgcttctttgatagc

SEQ ID NO: 13774 - DNA, 42 bp, Xenorhabdus bovienii
  Terminator sequence Name=Xb4151_4152.C436.trmnator29; Position on contig=79533..79574bp; Strand=+; Gene name=Tsf
gaacggaaccgccgattggcggttccgttttatctcatgatg

SEQ ID NO: 13775 - DNA, 59 bp, Xenorhabdus bovienii
  Terminator sequence Name=Xb4151_4152.C436.trmnator30; Position on contig=82498..82556bp; Strand=+; Gene name=Dxr
ttcaatatttgtcacacgttttctgagtgtgtgccaaagatagaggctttcattcgggc

SEQ ID NO: 13776 - DNA, 37 bp, Xenorhabdus bovienii
  Terminator sequence Name=Xb4151_4152.C436.trmnator31; Position on contig=88092..88128bp; Strand=+
tcgccttattactagataaggtgattgttaattttcc

SEQ ID NO: 13777 - DNA, 60 bp, Xenorhabdus bovienii
  Terminator sequence Name=Xb4151_4152.C436.trmnator32; Position on contig=97379..97438bp; Strand=+; Gene name=AccA
caggtggacagtactggggagagatagaacttcagtatttccacctgttttattgtttat

SEQ ID NO: 13778 - DNA, 50 bp, Xenorhabdus bovienii
  Terminator sequence Name=Xb4151_4152.C436.trmnator33; Position on contig=99946..99995bp; Strand=+; Gene name=MesJ
tttaccctcagtatctattaaaggttactgaaggtaaattttattcttta

SEQ ID NO: 13779 - DNA, 50 bp, Xenorhabdus bovienii
  Terminator sequence Name=Xb4151_4152.C436.trmnator34; Position on contig=99934..99983bp; Strand=-; Gene name=MesJ
tttaccttcagtaacctttaatagatactgagggtaaattgataaataga

SEQ ID NO: 13780 - DNA, 35 bp, Xenorhabdus bovienii
  Terminator sequence Name=Xb4151_4152.C436.trmnator35; Position on contig=100373..100407bp; Strand=+
tggtgctggcaagctagctcaaggttatcataatc

SEQ ID NO: 13781 - DNA, 34 bp, Xenorhabdus bovienii
  Terminator sequence Name=Xb4151_4152.C436.trmnator36; Position on contig=101491..101524bp; Strand=+; Gene name=CutF
cctgcgtattgaatacgcaggttttttctgaact

SEQ ID NO: 13782 - DNA, 46 bp, Xenorhabdus bovienii
  Terminator sequence Name=Xb4151_4152.C436.trmnator37; Position on contig=101473..101518bp; Strand=-; Gene name=CutF
gaaaaaacctgcgtattcaatacgcaggtttttttatgtataacgg

SEQ ID NO: 13783 - DNA, 28 bp, Xenorhabdus bovienii
  Terminator sequence Name=Xb4151_4152.C436.trmnator38; Position on contig=103334..103361bp; Strand=-
cgctggtagactagcggtttatctttat

SEQ ID NO: 13784 - DNA, 32 bp, Xenorhabdus bovienii
  Terminator sequence Name=Xb4151_4152.C436.trmnator39; Position on contig=110802..110833bp; Strand=-
ccctgatgatcagtcaggggattatcgctctg

SEQ ID NO: 13785 - DNA, 42 bp, Xenorhabdus bovienii
  Terminator sequence Name=Xb4151_4152.C436.trmnator40; Position on contig=113743..113784bp; Strand=+
tttttggggtgattttcgtttcataaagacactttaattaaa

SEQ ID NO: 13786 - DNA, 50 bp, Xenorhabdus bovienii
  Terminator sequence Name=Xb4151_4152.C436.trmnator41; Position on contig=114705..114754bp; Strand=-; Gene name=HisB
taaccagatcagcagcctgttctactgcttctgttaccgcttttccagta

SEQ ID NO: 13787 - DNA, 27 bp, Xenorhabdus bovienii
  Terminator sequence Name=Xb4151_4152.C437.trmnator1; Position on contig=117..143bp; Strand=+
ccagcatttgctgggttcatttacaag

SEQ ID NO: 13788 - DNA, 35 bp, Xenorhabdus bovienii
  Terminator sequence Name=Xb4151_4152.C437.trmnator2; Position on contig=100..134bp; Strand=-
gaacccagcaaatgctgggtctaatttcaattatt

SEQ ID NO: 13789 - DNA, 37 bp, Xenorhabdus bovienii; identical to SEQ ID NO: 13454
  Terminator sequence Name=Xb4151_4152.C437.trmnator3; Position on contig=942..978bp; Strand=+

SEQ ID NO: 13790 - DNA, 39 bp, Xenorhabdus bovienii; identical to SEQ ID NO: 13374
  Terminator sequence Name=Xb4151_4152.C437.trmnator4; Position on contig=1681..1719bp; Strand=+

SEQ ID NO: 13791 - DNA, 45 bp, Xenorhabdus bovienii
  Terminator sequence Name=Xb4151_4152.C437.trmnator5; Position on contig=4550..4594bp; Strand=+
tgatacagtacagagcctctgtcttttatcaatatttatgggcac

SEQ ID NO: 13792 - DNA, 67 bp, Xenorhabdus bovienii
  Terminator sequence Name=Xb4151_4152.C437.trmnator6; Position on contig=4418..4484bp; Strand=-
gccagaaaaacgtgacagagcatggttggctctgtgtacgttttagtttctggcgttgtccgttcct

SEQ ID NO: 13793 - DNA, 42 bp, Xenorhabdus bovienii
  Terminator sequence Name=Xb4151_4152.C437.trmnator7; Position on contig=5002..5043bp; Strand=-
gaaggcgagcagatttttctgctcgcctttttacttttttgt

SEQ ID NO: 13794 - DNA, 33 bp, Xenorhabdus bovienii
  Terminator sequence Name=Xb4151_4152.C437.trmnator8; Position on contig=7153..7185bp; Strand=-; Gene name=GroS
ctgcaagccccaacttgtagcttcatggtactg

SEQ ID NO: 13795 - DNA, 31 bp, Xenorhabdus bovienii
  Terminator sequence Name=Xb4151_4152.C437.trmnator9; Position on contig=10173..10203bp; Strand=+
cccgcttcacgagagcgggttttttatcact

SEQ ID NO: 13796 - DNA, 51 bp, Xenorhabdus bovienii
  Terminator sequence Name=Xb4151_4152.C437.trmnator10; Position on contig=10798..10848bp; Strand=-
ttggggtattgcaacgggctgaattgcatatgcttataattgcttataaat

SEQ ID NO: 13797 - DNA, 33 bp, Xenorhabdus bovienii
  Terminator sequence Name=Xb4151_4152.C437.trmnator11; Position on contig=13831..13863bp; Strand=-
ggtgggcttatttagcccatcttttattttgct

SEQ ID NO: 13798 - DNA, 38 bp, Xenorhabdus bovienii
  Terminator sequence Name=Xb4151_4152.C437.trmnator12; Position on contig=14954..14991bp; Strand=-; Gene name=RpoD
gggcaggatcctgacttcctgcccgcattatcatgggt

SEQ ID NO: 13799 - DNA, 52 bp, Xenorhabdus bovienii; identical to SEQ ID NO: 13402
  Terminator sequence Name=Xb4151_4152.C437.trmnator13; Position on contig=18695..18746bp; Strand=+

SEQ ID NO: 13800 - DNA, 50 bp, Xenorhabdus bovienii
  Terminator sequence Name=Xb4151_4152.C437.trmnator14; Position on contig=19805..19854bp; Strand=-
ttgatattatttttattttaagcgtatcaatgtcaaagtttattttcatt

SEQ ID NO: 13801 - DNA, 34 bp, Xenorhabdus bovienii
  Terminator sequence Name=Xb4151_4152.C437.trmnator15; Position on contig=20833..20866bp; Strand=-
catgacccatttctgggtcatgtattaaatggtt

SEQ ID NO: 13802 - DNA, 46 bp, Xenorhabdus bovienii
  Terminator sequence Name=Xb4151_4152.C437.trmnator16; Position on contig=22271..22316bp; Strand=+
gtttttccagtctgataagactgaggtgagactgttttttttcctt

SEQ ID NO: 13803 - DNA, 38 bp, Xenorhabdus bovienii
  Terminator sequence Name=Xb4151_4152.C437.trmnator17; Position on contig=28141..28178bp; Strand=-
cacattattgcgcgtggaataatgtgtttctacactca

SEQ ID NO: 13804 - DNA, 43 bp, Xenorhabdus bovienii
  Terminator sequence Name=Xb4151_4152.C437.trmnator18; Position on contig=37794..37836bp; Strand=-
tcactcagcaccagaatctggtgctgagtattctattcgccac

SEQ ID NO: 13805 - DNA, 50 bp, Xenorhabdus bovienii
  Terminator sequence Name=Xb4151_4152.C437.trmnator19; Position on contig=40075..40124bp; Strand=+; Gene name=AnsP
gaaaaagtgtcggtacgttagagctgccggcgcttttctttatctagcca

SEQ ID NO: 13806 - DNA, 48 bp, Xenorhabdus bovienii
  Terminator sequence Name=Xb4151_4152.C437.trmnator20; Position on contig=40036..40083bp; Strand=-; Gene name=AnsP
cactttttctagtcttattggttagtagaaagatgattttttgataat

SEQ ID NO: 13807 - DNA, 63 bp, Xenorhabdus bovienii
  Terminator sequence Name=Xb4151_4152.C437.trmnator21; Position on contig=42778..42840bp; Strand=+; Gene name=Map
cctgacaaaaatcagtaagtgatgaatgtagtgcccatggtttttgtcgggttttcattttca

SEQ ID NO: 13808 - DNA, 51 bp, Xenorhabdus bovienii
  Terminator sequence Name=Xb4151_4152.C437.trmnator22; Position on contig=47002..47052bp; Strand=+; Gene name=CstA
gataccccgcataatcgcctttgtattatgtggggtatttatctttggaga

SEQ ID NO: 13809 - DNA, 36 bp, Xenorhabdus bovienii
  Terminator sequence Name=Xb4151_4152.C437.trmnator23; Position on contig=48514..48549bp; Strand=+
tctccacaagttagctggtggagattgttgcaataa

SEQ ID NO: 13810 - DNA, 47 bp, Xenorhabdus bovienii
  Terminator sequence Name=Xb4151_4152.C437.trmnator24; Position on contig=49170..49216bp; Strand=-; Gene name=XerC
gattggtttaaataccttgctatttaaaattaatctatctgatgtca

SEQ ID NO: 13811 - DNA, 44 bp, Xenorhabdus bovienii
  Terminator sequence Name=Xb4151_4152.C437.trmnator25; Position on contig=49764..49807bp; Strand=+
ttagttataagtgttattatttgtaattaaaactattaatttgc

SEQ ID NO: 13812 - DNA, 48 bp, Xenorhabdus bovienii
  Terminator sequence Name=Xb4151_4152.C437.trmnator26; Position on contig=51961..52008bp; Strand=+
cgatgttattattttagataatataatgatattgattttaatggtttc

SEQ ID NO: 13813 - DNA, 38 bp, Xenorhabdus bovienii
  Terminator sequence Name=Xb4151_4152.C437.trmnator27; Position on contig=53546..53583bp; Strand=+
gtggaaaaatcacacgatttttccactatttgaattca

SEQ ID NO: 13814 - DNA, 51 bp, Xenorhabdus bovienii
  Terminator sequence Name=Xb4151_4152.C437.trmnator28; Position on contig=55569..55619bp; Strand=+
tgaaaaatgccgcaaatattctttgcggcattgtttattttttacatctat

SEQ ID NO: 13815 - DNA, 35 bp, Xenorhabdus bovienii
  Terminator sequence Name=Xb4151_4152.C437.trmnator29; Position on contig=55564..55598bp; Strand=-
tgccgcaaagaatatttgcggcatttttcacgctg

SEQ ID NO: 13816 - DNA, 43 bp, Xenorhabdus bovienii
  Terminator sequence Name=Xb4151_4152.C437.trmnator30; Position on contig=63377..63419bp; Strand=+; Gene name=PncA
taactggcagattaattatctgccagtgaaattattttacata

SEQ ID NO: 13817 - DNA, 35 bp, Xenorhabdus bovienii
  Terminator sequence Name=Xb4151_4152.C437.trmnator31; Position on contig=63368..63402bp; Strand=-; Gene name=PncA
ctggcagataattaatctgccagttatatattcca

SEQ ID NO: 13818 - DNA, 35 bp, Xenorhabdus bovienii
  Terminator sequence Name=Xb4151_4152.C437.trmnator32; Position on contig=66035..66069bp; Strand=-
tactattagcgctgttaatagtgtcttgggttatt

SEQ ID NO: 13819 - DNA, 39 bp, Xenorhabdus bovienii
  Terminator sequence Name=Xb4151_4152.C437.trmnator33; Position on contig=67830..67868bp; Strand=+; Gene name=MetK
gaagcccgctaatatccggcgggctttttcataactcac

SEQ ID NO: 13820 - DNA, 41 bp, Xenorhabdus bovienii
  Terminator sequence Name=Xb4151_4152.C437.trmnator34; Position on contig=68356..68396bp; Strand=-; Gene name=SprT
ctttctttgcattgctggcaaagatagcaactttttccttt

SEQ ID NO: 13821 - DNA, 40 bp, Xenorhabdus bovienii
  Terminator sequence Name=Xb4151_4152.C437.trmnator35; Position on contig=69028..69067bp; Strand=-
gaaaaatagctaatacagttatttttctcttttcttgatg

SEQ ID NO: 13822 - DNA, 33 bp, Xenorhabdus bovienii
  Terminator sequence Name=Xb4151_4152.C437.trmnator36; Position on contig=70992..71024bp; Strand=+; Gene name=FecB
cctacaggtttttcctgtgggtttttctataga

SEQ ID NO: 13823 - DNA, 33 bp, Xenorhabdus bovienii
  Terminator sequence Name=Xb4151_4152.C437.trmnator37; Position on contig=70779..70811bp; Strand=-; Gene name=FecB
tggtggtaaatcgccatcacgcgtttttcacgg

SEQ ID NO: 13824 - DNA, 34 bp, Xenorhabdus bovienii
  Terminator sequence Name=Xb4151_4152.C437.trmnator38; Position on contig=72547..72580bp; Strand=+; Gene name=GltP
gccaccgatatatatcggtggcttttaattacat

SEQ ID NO: 13825 - DNA, 45 bp, Xenorhabdus bovienii
  Terminator sequence Name=Xb4151_4152.C437.trmnator39; Position on contig=72695..72739bp; Strand=-; Gene name=GltP
tattggtatgtataataatacatatctgatattttagtttaattt

SEQ ID NO: 13826 - DNA, 34 bp, Xenorhabdus bovienii
  Terminator sequence Name=Xb4151_4152.C437.trmnator40; Position on contig=74477..74510bp; Strand=+; Gene name=PutA
tcgccacccttccgagtggcgatttttatgatca

SEQ ID NO: 13827 - DNA, 65 bp, Xenorhabdus bovienii
  Terminator sequence Name=Xb4151_4152.C437.trmnator41; Position on contig=77585..77649bp; Strand=-; Gene name=Eno
gggcgattgattggttttaattttaatgaatttaatttcaatcgattgcccggaatttaacttgt

SEQ ID NO: 13828 - DNA, 30 bp, Xenorhabdus bovienii
  Terminator sequence Name=Xb4151_4152.C437.trmnator42; Position on contig=89607..89636bp; Strand=+; Gene name=FecB
ggcggcgcttaagctgcccttatttttaat

SEQ ID NO: 13829 - DNA, 41 bp, Xenorhabdus bovienii
  Terminator sequence Name=Xb4151_4152.C437.trmnator43; Position on contig=89467..89507bp; Strand=-; Gene name=FecB
caatcgtcattcagagtgatgatcttgacatttagctgtgg

SEQ ID NO: 13830 - DNA, 44 bp, Xenorhabdus bovienii
  Terminator sequence Name=Xb4151_4152.C437.trmnator44; Position on contig=91917..91960bp; Strand=+
taccccccatcggaatcgatgggggcgatactctattactgatt

SEQ ID NO: 13831 - DNA, 41 bp, Xenorhabdus bovienii
  Terminator sequence Name=Xb4151_4152.C437.trmnator45; Position on contig=91673..91713bp; Strand=-
caatagtgaggactcactcaattgttggttttcggcgtgtt

SEQ ID NO: 13832 - DNA, 32 bp, Xenorhabdus bovienii
  Terminator sequence Name=Xb4151_4152.C437.trmnator46; Position on contig=97892..97923bp; Strand=+; Gene name=SfsA
ccctccattgttgggggggtcgtttgatagtg

SEQ ID NO: 13833 - DNA, 44 bp, Xenorhabdus bovienii
  Terminator sequence Name=Xb4151_4152.C437.trmnator47; Position on contig=103227..103270bp; Strand=-; Gene name=PanC
ggcttttttactttgcaacgtcagaggagtcaagttttctgcat

SEQ ID NO: 13834 - DNA, 37 bp, Xenorhabdus bovienii
  Terminator sequence Name=Xb4151_4152.C437.trmnator48; Position on contig=103432..103468bp; Strand=-
ttttactcacggtgtgagtgtgggtattatttaaacc

SEQ ID NO: 13835 - DNA, 54 bp, Xenorhabdus bovienii
  Terminator sequence Name=Xb4151_4152.C437.trmnator49; Position on contig=106190..106243bp; Strand=-
tgcacattataaaataaaagtgttattttttttatgtgtcatttgttgtgtttg

SEQ ID NO: 13836 - DNA, 31 bp, Xenorhabdus bovienii
  Terminator sequence Name=Xb4151_4152.C437.trmnator50; Position on contig=109622..109652bp; Strand=+; Gene name=CynT
tggcagccttgtgctgccatttactcacagt

SEQ ID NO: 13837 - DNA, 45 bp, Xenorhabdus bovienii
  Terminator sequence Name=Xb4151_4152.C437.trmnator51; Position on contig=109603..109647bp; Strand=-; Gene name=CynT
gagtaaatggcagcacaaggctgccatttgtttttatgtggatct

SEQ ID NO: 13838 - DNA, 34 bp, Xenorhabdus bovienii
  Terminator sequence Name=Xb4151_4152.C437.trmnator52; Position on contig=110267..110300bp; Strand=-
ggtatatcaatcggtgtatcacttttcgtaaaaa

SEQ ID NO: 13839 - DNA, 31 bp, Xenorhabdus bovienii
  Terminator sequence Name=Xb4151_4152.C437.trmnator53; Position on contig=117964..117994bp; Strand=+; Gene name=PtsP
ccgtctgaagcaggacggctcttaatccatt

SEQ ID NO: 13840 - DNA, 32 bp, Xenorhabdus bovienii
  Terminator sequence Name=Xb4151_4152.C437.trmnator54; Position on contig=119799..119830bp; Strand=+; Gene name=ThyA
gagcgggttcagcctgctctttttacatttat

SEQ ID NO: 13841 - DNA, 59 bp, Xenorhabdus bovienii
  Terminator sequence Name=Xb4151_4152.C438.trmnator1; Position on contig=1364..1422bp; Strand=-; Gene name=URH1
tagtgttaggggaatctttatccaaggtgaattattcttaacatctacatttgtgttta

SEQ ID NO: 13842 - DNA, 32 bp, Xenorhabdus bovienii
  Terminator sequence Name=Xb4151_4152.C438.trmnator2; Position on contig=6077..6108bp; Strand=+
gattggaaatgatccagtcgaatttttcctca

SEQ ID NO: 13843 - DNA, 43 bp, Xenorhabdus bovienii
  Terminator sequence Name=Xb4151_4152.C438.trmnator3; Position on contig=5810..5852bp; Strand=-
ttgcctgctcagttttaacgggcaggcaattcttgtgtatctg

SEQ ID NO: 13844 - DNA, 33 bp, Xenorhabdus bovienii
  Terminator sequence Name=Xb4151_4152.C438.trmnator4; Position on contig=9745..9777bp; Strand=+; Gene name=FusA
gggtcaacaaatcgttgacccttatcagtttgt

SEQ ID NO: 13845 - DNA, 35 bp, Xenorhabdus bovienii
  Terminator sequence Name=Xb4151_4152.C438.trmnator5; Position on contig=10315..10349bp; Strand=+; Gene name=OsmY
gggtggctgccaataggccactcttttttttgtta

SEQ ID NO: 13846 - DNA, 60 bp, Xenorhabdus bovienii
  Terminator sequence Name=Xb4151_4152.C438.trmnator6; Position on contig=13847..13906bp; Strand=+; Gene name=TatD
tagaaactagatggatttatgtgatctggatctcattttgtgtttttatattactttttg

SEQ ID NO: 13847 - DNA, 33 bp, Xenorhabdus bovienii
  Terminator sequence Name=Xb4151_4152.C438.trmnator7; Position on contig=13824..13856bp; Strand=-
ctagtttctaagggattagataattttgcggtg

SEQ ID NO: 13848 - DNA, 42 bp, Xenorhabdus bovienii
  Terminator sequence Name=Xb4151_4152.C438.trmnator8; Position on contig=15349..15390bp; Strand=+; Gene name=NupC
gaatgcaggtgagataatctcacctgcttttgtttttcctga

SEQ ID NO: 13849 - DNA, 44 bp, Xenorhabdus bovienii
  Terminator sequence Name=Xb4151_4152.C438.trmnator9; Position on contig=17772..17815bp; Strand=-; Gene name=DeoA
ttcactattggcataaatcattgccagaggagtatctgcgttca

SEQ ID NO: 13850 - DNA, 39 bp, Xenorhabdus bovienii
  Terminator sequence Name=Xb4151_4152.C438.trmnator10; Position on contig=19241..19279bp; Strand=+; Gene name=DeoB
tcagggcagccaacgggctgccctgattttcatctgttt

SEQ ID NO: 13851 - DNA, 36 bp, Xenorhabdus bovienii
  Terminator sequence Name=Xb4151_4152.C438.trmnator11; Position on contig=20066..20101bp; Strand=+; Gene name=DeoD
gctctttccataattggaaagagcttttttatttat

SEQ ID NO: 13852 - DNA, 41 bp, Xenorhabdus bovienii
  Terminator sequence Name=Xb4151_4152.C438.trmnator12; Position on contig=21360..21400bp; Strand=+; Gene name=FimA
tgttattataggtttcctgataattgatagtttattcaggg

SEQ ID NO: 13853 - DNA, 33 bp, Xenorhabdus bovienii
  Terminator sequence Name=Xb4151_4152.C438.trmnator13; Position on contig=24491..24523bp; Strand=-; Gene name=FimD
tgaagtcaaagaggcttcggatatttcctgcgg

SEQ ID NO: 13854 - DNA, 34 bp, Xenorhabdus bovienii
  Terminator sequence Name=Xb4151_4152.C438.trmnator14; Position on contig=27361..27394bp; Strand=+; Gene name=HipB
gccattcctgttaggaatggctttttttttgcca

SEQ ID NO: 13855 - DNA, 61 bp, Xenorhabdus bovienii
  Terminator sequence Name=Xb4151_4152.C438.trmnator15; Position on contig=31759..31819bp; Strand=+; Gene name=Sms
tgtctgattgcctgctatcatcacgttgactgtggcaggtagtcagacaccttttcaataa

SEQ ID NO: 13856 - DNA, 56 bp, Xenorhabdus bovienii
  Terminator sequence Name=Xb4151_4152.C438.trmnator16; Position on contig=39424..39479bp; Strand=+; Gene name=TrpR
gttatgacccctgacggccacgccgttaaggttggttattcaactctttgtaaatt

SEQ ID NO: 13857 - DNA, 35 bp, Xenorhabdus bovienii
  Terminator sequence Name=Xb4151_4152.C438.trmnator17; Position on contig=39400..39434bp; Strand=-; Gene name=TrpR
ggggtcataacaaaatgaccccgctttggttattt

SEQ ID NO: 13858 - DNA, 58 bp, Xenorhabdus bovienii
  Terminator sequence Name=Xb4151_4152.C438.trmnator18; Position on contig=40698..40755bp; Strand=+; Gene name=GpmB
tgaggtactcaaattccacaacgtgggtttgagactcatcctcaaagtttttccattc

SEQ ID NO: 13859 - DNA, 54 bp, Xenorhabdus bovienii
  Terminator sequence Name=Xb4151_4152.C438.trmnator19; Position on contig=41573..41626bp; Strand=-; Gene name=AraC
caaaatagtaagttgttgtacatttgtatgattttctttttgtcttaatgactt

SEQ ID NO: 13860 - DNA, 42 bp, Xenorhabdus bovienii
  Terminator sequence Name=Xb4151_4152.C438.trmnator20; Position on contig=42761..42802bp; Strand=+; Gene name=CreA
gccctgaatgtcgaaggtcattcagggcttttttgcaaatgc

SEQ ID NO: 13861 - DNA, 54 bp, Xenorhabdus bovienii
  Terminator sequence Name=Xb4151_4152.C438.trmnator21; Position on contig=42743..42796bp; Strand=-; Gene name=CreA
gcaaaaaagccctgaatgaccttcgacattcagggcttttgtttaatgggtaac

SEQ ID NO: 13862 - DNA, 27 bp, Xenorhabdus bovienii
  Terminator sequence Name=Xb4151_4152.C438.trmnator22; Position on contig=44020..44046bp; Strand=-; Gene name=OmpR
gccgacaatgtcggtttatagaattta

SEQ ID NO: 13863 - DNA, 56 bp, Xenorhabdus bovienii
  Terminator sequence Name=Xb4151_4152.C438.trmnator23; Position on contig=49074..49129bp; Strand=+; Gene name=ThrC
cctgaatagcgggtggagtgacatcaatcaatgctgttcagggcgtttaaataccc

SEQ ID NO: 13864 - DNA, 57 bp, Xenorhabdus bovienii
  Terminator sequence Name=Xb4151_4152.C438.trmnator24; Position on contig=49044..49100bp; Strand=-; Gene name=ThrC
ttgatgtcactccacccgctattcaggtggagtgacagatacgacgttatgtcggcg

SEQ ID NO: 13865 - DNA, 32 bp, Xenorhabdus bovienii
  Terminator sequence Name=Xb4151_4152.C438.trmnator25; Position on contig=51064..51095bp; Strand=+; Gene name=MipB
ggcgacataatgaggtcgccttttattttttc

SEQ ID NO: 13866 - DNA, 43 bp, Xenorhabdus bovienii
  Terminator sequence Name=Xb4151_4152.C438.trmnator26; Position on contig=51927..51969bp; Strand=+; Gene name=MoaB
taccggcgttattcatggcaagcccggtaagtgtattcgagct

SEQ ID NO: 13867 - DNA, 56 bp, Xenorhabdus bovienii
  Terminator sequence Name=Xb4151_4152.C438.trmnator27; Position on contig=54366..54421bp; Strand=+
tcgtttttttggatatttatttgtgtataaatattgaagatgagtattaaggttta

SEQ ID NO: 13868 - DNA, 41 bp, Xenorhabdus bovienii
  Terminator sequence Name=Xb4151_4152.C438.trmnator28; Position on contig=54416..54456bp; Strand=-
ggatggtttatgatttaaataagccatcctttttgtaaacc

SEQ ID NO: 13869 - DNA, 61 bp, Xenorhabdus bovienii
  Terminator sequence Name=Xb4151_4152.C438.trmnator29; Position on contig=58895..58955bp; Strand=+; Gene name=MetC
gaaaaacagaatgccagccgttatccttcggttggcattctgtgctgctcttttttagcga

SEQ ID NO: 13870 - DNA, 33 bp, Xenorhabdus bovienii
  Terminator sequence Name=Xb4151_4152.C438.trmnator30; Position on contig=74367..74399bp; Strand=+; Gene name=RecD
gcgctggtagttatacagcgcttgtttttccac

SEQ ID NO: 13871 - DNA, 53 bp, Xenorhabdus bovienii
  Terminator sequence Name=Xb4151_4152.C438.trmnator31; Position on contig=74036..74088bp; Strand=-; Gene name=RecD
ggccgtttcatgctgaggcaatcggctcggctgaaatggctttatcgtcccat

SEQ ID NO: 13872 - DNA, 38 bp, Xenorhabdus bovienii
  Terminator sequence Name=Xb4151_4152.C438.trmnator32; Position on contig=79002..79039bp; Strand=+; Gene name=MltA
tgggataggtcttagagccgatcccattaattacgcct

SEQ ID NO: 13873 - DNA, 37 bp, Xenorhabdus bovienii
  Terminator sequence Name=Xb4151_4152.C438.trmnator33; Position on contig=83215..83251bp; Strand=-; Gene name=Bax
cagaggcgtttgtgctgtcctctgttttgcccgtgaa

SEQ ID NO: 13874 - DNA, 47 bp, Xenorhabdus bovienii
  Terminator sequence Name=Xb4151_4152.C438.trmnator34; Position on contig=84390..84436bp; Strand=+
taatccgctatgtattaattacacagtggattatttttttataattt

SEQ ID NO: 13875 - DNA, 41 bp, Xenorhabdus bovienii
  Terminator sequence Name=Xb4151_4152.C438.trmnator35; Position on contig=89516..89556bp; Strand=-
cggcattttactgattgattaaaatgccgttttttttatat

SEQ ID NO: 13876 - DNA, 53 bp, Xenorhabdus bovienii
  Terminator sequence Name=Xb4151_4152.C438.trmnator36; Position on contig=91529..91581bp; Strand=-; Gene name=GntK
tgttgctggtaatgttaccgacaataagttaccggtaacattttatagataat

SEQ ID NO: 13877 - DNA, 50 bp, Xenorhabdus bovienii
  Terminator sequence Name=Xb4151_4152.C438.trmnator37; Position on contig=98052..98101bp; Strand=-
ttgttaaatttattaattgtaataaatttaattaagaatatattaataaa

SEQ ID NO: 13878 - DNA, 36 bp, Xenorhabdus bovienii
  Terminator sequence Name=Xb4151_4152.C438.trmnator38; Position on contig=99055..99090bp; Strand=+; Gene name=AcrR
tagtggctacctaggtagccactattgtcatcataa

SEQ ID NO: 13879 - DNA, 39 bp, Xenorhabdus bovienii
  Terminator sequence Name=Xb4151_4152.C438.trmnator39; Position on contig=103678..103716bp; Strand=+; Gene name=MdaB
ctcgtaattcccggaattaatgacgagatgttgattgat

SEQ ID NO: 13880 - DNA, 39 bp, Xenorhabdus bovienii
  Terminator sequence Name=Xb4151_4152.C438.trmnator40; Position on contig=104347..104385bp; Strand=-
ccctcaatttacagcacattgaggagactattattcggg

SEQ ID NO: 13881 - DNA, 41 bp, Xenorhabdus bovienii
  Terminator sequence Name=Xb4151_4152.C438.trmnator41; Position on contig=119307..119347bp; Strand=+
gtaaggagatagctccactatctccttactctttcccgaat

SEQ ID NO: 13882 - DNA, 30 bp, Xenorhabdus bovienii
  Terminator sequence Name=Xb4151_4152.C438.trmnator42; Position on contig=120157..120186bp; Strand=+
cgtggctgggaagccatgttttttagctcc

SEQ ID NO: 13883 - DNA, 43 bp, Xenorhabdus bovienii
  Terminator sequence Name=Xb4151_4152.C438.trmnator43; Position on contig=119875..119917bp; Strand=-
cacttgtatcaggaaaacattgatggggtgactattgtgagcg

SEQ ID NO: 13884 - DNA, 49 bp, Xenorhabdus bovienii
  Terminator sequence Name=Xb4151_4152.C438.trmnator44; Position on contig=122430..122478bp; Strand=+; Gene name=LysR
tgagtgtctagtattcaatatgatactggacactcaattaatttcaata

SEQ ID NO: 13885 - DNA, 54 bp, Xenorhabdus bovienii
  Terminator sequence Name=Xb4151_4152.C438.trmnator45; Position on contig=137380..137433bp; Strand=+
tacattgaattactgcccgaatttttttgggttattaatgtaatctttctttta

SEQ ID NO: 13886 - DNA, 29 bp, Xenorhabdus bovienii
  Terminator sequence Name=Xb4151_4152.C438.trmnator46; Position on contig=137154..137182bp; Strand=-
cccagtaaagtattgggttcttcttccat

SEQ ID NO: 13887 - DNA, 34 bp, Xenorhabdus bovienii
  Terminator sequence Name=Xb4151_4152.C438.trmnator47; Position on contig=140033..140066bp; Strand=-
tagtttcttgtaacgaaagctaatattttcatat

SEQ ID NO: 13888 - DNA, 26 bp, Xenorhabdus bovienii
  Terminator sequence Name=Xb4151_4152.C438.trmnator48; Position on contig=142756..142781bp; Strand=+
cgcgccatagcgcggattttaaagga

SEQ ID NO: 13889 - DNA, 41 bp, Xenorhabdus bovienii
  Terminator sequence Name=Xb4151_4152.C438.trmnator49; Position on contig=142736..142776bp; Strand=-
taaaatccgcgctatggcgcggattttggttttcacagaca

SEQ ID NO: 13890 - DNA, 44 bp, Xenorhabdus bovienii
  Terminator sequence Name=Xb4151_4152.C438.trmnator50; Position on contig=145261..145304bp; Strand=+
ggcaaggcggttattgatgaccaccttgcctttttgcttatatc

SEQ ID NO: 13891 - DNA, 40 bp, Xenorhabdus bovienii
  Terminator sequence Name=Xb4151_4152.C438.trmnator51; Position on contig=147811..147850bp; Strand=+
cccgttgacgcatccgcagcaacgggttttttcaggcaat

SEQ ID NO: 13892 - DNA, 58 bp, Xenorhabdus bovienii
  Terminator sequence Name=Xb4151_4152.C438.trmnator52; Position on contig=147788..147845bp; Strand=-
ctgaaaaaacccgttgctgcggatgcgtcaacgggttttttccgtcatgttaatacac

SEQ ID NO: 13893 - DNA, 51 bp, Xenorhabdus bovienii
  Terminator sequence Name=Xb4151_4152.C438.trmnator53; Position on contig=155632..155682bp; Strand=+; Gene name=KdsA
tagtcaccctctgccagttatgctggcagagggtgactaattgttactgac

SEQ ID NO: 13894 - DNA, 53 bp, Xenorhabdus bovienii
  Terminator sequence Name=Xb4151_4152.C438.trmnator54; Position on contig=163868..163920bp; Strand=-
taaaaaagagcctgaacacaataatcaggcttttttggttactcttgataggg

SEQ ID NO: 13895 - DNA, 45 bp, Xenorhabdus bovienii
  Terminator sequence Name=Xb4151_4152.C439.trmnator1; Position on contig=7842..7886bp; Strand=+; Gene name=CspR (BS)
ggccattcagcgcttgtatcacgctgaatggctttaattcttgat

SEQ ID NO: 13896 - DNA, 46 bp, Xenorhabdus bovienii
  Terminator sequence Name=Xb4151_4152.C439.trmnator2; Position on contig=7828..7873bp; Strand=-; Gene name=CspR (BS)
gccattcagcgtgatacaagcgctgaatggcctaatattaatcccg

SEQ ID NO: 13897 - DNA, 41 bp, Xenorhabdus bovienii
  Terminator sequence Name=Xb4151_4152.C439.trmnator3; Position on contig=10345..10385bp; Strand=-; Gene name=SecB
gggtgtaagcggtatgcttacgtcatcaaagtttaatcagg

SEQ ID NO: 13898 - DNA, 51 bp, Xenorhabdus bovienii
  Terminator sequence Name=Xb4151_4152.C439.trmnator4; Position on contig=13437..13487bp; Strand=-
cagcacaggtgtctgtcgttgtacgggcgcctgtgttgccttgtactgttt

SEQ ID NO: 13899 - DNA, 35 bp, Xenorhabdus bovienii
  Terminator sequence Name=Xb4151_4152.C439.trmnator5; Position on contig=18891..18925bp; Strand=-; Gene name=RfaF
tgcatcactttcggtggtgcaatgctttgcatcgt

SEQ ID NO: 13900 - DNA, 48 bp, Xenorhabdus bovienii
  Terminator sequence Name=Xb4151_4152.C439.trmnator6; Position on contig=36756..36803bp; Strand=-
cctatctcagtaagtttttttattgagataatgtgagtcttttcagtg

SEQ ID NO: 13901 - DNA, 59 bp, Xenorhabdus bovienii
  Terminator sequence Name=Xb4151_4152.C439.trmnator7; Position on contig=39509..39567bp; Strand=+; Gene name=Dut
ttcatattttttgcccatgatcgtggtgggcaaaaaatagctggatttgttttgctgtt

SEQ ID NO: 13902 - DNA, 40 bp, Xenorhabdus bovienii
  Terminator sequence Name=Xb4151_4152.C439.trmnator8; Position on contig=40611..40650bp; Strand=+
cagacaacgttgcaccgtgttgtttgataatttccatcga

SEQ ID NO: 13903 - DNA, 30 bp, Xenorhabdus bovienii
  Terminator sequence Name=Xb4151_4152.C439.trmnator9; Position on contig=41103..41132bp; Strand=-; Gene name=PyrE
ggcggctgaatagtcgccttttttatgcct

SEQ ID NO: 13904 - DNA, 40 bp, Xenorhabdus bovienii
  Terminator sequence Name=Xb4151_4152.C439.trmnator10; Position on contig=42893..42932bp; Strand=+
gccagcatacaccttgttgtatctggcttttttgttatca

SEQ ID NO: 13905 - DNA, 30 bp, Xenorhabdus bovienii
  Terminator sequence Name=Xb4151_4152.C439.trmnator11; Position on contig=48243..48272bp; Strand=+
gcccagtttaggctgggctgttttctcatc

SEQ ID NO: 13906 - DNA, 49 bp, Xenorhabdus bovienii
  Terminator sequence Name=Xb4151_4152.C439.trmnator12; Position on contig=52351..52399bp; Strand=+
ccctgcatagagactgacttttagtttttatgttgggtttcctaccaag

SEQ ID NO: 13907 - DNA, 63 bp, Xenorhabdus bovienii
  Terminator sequence Name=Xb4151_4152.C439.trmnator13; Position on contig=52452..52514bp; Strand=-
tgaaatgagtgaaaagaatttcagcaaatttcagttttctattcgtttacattctgggtgata

SEQ ID NO: 13908 - DNA, 54 bp, Xenorhabdus bovienii
  Terminator sequence Name=Xb4151_4152.C439.trmnator14; Position on contig=53755..53808bp; Strand=+
gtgtacccctaactatcacagaacctatttaggggtacacggctattttttatt

SEQ ID NO: 13909 - DNA, 39 bp, Xenorhabdus bovienii
  Terminator sequence Name=Xb4151_4152.C439.trmnator15; Position on contig=53652..53690bp; Strand=-
gccagatacaacaaggtgtattctggctttgtgatatgt

SEQ ID NO: 13910 - DNA, 40 bp, Xenorhabdus bovienii
  Terminator sequence Name=Xb4151_4152.C439.trmnator16; Position on contig=55398..55437bp; Strand=+
gccagcatacaccttgttgtatctggcttttttactatca

SEQ ID NO: 13911 - DNA, 39 bp, Xenorhabdus bovienii
  Terminator sequence Name=Xb4151_4152.C439.trmnator17; Position on contig=55386..55424bp; Strand=-
gccagatacaacaaggtgtatgctggctttgtgatatgt

SEQ ID NO: 13912 - DNA, 38 bp, Xenorhabdus bovienii
  Terminator sequence Name=Xb4151_4152.C439.trmnator18; Position on contig=56382..56419bp; Strand=+
cggcattattttttaagataatgccgttgataatatta

SEQ ID NO: 13913 - DNA, 39 bp, Xenorhabdus bovienii
  Terminator sequence Name=Xb4151_4152.C439.trmnator19; Position on contig=56369..56407bp; Strand=-
cggcattatcttaaaaaataatgccgctttgcttcatct

SEQ ID NO: 13914 - DNA, 57 bp, Xenorhabdus bovienii
  Terminator sequence Name=Xb4151_4152.C439.trmnator20; Position on contig=58610..58666bp; Strand=+
cggaataaaacctacacgactggaagcacgtaggttttattcgccttaatttccggt

SEQ ID NO: 13915 - DNA, 61 bp, Xenorhabdus bovienii
  Terminator sequence Name=Xb4151_4152.C439.trmnator21; Position on contig=58594..58654bp; Strand=-
ggcgaataaaacctacgtgcttccagtcgtgtaggttttattccgtctatttcaatggcgt

SEQ ID NO: 13916 - DNA, 61 bp, Xenorhabdus bovienii
  Terminator sequence Name=Xb4151_4152.C439.trmnator22; Position on contig=66005..66065bp; Strand=-
taagatatatggacaccgactgaattcaagttggtgtccatatatcttatttaatcgcatg

SEQ ID NO: 13917 - DNA, 31 bp, Xenorhabdus bovienii
  Terminator sequence Name=Xb4151_4152.C439.trmnator23; Position on contig=70616..70646bp; Strand=+
tcgcgcattaaatgcgcgactttatggaaca

SEQ ID NO: 13918 - DNA, 41 bp, Xenorhabdus bovienii
  Terminator sequence Name=Xb4151_4152.C439.trmnator24; Position on contig=70599..70639bp; Strand=-
taaagtcgcgcatttaatgcgcgactaatgattttaatcaa

SEQ ID NO: 13919 - DNA, 25 bp, Xenorhabdus bovienii
  Terminator sequence Name=Xb4151_4152.C439.trmnator25; Position on contig=73311..73335bp; Strand=+; Gene name=FdhD
cccactttgtgggaatttcatgcct

SEQ ID NO: 13920 - DNA, 45 bp, Xenorhabdus bovienii
  Terminator sequence Name=Xb4151_4152.C439.trmnator26; Position on contig=82250..82294bp; Strand=-; Gene name=ThdF
tgactagaaggcggtcattggccgcctttattatttcagttgatt

SEQ ID NO: 13921 - DNA, 50 bp, Xenorhabdus bovienii
  Terminator sequence Name=Xb4151_4152.C439.trmnator27; Position on contig=91418..91467bp; Strand=-
tggaatgtggtcatactcattgggtataatattttgttttattagatatc

SEQ ID NO: 13922 - DNA, 47 bp, Xenorhabdus bovienii
  Terminator sequence Name=Xb4151_4152.C439.trmnator28; Position on contig=93030..93076bp; Strand=-
taaaccgccaattcaaccaataaattggcggttagagtttgcattga

SEQ ID NO: 13923 - DNA, 47 bp, Xenorhabdus bovienii
  Terminator sequence Name=Xb4151_4152.C439.trmnator29; Position on contig=96466..96512bp; Strand=-
tttgattctgttgatgtaatgaattgaattaaaaaagtttagtacag

SEQ ID NO: 13924 - DNA, 37 bp, Xenorhabdus bovienii
  Terminator sequence Name=Xb4151_4152.C439.trmnator30; Position on contig=107890..107926bp; Strand=-
tccggttatgcaaacgctgaccggatttttttatggt

SEQ ID NO: 13925 - DNA, 61 bp, Xenorhabdus bovienii
  Terminator sequence Name=Xb4151_4152.C439.trmnator31; Position on contig=118911..118971bp; Strand=-; Gene name=AtpI
taattagtgacgttaaccacatttataatgttactgacgttactaattattacttttggct

SEQ ID NO: 13926 - DNA, 61 bp, Xenorhabdus bovienii
  Terminator sequence Name=Xb4151_4152.C439.trmnator32; Position on contig=124120..124180bp; Strand=+; Gene name=AsnA
tccggtatcaaagtgccagatatgatcgaatatctgcatgataccgggctttccataatgg

SEQ ID NO: 13927 - DNA, 42 bp, Xenorhabdus bovienii
  Terminator sequence Name=Xb4151_4152.C440.trmnator1; Position on contig=439..480bp; Strand=+
gagctgccctgaacgttcagggcaggtctttattaatgacca

SEQ ID NO: 13928 - DNA, 38 bp, Xenorhabdus bovienii
  Terminator sequence Name=Xb4151_4152.C440.trmnator2; Position on contig=1241..1278bp; Strand=+; Gene name=Ssb
cttgaaggttatattaactttgagttttgttatgttaa

SEQ ID NO: 13929 - DNA, 36 bp, Xenorhabdus bovienii
  Terminator sequence Name=Xb4151_4152.C440.trmnator3; Position on contig=1120..1155bp; Strand=-; Gene name=Ssb
ttctctgctaactggttgagaggattgcttctgtat

SEQ ID NO: 13930 - DNA, 26 bp, Xenorhabdus bovienii
  Terminator sequence Name=Xb4151_4152.C440.trmnator4; Position on contig=8636..8661bp; Strand=-
gccgctgagcggcttgtctgctggcg

SEQ ID NO: 13931 - DNA, 46 bp, Xenorhabdus bovienii
  Terminator sequence Name=Xb4151_4152.C440.trmnator5; Position on contig=10423..10468bp; Strand=+
catcgtagtcggtgtggtgctgttggttgcggtgatttggctgctg

SEQ ID NO: 13932 - DNA, 32 bp, Xenorhabdus bovienii
  Terminator sequence Name=Xb4151_4152.C440.trmnator6; Position on contig=18020..18051bp; Strand=+
tcaggggttttaccctgacgaatttgttcatt

SEQ ID NO: 13933 - DNA, 55 bp, Xenorhabdus bovienii
  Terminator sequence Name=Xb4151_4152.C440.trmnator7; Position on contig=22764..22818bp; Strand=+
tgatagggaaaagttgggtgatgtgactttttccgtatctgaaatgtttagttaa

SEQ ID NO: 13934 - DNA, 50 bp, Xenorhabdus bovienii
  Terminator sequence Name=Xb4151_4152.C440.trmnator8; Position on contig=23397..23446bp; Strand=-
cattaactttcgggtgcgataatcactgagagtaaggccttctttgcgta

SEQ ID NO: 13935 - DNA, 57 bp, Xenorhabdus bovienii
  Terminator sequence Name=Xb4151_4152.C440.trmnator9; Position on contig=29956..30012bp; Strand=-
cttactctttctacttgaggtatatgctaggtcaagagagtgagtttttttggtcat

SEQ ID NO: 13936 - DNA, 41 bp, Xenorhabdus bovienii
  Terminator sequence Name=Xb4151_4152.C440.trmnator10; Position on contig=33547..33587bp; Strand=+; Gene name=Qor
cgatataaggataaagcgccttaatcgcattaatggtgttc

SEQ ID NO: 13937 - DNA, 30 bp, Xenorhabdus bovienii
  Terminator sequence Name=Xb4151_4152.C440.trmnator11; Position on contig=33290..33319bp; Strand=-; Gene name=Qor
gccgtgggtgacgcggctttctagtgtgcg

SEQ ID NO: 13938 - DNA, 51 bp, Xenorhabdus bovienii
  Terminator sequence Name=Xb4151_4152.C440.trmnator12; Position on contig=37272..37322bp; Strand=+
ttcatgcgcctgttctgtaatcgggcaggcatatgcgcgttctgtctgtgt

SEQ ID NO: 13939 - DNA, 52 bp, Xenorhabdus bovienii
  Terminator sequence Name=Xb4151_4152.C440.trmnator13; Position on contig=36948..36999bp; Strand=-
catggcaataaacccgcaggaaggtgcgggttggtatgagttgtatatgcat

SEQ ID NO: 13940 - DNA, 43 bp, Xenorhabdus bovienii; identical to SEQ ID NO: 13331
  Terminator sequence Name=Xb4151_4152.C440.trmnator14; Position on contig=39448..39490bp; Strand=-

SEQ ID NO: 13941 - DNA, 27 bp, Xenorhabdus bovienii
  Terminator sequence Name=Xb4151_4152.C440.trmnator15; Position on contig=43437..43463bp; Strand=-
ccctcttcggagggtttttttatggag

SEQ ID NO: 13942 - DNA, 29 bp, Xenorhabdus bovienii
  Terminator sequence Name=Xb4151_4152.C440.trmnator16; Position on contig=44732..44760bp; Strand=-
cccagccccagctgggttttttattaccc

SEQ ID NO: 13943 - DNA, 31 bp, Xenorhabdus bovienii
  Terminator sequence Name=Xb4151_4152.C440.trmnator17; Position on contig=49831..49861bp; Strand=+
cgccgcaataatggtggcgttatcgtgggta

SEQ ID NO: 13944 - DNA, 36 bp, Xenorhabdus bovienii
  Terminator sequence Name=Xb4151_4152.C440.trmnator18; Position on contig=51547..51582bp; Strand=+
cttgttgctgatcggcggtacggattttgcggttgg

SEQ ID NO: 13945 - DNA, 38 bp, Xenorhabdus bovienii; identical to SEQ ID NO: 13310
  Terminator sequence Name=Xb4151_4152.C440.trmnator19; Position on contig=52394..52431bp; Strand=+

SEQ ID NO: 13946 - DNA, 55 bp, Xenorhabdus bovienii
  Terminator sequence Name=Xb4151_4152.C440.trmnator20; Position on contig=55847..55901bp; Strand=-
gacatgagtaggacggcaggaatgaaccgtcctatttgatgttattttaaacaaa

SEQ ID NO: 13947 - DNA, 47 bp, Xenorhabdus bovienii
  Terminator sequence Name=Xb4151_4152.C440.trmnator21; Position on contig=61277..61323bp; Strand=-
tgagaggacggcaggaatgctccgtcctactcagttttattagtata

SEQ ID NO: 13948 - DNA, 39 bp, Xenorhabdus bovienii
  Terminator sequence Name=Xb4151_4152.C440.trmnator22; Position on contig=62277..62315bp; Strand=-
gttggtgttgacaattcgacgttaaccgtctttcgggag

SEQ ID NO: 13949 - DNA, 51 bp, Xenorhabdus bovienii
  Terminator sequence Name=Xb4151_4152.C440.trmnator23; Position on contig=71007..71057bp; Strand=+; Gene name=UhpC
tcctccactcgttctctgaataaaatcgagtggaggattttttcaatcaaa

SEQ ID NO: 13950 - DNA, 39 bp, Xenorhabdus bovienii
  Terminator sequence Name=Xb4151_4152.C440.trmnator24; Position on contig=74615..74653bp; Strand=+
cttggtgataaagggtgtgcatcaggtaatttctctcgg

SEQ ID NO: 13951 - DNA, 32 bp, Xenorhabdus bovienii
  Terminator sequence Name=Xb4151_4152.C440.trmnator25; Position on contig=74260..74291bp; Strand=-
ggctgcgctccggcgtggcctttttcatatct

SEQ ID NO: 13952 - DNA, 60 bp, Xenorhabdus bovienii
  Terminator sequence Name=Xb4151_4152.C440.trmnator26; Position on contig=75263..75322bp; Strand=-
gatggtgaggtctggttgttttttggcgaaagtaatcaatcttatatcttgattatcagg

SEQ ID NO: 13953 - DNA, 54 bp, Xenorhabdus bovienii
  Terminator sequence Name=Xb4151_4152.C440.trmnator27; Position on contig=75838..75891bp; Strand=+
tggcgacgataaaatcacaatgaataattttatcgtcgccaacttattttatat

SEQ ID NO: 13954 - DNA, 29 bp, Xenorhabdus bovienii
  Terminator sequence Name=Xb4151_4152.C440.trmnator28; Position on contig=93964..93992bp; Strand=+
cctcccttaggggaggttatttcccacca

SEQ ID NO: 13955 - DNA, 36 bp, Xenorhabdus bovienii
  Terminator sequence Name=Xb4151_4152.C440.trmnator29; Position on contig=103081..103116bp; Strand=+
tcgccgtttgatgttgcggtgatcctgttcaatcag

SEQ ID NO: 13956 - DNA, 57 bp, Xenorhabdus bovienii
  Terminator sequence Name=Xb4151_4152.C440.trmnator30; Position on contig=102738..102794bp; Strand=-
gctgaagtcttgatactcgttggctaacaaacgtatcaaattcgctgtctgaatctg

SEQ ID NO: 13957 - DNA, 34 bp, Xenorhabdus bovienii; identical to SEQ ID NO: 13287
  Terminator sequence Name=Xb4151_4152.C440.trmnator31; Position on contig=104539..104572bp; Strand=+

SEQ ID NO: 13958 - DNA, 53 bp, Xenorhabdus bovienii
  Terminator sequence Name=Xb4151_4152.C440.trmnator32; Position on contig=112013..112065bp; Strand=-; Gene name=DedD
caattctttcaattcaggcaaagtggattcaagggtttgccttgatgcattcg

SEQ ID NO: 13959 - DNA, 32 bp, Xenorhabdus bovienii
  Terminator sequence Name=Xb4151_4152.C440.trmnator33; Position on contig=114795..114826bp; Strand=-; Gene name=UbiX
ggcggcataatcaccgcccctatttcagccgc

SEQ ID NO: 13960 - DNA, 32 bp, Xenorhabdus bovienii
  Terminator sequence Name=Xb4151_4152.C440.trmnator34; Position on contig=117412..117443bp; Strand=+; Gene name=MutT
gctcctctttatgaggagctttttatttgtct

SEQ ID NO: 13961 - DNA, 31 bp, Xenorhabdus bovienii
  Terminator sequence Name=Xb4151_4152.C440.trmnator35; Position on contig=118711..118741bp; Strand=+
cgttattgtttcgataatggtattttaatta

SEQ ID NO: 13962 - DNA, 45 bp, Xenorhabdus bovienii
  Terminator sequence Name=Xb4151_4152.C440.trmnator36; Position on contig=126055..126099bp; Strand=+
tatacctgagcgaaagtattcgctcagggaaactctgtcatattc

SEQ ID NO: 13963 - DNA, 39 bp, Xenorhabdus bovienii
  Terminator sequence Name=Xb4151_4152.C440.trmnator37; Position on contig=139651..139689bp; Strand=+
catccggcggatggtttgccggatgtttattttcaaaac

SEQ ID NO: 13964 - DNA, 37 bp, Xenorhabdus bovienii
  Terminator sequence Name=Xb4151_4152.C440.trmnator38; Position on contig=139639..139675bp; Strand=-
catccggcaaaccatccgccggatgtttataataatc

SEQ ID NO: 13965 - DNA, 38 bp, Xenorhabdus bovienii
  Terminator sequence Name=Xb4151_4152.C440.trmnator39; Position on contig=142047..142084bp; Strand=-; Gene name=Uup
tgggttttgactaatcaagaccataagttattattaaa

SEQ ID NO: 13966 - DNA, 39 bp, Xenorhabdus bovienii
  Terminator sequence Name=Xb4151_4152.C440.trmnator40; Position on contig=150587..150625bp; Strand=-
taaccccatactttttggctggggttatttttttatagc

SEQ ID NO: 13967 - DNA, 28 bp, Xenorhabdus bovienii
  Terminator sequence Name=Xb4151_4152.C440.trmnator41; Position on contig=152964..152991bp; Strand=+
gccagcattgctggcagttcttgaaatc

SEQ ID NO: 13968 - DNA, 38 bp, Xenorhabdus bovienii
  Terminator sequence Name=Xb4151_4152.C440.trmnator42; Position on contig=152946..152983bp; Strand=-
gaactgccagcaatgctggcggttctctattcatgaat

SEQ ID NO: 13969 - DNA, 38 bp, Xenorhabdus bovienii
  Terminator sequence Name=Xb4151_4152.C440.trmnator43; Position on contig=155942..155979bp; Strand=+
ccaatctgcctatcggcagattggtattgctgatggga

SEQ ID NO: 13970 - DNA, 36 bp, Xenorhabdus bovienii
  Terminator sequence Name=Xb4151_4152.C440.trmnator44; Position on contig=157910..157945bp; Strand=+; Gene name=CitT
cagcttccgcatcaaggaagctgcattgtggttaca

SEQ ID NO: 13971 - DNA, 39 bp, Xenorhabdus bovienii
  Terminator sequence Name=Xb4151_4152.C440.trmnator45; Position on contig=157896..157934bp; Strand=-; Gene name=CitT
tgcagcttccttgatgcggaagctgtactatttaaactt

SEQ ID NO: 13972 - DNA, 49 bp, Xenorhabdus bovienii
  Terminator sequence Name=Xb4151_4152.C440.trmnator46; Position on contig=161715..161763bp; Strand=+; Gene name=LysR
ggctaatatttccattttatttgtagagatattagcctttctctaaact

SEQ ID NO: 13973 - DNA, 46 bp, Xenorhabdus bovienii
  Terminator sequence Name=Xb4151_4152.C440.trmnator47; Position on contig=162010..162055bp; Strand=-; Gene name=LysR
gcactgatcagagtatttttatgatcgagtgcacaatttcattgaa

SEQ ID NO: 13974 - DNA, 39 bp, Xenorhabdus bovienii; identical to SEQ ID NO: 13348
  Terminator sequence Name=Xb4151_4152.C440.trmnator48; Position on contig=178081..178119bp; Strand=+

SEQ ID NO: 13975 - DNA, 55 bp, Xenorhabdus bovienii
  Terminator sequence Name=Xb4151_4152.C440.trmnator49; Position on contig=177835..177889bp; Strand=-
gattgccttgccgtctgaatccacagcacggtaaaggtaactccatttccctttg

SEQ ID NO: 13976 - DNA, 45 bp, Xenorhabdus bovienii
  Terminator sequence Name=Xb4151_4152.C440.trmnator50; Position on contig=182098..182142bp; Strand=+
tttttaacccgcaggaggttgcgggttaaaaattattgatgtgtt

SEQ ID NO: 13977 - DNA, 44 bp, Xenorhabdus bovienii
  Terminator sequence Name=Xb4151_4152.C440.trmnator51; Position on contig=182086..182129bp; Strand=-
tttttaacccgcaacctcctgcgggttaaaaattccttactctg

SEQ ID NO: 13978 - DNA, 36 bp, Xenorhabdus bovienii
  Terminator sequence Name=Xb4151_4152.C440.trmnator52; Position on contig=183210..183245bp; Strand=+
tttccagatttaaaatcgggggcattatcatctcaa

SEQ ID NO: 13979 - DNA, 30 bp, Xenorhabdus bovienii
  Terminator sequence Name=Xb4151_4152.C440.trmnator53; Position on contig=184010..184039bp; Strand=+
ccaaccttaacaggttggcttttctaggga

SEQ ID NO: 13980 - DNA, 39 bp, Xenorhabdus bovienii
  Terminator sequence Name=Xb4151_4152.C440.trmnator54; Position on contig=184145..184183bp; Strand=-
caagcactcactaaattaagtgcttgctttgaaaataaa

SEQ ID NO: 13981 - DNA, 36 bp, Xenorhabdus bovienii
  Terminator sequence Name=Xb4151_4152.C440.trmnator55; Position on contig=186207..186242bp; Strand=-
ccttctatacggtagtatatagggctttgtatattc

SEQ ID NO: 13982 - DNA, 34 bp, Xenorhabdus bovienii
  Terminator sequence Name=Xb4151_4152.C440.trmnator56; Position on contig=187515..187548bp; Strand=+
taacgccgcaaatgcggcgttatttactcggcgt

SEQ ID NO: 13983 - DNA, 44 bp, Xenorhabdus bovienii
  Terminator sequence Name=Xb4151_4152.C440.trmnator57; Position on contig=187498..187541bp; Strand=-
gtaaataacgccgcatttgcggcgttatttatttctactgcttt

SEQ ID NO: 13984 - DNA, 40 bp, Xenorhabdus bovienii
  Terminator sequence Name=Xb4151_4152.C440.trmnator58; Position on contig=187874..187913bp; Strand=-; Gene name=RplY
cctgctgctgggtcgcctgtagcaggatttattttcttct

SEQ ID NO: 13985 - DNA, 35 bp, Xenorhabdus bovienii
  Terminator sequence Name=Xb4151_4152.C440.trmnator59; Position on contig=190813..190847bp; Strand=+; Gene name=RsuA
gattatcctatttgggattagtcttgatccttggt

SEQ ID NO: 13986 - DNA, 41 bp, Xenorhabdus bovienii
  Terminator sequence Name=Xb4151_4152.C440.trmnator60; Position on contig=191998..192038bp; Strand=+; Gene name=ProP
ggggctaccagatagcataaggtagcctctgttttttaatt

SEQ ID NO: 13987 - DNA, 32 bp, Xenorhabdus bovienii
  Terminator sequence Name=Xb4151_4152.C440.trmnator61; Position on contig=193026..193057bp; Strand=+
cgcttccaaagggaagcgtttttttatgtctg

SEQ ID NO: 13988 - DNA, 54 bp, Xenorhabdus bovienii
  Terminator sequence Name=Xb4151_4152.C440.trmnator62; Position on contig=193002..193055bp; Strand=-
gacataaaaaaacgcttccctttggaagcgtttttttatccaattgttatccac

SEQ ID NO: 13989 - DNA, 53 bp, Xenorhabdus bovienii
  Terminator sequence Name=Xb4151_4152.C440.trmnator63; Position on contig=193947..193999bp; Strand=-
gtaatgatgaggagatattgcttatctcctcaaaactacacaatttttaccaa

SEQ ID NO: 13990 - DNA, 52 bp, Xenorhabdus bovienii
  Terminator sequence Name=Xb4151_4152.C440.trmnator64; Position on contig=195577..195628bp; Strand=+
ttgtttaaataatggttattaataaccgttttgtaaatgatttaataaaaac

SEQ ID NO: 13991 - DNA, 57 bp, Xenorhabdus bovienii
  Terminator sequence Name=Xb4151_4152.C440.trmnator65; Position on contig=196101..196157bp; Strand=+
gtgatgaattgctcttttcatcgaaagggaaagagcaattcatattttaaggatata

SEQ ID NO: 13992 - DNA, 57 bp, Xenorhabdus bovienii
  Terminator sequence Name=Xb4151_4152.C440.trmnator66; Position on contig=196088..196144bp; Strand=-
tatgaattgctctttccctttcgatgaaaagagcaattcatcacctattaaaatcag

SEQ ID NO: 13993 - DNA, 55 bp, Xenorhabdus bovienii
  Terminator sequence Name=Xb4151_4152.C440.trmnator67; Position on contig=199943..199997bp; Strand=+; Gene name=FruK
tgatcgtttcaagaaccaatggaatgccattgaaacggtcatctttcataatgta

SEQ ID NO: 13994 - DNA, 31 bp, Xenorhabdus bovienii
  Terminator sequence Name=Xb4151_4152.C440.trmnator68; Position on contig=200780..200810bp; Strand=-
tctctgtttttgacagagatttttttggcag

SEQ ID NO: 13995 - DNA, 39 bp, Xenorhabdus bovienii
  Terminator sequence Name=Xb4151_4152.C440.trmnator69; Position on contig=207944..207982bp; Strand=+; Gene name=FepC
gacagggataaataattatccctgtactttgagcgtata

SEQ ID NO: 13996 - DNA, 47 bp, Xenorhabdus bovienii
  Terminator sequence Name=Xb4151_4152.C440.trmnator70; Position on contig=210069..210115bp; Strand=+; Gene name=CirA
tcaacctttcatcagttctatgatgaaaggttgagctttttgatgtc

SEQ ID NO: 13997 - DNA, 47 bp, Xenorhabdus bovienii
  Terminator sequence Name=Xb4151_4152.C440.trmnator71; Position on contig=210056..210102bp; Strand=-; Gene name=CirA
tcaacctttcatcatagaactgatgaaaggttgatttaatattacat

SEQ ID NO: 13998 - DNA, 30 bp, Xenorhabdus bovienii
  Terminator sequence Name=Xb4151_4152.C440.trmnator72; Position on contig=212084..212113bp; Strand=+; Gene name=PotE
cagcatcttcgggtgctgtttttaattaaa

SEQ ID NO: 13999 - DNA, 54 bp, Xenorhabdus bovienii
  Terminator sequence Name=Xb4151_4152.C440.trmnator73; Position on contig=214010..214063bp; Strand=+; Gene name=GlcD
gaggataaaaaagacaaaacagagaattttgtctttttctttttctgaaataag

SEQ ID NO: 14000 - DNA, 39 bp, Xenorhabdus bovienii
  Terminator sequence Name=Xb4151_4152.C440.trmnator74; Position on contig=216299..216337bp; Strand=+
gcaaccacgccttttgggcgtggttattttgtcagcccc

SEQ ID NO: 14001 - DNA, 40 bp, Xenorhabdus bovienii
  Terminator sequence Name=Xb4151_4152.C440.trmnator75; Position on contig=220685..220724bp; Strand=+
ccattgctattggggtgatagcaaggtgactttatctctt

SEQ ID NO: 14002 - DNA, 47 bp, Xenorhabdus bovienii
  Terminator sequence Name=Xb4151_4152.C440.trmnator76; Position on contig=221838..221884bp; Strand=+; Gene name=RluA
cataccgtcagtgggtttatcccttgacggatgagcatttctgtcag

SEQ ID NO: 14003 - DNA, 42 bp, Xenorhabdus bovienii
  Terminator sequence Name=Xb4151_4152.C440.trmnator77; Position on contig=227016..227057bp; Strand=+
ctgatgtattttttatacaaaaagacacagtttgtggttcga

SEQ ID NO: 14004 - DNA, 45 bp, Xenorhabdus bovienii
  Terminator sequence Name=Xb4151_4152.C441.trmnator1; Position on contig=557..601bp; Strand=+; Gene name=Fur
tactgccgattagctcaagctaatcggcaggctgctttttaaaag

SEQ ID NO: 14005 - DNA, 46 bp, Xenorhabdus bovienii
  Terminator sequence Name=Xb4151_4152.C441.trmnator2; Position on contig=543..588bp; Strand=-; Gene name=Fur
gcctgccgattagcttgagctaatcggcagtagcttattcagacta

SEQ ID NO: 14006 - DNA, 50 bp, Xenorhabdus bovienii
  Terminator sequence Name=Xb4151_4152.C441.trmnator3; Position on contig=3583..3632bp; Strand=-; Gene name=Chb
cattaaaaaggcgcgattattatcgcgctttttttatgtttaaaatattt

SEQ ID NO: 14007 - DNA, 38 bp, Xenorhabdus bovienii
  Terminator sequence Name=Xb4151_4152.C441.trmnator4; Position on contig=5517..5554bp; Strand=-
gatgagcgttaaaccaacagcttattttgttgctcaaa

SEQ ID NO: 14008 - DNA, 43 bp, Xenorhabdus bovienii
  Terminator sequence Name=Xb4151_4152.C441.trmnator5; Position on contig=11407..11449bp; Strand=-
tggggtttctgaaaataatagaatccccatgctttcattatga

SEQ ID NO: 14009 - DNA, 38 bp, Xenorhabdus bovienii
  Terminator sequence Name=Xb4151_4152.C441.trmnator6; Position on contig=15129..15166bp; Strand=+
ggtagtaatgtgttatttactatctgattgttgcctat

SEQ ID NO: 14010 - DNA, 48 bp, Xenorhabdus bovienii
  Terminator sequence Name=Xb4151_4152.C441.trmnator7; Position on contig=18829..18876bp; Strand=-
taaaaaaccctatcggatattgatggggttttctataattttgtgaca

SEQ ID NO: 14011 - DNA, 58 bp, Xenorhabdus bovienii
  Terminator sequence Name=Xb4151_4152.C441.trmnator8; Position on contig=19465..19522bp; Strand=-
tttcattaatttatttattaattacatcaataaataaattaatgaaatgtttttattt

SEQ ID NO: 14012 - DNA, 34 bp, Xenorhabdus bovienii
  Terminator sequence Name=Xb4151_4152.C441.trmnator9; Position on contig=20405..20438bp; Strand=+
cagccctgaaatgccagggctgtattcagttata

SEQ ID NO: 14013 - DNA, 37 bp, Xenorhabdus bovienii
  Terminator sequence Name=Xb4151_4152.C441.trmnator10; Position on contig=20727..20763bp; Strand=-
gcaggcaggattttctgccttgctatttccgataatt

SEQ ID NO: 14014 - DNA, 30 bp, Xenorhabdus bovienii
  Terminator sequence Name=Xb4151_4152.C441.trmnator11; Position on contig=23903..23932bp; Strand=+
ggccctggatccgggccattgattaattag

SEQ ID NO: 14015 - DNA, 30 bp, Xenorhabdus bovienii
  Terminator sequence Name=Xb4151_4152.C441.trmnator12; Position on contig=23890..23919bp; Strand=-
ggcccggatccagggccatttttttaccta

SEQ ID NO: 14016 - DNA, 41 bp, Xenorhabdus bovienii
  Terminator sequence Name=Xb4151_4152.C441.trmnator13; Position on contig=25622..25662bp; Strand=+
tcccaccacagagattgctcggtgcggattttttcccattc

SEQ ID NO: 14017 - DNA, 55 bp, Xenorhabdus bovienii
  Terminator sequence Name=Xb4151_4152.C441.trmnator14; Position on contig=30118..30172bp; Strand=-
ttaaattcagcctctttatccgaatacgaagggtgaatttagttctctcaatacg

SEQ ID NO: 14018 - DNA, 55 bp, Xenorhabdus bovienii
  Terminator sequence Name=Xb4151_4152.C441.trmnator15; Position on contig=31830..31884bp; Strand=+
taatggattgagttctgtgctcaaccggactcaatccattcaatttaattttgat

SEQ ID NO: 14019 - DNA, 38 bp, Xenorhabdus bovienii
  Terminator sequence Name=Xb4151_4152.C441.trmnator16; Position on contig=33895..33932bp; Strand=+
gtagattgcctttcagggcaatctactctatcgcttat

SEQ ID NO: 14020 - DNA, 38 bp, Xenorhabdus bovienii
  Terminator sequence Name=Xb4151_4152.C441.trmnator17; Position on contig=33883..33920bp; Strand=-
gtagattgccctgaaaggcaatctacatgttgtagtat

SEQ ID NO: 14021 - DNA, 41 bp, Xenorhabdus bovienii
  Terminator sequence Name=Xb4151_4152.C441.trmnator18; Position on contig=35408..35448bp; Strand=+
ctttgtaacggttaaaacgttacatgagaattgtttatcat

SEQ ID NO: 14022 - DNA, 33 bp, Xenorhabdus bovienii
  Terminator sequence Name=Xb4151_4152.C441.trmnator19; Position on contig=36398..36430bp; Strand=+
ggcgggattatattacccgcctcttggtgttaa

SEQ ID NO: 14023 - DNA, 37 bp, Xenorhabdus bovienii
  Terminator sequence Name=Xb4151_4152.C441.trmnator20; Position on contig=36384..36420bp; Strand=-
gaggcgggtaatataatcccgccttatttgtggatga

SEQ ID NO: 14024 - DNA, 41 bp, Xenorhabdus bovienii
  Terminator sequence Name=Xb4151_4152.C441.trmnator21; Position on contig=38513..38553bp; Strand=+; Gene name=XerC
ttatcttttgaaaatgttctgaaaggtgatttgagtcataa

SEQ ID NO: 14025 - DNA, 34 bp, Xenorhabdus bovienii
  Terminator sequence Name=Xb4151_4152.C441.trmnator22; Position on contig=38882..38915bp; Strand=+
tcgcgacgaatttcgtcggaacctattgagtgat

SEQ ID NO: 14026 - DNA, 37 bp, Xenorhabdus bovienii
  Terminator sequence Name=Xb4151_4152.C441.trmnator23; Position on contig=39744..39780bp; Strand=-
gcagacctcgaattctgggatctgcttataatttgag

SEQ ID NO: 14027 - DNA, 38 bp, Xenorhabdus bovienii
  Terminator sequence Name=Xb4151_4152.C441.trmnator24; Position on contig=54693..54730bp; Strand=+; Gene name=Qor
gccacgatatgtttataatgtcgggctttatcgccaaa

SEQ ID NO: 14028 - DNA, 33 bp, Xenorhabdus bovienii
  Terminator sequence Name=Xb4151_4152.C441.trmnator25; Position on contig=57162..57194bp; Strand=+; Gene name=AccC
tcccactttaaaaggtgggatttttttataact

SEQ ID NO: 14029 - DNA, 34 bp, Xenorhabdus bovienii
  Terminator sequence Name=Xb4151_4152.C441.trmnator26; Position on contig=57148..57181bp; Strand=-; Gene name=AccC
tcccaccttttaaagtgggattttaatcattcaa

SEQ ID NO: 14030 - DNA, 39 bp, Xenorhabdus bovienii
  Terminator sequence Name=Xb4151_4152.C441.trmnator27; Position on contig=67849..67887bp; Strand=+; Gene name=Fis
gcactttctcttttaggggaagtgctttttttgtttagg

SEQ ID NO: 14031 - DNA, 37 bp, Xenorhabdus bovienii
  Terminator sequence Name=Xb4151_4152.C441.trmnator28; Position on contig=68109..68145bp; Strand=-; Gene name=Fis
cgttgatggggtgacactatcggtgatattattacga

SEQ ID NO: 14032 - DNA, 48 bp, Xenorhabdus bovienii
  Terminator sequence Name=Xb4151_4152.C441.trmnator29; Position on contig=69199..69246bp; Strand=-
tataagaatggcgatttaattcgccattttttatactttctcaacata

SEQ ID NO: 14033 - DNA, 44 bp, Xenorhabdus bovienii
  Terminator sequence Name=Xb4151_4152.C441.trmnator30; Position on contig=70707..70750bp; Strand=+
tgttatagtaatcactaagagttactatgtcatctatattagaa

SEQ ID NO: 14034 - DNA, 36 bp, Xenorhabdus bovienii
  Terminator sequence Name=Xb4151_4152.C441.trmnator31; Position on contig=87698..87733bp; Strand=+; Gene name=ProP
caggatgagcgatggctcatcctgtttaatcgggtt

SEQ ID NO: 14035 - DNA, 38 bp, Xenorhabdus bovienii
  Terminator sequence Name=Xb4151_4152.C441.trmnator32; Position on contig=87684..87721bp; Strand=-; Gene name=ProP
caggatgagccatcgctcatcctgtttttttgtgtcac

SEQ ID NO: 14036 - DNA, 32 bp, Xenorhabdus bovienii
  Terminator sequence Name=Xb4151_4152.C441.trmnator33; Position on contig=90605..90636bp; Strand=+; Gene name=DnaK
gtaacagggcgcctgttacttgttaactaaca

SEQ ID NO: 14037 - DNA, 52 bp, Xenorhabdus bovienii
  Terminator sequence Name=Xb4151_4152.C441.trmnator34; Position on contig=91859..91910bp; Strand=+; Gene name=DnaJ
ttcccttgattatctttttgaactgataatcaggggaatatattcagtagtc

SEQ ID NO: 14038 - DNA, 34 bp, Xenorhabdus bovienii
  Terminator sequence Name=Xb4151_4152.C441.trmnator35; Position on contig=94155..94188bp; Strand=+; Gene name=ClpP
gggtgggcagaagttcacccattatttcatatat

SEQ ID NO: 14039 - DNA, 42 bp, Xenorhabdus bovienii
  Terminator sequence Name=Xb4151_4152.C441.trmnator36; Position on contig=93960..94001bp; Strand=-; Gene name=ClpP
tttatttatacggctgcgtataaataagaattccttagcttc

SEQ ID NO: 14040 - DNA, 64 bp, Xenorhabdus bovienii
  Terminator sequence Name=Xb4151_4152.C441.trmnator37; Position on contig=102231..102294bp; Strand=-
gccagagcgggaattttttgttttatttaaagaaattcccgctattacaggtatgttgtttttt

SEQ ID NO: 14041 - DNA, 61 bp, Xenorhabdus bovienii
  Terminator sequence Name=Xb4151_4152.C441.trmnator38; Position on contig=105669..105729bp; Strand=-
ccgccggaatgaactgtttgtgtgtttttagcagtttattgcggcggtttttctattttta

SEQ ID NO: 14042 - DNA, 31 bp, Xenorhabdus bovienii
  Terminator sequence Name=Xb4151_4152.C441.trmnator39; Position on contig=117363..117393bp; Strand=-
gcggtgtcagtggcaccgcttttaaacaaat

SEQ ID NO: 14043 - DNA, 49 bp, Xenorhabdus bovienii
  Terminator sequence Name=Xb4151_4152.C441.trmnator40; Position on contig=118774..118822bp; Strand=-
gatattaaattattaatctggtggtgatttgaatcggagtttatgtagc

SEQ ID NO: 14044 - DNA, 43 bp, Xenorhabdus bovienii
  Terminator sequence Name=Xb4151_4152.C441.trmnator41; Position on contig=120374..120416bp; Strand=-
tagttgtaatagttactattacatgttcaattatgtttataac

SEQ ID NO: 14045 - DNA, 57 bp, Xenorhabdus bovienii
  Terminator sequence Name=Xb4151_4152.C441.trmnator42; Position on contig=122560..122616bp; Strand=-
taagtcataatcggcttcagataatcatctgaggccggttttttatgtctgaatttt

SEQ ID NO: 14046 - DNA, 45 bp, Xenorhabdus bovienii
  Terminator sequence Name=Xb4151_4152.C441.trmnator43; Position on contig=124011..124055bp; Strand=-; Gene name=SerS
gtgtcggcttggtcagtccgagctgatttcaccacttttttctca

SEQ ID NO: 14047 - DNA, 32 bp, Xenorhabdus bovienii
  Terminator sequence Name=Xb4151_4152.C441.trmnator44; Position on contig=129490..129521bp; Strand=-; Gene name=FtsK
cgctgagcaatcctcagcgttgttccatttaa

SEQ ID NO: 14048 - DNA, 55 bp, Xenorhabdus bovienii
  Terminator sequence Name=Xb4151_4152.C441.trmnator45; Position on contig=130470..130524bp; Strand=-
caagctattgaaaggatttactcaaaatttgtttggtaggttgttctgatttttg

SEQ ID NO: 14049 - DNA, 30 bp, Xenorhabdus bovienii
  Terminator sequence Name=Xb4151_4152.C441.trmnator46; Position on contig=131702..131731bp; Strand=+; Gene name=TrxB
gcgctatttcggtagcgctttttaacaggg

SEQ ID NO: 14050 - DNA, 36 bp, Xenorhabdus bovienii
  Terminator sequence Name=Xb4151_4152.C441.trmnator47; Position on contig=136503..136538bp; Strand=+; Gene name=InfA
tgtggtctgttttatagcaccgcatcttccgatttc

SEQ ID NO: 14051 - DNA, 48 bp, Xenorhabdus bovienii
  Terminator sequence Name=Xb4151_4152.C441.trmnator48; Position on contig=139726..139773bp; Strand=+; Gene name=CspC
cacgccacaaacgaataatggcttatttgtggcgtgctattaatacaa

SEQ ID NO: 14052 - DNA, 37 bp, Xenorhabdus bovienii
  Terminator sequence Name=Xb4151_4152.C441.trmnator49; Position on contig=144535..144571bp; Strand=+; Gene name=ArtM
gatattgctcaagcgcagcaatatcttttgccattgt

SEQ ID NO: 14053 - DNA, 40 bp, Xenorhabdus bovienii
  Terminator sequence Name=Xb4151_4152.C441.trmnator50; Position on contig=150370..150409bp; Strand=+; Gene name=SdaC
tgccagccaacctcacaattgactggcattttcctattta

SEQ ID NO: 14054 - DNA, 37 bp, Xenorhabdus bovienii
  Terminator sequence Name=Xb4151_4152.C441.trmnator51; Position on contig=150215..150251bp; Strand=-; Gene name=SdaC
ccagcatatttgcgcatggctggcactttgtgaatag

SEQ ID NO: 14055 - DNA, 32 bp, Xenorhabdus bovienii
  Terminator sequence Name=Xb4151_4152.C441.trmnator52; Position on contig=152340..152371bp; Strand=-; Gene name=Gst
gagatggacgctctatctcgatgtttagccac

SEQ ID NO: 14056 - DNA, 36 bp, Xenorhabdus bovienii
  Terminator sequence Name=Xb4151_4152.C441.trmnator53; Position on contig=153335..153370bp; Strand=-; Gene name=WcaG
tttgttttataaataaaacgggtgttgtcgttaagg

SEQ ID NO: 14057 - DNA, 48 bp, Xenorhabdus bovienii
  Terminator sequence Name=Xb4151_4152.C441.trmnator54; Position on contig=160844..160891bp; Strand=-; Gene name=HisI
ccctgaacagttctcgttaatcgagcaattcagggtgctttaccttat

SEQ ID NO: 14058 - DNA, 34 bp, Xenorhabdus bovienii
  Terminator sequence Name=Xb4151_4152.C441.trmnator55; Position on contig=162982..163015bp; Strand=+
gggtgctgaacttccagcaccctatttactaaca

SEQ ID NO: 14059 - DNA, 28 bp, Xenorhabdus bovienii
  Terminator sequence Name=Xb4151_4152.C441.trmnator56; Position on contig=166341..166368bp; Strand=+
ccgacataatgtcggttttttcagctct

SEQ ID NO: 14060 - DNA, 46 bp, Xenorhabdus bovienii
  Terminator sequence Name=Xb4151_4152.C441.trmnator57; Position on contig=166319..166364bp; Strand=-
ctgaaaaaaccgacattatgtcggtttttgtcagttagtgatgggt

SEQ ID NO: 14061 - DNA, 34 bp, Xenorhabdus bovienii
  Terminator sequence Name=Xb4151_4152.C441.trmnator58; Position on contig=170082..170115bp; Strand=+
ggtgatcgccgaggcgatcacctttaatattcag

SEQ ID NO: 14062 - DNA, 35 bp, Xenorhabdus bovienii
  Terminator sequence Name=Xb4151_4152.C441.trmnator59; Position on contig=170069..170103bp; Strand=-
ggtgatcgcctcggcgatcacctgatttatgccaa

SEQ ID NO: 14063 - DNA, 36 bp, Xenorhabdus bovienii
  Terminator sequence Name=Xb4151_4152.C441.trmnator60; Position on contig=173556..173591bp; Strand=-; Gene name=Udk
tggctctgtttatacagagccattttttcatttttc

SEQ ID NO: 14064 - DNA, 33 bp, Xenorhabdus bovienii
  Terminator sequence Name=Xb4151_4152.C441.trmnator61; Position on contig=177116..177148bp; Strand=+; Gene name=MetG
gcggactcaaaaaaagtccgctttttaatgtga

SEQ ID NO: 14065 - DNA, 37 bp, Xenorhabdus bovienii
  Terminator sequence Name=Xb4151_4152.C441.trmnator62; Position on contig=181414..181450bp; Strand=+; Gene name=SfcA
gcctgccaacggagttggcaggcttttattaccgcac

SEQ ID NO: 14066 - DNA, 39 bp, Xenorhabdus bovienii
  Terminator sequence Name=Xb4151_4152.C441.trmnator63; Position on contig=182266..182304bp; Strand=+; Gene name=SanA
taagagcctattggataggctcttaccttttcatttaaa

SEQ ID NO: 14067 - DNA, 55 bp, Xenorhabdus bovienii
  Terminator sequence Name=Xb4151_4152.C441.trmnator64; Position on contig=182243..182297bp; Strand=-; Gene name=SanA
gaaaaggtaagagcctatccaataggctcttatgctatttctacgtttattaact

SEQ ID NO: 14068 - DNA, 48 bp, Xenorhabdus bovienii
  Terminator sequence Name=Xb4151_4152.C441.trmnator65; Position on contig=190645..190692bp; Strand=+; Gene name=Icc
taaaaaagcgcttcatatgaggcgcttacttattggttgatacctgat

SEQ ID NO: 14069 - DNA, 45 bp, Xenorhabdus bovienii
  Terminator sequence Name=Xb4151_4152.C441.trmnator66; Position on contig=190632..190676bp; Strand=-; Gene name=Icc
taagtaagcgcctcatatgaagcgcttttttacttgtcgttattg

SEQ ID NO: 14070 - DNA, 43 bp, Xenorhabdus bovienii
  Terminator sequence Name=Xb4151_4152.C441.trmnator67; Position on contig=193758..193800bp; Strand=-; Gene name=MviM
tcactatcagaacaatattctgatagttgatatatttttattt

SEQ ID NO: 14071 - DNA, 28 bp, Xenorhabdus bovienii
  Terminator sequence Name=Xb4151_4152.C441.trmnator68; Position on contig=196087..196114bp; Strand=+; Gene name=Dps
ggccgcatctgcggcctttctgcatcac

SEQ ID NO: 14072 - DNA, 47 bp, Xenorhabdus bovienii
  Terminator sequence Name=Xb4151_4152.C441.trmnator69; Position on contig=197109..197155bp; Strand=-
ttatgctaacttcccgttttggaattaagcataaatatatcctccta

SEQ ID NO: 14073 - DNA, 33 bp, Xenorhabdus bovienii
  Terminator sequence Name=Xb4151_4152.C441.trmnator70; Position on contig=200672..200704bp; Strand=+; Gene name=SseA
gggcattaaaatatcatgccctttttcctatca

SEQ ID NO: 14074 - DNA, 33 bp, Xenorhabdus bovienii
  Terminator sequence Name=Xb4151_4152.C441.trmnator71; Position on contig=200660..200692bp; Strand=-; Gene name=SseA
gggcatgatattttaatgccctttgccgtttta

SEQ ID NO: 14075 - DNA, 35 bp, Xenorhabdus bovienii
  Terminator sequence Name=Xb4151_4152.C441.trmnator72; Position on contig=201302..201336bp; Strand=-
gcggctgggaccaacccagccgctattaaattatc

SEQ ID NO: 14076 - DNA, 49 bp, Xenorhabdus bovienii
  Terminator sequence Name=Xb4151_4152.C441.trmnator73; Position on contig=203989..204037bp; Strand=+
gttttaaagttaatcatatgattgatatattgatggcattttcgaaaat

SEQ ID NO: 14077 - DNA, 28 bp, Xenorhabdus bovienii
  Terminator sequence Name=Xb4151_4152.C441.trmnator74; Position on contig=210052..210079bp; Strand=+
cctgctaatgcaggtttttctcaaaata

SEQ ID NO: 14078 - DNA, 38 bp, Xenorhabdus bovienii
  Terminator sequence Name=Xb4151_4152.C441.trmnator75; Position on contig=210034..210071bp; Strand=-
gaaaaacctgcattagcaggtttttttatattaaaaag

SEQ ID NO: 14079 - DNA, 41 bp, Xenorhabdus bovienii
  unsure (1)..(41): unsure at all n locations
  Terminator sequence Name=Xb4151_4152.C441.trmnator76; Position on contig=210849..210889bp; Strand=-
tctatgctaatgtataacatttgaatagattgtttattntt

SEQ ID NO: 14080 - DNA, 42 bp, Xenorhabdus bovienii
  Terminator sequence Name=Xb4151_4152.C441.trmnator77; Position on contig=214565..214606bp; Strand=+
gtggagagtgatgctattcactctccgcctttcattttattt

SEQ ID NO: 14081 - DNA, 44 bp, Xenorhabdus bovienii
  Terminator sequence Name=Xb4151_4152.C441.trmnator78; Position on contig=214507..214550bp; Strand=-
cttgcaaaatagtcagcccaatttttgcagggtattttcgatag

SEQ ID NO: 14082 - DNA, 32 bp, Xenorhabdus bovienii
  Terminator sequence Name=Xb4151_4152.C441.trmnator79; Position on contig=224217..224248bp; Strand=-
gagccactctttagtggcttttctattatcat

SEQ ID NO: 14083 - DNA, 47 bp, Xenorhabdus bovienii
  Terminator sequence Name=Xb4151_4152.C441.trmnator80; Position on contig=244821..244867bp; Strand=+
caaaaaaaccaacctcaccagttggtttttttgtttcttcctatcta

SEQ ID NO: 14084 - DNA, 61 bp, Xenorhabdus bovienii
  Terminator sequence Name=Xb4151_4152.C441.trmnator81; Position on contig=244800..244860bp; Strand=-
gaagaaacaaaaaaaccaactggtgaggttggtttttttgtttttacttttgatgagtcgt

SEQ ID NO: 14085 - DNA, 50 bp, Xenorhabdus bovienii
  Terminator sequence Name=Xb4151_4152.C441.trmnator82; Position on contig=246191..246240bp; Strand=-
cgtcgggtgttaattaaaagttaatatcacgataaggttattttggtttc

SEQ ID NO: 14086 - DNA, 25 bp, Xenorhabdus bovienii
  Terminator sequence Name=Xb4151_4152.C442.trmnator1; Position on contig=9526..9550bp; Strand=+
gccgctgggcggcttgtctgctgac

SEQ ID NO: 14087 - DNA, 45 bp, Xenorhabdus bovienii
  Terminator sequence Name=Xb4151_4152.C442.trmnator2; Position on contig=10382..10426bp; Strand=-
ggattttattgaattaatttgattaaagaatttttgtcatcttgc

SEQ ID NO: 14088 - DNA, 29 bp, Xenorhabdus bovienii
  Terminator sequence Name=Xb4151_4152.C442.trmnator3; Position on contig=15200..15228bp; Strand=-
ttgaccaatatggtcagttgattgagcgt

SEQ ID NO: 14089 - DNA, 30 bp, Xenorhabdus bovienii
  Terminator sequence Name=Xb4151_4152.C442.trmnator4; Position on contig=17655..17684bp; Strand=-
gccctgtgaaaacagggcctgtttctattt

SEQ ID NO: 14090 - DNA, 42 bp, Xenorhabdus bovienii; identical to SEQ ID NO: 13927
  Terminator sequence Name=Xb4151_4152.C442.trmnator5; Position on contig=18466..18507bp; Strand=-

SEQ ID NO: 14091 - DNA, 34 bp, Xenorhabdus bovienii
  Terminator sequence Name=Xb4151_4152.C442.trmnator6; Position on contig=19262..19295bp; Strand=+
tccggtgaatttccccgccgggtttttcgggagc

SEQ ID NO: 14092 - DNA, 29 bp, Xenorhabdus bovienii
  Terminator sequence Name=Xb4151_4152.C442.trmnator7; Position on contig=23683..23711bp; Strand=-
cagggtgcagccctgacattattttcaca

SEQ ID NO: 14093 - DNA, 28 bp, Xenorhabdus bovienii
  Terminator sequence Name=Xb4151_4152.C442.trmnator8; Position on contig=34026..34053bp; Strand=-
gcgcctttcggggcgctttttttttgtt

SEQ ID NO: 14094 - DNA, 47 bp, Xenorhabdus bovienii
  Terminator sequence Name=Xb4151_4152.C442.trmnator9; Position on contig=35830..35876bp; Strand=-
gggggaactgtgccctgggtgggcagttcctcctgtttattcttatc

SEQ ID NO: 14095 - DNA, 40 bp, Xenorhabdus bovienii
  Terminator sequence Name=Xb4151_4152.C442.trmnator10; Position on contig=36851..36890bp; Strand=-
cgttatcagcccatgaggctgttaacgcttttcttcagcg

SEQ ID NO: 14096 - DNA, 36 bp, Xenorhabdus bovienii
  Terminator sequence Name=Xb4151_4152.C442.trmnator11; Position on contig=38281..38316bp; Strand=+
cagccccctttattgggggctgggatatttaaaatc

SEQ ID NO: 14097 - DNA, 39 bp, Xenorhabdus bovienii
  Terminator sequence Name=Xb4151_4152.C442.trmnator12; Position on contig=56491..56529bp; Strand=+; Gene name=PinR
taggttcagcttgtgctgaatagctagctttgcgttcat

SEQ ID NO: 14098 - DNA, 46 bp, Xenorhabdus bovienii
  Terminator sequence Name=Xb4151_4152.C442.trmnator13; Position on contig=56706..56751bp; Strand=-
gaccccgttagcggcaggagtttaaaggggtccattactatctggt

SEQ ID NO: 14099 - DNA, 40 bp, Xenorhabdus bovienii
  Terminator sequence Name=Xb4151_4152.C442.trmnator14; Position on contig=57082..57121bp; Strand=-
gtgtgactttgtgagataaagttacacattgattggaggt

SEQ ID NO: 14100 - DNA, 34 bp, Xenorhabdus bovienii; identical to SEQ ID NO: 13287
  Terminator sequence Name=Xb4151_4152.C442.trmnator15; Position on contig=58589..58622bp; Strand=+

SEQ ID NO: 14101 - DNA, 42 bp, Xenorhabdus bovienii
  Terminator sequence Name=Xb4151_4152.C442.trmnator16; Position on contig=58411..58452bp; Strand=-
ttaatacatgaccggtatgttaagtattaggctttctattag

SEQ ID NO: 14102 - DNA, 40 bp, Xenorhabdus bovienii
  Terminator sequence Name=Xb4151_4152.C442.trmnator17; Position on contig=59239..59278bp; Strand=-; Gene name=InsB
cggattttggtaaaaagccgagtctgaatttacgtgattc

SEQ ID NO: 14103 - DNA, 41 bp, Xenorhabdus bovienii
  Terminator sequence Name=Xb4151_4152.C442.trmnator18; Position on contig=59700..59740bp; Strand=-
tcccttgttgtagtattaggcagggggtttttgttaccata

SEQ ID NO: 14104 - DNA, 32 bp, Xenorhabdus bovienii
  Terminator sequence Name=Xb4151_4152.C442.trmnator19; Position on contig=63661..63692bp; Strand=-; Gene name=DnaB
tggcgtatactgatgcgctatttcgttcttgt

SEQ ID NO: 14105 - DNA, 31 bp, Xenorhabdus bovienii
  Terminator sequence Name=Xb4151_4152.C442.trmnator20; Position on contig=64549..64579bp; Strand=-
gacctcctatgctgaggtctttttattatat

SEQ ID NO: 14106 - DNA, 45 bp, Xenorhabdus bovienii
  Terminator sequence Name=Xb4151_4152.C442.trmnator21; Position on contig=76245..76289bp; Strand=-
gcatgtttgaagctgccttcaagcaatggacgtgttttggcacat

SEQ ID NO: 14107 - DNA, 33 bp, Xenorhabdus bovienii
  Terminator sequence Name=Xb4151_4152.C442.trmnator22; Position on contig=78849..78881bp; Strand=+
ttctgttcgtgcagagcagggaatttctctaac

SEQ ID NO: 14108 - DNA, 37 bp, Xenorhabdus bovienii
  Terminator sequence Name=Xb4151_4152.C442.trmnator23; Position on contig=78498..78534bp; Strand=-
tacctgtgagacgacatcaggtatgatattggtaatg

SEQ ID NO: 14109 - DNA, 35 bp, Xenorhabdus bovienii
  Terminator sequence Name=Xb4151_4152.C442.trmnator24; Position on contig=79840..79874bp; Strand=-; Gene name=TonB
ggggcgtattcattacgctcctttttatttataaa

SEQ ID NO: 14110 - DNA, 43 bp, Xenorhabdus bovienii
  Terminator sequence Name=Xb4151_4152.C442.trmnator25; Position on contig=80360..80402bp; Strand=-
ggatacctgccgaaacatcggcaggtattgttgtattcaccaa

SEQ ID NO: 14111 - DNA, 41 bp, Xenorhabdus bovienii
  Terminator sequence Name=Xb4151_4152.C442.trmnator26; Position on contig=82940..82980bp; Strand=+; Gene name=SUL1
gctctgtgttcctgttttaaacacagagcttttatggcgct

SEQ ID NO: 14112 - DNA, 52 bp, Xenorhabdus bovienii
  Terminator sequence Name=Xb4151_4152.C442.trmnator27; Position on contig=91574..91625bp; Strand=+
tgttaagcaactggtcgatctaattggctagttgcacaaattttctgtatta

SEQ ID NO: 14113 - DNA, 44 bp, Xenorhabdus bovienii
  Terminator sequence Name=Xb4151_4152.C442.trmnator28; Position on contig=91678..91721bp; Strand=-
tctgatgggggaaagtaacctcccatcagattttttattgcctg

SEQ ID NO: 14114 - DNA, 44 bp, Xenorhabdus bovienii
  Terminator sequence Name=Xb4151_4152.C442.trmnator29; Position on contig=94059..94102bp; Strand=-
gagagccatatctaattttggatatggttctctattgagtgcta

SEQ ID NO: 14115 - DNA, 30 bp, Xenorhabdus bovienii
  Terminator sequence Name=Xb4151_4152.C442.trmnator30; Position on contig=98843..98872bp; Strand=+; Gene name=MltE
ttgtctcgaatgaggcaagttttttcttat

SEQ ID NO: 14116 - DNA, 40 bp, Xenorhabdus bovienii
  Terminator sequence Name=Xb4151_4152.C442.trmnator31; Position on contig=98661..98700bp; Strand=-; Gene name=MltE
gtgtaatctattgattaatagatatcaattattaatgata

SEQ ID NO: 14117 - DNA, 39 bp, Xenorhabdus bovienii
  Terminator sequence Name=Xb4151_4152.C442.trmnator32; Position on contig=107085..107123bp; Strand=+
taattccgtgtgctgtacgggatcactttgatggtgggt

SEQ ID NO: 14118 - DNA, 36 bp, Xenorhabdus bovienii
  Terminator sequence Name=Xb4151_4152.C442.trmnator33; Position on contig=109366..109401bp; Strand=-
tgccattagttaacactggtggcatttttgtatctg

SEQ ID NO: 14119 - DNA, 51 bp, Xenorhabdus bovienii
  Terminator sequence Name=Xb4151_4152.C442.trmnator34; Position on contig=114602..114652bp; Strand=+; Gene name=SmtA
cgctgtaaaccctcgcattgggcgagggtttacagcgcaattgttaatttg

SEQ ID NO: 14120 - DNA, 49 bp, Xenorhabdus bovienii
  Terminator sequence Name=Xb4151_4152.C442.trmnator35; Position on contig=114590..114638bp; Strand=-; Gene name=SmtA
cgctgtaaaccctcgcccaatgcgagggtttacagcggattttggtaaa

SEQ ID NO: 14121 - DNA, 37 bp, Xenorhabdus bovienii
  Terminator sequence Name=Xb4151_4152.C442.trmnator36; Position on contig=116154..116190bp; Strand=+; Gene name=DnaQ
gccctgagtttttaactcggggctttttctttttccg

SEQ ID NO: 14122 - DNA, 69 bp, Xenorhabdus bovienii
  Terminator sequence Name=Xb4151_4152.C442.trmnator37; Position on contig=116050..116118bp; Strand=-; Gene name=DnaQ
cgcgacccccggcgtgacaggccggtattctaaccaactgaactaccgcaccgcatgctgttctggttg

SEQ ID NO: 14123 - DNA, 31 bp, Xenorhabdus bovienii
  Terminator sequence Name=Xb4151_4152.C442.trmnator38; Position on contig=116887..116917bp; Strand=+
tctgagtttttaactcggattttttcttttt

SEQ ID NO: 14124 - DNA, 46 bp, Xenorhabdus bovienii
  Terminator sequence Name=Xb4151_4152.C442.trmnator39; Position on contig=119894..119939bp; Strand=+; Gene name=TktA
gcgcattcgcatcaatatctgagcgaatgcgctctttttttataca

SEQ ID NO: 14125 - DNA, 44 bp, Xenorhabdus bovienii
  Terminator sequence Name=Xb4151_4152.C442.trmnator40; Position on contig=119882..119925bp; Strand=-; Gene name=TktA
gcgcattcgctcagatattgatgcgaatgcgcttatcgtttcgt

SEQ ID NO: 14126 - DNA, 27 bp, Xenorhabdus bovienii
  Terminator sequence Name=Xb4151_4152.C442.trmnator41; Position on contig=122438..122464bp; Strand=+; Gene name=Pgk
gcagcatttgctgcctgttcaatgtca

SEQ ID NO: 14127 - DNA, 47 bp, Xenorhabdus bovienii
  Terminator sequence Name=Xb4151_4152.C442.trmnator42; Position on contig=123651..123697bp; Strand=+; Gene name=Fba
gagctggctaaactttttctgggttagtcagctcaatattaatgata

SEQ ID NO: 14128 - DNA, 46 bp, Xenorhabdus bovienii
  Terminator sequence Name=Xb4151_4152.C442.trmnator43; Position on contig=123639..123684bp; Strand=-; Gene name=Fba
gagctgactaacccagaaaaagtttagccagctcttgtactatttg

SEQ ID NO: 14129 - DNA, 47 bp, Xenorhabdus bovienii
  Terminator sequence Name=Xb4151_4152.C442.trmnator44; Position on contig=127773..127819bp; Strand=-; Gene name=AmpC
tactcttatcggttataaagcgtgataggggtcacaatttctgtata

SEQ ID NO: 14130 - DNA, 40 bp, Xenorhabdus bovienii
  Terminator sequence Name=Xb4151_4152.C442.trmnator45; Position on contig=129400..129439bp; Strand=+; Gene name=UhpC
gacgccattgcctgaacgcagtggcgttttctgcttatct

SEQ ID NO: 14131 - DNA, 39 bp, Xenorhabdus bovienii
  Terminator sequence Name=Xb4151_4152.C442.trmnator46; Position on contig=130389..130427bp; Strand=+; Gene name=CitB
gatgcgcgtttctgaataaacggcatttattgcgtccgg

SEQ ID NO: 14132 - DNA, 32 bp, Xenorhabdus bovienii
  Terminator sequence Name=Xb4151_4152.C442.trmnator47; Position on contig=131278..131309bp; Strand=+
ccgcccactgatggggcggtttatagttattt

SEQ ID NO: 14133 - DNA, 33 bp, Xenorhabdus bovienii
  Terminator sequence Name=Xb4151_4152.C442.trmnator48; Position on contig=131264..131296bp; Strand=-
ccgccccatcagtgggcggttcgtttttagcgc

SEQ ID NO: 14134 - DNA, 50 bp, Xenorhabdus bovienii
  Terminator sequence Name=Xb4151_4152.C442.trmnator49; Position on contig=135996..136045bp; Strand=+; Gene name=PurK
ggaagtggtaatatttgaaaataacttaccacttcctattctagctccag

SEQ ID NO: 14135 - DNA, 40 bp, Xenorhabdus bovienii
  Terminator sequence Name=Xb4151_4152.C442.trmnator50; Position on contig=135988..136027bp; Strand=-; Gene name=PurK
gtggtaagttattttcaaatattaccacttccttgaattc

SEQ ID NO: 14136 - DNA, 35 bp, Xenorhabdus bovienii
  Terminator sequence Name=Xb4151_4152.C442.trmnator51; Position on contig=137515..137549bp; Strand=-; Gene name=Tdh
caacagcatcggtgtgctgcttgtgttcactaatc

SEQ ID NO: 14137 - DNA, 38 bp, Xenorhabdus bovienii
  Terminator sequence Name=Xb4151_4152.C442.trmnator52; Position on contig=139004..139041bp; Strand=+
gctctctgcttggttgagtaaagagctatgtcactcat

SEQ ID NO: 14138 - DNA, 31 bp, Xenorhabdus bovienii
  Terminator sequence Name=Xb4151_4152.C442.trmnator53; Position on contig=139609..139639bp; Strand=+
ctggctggaagcagccgggtttaccactggg

SEQ ID NO: 14139 - DNA, 40 bp, Xenorhabdus bovienii
  Terminator sequence Name=Xb4151_4152.C442.trmnator54; Position on contig=139702..139741bp; Strand=-
gatcccagcccacaagagctgggatcttccttttaaccgt

SEQ ID NO: 14140 - DNA, 37 bp, Xenorhabdus bovienii
  Terminator sequence Name=Xb4151_4152.C442.trmnator55; Position on contig=142858..142894bp; Strand=-
tatctaagttataatgatttggtaattatatggtttt

SEQ ID NO: 14141 - DNA, 42 bp, Xenorhabdus bovienii
  Terminator sequence Name=Xb4151_4152.C442.trmnator56; Position on contig=145071..145112bp; Strand=+; Gene name=PrfB
ttgacggacttatctaatgattcgtcaaaatgtttatggctc

SEQ ID NO: 14142 - DNA, 42 bp, Xenorhabdus bovienii
  Terminator sequence Name=Xb4151_4152.C442.trmnator57; Position on contig=144973..145014bp; Strand=-; Gene name=PrfB
tagagcgacggacacccttcgtcgctctatttatcatcaaat

SEQ ID NO: 14143 - DNA, 42 bp, Xenorhabdus bovienii
  Terminator sequence Name=Xb4151_4152.C442.trmnator58; Position on contig=146551..146592bp; Strand=+
cccgtttaggcaaaatgttgtctgcggggttttttctttttc

SEQ ID NO: 14144 - DNA, 30 bp, Xenorhabdus bovienii
  Terminator sequence Name=Xb4151_4152.C442.trmnator59; Position on contig=146353..146382bp; Strand=-
cgggagtttccactcccgttgattttttgg

SEQ ID NO: 14145 - DNA, 35 bp, Xenorhabdus bovienii
  Terminator sequence Name=Xb4151_4152.C442.trmnator60; Position on contig=148683..148717bp; Strand=-; Gene name=AlsT (BS)
gctggttgtagtccttagccagctttatcgcaata

SEQ ID NO: 14146 - DNA, 49 bp, Xenorhabdus bovienii
  Terminator sequence Name=Xb4151_4152.C442.trmnator61; Position on contig=150042..150090bp; Strand=+; Gene name=AmpD
tatctgtactttgacgaaaatcgtaaggtgtaatgccatattctttacg

SEQ ID NO: 14147 - DNA, 33 bp, Xenorhabdus bovienii
  Terminator sequence Name=Xb4151_4152.C442.trmnator62; Position on contig=149941..149973bp; Strand=-; Gene name=AmpD
gcggccattcgttaaggccgcagtttccttccc

SEQ ID NO: 14148 - DNA, 38 bp, Xenorhabdus bovienii
  Terminator sequence Name=Xb4151_4152.C442.trmnator63; Position on contig=152604..152641bp; Strand=+; Gene name=AnsP
ccagccggatctatttccggctggtcttatgattagtt

SEQ ID NO: 14149 - DNA, 42 bp, Xenorhabdus bovienii
  Terminator sequence Name=Xb4151_4152.C442.trmnator64; Position on contig=153743..153784bp; Strand=+; Gene name=CspC
tttggctggtatttgattactgaccaaatatatttatcatta

SEQ ID NO: 14150 - DNA, 32 bp, Xenorhabdus bovienii
  Terminator sequence Name=Xb4151_4152.C442.trmnator65; Position on contig=154913..154944bp; Strand=+; Gene name=ThiD
gagtggattaattctactccttctttcattga

SEQ ID NO: 14151 - DNA, 41 bp, Xenorhabdus bovienii
  Terminator sequence Name=Xb4151_4152.C442.trmnator66; Position on contig=155425..155465bp; Strand=-; Gene name=ThiD
ggctggctcaatctcccttgagctggccttttctttttatt

SEQ ID NO: 14152 - DNA, 50 bp, Xenorhabdus bovienii
  Terminator sequence Name=Xb4151_4152.C442.trmnator67; Position on contig=157319..157368bp; Strand=+
cggcatcacgctttcaatatagtgagtgtgatgatgaacatttataccaa

SEQ ID NO: 14153 - DNA, 41 bp, Xenorhabdus bovienii
  Terminator sequence Name=Xb4151_4152.C442.trmnator68; Position on contig=167273..167313bp; Strand=-; Gene name=AcrA
cgcaagacagtgatatttattgtcttgcgtttctgattgag

SEQ ID NO: 14154 - DNA, 43 bp, Xenorhabdus bovienii
  Terminator sequence Name=Xb4151_4152.C442.trmnator69; Position on contig=169574..169616bp; Strand=+
tccccctgtaggcgtatgttggcagggggattttttttacaag

SEQ ID NO: 14155 - DNA, 62 bp, Xenorhabdus bovienii
  Terminator sequence Name=Xb4151_4152.C442.trmnator70; Position on contig=173650..173711bp; Strand=+
tatagtaatcaaaaaaagttatcaattgataattttttttgattagtgttttatttttttat

SEQ ID NO: 14156 - DNA, 45 bp, Xenorhabdus bovienii
  Terminator sequence Name=Xb4151_4152.C442.trmnator71; Position on contig=175926..175970bp; Strand=+
ttccttgctcctaatatatcaaggagtaaggaaatgtttggaaga

SEQ ID NO: 14157 - DNA, 49 bp, Xenorhabdus bovienii
  Terminator sequence Name=Xb4151_4152.C442.trmnator72; Position on contig=180635..180683bp; Strand=+
cgattgctgttcaggcgttttgatgctgacgaatcgcatgttagtgcta

SEQ ID NO: 14158 - DNA, 33 bp, Xenorhabdus bovienii
  Terminator sequence Name=Xb4151_4152.C442.trmnator73; Position on contig=181334..181366bp; Strand=+
tggtgcaatctggctgcactatttattagcctc

SEQ ID NO: 14159 - DNA, 40 bp, Xenorhabdus bovienii
  Terminator sequence Name=Xb4151_4152.C442.trmnator74; Position on contig=184424..184463bp; Strand=+
gtcggaagatcacggggatcttccggctgatttcatgata

SEQ ID NO: 14160 - DNA, 46 bp, Xenorhabdus bovienii
  Terminator sequence Name=Xb4151_4152.C442.trmnator75; Position on contig=190110..190155bp; Strand=+
gcaggagaaaaaacatcgtaattttctctttcaaattctgatttca

SEQ ID NO: 14161 - DNA, 48 bp, Xenorhabdus bovienii
  Terminator sequence Name=Xb4151_4152.C442.trmnator76; Position on contig=190156..190203bp; Strand=-
tatttctgccagtagttatcactggcagatgatgatttttttcttata

SEQ ID NO: 14162 - DNA, 32 bp, Xenorhabdus bovienii
  Terminator sequence Name=Xb4151_4152.C442.trmnator77; Position on contig=195059..195090bp; Strand=-
cccctgcctccgggcgggggttttttaaaaga

SEQ ID NO: 14163 - DNA, 50 bp, Xenorhabdus bovienii
  Terminator sequence Name=Xb4151_4152.C442.trmnator78; Position on contig=215025..215074bp; Strand=-; Gene name=Hcp
ttattcagccaatgaatagtattcattggctgaatggttattacttaata

SEQ ID NO: 14164 - DNA, 37 bp, Xenorhabdus bovienii
  Terminator sequence Name=Xb4151_4152.C442.trmnator79; Position on contig=217313..217349bp; Strand=-; Gene name=FhaC
ttgtctctattttgatgggataataatttgcctcggc

SEQ ID NO: 14165 - DNA, 42 bp, Xenorhabdus bovienii
  Terminator sequence Name=Xb4151_4152.C442.trmnator80; Position on contig=221969..222010bp; Strand=+; Gene name=FhaB
gtacggtagcccatcatgcggctaccgtatttgttgcctttt

SEQ ID NO: 14166 - DNA, 30 bp, Xenorhabdus bovienii
  Terminator sequence Name=Xb4151_4152.C442.trmnator81; Position on contig=223213..223242bp; Strand=-
gggcgagcaaattcgccctttacatcgata

SEQ ID NO: 14167 - DNA, 45 bp, Xenorhabdus bovienii
  Terminator sequence Name=Xb4151_4152.C442.trmnator82; Position on contig=226224..226268bp; Strand=+; Gene name=LysR
taaaggagatgtcctgagacaacatctctttcagttttttgttca

SEQ ID NO: 14168 - DNA, 41 bp, Xenorhabdus bovienii
  Terminator sequence Name=Xb4151_4152.C442.trmnator83; Position on contig=226031..226071bp; Strand=-; Gene name=LysR
gtttgataataatctggttattatttgaccttgtgatgcgg

SEQ ID NO: 14169 - DNA, 41 bp, Xenorhabdus bovienii
  Terminator sequence Name=Xb4151_4152.C442.trmnator84; Position on contig=232602..232642bp; Strand=-
ccatcccccagattgttctgtggggatggtttcgcttctct

SEQ ID NO: 14170 - DNA, 33 bp, Xenorhabdus bovienii
  Terminator sequence Name=Xb4151_4152.C443.trmnator1; Position on contig=7788..7820bp; Strand=+; Gene name=PaaJ
cccgcctgtcaggggcgggtttttttattgtta

SEQ ID NO: 14171 - DNA, 42 bp, Xenorhabdus bovienii
  Terminator sequence Name=Xb4151_4152.C443.trmnator2; Position on contig=10910..10951bp; Strand=+; Gene name=NusG
gcaaaaacgggctactttgcccgtttttattatctgtttttt

SEQ ID NO: 14172 - DNA, 28 bp, Xenorhabdus bovienii
  Terminator sequence Name=Xb4151_4152.C443.trmnator3; Position on contig=10905..10932bp; Strand=-; Gene name=NusG
cgggcaaagtagcccgtttttgctgatt

SEQ ID NO: 14173 - DNA, 32 bp, Xenorhabdus bovienii
  Terminator sequence Name=Xb4151_4152.C443.trmnator4; Position on contig=11998..12029bp; Strand=-; Gene name=HemB
cccggcgtattgtcgctgggttttacattagg

SEQ ID NO: 14174 - DNA, 42 bp, Xenorhabdus bovienii
  Terminator sequence Name=Xb4151_4152.C443.trmnator5; Position on contig=13607..13648bp; Strand=-; Gene name=TatA
tgccgtagccttaatagtgtggttgcggtatttttgaacata

SEQ ID NO: 14175 - DNA, 33 bp, Xenorhabdus bovienii
  Terminator sequence Name=Xb4151_4152.C443.trmnator6; Position on contig=19707..19739bp; Strand=-
gggccagaacactctggctcgatctttctgctt

SEQ ID NO: 14176 - DNA, 53 bp, Xenorhabdus bovienii
  Terminator sequence Name=Xb4151_4152.C443.trmnator7; Position on contig=20679..20731bp; Strand=-; Gene name=Udp
ttgatgcttgttgactctgtgacggagtaataagtattggccttatttgaatc

SEQ ID NO: 14177 - DNA, 45 bp, Xenorhabdus bovienii
  Terminator sequence Name=Xb4151_4152.C443.trmnator8; Position on contig=26922..26966bp; Strand=-; Gene name=NhaP
ctttaataactttaatatttatggttattacggctgttattagag

SEQ ID NO: 14178 - DNA, 38 bp, Xenorhabdus bovienii
  Terminator sequence Name=Xb4151_4152.C443.trmnator9; Position on contig=28553..28590bp; Strand=-
gtggctgtactaatgagtacagcaccaattttaagtat

SEQ ID NO: 14179 - DNA, 43 bp, Xenorhabdus bovienii
  Terminator sequence Name=Xb4151_4152.C443.trmnator10; Position on contig=31904..31946bp; Strand=+
ccgaatgaaactcacgctattttattcgagagtcttcttttta

SEQ ID NO: 14180 - DNA, 41 bp, Xenorhabdus bovienii
  Terminator sequence Name=Xb4151_4152.C443.trmnator11; Position on contig=33477..33517bp; Strand=+
tggcatatcacgatagcgcgatactgccgtatgtattaata

SEQ ID NO: 14181 - DNA, 38 bp, Xenorhabdus bovienii
  Terminator sequence Name=Xb4151_4152.C443.trmnator12; Position on contig=38602..38639bp; Strand=+; Gene name=TolC
ctaccaccgactaaagtcggtggtagtttagtaattca

SEQ ID NO: 14182 - DNA, 38 bp, Xenorhabdus bovienii
  Terminator sequence Name=Xb4151_4152.C443.trmnator13; Position on contig=38590..38627bp; Strand=-; Gene name=TolC
ctaccaccgactttagtcggtggtagtttagtaaatgg

SEQ ID NO: 14183 - DNA, 60 bp, Xenorhabdus bovienii
  Terminator sequence Name=Xb4151_4152.C443.trmnator14; Position on contig=38961..39020bp; Strand=-
tataaaagcaaagtgtgatttcaatgttgaatgagctttgcttttttattatttaacctc

SEQ ID NO: 14184 - DNA, 44 bp, Xenorhabdus bovienii
  Terminator sequence Name=Xb4151_4152.C443.trmnator15; Position on contig=41428..41471bp; Strand=-; Gene name=ET17
caccggtatcaatatctgttgataccggtgttttattatttctt

SEQ ID NO: 14185 - DNA, 38 bp, Xenorhabdus bovienii
  Terminator sequence Name=Xb4151_4152.C443.trmnator16; Position on contig=44734..44771bp; Strand=+; Gene name=RhaT
tgatgggggcaatctttcccccatcattattaactttg

SEQ ID NO: 14186 - DNA, 30 bp, Xenorhabdus bovienii
  Terminator sequence Name=Xb4151_4152.C443.trmnator17; Position on contig=46511..46540bp; Strand=-
ggctggtttttaccggcctttgcataatat

SEQ ID NO: 14187 - DNA, 29 bp, Xenorhabdus bovienii
  Terminator sequence Name=Xb4151_4152.C443.trmnator18; Position on contig=50539..50567bp; Strand=-
ggagcgggtggctcccctttttaatctgt

SEQ ID NO: 14188 - DNA, 33 bp, Xenorhabdus bovienii
  Terminator sequence Name=Xb4151_4152.C443.trmnator19; Position on contig=51819..51851bp; Strand=-
cgtggtcacaagctggccacgtcttcactttat

SEQ ID NO: 14189 - DNA, 31 bp, Xenorhabdus bovienii
  Terminator sequence Name=Xb4151_4152.C443.trmnator20; Position on contig=55241..55271bp; Strand=+
ctcacctccaaaaggtgagttcatttgaaca

SEQ ID NO: 14190 - DNA, 36 bp, Xenorhabdus bovienii
  Terminator sequence Name=Xb4151_4152.C443.trmnator21; Position on contig=56090..56125bp; Strand=+; Gene name=DnaC
taacccctgattacaggggcttacaatttatttatc

SEQ ID NO: 14191 - DNA, 36 bp, Xenorhabdus bovienii
  Terminator sequence Name=Xb4151_4152.C443.trmnator22; Position on contig=56077..56112bp; Strand=-; Gene name=DnaC
taagcccctgtaatcaggggttattttagtcattta

SEQ ID NO: 14192 - DNA, 41 bp, Xenorhabdus bovienii
  Terminator sequence Name=Xb4151_4152.C443.trmnator23; Position on contig=58729..58769bp; Strand=-
gatgggggtggaatttgtcgccactatcacgtttgatgcag

SEQ ID NO: 14193 - DNA, 34 bp, Xenorhabdus bovienii; identical to SEQ ID NO: 13287
  Terminator sequence Name=Xb4151_4152.C443.trmnator24; Position on contig=59854..59887bp; Strand=+

SEQ ID NO: 14194 - DNA, 34 bp, Xenorhabdus bovienii
  Terminator sequence Name=Xb4151_4152.C443.trmnator25; Position on contig=59676..59709bp; Strand=-
tgaccgctttttagcggcttaagttatccattta

SEQ ID NO: 14195 - DNA, 67 bp, Xenorhabdus bovienii
  Terminator sequence Name=Xb4151_4152.C443.trmnator26; Position on contig=61391..61457bp; Strand=+
tagcacgcaattatgccagtacgttagcactggcgtttaccattgtgtggctgcctatgtgggttga

SEQ ID NO: 14196 - DNA, 49 bp, Xenorhabdus bovienii
  Terminator sequence Name=Xb4151_4152.C443.trmnator27; Position on contig=62222..62270bp; Strand=+
tggcgtcagtctacccttttggggatgactaacgccgttctactgacgt

SEQ ID NO: 14197 - DNA, 31 bp, Xenorhabdus bovienii
  Terminator sequence Name=Xb4151_4152.C443.trmnator28; Position on contig=70048..70078bp; Strand=+
ggtatccttgtgggtatcattattggcgctg

SEQ ID NO: 14198 - DNA, 46 bp, Xenorhabdus bovienii
  Terminator sequence Name=Xb4151_4152.C443.trmnator29; Position on contig=69851..69896bp; Strand=-
gagcgtttttaatgggaaaggattagatatgctttttttttcgaca

SEQ ID NO: 14199 - DNA, 52 bp, Xenorhabdus bovienii
  Terminator sequence Name=Xb4151_4152.C443.trmnator30; Position on contig=71414..71465bp; Strand=+; Gene name=AmpC
tcacagcctgagatttgtaagtgtaaagctcaggctgtgatttgtgatgaac

SEQ ID NO: 14200 - DNA, 52 bp, Xenorhabdus bovienii
  Terminator sequence Name=Xb4151_4152.C443.trmnator31; Position on contig=71402..71453bp; Strand=-; Gene name=AmpC
tcacagcctgagctttacacttacaaatctcaggctgtgatttttcaagaac

SEQ ID NO: 14201 - DNA, 36 bp, Xenorhabdus bovienii
  Terminator sequence Name=Xb4151_4152.C443.trmnator32; Position on contig=75514..75549bp; Strand=+; Gene name=PepB
gggtattgcggctgcaatacccttttgtatcgcttt

SEQ ID NO: 14202 - DNA, 36 bp, Xenorhabdus bovienii
  Terminator sequence Name=Xb4151_4152.C443.trmnator33; Position on contig=79000..79035bp; Strand=+; Gene name=ValS
gccactgcatttagttgcagtggcttttttcatagt

SEQ ID NO: 14203 - DNA, 36 bp, Xenorhabdus bovienii
  Terminator sequence Name=Xb4151_4152.C443.trmnator34; Position on contig=78988..79023bp; Strand=-; Gene name=ValS
gccactgcaactaaatgcagtggcttatacttgaat

SEQ ID NO: 14204 - DNA, 36 bp, Xenorhabdus bovienii
  Terminator sequence Name=Xb4151_4152.C443.trmnator35; Position on contig=79924..79959bp; Strand=-; Gene name=MazF
gaaagtacggaagccgatacttttccttttatttta

SEQ ID NO: 14205 - DNA, 41 bp, Xenorhabdus bovienii
  Terminator sequence Name=Xb4151_4152.C443.trmnator36; Position on contig=82536..82576bp; Strand=+; Gene name=ArtI
ttatgggtgttttttaattattcataaaccatttaaattaa

SEQ ID NO: 14206 - DNA, 38 bp, Xenorhabdus bovienii
  Terminator sequence Name=Xb4151_4152.C443.trmnator37; Position on contig=83921..83958bp; Strand=-; Gene name=Tra8
gatgatattgcaatacaatgccatctttatataaaata

SEQ ID NO: 14207 - DNA, 33 bp, Xenorhabdus bovienii
  Terminator sequence Name=Xb4151_4152.C443.trmnator38; Position on contig=87182..87214bp; Strand=+; Gene name=WecD
gccccacagaccaagtggggcatttatttcgac

SEQ ID NO: 14208 - DNA, 32 bp, Xenorhabdus bovienii
  Terminator sequence Name=Xb4151_4152.C443.trmnator39; Position on contig=88922..88953bp; Strand=+; Gene name=ArgF
gcggtgcgaataagcaccgctttttgtttttc

SEQ ID NO: 14209 - DNA, 33 bp, Xenorhabdus bovienii
  Terminator sequence Name=Xb4151_4152.C443.trmnator40; Position on contig=88679..88711bp; Strand=-; Gene name=ArgF
tggaggaacttcacctccgggttctccgtcagt

SEQ ID NO: 14210 - DNA, 30 bp, Xenorhabdus bovienii
  Terminator sequence Name=Xb4151_4152.C443.trmnator41; Position on contig=91691..91720bp; Strand=+
gccgcctgagtaggcggctttaacttagag

SEQ ID NO: 14211 - DNA, 30 bp, Xenorhabdus bovienii
  Terminator sequence Name=Xb4151_4152.C443.trmnator42; Position on contig=91679..91708bp; Strand=-
gccgcctactcaggcggctttaactttttt

SEQ ID NO: 14212 - DNA, 32 bp, Xenorhabdus bovienii
  Terminator sequence Name=Xb4151_4152.C443.trmnator43; Position on contig=100650..100681bp; Strand=+
gtcaccatttttaggtgacatattaacatttt

SEQ ID NO: 14213 - DNA, 39 bp, Xenorhabdus bovienii
  Terminator sequence Name=Xb4151_4152.C443.trmnator44; Position on contig=111991..112029bp; Strand=+
tggtattgattatataaatcagtaccattctacttatag

SEQ ID NO: 14214 - DNA, 33 bp, Xenorhabdus bovienii
  Terminator sequence Name=Xb4151_4152.C443.trmnator45; Position on contig=115908..115940bp; Strand=+; Gene name=PyrB
cgcctcctgattggaggcgtatttctcattgag

SEQ ID NO: 14215 - DNA, 31 bp, Xenorhabdus bovienii
  Terminator sequence Name=Xb4151_4152.C443.trmnator46; Position on contig=115896..115926bp; Strand=-; Gene name=PyrB
cgcctccaatcaggaggcgttatcagattcg

SEQ ID NO: 14216 - DNA, 34 bp, Xenorhabdus bovienii
  Terminator sequence Name=Xb4151_4152.C443.trmnator47; Position on contig=118606..118639bp; Strand=-
ttgaggcctaaacgtctcaatcgttatcgtaagc

SEQ ID NO: 14217 - DNA, 42 bp, Xenorhabdus bovienii
  Terminator sequence Name=Xb4151_4152.C443.trmnator48; Position on contig=122282..122323bp; Strand=+; Gene name=TdcF
cagctctgatagcttcagtatcagagctgtaatttcctcgat

SEQ ID NO: 14218 - DNA, 38 bp, Xenorhabdus bovienii
  Terminator sequence Name=Xb4151_4152.C443.trmnator49; Position on contig=122853..122890bp; Strand=-
cgtggctggctgaatatccagttgtgttctgatatgaa

SEQ ID NO: 14219 - DNA, 47 bp, Xenorhabdus bovienii
  Terminator sequence Name=Xb4151_4152.C443.trmnator50; Position on contig=123569..123615bp; Strand=-
tgttaatggcccttttccttttaaggctttggcaccttttccagaca

SEQ ID NO: 14220 - DNA, 51 bp, Xenorhabdus bovienii
  Terminator sequence Name=Xb4151_4152.C443.trmnator51; Position on contig=126878..126928bp; Strand=-
tgagttggagccagcatatttgctggctctatatttcatttaatctaggag

SEQ ID NO: 14221 - DNA, 39 bp, Xenorhabdus bovienii
  Terminator sequence Name=Xb4151_4152.C443.trmnator52; Position on contig=127312..127350bp; Strand=-
gccgacctctgtactatagggtcggctttaatcaataga

SEQ ID NO: 14222 - DNA, 52 bp, Xenorhabdus bovienii
  Terminator sequence Name=Xb4151_4152.C443.trmnator53; Position on contig=129592..129643bp; Strand=-; Gene name=LysR
gaacaagtcgggatgattatcagtttaccggcttgttcagctatttttccca

SEQ ID NO: 14223 - DNA, 42 bp, Xenorhabdus bovienii
  Terminator sequence Name=Xb4151_4152.C443.trmnator54; Position on contig=132475..132516bp; Strand=-
gaccggaagatcaccatgatctgtccggttttgtagctattt

SEQ ID NO: 14224 - DNA, 37 bp, Xenorhabdus bovienii
  Terminator sequence Name=Xb4151_4152.C443.trmnator55; Position on contig=133276..133312bp; Strand=-; Gene name=XerC
tgacattctgctcaaacagaatgtatttaattaaagt

SEQ ID NO: 14225 - DNA, 38 bp, Xenorhabdus bovienii
  Terminator sequence Name=Xb4151_4152.C443.trmnator56; Position on contig=139755..139792bp; Strand=+; Gene name=LytT
gccccttctctgttaggaaaaggggctttatcttcaag

SEQ ID NO: 14226 - DNA, 39 bp, Xenorhabdus bovienii
  Terminator sequence Name=Xb4151_4152.C443.trmnator57; Position on contig=139742..139780bp; Strand=-; Gene name=LytT
gccccttttcctaacagagaaggggctttttaatattga

SEQ ID NO: 14227 - DNA, 42 bp, Xenorhabdus bovienii
  Terminator sequence Name=Xb4151_4152.C443.trmnator58; Position on contig=141914..141955bp; Strand=-; Gene name=SrmB
taagtccacatcttgataggtgggggcttgtttgttcgttta

SEQ ID NO: 14228 - DNA, 58 bp, Xenorhabdus bovienii
  Terminator sequence Name=Xb4151_4152.C443.trmnator59; Position on contig=142937..142994bp; Strand=-; Gene name=NrfG
ttgacgtaaagaacggcgtcctgtaaaaagggcgccgtttagtcaattttgggcagga

SEQ ID NO: 14229 - DNA, 31 bp, Xenorhabdus bovienii
  Terminator sequence Name=Xb4151_4152.C443.trmnator60; Position on contig=145341..145371bp; Strand=+
ggggccctattaggccccttttcactgaaac

SEQ ID NO: 14230 - DNA, 32 bp, Xenorhabdus bovienii
  Terminator sequence Name=Xb4151_4152.C443.trmnator61; Position on contig=145327..145358bp; Strand=-
ggggcctaatagggccccttttcttctaggaa

SEQ ID NO: 14231 - DNA, 55 bp, Xenorhabdus bovienii
  Terminator sequence Name=Xb4151_4152.C443.trmnator62; Position on contig=145704..145758bp; Strand=-; Gene name=RpsO
gggctgtcttgcgcttcccctatttgcagcgtagaatagcgcgtctatatgtgag

SEQ ID NO: 14232 - DNA, 47 bp, Xenorhabdus bovienii
  Terminator sequence Name=Xb4151_4152.C443.trmnator63; Position on contig=155394..155440bp; Strand=-; Gene name=FolP
tacagactgttgcccttggatttgacagactgtacttattaaacccc

SEQ ID NO: 14233 - DNA, 40 bp, Xenorhabdus bovienii
  Terminator sequence Name=Xb4151_4152.C443.trmnator64; Position on contig=158537..158576bp; Strand=+
taaaaaaggccatctcaggccttttttatttccatatcag

SEQ ID NO: 14234 - DNA, 46 bp, Xenorhabdus bovienii
  Terminator sequence Name=Xb4151_4152.C443.trmnator65; Position on contig=160854..160899bp; Strand=+; Gene name=DacB
gaaaaagggcgcttaaaaagcgcccttttatcattcttatacatca

SEQ ID NO: 14235 - DNA, 52 bp, Xenorhabdus bovienii
  Terminator sequence Name=Xb4151_4152.C443.trmnator66; Position on contig=160835..160886bp; Strand=-; Gene name=DacB
tgataaaagggcgctttttaagcgccctttttcgatcaatgattttggtata

SEQ ID NO: 14236 - DNA, 39 bp, Xenorhabdus bovienii
  Terminator sequence Name=Xb4151_4152.C443.trmnator67; Position on contig=162398..162436bp; Strand=+
caaaacgttttacacccagacgtttgctttcagaatcgc

SEQ ID NO: 14237 - DNA, 34 bp, Xenorhabdus bovienii
  Terminator sequence Name=Xb4151_4152.C443.trmnator68; Position on contig=162290..162323bp; Strand=-
ggttgtggtcgtgaccacaccctgttcgcattag

SEQ ID NO: 14238 - DNA, 45 bp, Xenorhabdus bovienii
  Terminator sequence Name=Xb4151_4152.C443.trmnator69; Position on contig=164041..164085bp; Strand=+; Gene name=IspA
cagtatcccagattgctcaatctgggatactgtctttattttcaa

SEQ ID NO: 14239 - DNA, 33 bp, Xenorhabdus bovienii
  Terminator sequence Name=Xb4151_4152.C443.trmnator70; Position on contig=164465..164497bp; Strand=-
gccaaatgtttaaaatttggcttcctctacact

SEQ ID NO: 14240 - DNA, 48 bp, Xenorhabdus bovienii
  Terminator sequence Name=Xb4151_4152.C443.trmnator71; Position on contig=165336..165383bp; Strand=+; Gene name=Nlp
gaaaaaccgctagttatttttgagctagcggtttcagttatctaatat

SEQ ID NO: 14241 - DNA, 45 bp, Xenorhabdus bovienii
  Terminator sequence Name=Xb4151_4152.C443.trmnator72; Position on contig=165326..165370bp; Strand=-; Gene name=Nlp
gaaaccgctagctcaaaaataactagcggtttttctttcaataat

SEQ ID NO: 14242 - DNA, 41 bp, Xenorhabdus bovienii
  Terminator sequence Name=Xb4151_4152.C443.trmnator73; Position on contig=167430..167470bp; Strand=-; Gene name=ArgR
gggggatcgcattagctgtgcgatcctctttaatctatata

SEQ ID NO: 14243 - DNA, 30 bp, Xenorhabdus bovienii
  Terminator sequence Name=Xb4151_4152.C443.trmnator74; Position on contig=170072..170101bp; Strand=+; Gene name=Fbp
ggggcgaagtgtcgcctctttattaacaac

SEQ ID NO: 14244 - DNA, 53 bp, Xenorhabdus bovienii
  Terminator sequence Name=Xb4151_4152.C443.trmnator75; Position on contig=171012..171064bp; Strand=+; Gene name=Ppa
taaaaaacctctgccaccacatagaggcagaggtttttatttattcttcttcg

SEQ ID NO: 14245 - DNA, 40 bp, Xenorhabdus bovienii
  Terminator sequence Name=Xb4151_4152.C443.trmnator76; Position on contig=171005..171044bp; Strand=-; Gene name=Ppa
cctctgcctctatgtggtggcagaggttttttatgaccaa

SEQ ID NO: 14246 - DNA, 37 bp, Xenorhabdus bovienii
  Terminator sequence Name=Xb4151_4152.C443.trmnator77; Position on contig=177740..177776bp; Strand=+; Gene name=MsrA
tcttacggtaaaatgccgtaagattttatttgtataa

SEQ ID NO: 14247 - DNA, 26 bp, Xenorhabdus bovienii
  Terminator sequence Name=Xb4151_4152.C443.trmnator78; Position on contig=179196..179221bp; Strand=+
cggccgcgaggccgttaattatactc

SEQ ID NO: 14248 - DNA, 28 bp, Xenorhabdus bovienii
  Terminator sequence Name=Xb4151_4152.C443.trmnator79; Position on contig=179182..179209bp; Strand=-
cggcctcgcggccgtttttgatcggatt

SEQ ID NO: 14249 - DNA, 47 bp, Xenorhabdus bovienii
  Terminator sequence Name=Xb4151_4152.C443.trmnator80; Position on contig=180402..180448bp; Strand=+
gtcataatggttccaaaacaggaaccattatcaccttaataatgaag

SEQ ID NO: 14250 - DNA, 32 bp, Xenorhabdus bovienii
  Terminator sequence Name=Xb4151_4152.C443.trmnator81; Position on contig=180397..180428bp; Strand=-
tggttcctgttttggaaccattatgactaaat

SEQ ID NO: 14251 - DNA, 48 bp, Xenorhabdus bovienii
  Terminator sequence Name=Xb4151_4152.C443.trmnator82; Position on contig=181282..181329bp; Strand=-
ccataaaatagccggttatccggctatttttttgcgcgttttttgaga

SEQ ID NO: 14252 - DNA, 42 bp, Xenorhabdus bovienii
  Terminator sequence Name=Xb4151_4152.C443.trmnator83; Position on contig=183731..183772bp; Strand=-; Gene name=RpsF
tgtcccgcatgatacatttcattggggcattattggaattaa

SEQ ID NO: 14253 - DNA, 32 bp, Xenorhabdus bovienii
  Terminator sequence Name=Xb4151_4152.C443.trmnator84; Position on contig=184555..184586bp; Strand=-; Gene name=SpoU
gggcggcttctgctgccctccatttttcaggt

SEQ ID NO: 14254 - DNA, 39 bp, Xenorhabdus bovienii
  Terminator sequence Name=Xb4151_4152.C443.trmnator85; Position on contig=193151..193189bp; Strand=-; Gene name=HflX
cataggtagggagactttacctatgttttttcctatgga

SEQ ID NO: 14255 - DNA, 34 bp, Xenorhabdus bovienii
  Terminator sequence Name=Xb4151_4152.C443.trmnator86; Position on contig=199751..199784bp; Strand=-
tgtctgttgatcaacaaggcatttttattttatt

SEQ ID NO: 14256 - DNA, 31 bp, Xenorhabdus bovienii
  Terminator sequence Name=Xb4151_4152.C443.trmnator87; Position on contig=200550..200580bp; Strand=+
gcgccggaatagttggcgcttttccgacagg

SEQ ID NO: 14257 - DNA, 36 bp, Xenorhabdus bovienii
  Terminator sequence Name=Xb4151_4152.C443.trmnator88; Position on contig=200428..200463bp; Strand=-
ggtcaatattctggatattggtcacgtttttctggt

SEQ ID NO: 14258 - DNA, 27 bp, Xenorhabdus bovienii
  Terminator sequence Name=Xb4151_4152.C443.trmnator89; Position on contig=214130..214156bp; Strand=+
ggacctttcggtccttttttctgtggc

SEQ ID NO: 14259 - DNA, 51 bp, Xenorhabdus bovienii
  Terminator sequence Name=Xb4151_4152.C443.trmnator90; Position on contig=219641..219691bp; Strand=-
tataagccggaaagatccctgtgatcttccggctttattttttggacgcgc

SEQ ID NO: 14260 - DNA, 42 bp, Xenorhabdus bovienii
  Terminator sequence Name=Xb4151_4152.C443.trmnator91; Position on contig=221352..221393bp; Strand=-; Gene name=RhsA
gccggaaagatccctgtgatcttccggctttattttttggac

SEQ ID NO: 14261 - DNA, 33 bp, Xenorhabdus bovienii
  Terminator sequence Name=Xb4151_4152.C443.trmnator92; Position on contig=223729..223761bp; Strand=-
gacccacatgtaatgggtcgttttttcagacgt

SEQ ID NO: 14262 - DNA, 35 bp, Xenorhabdus bovienii
  Terminator sequence Name=Xb4151_4152.C443.trmnator93; Position on contig=224633..224667bp; Strand=+; Gene name=InsB
tatcagtgggtttctcatgatgtttcttcagaaaa

SEQ ID NO: 14263 - DNA, 44 bp, Xenorhabdus bovienii
  Terminator sequence Name=Xb4151_4152.C443.trmnator94; Position on contig=225680..225723bp; Strand=+
caaaaggtgagcacaaactgtgttcacctgacttcgtatagagt

SEQ ID NO: 14264 - DNA, 47 bp, Xenorhabdus bovienii
  Terminator sequence Name=Xb4151_4152.C443.trmnator95; Position on contig=226015..226061bp; Strand=-
caatgaatggagaggcactatcctctccattattgtttaaatttata

SEQ ID NO: 14265 - DNA, 35 bp, Xenorhabdus bovienii
  Terminator sequence Name=Xb4151_4152.C443.trmnator96; Position on contig=229982..230016bp; Strand=+
caagggctcctttggggcccttgtttgtctggaga

SEQ ID NO: 14266 - DNA, 39 bp, Xenorhabdus bovienii
  Terminator sequence Name=Xb4151_4152.C443.trmnator97; Position on contig=232971..233009bp; Strand=+; Gene name=FecB
gctgcacctgatattttcaggtgcagtttatcctttaaa

SEQ ID NO: 14267 - DNA, 37 bp, Xenorhabdus bovienii
  Terminator sequence Name=Xb4151_4152.C443.trmnator98; Position on contig=237886..237922bp; Strand=-
cccaacaactcacgttgttgtcggctttgctcatgag

SEQ ID NO: 14268 - DNA, 44 bp, Xenorhabdus bovienii
  Terminator sequence Name=Xb4151_4152.C443.trmnator99; Position on contig=242479..242522bp; Strand=+
tgatgctgttatattaatataacagcattgtctttaaagtttgt

SEQ ID NO: 14269 - DNA, 43 bp, Xenorhabdus bovienii
  Terminator sequence Name=Xb4151_4152.C443.trmnator100; Position on contig=242468..242510bp; Strand=-
gacaatgctgttatattaatataacagcatcattttttatcta

SEQ ID NO: 14270 - DNA, 39 bp, Xenorhabdus bovienii
  Terminator sequence Name=Xb4151_4152.C443.trmnator101; Position on contig=244533..244571bp; Strand=+; Gene name=LysR
tgccagttttagcggaaactggccggtctgttgtttcaa

SEQ ID NO: 14271 - DNA, 36 bp, Xenorhabdus bovienii
  Terminator sequence Name=Xb4151_4152.C443.trmnator102; Position on contig=246920..246955bp; Strand=+; Gene name=LysA
tacggggaattttgtgtccccgtattctcgattact

SEQ ID NO: 14272 - DNA, 42 bp, Xenorhabdus bovienii
  Terminator sequence Name=Xb4151_4152.C443.trmnator103; Position on contig=246905..246946bp; Strand=-; Gene name=LysA
gaatacggggacacaaaattccccgtattttatttataccgc

SEQ ID NO: 14273 - DNA, 34 bp, Xenorhabdus bovienii
  Terminator sequence Name=Xb4151_4152.C443.trmnator104; Position on contig=251107..251140bp; Strand=+
ctattacgttgacagtggtaggtttgctattttt

SEQ ID NO: 14274 - DNA, 54 bp, Xenorhabdus bovienii
  Terminator sequence Name=Xb4151_4152.C443.trmnator105; Position on contig=252634..252687bp; Strand=+
caaattaatagcgcgataatagcggctattgggctttaattgtttaaggttaac

SEQ ID NO: 14275 - DNA, 39 bp, Xenorhabdus bovienii; identical to SEQ ID NO: 13348
  Terminator sequence Name=Xb4151_4152.C443.trmnator106; Position on contig=252220..252258bp; Strand=-

SEQ ID NO: 14276 - DNA, 50 bp, Xenorhabdus bovienii
  Terminator sequence Name=Xb4151_4152.C443.trmnator107; Position on contig=253025..253074bp; Strand=-
tgctatatttgtattcagcgcattgtcaatatatggcaactttcaatccg

SEQ ID NO: 14277 - DNA, 42 bp, Xenorhabdus bovienii
  Terminator sequence Name=Xb4151_4152.C443.trmnator108; Position on contig=261691..261732bp; Strand=+; Gene name=InsB
cagccattaatcaatatatagatttggctgatttagttcagc

SEQ ID NO: 14278 - DNA, 32 bp, Xenorhabdus bovienii
  Terminator sequence Name=Xb4151_4152.C443.trmnator109; Position on contig=262106..262137bp; Strand=+
tcatctttcatggaggtgatctctttttcgct

SEQ ID NO: 14279 - DNA, 31 bp, Xenorhabdus bovienii
  Terminator sequence Name=Xb4151_4152.C443.trmnator110; Position on contig=264695..264725bp; Strand=-
cccacttaataggtgggttttttactgccct

SEQ ID NO: 14280 - DNA, 38 bp, Xenorhabdus bovienii
  Terminator sequence Name=Xb4151_4152.C443.trmnator111; Position on contig=265273..265310bp; Strand=-
ctgggtcgtacaggataccgatccggttttttgtcttg

SEQ ID NO: 14281 - DNA, 56 bp, Xenorhabdus bovienii
  Terminator sequence Name=Xb4151_4152.C443.trmnator112; Position on contig=276675..276730bp; Strand=+; Gene name=MgtE
ggagaaacgccgatttataaatgatatcggcgttttcgatcctgtttctaaatttg

SEQ ID NO: 14282 - DNA, 31 bp, Xenorhabdus bovienii
  Terminator sequence Name=Xb4151_4152.C443.trmnator113; Position on contig=277317..277347bp; Strand=-
ggtgggaatttctcaccttttaattcaatcc

SEQ ID NO: 14283 - DNA, 30 bp, Xenorhabdus bovienii
  Terminator sequence Name=Xb4151_4152.C444.trmnator1; Position on contig=893..922bp; Strand=-
cgtctgttccgacaggcgtttttttatgac

SEQ ID NO: 14284 - DNA, 40 bp, Xenorhabdus bovienii
  Terminator sequence Name=Xb4151_4152.C444.trmnator2; Position on contig=4830..4869bp; Strand=-; Gene name=DnaG
gccgtgctttccccaaaggaagcgcggcttattctcgttc

SEQ ID NO: 14285 - DNA, 35 bp, Xenorhabdus bovienii
  Terminator sequence Name=Xb4151_4152.C444.trmnator3; Position on contig=6627..6661bp; Strand=+; Gene name=QRI7
tgatcgctaaactttagcgatcattgtatcgagta

SEQ ID NO: 14286 - DNA, 56 bp, Xenorhabdus bovienii
  Terminator sequence Name=Xb4151_4152.C444.trmnator4; Position on contig=7717..7772bp; Strand=-; Gene name=SmtA
tgatatccgccatttttatattaaataaaaatggcggatatcaatattatctgata

SEQ ID NO: 14287 - DNA, 45 bp, Xenorhabdus bovienii
  Terminator sequence Name=Xb4151_4152.C444.trmnator5; Position on contig=9158..9202bp; Strand=+; Gene name=FolB
gcgcctcaaattgatagattatttggagcgcttttatcaattacc

SEQ ID NO: 14288 - DNA, 45 bp, Xenorhabdus bovienii
  Terminator sequence Name=Xb4151_4152.C444.trmnator6; Position on contig=9144..9188bp; Strand=-; Gene name=FolB
gcgctccaaataatctatcaatttgaggcgcttttttaatgcagg

SEQ ID NO: 14289 - DNA, 42 bp, Xenorhabdus bovienii
  Terminator sequence Name=Xb4151_4152.C444.trmnator7; Position on contig=15220..15261bp; Strand=+; Gene name=GlnE
cctgctggatcttgctggcattcagttaggttatggtaatat

SEQ ID NO: 14290 - DNA, 46 bp, Xenorhabdus bovienii
  Terminator sequence Name=Xb4151_4152.C444.trmnator8; Position on contig=16747..16792bp; Strand=+; Gene name=RfaE
tgccgttatgtttcttgtgggacataaacggcattgtctaagttat

SEQ ID NO: 14291 - DNA, 43 bp, Xenorhabdus bovienii
  Terminator sequence Name=Xb4151_4152.C444.trmnator9; Position on contig=16700..16742bp; Strand=-; Gene name=RfaE
gacgcggtaagatgcggtaaacttactggtttttaatagcgtt

SEQ ID NO: 14292 - DNA, 48 bp, Xenorhabdus bovienii
  Terminator sequence Name=Xb4151_4152.C444.trmnator10; Position on contig=18335..18382bp; Strand=+; Gene name=RibB
ttgaaaggccgcagtccaccccctgcggccttcagtatttttgaaata

SEQ ID NO: 14293 - DNA, 46 bp, Xenorhabdus bovienii
  Terminator sequence Name=Xb4151_4152.C444.trmnator11; Position on contig=19452..19497bp; Strand=+
gcagggcatggaattgctgtacgatcatgccttctttcccataggg

SEQ ID NO: 14294 - DNA, 31 bp, Xenorhabdus bovienii
  Terminator sequence Name=Xb4151_4152.C444.trmnator12; Position on contig=21234..21264bp; Strand=-
gcccgcccattgtgtgggctattttttaaga

SEQ ID NO: 14295 - DNA, 54 bp, Xenorhabdus bovienii
  Terminator sequence Name=Xb4151_4152.C444.trmnator13; Position on contig=23269..23322bp; Strand=-; Gene name=MutT
gttcctcccgggctggaaaggtagctcagggcaggctgacaacgtttgacttca

SEQ ID NO: 14296 - DNA, 35 bp, Xenorhabdus bovienii
  Terminator sequence Name=Xb4151_4152.C444.trmnator14; Position on contig=29430..29464bp; Strand=+; Gene name=GyrA
caggccagatttattctggcctgctttataagagg

SEQ ID NO: 14297 - DNA, 53 bp, Xenorhabdus bovienii
  Terminator sequence Name=Xb4151_4152.C444.trmnator15; Position on contig=30258..30310bp; Strand=+; Gene name=PlsC
cggattctggctataaatttaagatagttttagagtttgcactttattcgcga

SEQ ID NO: 14298 - DNA, 34 bp, Xenorhabdus bovienii
  Terminator sequence Name=Xb4151_4152.C444.trmnator16; Position on contig=31968..32001bp; Strand=+; Gene name=SufI
gccctgtcagagcagatggggctgttatttcaga

SEQ ID NO: 14299 - DNA, 27 bp, Xenorhabdus bovienii
  Terminator sequence Name=Xb4151_4152.C444.trmnator17; Position on contig=37101..37127bp; Strand=-; Gene name=SurA
cccgccaaggcgggattgatatgatgg

SEQ ID NO: 14300 - DNA, 36 bp, Xenorhabdus bovienii
  Terminator sequence Name=Xb4151_4152.C444.trmnator18; Position on contig=40375..40410bp; Strand=-; Gene name=DjlA
tggcggtaagccttttgccaccagtttatcgggatg

SEQ ID NO: 14301 - DNA, 36 bp, Xenorhabdus bovienii
  Terminator sequence Name=Xb4151_4152.C444.trmnator19; Position on contig=41220..41255bp; Strand=-; Gene name=RluA
ggggcgatctcgatgagatgcccctgtattttaatc

SEQ ID NO: 14302 - DNA, 48 bp, Xenorhabdus bovienii
  Terminator sequence Name=Xb4151_4152.C444.trmnator20; Position on contig=48353..48400bp; Strand=+
ttaaaggtggctattcagatggccacctaattcagtattgttttaatg

SEQ ID NO: 14303 - DNA, 42 bp, Xenorhabdus bovienii
  Terminator sequence Name=Xb4151_4152.C444.trmnator21; Position on contig=48829..48870bp; Strand=-
gccggaaatatccttaatcttctttccggctattcatattca

SEQ ID NO: 14304 - DNA, 49 bp, Xenorhabdus bovienii
  Terminator sequence Name=Xb4151_4152.C444.trmnator22; Position on contig=50643..50691bp; Strand=-; Gene name=InsB
ttgcagtacaactctaccattaaagtttttctgcaatttatatgcatta

SEQ ID NO: 14305 - DNA, 63 bp, Xenorhabdus bovienii
  Terminator sequence Name=Xb4151_4152.C444.trmnator23; Position on contig=53435..53497bp; Strand=-; Gene name=XerC
ctatgattaaaaaaccctgcttggtaatatcggcggggttttttagcaagttattactgataa

SEQ ID NO: 14306 - DNA, 39 bp, Xenorhabdus bovienii
  Terminator sequence Name=Xb4151_4152.C444.trmnator24; Position on contig=54098..54136bp; Strand=-; Gene name=TerZ
gatcgggcaggtgtgcctgcccgatactttaaaatacta

SEQ ID NO: 14307 - DNA, 48 bp, Xenorhabdus bovienii
  Terminator sequence Name=Xb4151_4152.C444.trmnator25; Position on contig=63262..63309bp; Strand=+
tggataatgacataccacatcagtttattgtccggaatatttttggca

SEQ ID NO: 14308 - DNA, 48 bp, Xenorhabdus bovienii
  Terminator sequence Name=Xb4151_4152.C444.trmnator26; Position on contig=63111..63158bp; Strand=-
tgatgccagttgatcacagtcaactggcataacgatgatttatctttt

SEQ ID NO: 14309 - DNA, 49 bp, Xenorhabdus bovienii
  Terminator sequence Name=Xb4151_4152.C444.trmnator27; Position on contig=64089..64137bp; Strand=-
tggtatatgtttcgaaagattatttttccatataccattactacgttaa

SEQ ID NO: 14310 - DNA, 51 bp, Xenorhabdus bovienii
  Terminator sequence Name=Xb4151_4152.C444.trmnator28; Position on contig=68582..68632bp; Strand=+; Gene name=AprE (BS)
tattgtattcaggccaatgactggcctgaatacaataaatttaagatcata

SEQ ID NO: 14311 - DNA, 53 bp, Xenorhabdus bovienii
  Terminator sequence Name=Xb4151_4152.C444.trmnator29; Position on contig=69908..69960bp; Strand=+
tgaccgtcgataaataactttatgtttatcgacggtatatattaatcactact

SEQ ID NO: 14312 - DNA, 51 bp, Xenorhabdus bovienii
  unsure (1)..(51): unsure at all n locations
  Terminator sequence Name=Xb4151_4152.C444.trmnator30; Position on contig=71169..71219bp; Strand=-; Gene name=AraJ
nnnnnnnnnnnnnnnnnnnnnnnnnnnnnnnnnnnnntaatttctgatata

SEQ ID NO: 14313 - DNA, 33 bp, Xenorhabdus bovienii
  Terminator sequence Name=Xb4151_4152.C444.trmnator31; Position on contig=73404..73436bp; Strand=+
taataggataagtgcctattattcgttaatcat

SEQ ID NO: 14314 - DNA, 34 bp, Xenorhabdus bovienii
  Terminator sequence Name=Xb4151_4152.C444.trmnator32; Position on contig=73523..73556bp; Strand=-
tcgggatgtactgacatcccgatttcaaatattc

SEQ ID NO: 14315 - DNA, 53 bp, Xenorhabdus bovienii
  Terminator sequence Name=Xb4151_4152.C444.trmnator33; Position on contig=78090..78142bp; Strand=+
tacttattgatataaaagggactttatatcatatggctgtattttgggtatcg

SEQ ID NO: 14316 - DNA, 47 bp, Xenorhabdus bovienii
  Terminator sequence Name=Xb4151_4152.C444.trmnator34; Position on contig=79947..79993bp; Strand=+
cttaccaaatatatatggagtactgttggtgaggatttgaagtcaga

SEQ ID NO: 14317 - DNA, 52 bp, Xenorhabdus bovienii
  Terminator sequence Name=Xb4151_4152.C444.trmnator35; Position on contig=80197..80248bp; Strand=-
tgggtaatcagctcaacccgcattttcagctggttatccatttgatagccat

SEQ ID NO: 14318 - DNA, 30 bp, Xenorhabdus bovienii
  Terminator sequence Name=Xb4151_4152.C444.trmnator36; Position on contig=85135..85164bp; Strand=-
gcgcgccagatggcgcgctttttcatttta

SEQ ID NO: 14319 - DNA, 38 bp, Xenorhabdus bovienii
  Terminator sequence Name=Xb4151_4152.C444.trmnator37; Position on contig=90090..90127bp; Strand=+; Gene name=HrpA
ggggctgtaggtaactcaacagccccgtatttacattg

SEQ ID NO: 14320 - DNA, 44 bp, Xenorhabdus bovienii
  Terminator sequence Name=Xb4151_4152.C444.trmnator38; Position on contig=107950..107993bp; Strand=+
cacgatagctgttttttccagcatattcagtggtttttgtcctt

SEQ ID NO: 14321 - DNA, 44 bp, Xenorhabdus bovienii
  Terminator sequence Name=Xb4151_4152.C444.trmnator39; Position on contig=107813..107856bp; Strand=-
taaggagagaatcatcaacttctctccttaatttttttggttga

SEQ ID NO: 14322 - DNA, 44 bp, Xenorhabdus bovienii
  Terminator sequence Name=Xb4151_4152.C444.trmnator40; Position on contig=109552..109595bp; Strand=-
gaaaaggtacaaatcatcatttgtgcctttttattattgccaaa

SEQ ID NO: 14323 - DNA, 38 bp, Xenorhabdus bovienii
  Terminator sequence Name=Xb4151_4152.C444.trmnator41; Position on contig=113894..113931bp; Strand=+; Gene name=PntB
gagcttcatgttgtggcatgaagcttttttaatgaaat

SEQ ID NO: 14324 - DNA, 34 bp, Xenorhabdus bovienii
  Terminator sequence Name=Xb4151_4152.C444.trmnator42; Position on contig=113884..113917bp; Strand=-; Gene name=PntB
gcttcatgccacaacatgaagctctctaatatca

SEQ ID NO: 14325 - DNA, 35 bp, Xenorhabdus bovienii
  Terminator sequence Name=Xb4151_4152.C444.trmnator43; Position on contig=115436..115470bp; Strand=-; Gene name=XerC
gccagctcctttatgagactggtttttttctgcct

SEQ ID NO: 14326 - DNA, 41 bp, Xenorhabdus bovienii
  Terminator sequence Name=Xb4151_4152.C444.trmnator44; Position on contig=116529..116569bp; Strand=-; Gene name=UspA
gccggatcgctatattttgctgatctggctttcttttaccc

SEQ ID NO: 14327 - DNA, 40 bp, Xenorhabdus bovienii
  Terminator sequence Name=Xb4151_4152.C444.trmnator45; Position on contig=119959..119998bp; Strand=+; Gene name=GadB
ggcttggagagtaacgcttccaagccttttttattactta

SEQ ID NO: 14328 - DNA, 37 bp, Xenorhabdus bovienii
  Terminator sequence Name=Xb4151_4152.C444.trmnator46; Position on contig=125594..125630bp; Strand=+
tgccgaaatattattatccggcatttttgctattaat

SEQ ID NO: 14329 - DNA, 25 bp, Xenorhabdus bovienii
  Terminator sequence Name=Xb4151_4152.C444.trmnator47; Position on contig=152198..152222bp; Strand=-; Gene name=EntF
ggggcatagcccctattcagatata

SEQ ID NO: 14330 - DNA, 36 bp, Xenorhabdus bovienii
  Terminator sequence Name=Xb4151_4152.C444.trmnator48; Position on contig=153698..153733bp; Strand=+
ggaattgagatttatcccaatttcttttataaaaaa

SEQ ID NO: 14331 - DNA, 50 bp, Xenorhabdus bovienii
  Terminator sequence Name=Xb4151_4152.C444.trmnator49; Position on contig=155195..155244bp; Strand=+; Gene name=OmpA
taattaaaaaccccatgttaacatggggttttattgtttctgtctatagc

SEQ ID NO: 14332 - DNA, 32 bp, Xenorhabdus bovienii
  Terminator sequence Name=Xb4151_4152.C444.trmnator50; Position on contig=155191..155222bp; Strand=-; Gene name=OmpA
ccccatgttaacatggggtttttaattaaata

SEQ ID NO: 14333 - DNA, 39 bp, Xenorhabdus bovienii
  Terminator sequence Name=Xb4151_4152.C444.trmnator51; Position on contig=158276..158314bp; Strand=+; Gene name=FabA
tcacctccgctactgcggcggaggtgattatcctaatga

SEQ ID NO: 14334 - DNA, 43 bp, Xenorhabdus bovienii
  Terminator sequence Name=Xb4151_4152.C444.trmnator52; Position on contig=168488..168530bp; Strand=-
gagttgggggtttatttctactctcaactcgtctatattttgt

SEQ ID NO: 14335 - DNA, 34 bp, Xenorhabdus bovienii
  Terminator sequence Name=Xb4151_4152.C444.trmnator53; Position on contig=169671..169704bp; Strand=-; Gene name=PyrD
tcctccggcgttggccggaggatatttaccagca

SEQ ID NO: 14336 - DNA, 37 bp, Xenorhabdus bovienii
  Terminator sequence Name=Xb4151_4152.C444.trmnator54; Position on contig=175601..175637bp; Strand=+; Gene name=AsnS
gaaaagtcaacgaaagttggcttttttcattttatga

SEQ ID NO: 14337 - DNA, 45 bp, Xenorhabdus bovienii
  Terminator sequence Name=Xb4151_4152.C444.trmnator55; Position on contig=177042..177086bp; Strand=+; Gene name=OmpC
tgaaaagcagcgcttaggcgctgcttttttacgttttactttact

SEQ ID NO: 14338 - DNA, 31 bp, Xenorhabdus bovienii
  Terminator sequence Name=Xb4151_4152.C444.trmnator56; Position on contig=178466..178496bp; Strand=+; Gene name=TyrB
gccgctgaaaaagcggcttttatcttccgaa

SEQ ID NO: 14339 - DNA, 40 bp, Xenorhabdus bovienii
  Terminator sequence Name=Xb4151_4152.C444.trmnator57; Position on contig=178468..178507bp; Strand=-; Gene name=TyrB
gtttttaattgttcggaagataaaagccgctttttcagcg

SEQ ID NO: 14340 - DNA, 51 bp, Xenorhabdus bovienii
  Terminator sequence Name=Xb4151_4152.C444.trmnator58; Position on contig=180056..180106bp; Strand=-
gtacagtgagggaaatagcgctaatttcctcactgttattttctccttatc

SEQ ID NO: 14341 - DNA, 31 bp, Xenorhabdus bovienii
  Terminator sequence Name=Xb4151_4152.C444.trmnator59; Position on contig=182062..182092bp; Strand=-
gaggcacttaaggtgcctttttcttttttag

SEQ ID NO: 14342 - DNA, 52 bp, Xenorhabdus bovienii
  Terminator sequence Name=Xb4151_4152.C444.trmnator60; Position on contig=192165..192216bp; Strand=+
gaaaaaagagaatgccgcagaagcggcattctcttttgactgttataccgga

SEQ ID NO: 14343 - DNA, 40 bp, Xenorhabdus bovienii
  Terminator sequence Name=Xb4151_4152.C444.trmnator61; Position on contig=192158..192197bp; Strand=-
gagaatgccgcttctgcggcattctcttttttcagtatga

SEQ ID NO: 14344 - DNA, 31 bp, Xenorhabdus bovienii
  Terminator sequence Name=Xb4151_4152.C444.trmnator62; Position on contig=198535..198565bp; Strand=-; Gene name=ComEC (BS)
cggcaccttggggtgccgtttttttgtgatt

SEQ ID NO: 14345 - DNA, 28 bp, Xenorhabdus bovienii
  Terminator sequence Name=Xb4151_4152.C444.trmnator63; Position on contig=201034..201061bp; Strand=+
tgcgcctgcgggcgcgttcttccgcact

SEQ ID NO: 14346 - DNA, 31 bp, Xenorhabdus bovienii
  Terminator sequence Name=Xb4151_4152.C444.trmnator64; Position on contig=201562..201592bp; Strand=-; Gene name=Cmk
ctgctcattaattgagcagttttctgcaatc

SEQ ID NO: 14347 - DNA, 46 bp, Xenorhabdus bovienii
  Terminator sequence Name=Xb4151_4152.C444.trmnator65; Position on contig=203053..203098bp; Strand=-; Gene name=AroA
ttattatcgggaggaatgaaacctcccgatgtgaatattcctcact

SEQ ID NO: 14348 - DNA, 41 bp, Xenorhabdus bovienii
  Terminator sequence Name=Xb4151_4152.C444.trmnator66; Position on contig=204539..204579bp; Strand=-; Gene name=SerC
cagaaagacgcctttaatgcgtctttctgtatttaagttca

SEQ ID NO: 14349 - DNA, 41 bp, Xenorhabdus bovienii
  Terminator sequence Name=Xb4151_4152.C444.trmnator67; Position on contig=211195..211235bp; Strand=+; Gene name=PflD
taaaggccccttcacaattggggcctttattatcctgtcag

SEQ ID NO: 14350 - DNA, 41 bp, Xenorhabdus bovienii
  Terminator sequence Name=Xb4151_4152.C444.trmnator68; Position on contig=212027..212067bp; Strand=+; Gene name=PflA
cctgactaaaaatttaatttcagtcaggtttttctaaaaaa

SEQ ID NO: 14351 - DNA, 42 bp, Xenorhabdus bovienii
  Terminator sequence Name=Xb4151_4152.C444.trmnator69; Position on contig=212013..212054bp; Strand=-; Gene name=PflA
cctgactgaaattaaatttttagtcaggttatattaaatgaa

SEQ ID NO: 14352 - DNA, 43 bp, Xenorhabdus bovienii
  Terminator sequence Name=Xb4151_4152.C444.trmnator70; Position on contig=216427..216469bp; Strand=+
tacttgatttcaattggctggattaagtgttttattaatcaat

SEQ ID NO: 14353 - DNA, 29 bp, Xenorhabdus bovienii
  Terminator sequence Name=Xb4151_4152.C444.trmnator71; Position on contig=221234..221262bp; Strand=+
gggcgtaatatacgcccttttttatgtgt

SEQ ID NO: 14354 - DNA, 36 bp, Xenorhabdus bovienii
  Terminator sequence Name=Xb4151_4152.C444.trmnator72; Position on contig=223066..223101bp; Strand=+; Gene name=PckA
gaccctatctggctggatagggttttttcattcatc

SEQ ID NO: 14355 - DNA, 32 bp, Xenorhabdus bovienii
  Terminator sequence Name=Xb4151_4152.C444.trmnator73; Position on contig=223056..223087bp; Strand=-; Gene name=PckA
ccctatccagccagatagggtcttacgtggtt

SEQ ID NO: 14356 - DNA, 38 bp, Xenorhabdus bovienii
  Terminator sequence Name=Xb4151_4152.C444.trmnator74; Position on contig=226382..226419bp; Strand=+; Gene name=UraA
gaagggttttaaagaacaaacccttctttttttgactc

SEQ ID NO: 14357 - DNA, 53 bp, Xenorhabdus bovienii
  Terminator sequence Name=Xb4151_4152.C444.trmnator75; Position on contig=227662..227714bp; Strand=+; Gene name=DnaA
ggaaaaaagtgatagtgaatatgtccctatcacttttttgtttgtatgatttt

SEQ ID NO: 14358 - DNA, 39 bp, Xenorhabdus bovienii
  Terminator sequence Name=Xb4151_4152.C444.trmnator76; Position on contig=227656..227694bp; Strand=-; Gene name=DnaA
gtgatagggacatattcactatcacttttttcctgttcc

SEQ ID NO: 14359 - DNA, 33 bp, Xenorhabdus bovienii
  Terminator sequence Name=Xb4151_4152.C444.trmnator77; Position on contig=230050..230082bp; Strand=-
tccccctgtcaaacagggggaatttcgctatct

SEQ ID NO: 14360 - DNA, 35 bp, Xenorhabdus bovienii
  Terminator sequence Name=Xb4151_4152.C444.trmnator78; Position on contig=233353..233387bp; Strand=+; Gene name=NlpB
taaaggggccaaggcccctttatagtttgggtaaa

SEQ ID NO: 14361 - DNA, 41 bp, Xenorhabdus bovienii
  Terminator sequence Name=Xb4151_4152.C444.trmnator79; Position on contig=234187..234227bp; Strand=+; Gene name=PurC
gatatcctacactaaagtcgtggggtatctttgatcgcgat

SEQ ID NO: 14362 - DNA, 46 bp, Xenorhabdus bovienii
  Terminator sequence Name=Xb4151_4152.C444.trmnator80; Position on contig=234269..234314bp; Strand=-; Gene name=PurC
tctgggtagtcaatcaagctattggctatcctgaatatttcctatt

SEQ ID NO: 14363 - DNA, 48 bp, Xenorhabdus bovienii
  Terminator sequence Name=Xb4151_4152.C444.trmnator81; Position on contig=236914..236961bp; Strand=+
tcatttccccctagtttcttgttagggggaatatgactgttgttttta

SEQ ID NO: 14364 - DNA, 58 bp, Xenorhabdus bovienii
  Terminator sequence Name=Xb4151_4152.C444.trmnator82; Position on contig=246184..246241bp; Strand=+
ccaaagtgggtgtgagaatgttatctttcacacccactattcaggatattgcttcagg

SEQ ID NO: 14365 - DNA, 41 bp, Xenorhabdus bovienii; identical to SEQ ID NO: 13378
  Terminator sequence Name=Xb4151_4152.C444.trmnator83; Position on contig=246889..246929bp; Strand=+

SEQ ID NO: 14366 - DNA, 39 bp, Xenorhabdus bovienii; identical to SEQ ID NO: 13379
  Terminator sequence Name=Xb4151_4152.C444.trmnator84; Position on contig=247287..247325bp; Strand=-

SEQ ID NO: 14367 - DNA, 44 bp, Xenorhabdus bovienii
  Terminator sequence Name=Xb4151_4152.C444.trmnator85; Position on contig=254195..254238bp; Strand=-
tagactttgttggtagtgccaataaagtctattttttatacaac

SEQ ID NO: 14368 - DNA, 54 bp, Xenorhabdus bovienii
  Terminator sequence Name=Xb4151_4152.C444.trmnator86; Position on contig=259113..259166bp; Strand=+
tgacaaatgggaaacctcatatgaacggtttcccatttattattaatagttcgg

SEQ ID NO: 14369 - DNA, 40 bp, Xenorhabdus bovienii
  Terminator sequence Name=Xb4151_4152.C444.trmnator87; Position on contig=259108..259147bp; Strand=-
tgggaaaccgttcatatgaggtttcccatttgtcaaagga

SEQ ID NO: 14370 - DNA, 37 bp, Xenorhabdus bovienii
  Terminator sequence Name=Xb4151_4152.C444.trmnator88; Position on contig=271041..271077bp; Strand=+; Gene name=EbsC
gaccacctatcttacaggtggtctttttatacagata

SEQ ID NO: 14371 - DNA, 49 bp, Xenorhabdus bovienii
  Terminator sequence Name=Xb4151_4152.C444.trmnator89; Position on contig=271021..271069bp; Strand=-; Gene name=EbsC
taaaaagaccacctgtaagataggtggtctttacttattatgctgagtg

SEQ ID NO: 14372 - DNA, 45 bp, Xenorhabdus bovienii
  Terminator sequence Name=Xb4151_4152.C444.trmnator90; Position on contig=272992..273036bp; Strand=+
ggttttattttatttttatgggataagtatcaaattatatcaatg

SEQ ID NO: 14373 - DNA, 40 bp, Xenorhabdus bovienii
  Terminator sequence Name=Xb4151_4152.C444.trmnator91; Position on contig=276188..276227bp; Strand=-; Gene name=KefB
cgggagtgcatcagccatcgctcttgctatttcatgttca

SEQ ID NO: 14374 - DNA, 45 bp, Xenorhabdus bovienii
  Terminator sequence Name=Xb4151_4152.C444.trmnator92; Position on contig=277750..277794bp; Strand=-; Gene name=RbsK
tgacagccaatgctgcaatagcattggctgttgttcgttatggcg

SEQ ID NO: 14375 - DNA, 35 bp, Xenorhabdus bovienii
  Terminator sequence Name=Xb4151_4152.C444.trmnator93; Position on contig=280190..280224bp; Strand=-; Gene name=HemH
caggcggtgttaataaccgcctgatttttttgaat

SEQ ID NO: 14376 - DNA, 50 bp, Xenorhabdus bovienii
  Terminator sequence Name=Xb4151_4152.C444.trmnator94; Position on contig=281015..281064bp; Strand=-; Gene name=Adk
tagaccacgcttcaacgtaaaattgggcgtggtttatttttaggtcaata

SEQ ID NO: 14377 - DNA, 42 bp, Xenorhabdus bovienii
  Terminator sequence Name=Xb4151_4152.C444.trmnator95; Position on contig=283200..283241bp; Strand=+
gtgaatgggacaacgttgtaccatccaccatttcaagttccc

SEQ ID NO: 14378 - DNA, 51 bp, Xenorhabdus bovienii
  Terminator sequence Name=Xb4151_4152.C444.trmnator96; Position on contig=283088..283138bp; Strand=-
caatggatggtgttgcggataacgccaccatccatagctgatttgtacatt

SEQ ID NO: 14379 - DNA, 43 bp, Xenorhabdus bovienii
  Terminator sequence Name=Xb4151_4152.C444.trmnator97; Position on contig=287788..287830bp; Strand=+
catctggatggtggctaccaccgttcaatgacttctgtacctc

SEQ ID NO: 14380 - DNA, 29 bp, Xenorhabdus bovienii
  Terminator sequence Name=Xb4151_4152.C444.trmnator98; Position on contig=296549..296577bp; Strand=+; Gene name=AcrB
ggccactgatgtggccttttaaaatgggc

SEQ ID NO: 14381 - DNA, 49 bp, Xenorhabdus bovienii
  Terminator sequence Name=Xb4151_4152.C444.trmnator99; Position on contig=298737..298785bp; Strand=-
tgtcgtgtgccatactatatctacggcacacgatattattttcgtttgc

SEQ ID NO: 14382 - DNA, 54 bp, Xenorhabdus bovienii
  Terminator sequence Name=Xb4151_4152.C444.trmnator100; Position on contig=300567..300620bp; Strand=-; Gene name=GlnK
gtgcataaaaggagtgactgctctagtcactccttttttactttcctttcccag

SEQ ID NO: 14383 - DNA, 40 bp, Xenorhabdus bovienii
  Terminator sequence Name=Xb4151_4152.C444.trmnator101; Position on contig=304156..304195bp; Strand=-; Gene name=MdlB
tgatggagttaatgctaattctttcatttttactttggga

SEQ ID NO: 14384 - DNA, 36 bp, Xenorhabdus bovienii
  Terminator sequence Name=Xb4151_4152.C444.trmnator102; Position on contig=306613..306648bp; Strand=+
tgagaggctgccaagcctctcactattttaaacttt

SEQ ID NO: 14385 - DNA, 39 bp, Xenorhabdus bovienii
  Terminator sequence Name=Xb4151_4152.C444.trmnator103; Position on contig=309666..309704bp; Strand=-; Gene name=SurA
gcgcaccaaccaattggttgatgcgctttttttctctta

SEQ ID NO: 14386 - DNA, 43 bp, Xenorhabdus bovienii
  Terminator sequence Name=Xb4151_4152.C444.trmnator104; Position on contig=310218..310260bp; Strand=-; Gene name=HimA
ggttggcgagtttattaagacttgccagcctttttttgtctca

SEQ ID NO: 14387 - DNA, 40 bp, Xenorhabdus bovienii
  Terminator sequence Name=Xb4151_4152.C444.trmnator105; Position on contig=312782..312821bp; Strand=-; Gene name=Lon
taaaaatgagggattctccctcattttgctttttgcaggc

SEQ ID NO: 14388 - DNA, 42 bp, Xenorhabdus bovienii
  Terminator sequence Name=Xb4151_4152.C444.trmnator106; Position on contig=315077..315118bp; Strand=-; Gene name=ClpP
gcaaacccgcaggctatgcttgcgggtttttttattgtcctt

SEQ ID NO: 14389 - DNA, 27 bp, Xenorhabdus bovienii
  Terminator sequence Name=Xb4151_4152.C444.trmnator107; Position on contig=316758..316784bp; Strand=-
cagccttcgggctgtatttttgtatat

SEQ ID NO: 14390 - DNA, 56 bp, Xenorhabdus bovienii
  Terminator sequence Name=Xb4151_4152.C444.trmnator108; Position on contig=319620..319675bp; Strand=+; Gene name=ProP
tgaaaaagccaaaggttggcagggttcaacctttggctgccttattttagtgataa

SEQ ID NO: 14391 - DNA, 38 bp, Xenorhabdus bovienii
  Terminator sequence Name=Xb4151_4152.C444.trmnator109; Position on contig=325757..325794bp; Strand=+; Gene name=CyoE
gagggcagggttttccccctgctcttttttcctttccc

SEQ ID NO: 14392 - DNA, 47 bp, Xenorhabdus bovienii
  Terminator sequence Name=Xb4151_4152.C444.trmnator110; Position on contig=327329..327375bp; Strand=+; Gene name=ProP
gtacggtgcatagaaataataccctagcaccgtactatgtctgtatt

SEQ ID NO: 14393 - DNA, 52 bp, Xenorhabdus bovienii
  Terminator sequence Name=Xb4151_4152.C444.trmnator111; Position on contig=327314..327365bp; Strand=-; Gene name=ProP
tagtacggtgctagggtattatttctatgcaccgtactgttctattacaaac

SEQ ID NO: 14394 - DNA, 40 bp, Xenorhabdus bovienii
  Terminator sequence Name=Xb4151_4152.C444.trmnator112; Position on contig=328921..328960bp; Strand=-; Gene name=ChiA
gaagttatatagttagacatgtaattctaattttaaataa

SEQ ID NO: 14395 - DNA, 42 bp, Xenorhabdus bovienii
  Terminator sequence Name=Xb4151_4152.C444.trmnator113; Position on contig=331016..331057bp; Strand=-; Gene name=ThiJ
ctacttacagaaatgatattttgtaagtagtttgtgcaaatc

SEQ ID NO: 14396 - DNA, 38 bp, Xenorhabdus bovienii
  Terminator sequence Name=Xb4151_4152.C444.trmnator114; Position on contig=340364..340401bp; Strand=+; Gene name=ProP
tgtatcataataattatggtgatcagcttattatgtaa

SEQ ID NO: 14397 - DNA, 40 bp, Xenorhabdus bovienii
  Terminator sequence Name=Xb4151_4152.C444.trmnator115; Position on contig=343270..343309bp; Strand=-; Gene name=Pcp (BS)
gattagccattgtactcagtggctaatttatttttatcgc

SEQ ID NO: 14398 - DNA, 42 bp, Xenorhabdus bovienii
  Terminator sequence Name=Xb4151_4152.C444.trmnator116; Position on contig=347620..347661bp; Strand=-
caccctgtgagtacttactgacagggtgtttttcattatcac

SEQ ID NO: 14399 - DNA, 32 bp, Xenorhabdus bovienii
  Terminator sequence Name=Xb4151_4152.C444.trmnator117; Position on contig=354811..354842bp; Strand=+; Gene name=AhpC
ccagccactctgtcggctggttttttcttagc

SEQ ID NO: 14400 - DNA, 40 bp, Xenorhabdus bovienii
  Terminator sequence Name=Xb4151_4152.C444.trmnator118; Position on contig=356799..356838bp; Strand=+; Gene name=Ggt
gggtgagcagtttgatatgctcaccctttttacaggtttc

SEQ ID NO: 14401 - DNA, 40 bp, Xenorhabdus bovienii
  Terminator sequence Name=Xb4151_4152.C444.trmnator119; Position on contig=356785..356824bp; Strand=-; Gene name=Ggt
gggtgagcatatcaaactgctcacccttgttttttatatc

SEQ ID NO: 14402 - DNA, 38 bp, Xenorhabdus bovienii
  Terminator sequence Name=Xb4151_4152.C444.trmnator120; Position on contig=366249..366286bp; Strand=+
ccatagcctgttaacacaggctatggttccttgatgaa

SEQ ID NO: 14403 - DNA, 59 bp, Xenorhabdus bovienii
  Terminator sequence Name=Xb4151_4152.C444.trmnator121; Position on contig=366228..366286bp; Strand=-
ttcatcaaggaaccatagcctgtgttaacaggctatggttgtgaaaattaatttttata

SEQ ID NO: 14404 - DNA, 40 bp, Xenorhabdus bovienii
  Terminator sequence Name=Xb4151_4152.C444.trmnator122; Position on contig=373195..373234bp; Strand=-; Gene name=OppA
gagcaacgctacttatctggcgttgctttttacgttacgt

SEQ ID NO: 14405 - DNA, 38 bp, Xenorhabdus bovienii
  Terminator sequence Name=Xb4151_4152.C444.trmnator123; Position on contig=374286..374323bp; Strand=-; Gene name=UshA
tggaacctgccctgtggggcaggctgattgttatcatt

SEQ ID NO: 14406 - DNA, 61 bp, Xenorhabdus bovienii
  Terminator sequence Name=Xb4151_4152.C444.trmnator124; Position on contig=377274..377334bp; Strand=-
cttgaagctttcttactcctcgggggcgaggagtaagaaagtgatctggcattttgaaaaa

SEQ ID NO: 14407 - DNA, 44 bp, Xenorhabdus bovienii
  Terminator sequence Name=Xb4151_4152.C444.trmnator125; Position on contig=379637..379680bp; Strand=-; Gene name=RdgC
ttatcagccagatttaatatctggctgcatgattatcattttgt

SEQ ID NO: 14408 - DNA, 36 bp, Xenorhabdus bovienii
  Terminator sequence Name=Xb4151_4152.C444.trmnator126; Position on contig=384630..384665bp; Strand=+
ggctgagaaatcctgttctcagccctgttcttaccg

SEQ ID NO: 14409 - DNA, 49 bp, Xenorhabdus bovienii
  Terminator sequence Name=Xb4151_4152.C444.trmnator127; Position on contig=387701..387749bp; Strand=-
ttaaactgcccggatagtgatatcgggcagtttaattttttatccagaa

SEQ ID NO: 14410 - DNA, 45 bp, Xenorhabdus bovienii
  Terminator sequence Name=Xb4151_4152.C444.trmnator128; Position on contig=390782..390826bp; Strand=+; Gene name=MetC
tcatggctgtctttctgttgcagatagccacggttgatttcctct

SEQ ID NO: 14411 - DNA, 33 bp, Xenorhabdus bovienii
  Terminator sequence Name=Xb4151_4152.C444.trmnator129; Position on contig=391609..391641bp; Strand=+; Gene name=DedA
gtaagcatacttgtcgcttacctttatttaaaa

SEQ ID NO: 14412 - DNA, 54 bp, Xenorhabdus bovienii
  Terminator sequence Name=Xb4151_4152.C444.trmnator130; Position on contig=392690..392743bp; Strand=+; Gene name=ARA1
tataaggcctgaactcgcaaaaatagagctcaggccatgcaaatgttcatccgc

SEQ ID NO: 14413 - DNA, 36 bp, Xenorhabdus bovienii
  Terminator sequence Name=Xb4151_4152.C444.trmnator131; Position on contig=393328..393363bp; Strand=+
gatactgtcaaagctgacggtattttatcctgtgat

SEQ ID NO: 14414 - DNA, 46 bp, Xenorhabdus bovienii
  Terminator sequence Name=Xb4151_4152.C444.trmnator132; Position on contig=398124..398169bp; Strand=-; Gene name=CarA
tgtaattacgtaattatttttgtgtaattacgtaatttttcgattt

SEQ ID NO: 14415 - DNA, 50 bp, Xenorhabdus bovienii
  Terminator sequence Name=Xb4151_4152.C444.trmnator133; Position on contig=399196..399245bp; Strand=-; Gene name=DapB
ggtctaccataatcaacttactttattcatggtagaccttcatactctat

SEQ ID NO: 14416 - DNA, 42 bp, Xenorhabdus bovienii
  Terminator sequence Name=Xb4151_4152.C444.trmnator134; Position on contig=400747..400788bp; Strand=-; Gene name=SlpA
tcagccccggtcaacggtactggggctgataatttcatctat

SEQ ID NO: 14417 - DNA, 38 bp, Xenorhabdus bovienii
  Terminator sequence Name=Xb4151_4152.C444.trmnator135; Position on contig=405718..405755bp; Strand=+; Gene name=RpsT
gaaaaaccggcttagtgccggtttttttgtacctgtaa

SEQ ID NO: 14418 - DNA, 29 bp, Xenorhabdus bovienii
  Terminator sequence Name=Xb4151_4152.C444.trmnator136; Position on contig=405710..405738bp; Strand=-; Gene name=RpsT
ccggcactaagccggtttttcagcataat

SEQ ID NO: 14419 - DNA, 68 bp, Xenorhabdus bovienii
  Terminator sequence Name=Xb4151_4152.C444.trmnator137; Position on contig=413206..413273bp; Strand=+
cgatattaaattgaataatttattcgtattgttaatgaattattcaataatttgcctttatgcttaca

SEQ ID NO: 14420 - DNA, 49 bp, Xenorhabdus bovienii
  Terminator sequence Name=Xb4151_4152.C444.trmnator138; Position on contig=413753..413801bp; Strand=-
ctggagctgttgctgtggcagttgagcgttgttccagtttttcaaggcg

SEQ ID NO: 14421 - DNA, 40 bp, Xenorhabdus bovienii
  Terminator sequence Name=Xb4151_4152.C444.trmnator139; Position on contig=416043..416082bp; Strand=+
gctgcaaaaaagctgcaatttttgcggtctgttttgtcgt

SEQ ID NO: 14422 - DNA, 36 bp, Xenorhabdus bovienii
  Terminator sequence Name=Xb4151_4152.C444.trmnator140; Position on contig=423423..423458bp; Strand=+; Gene name=RecG
tgccgctgaatatttcagcggcatttttagccaagt

SEQ ID NO: 14423 - DNA, 37 bp, Xenorhabdus bovienii
  Terminator sequence Name=Xb4151_4152.C444.trmnator141; Position on contig=423409..423445bp; Strand=-; Gene name=RecG
tgccgctgaaatattcagcggcatttttttgcttaca

SEQ ID NO: 14424 - DNA, 33 bp, Xenorhabdus bovienii
  Terminator sequence Name=Xb4151_4152.C444.trmnator142; Position on contig=426359..426391bp; Strand=+; Gene name=UraA
ctcccgctttttcagtgggagttttttcatttt

SEQ ID NO: 14425 - DNA, 38 bp, Xenorhabdus bovienii
  Terminator sequence Name=Xb4151_4152.C444.trmnator143; Position on contig=428277..428314bp; Strand=-
ctcggcagtttcactttctgcgcgggtattacctgcct

SEQ ID NO: 14426 - DNA, 57 bp, Xenorhabdus bovienii
  Terminator sequence Name=Xb4151_4152.C444.trmnator144; Position on contig=430670..430726bp; Strand=-
cgtatgaatagcttagggtgcttcggcactctgagttttattggcgtttcttccgat

SEQ ID NO: 14427 - DNA, 35 bp, Xenorhabdus bovienii
  Terminator sequence Name=Xb4151_4152.C444.trmnator145; Position on contig=436094..436128bp; Strand=-
cctcgtccgaataggacgaggtacatttacctcat

SEQ ID NO: 14428 - DNA, 42 bp, Xenorhabdus bovienii
  Terminator sequence Name=Xb4151_4152.C444.trmnator146; Position on contig=440270..440311bp; Strand=+
taccatgttgtcggagaccgaaactgtaatccttttaataac

SEQ ID NO: 14429 - DNA, 44 bp, Xenorhabdus bovienii
  Terminator sequence Name=Xb4151_4152.C444.trmnator147; Position on contig=440255..440298bp; Strand=-
ttacagtttcggtctccgacaacatggtaacgattctatacggg

SEQ ID NO: 14430 - DNA, 44 bp, Xenorhabdus bovienii
  Terminator sequence Name=Xb4151_4152.C444.trmnator148; Position on contig=443722..443765bp; Strand=+
cacaactgctcgcagactgcgggcagttcgtgtttaaattagcg

SEQ ID NO: 14431 - DNA, 47 bp, Xenorhabdus bovienii
  Terminator sequence Name=Xb4151_4152.C444.trmnator149; Position on contig=443679..443725bp; Strand=-
tgtgatattacctgaccccagaaggtgttatcgtgattttctgccca

SEQ ID NO: 14432 - DNA, 40 bp, Xenorhabdus bovienii
  Terminator sequence Name=Xb4151_4152.C444.trmnator150; Position on contig=447205..447244bp; Strand=-; Gene name=DdlA
tatgcttgaattgatttcaatgcatgaattatattttaaa

SEQ ID NO: 14433 - DNA, 29 bp, Xenorhabdus bovienii
  Terminator sequence Name=Xb4151_4152.C444.trmnator151; Position on contig=447670..447698bp; Strand=-
ccccttaaaatagggggttatcgtaattt

SEQ ID NO: 14434 - DNA, 34 bp, Xenorhabdus bovienii
  Terminator sequence Name=Xb4151_4152.C444.trmnator152; Position on contig=449465..449498bp; Strand=+; Gene name=WecD
ggtgggaccgcggtcccacctcattcttcagtaa

SEQ ID NO: 14435 - DNA, 41 bp, Xenorhabdus bovienii
  Terminator sequence Name=Xb4151_4152.C444.trmnator153; Position on contig=449447..449487bp; Strand=-; Gene name=WecD
tgaggtgggaccgcggtcccacctgttgaattatatcgcgt

SEQ ID NO: 14436 - DNA, 47 bp, Xenorhabdus bovienii
  Terminator sequence Name=Xb4151_4152.C444.trmnator154; Position on contig=454210..454256bp; Strand=+
catcgccagatcgatatctgcagcgctggcgatgcttttattgatgg

SEQ ID NO: 14437 - DNA, 48 bp, Xenorhabdus bovienii
  Terminator sequence Name=Xb4151_4152.C444.trmnator155; Position on contig=472022..472069bp; Strand=-
gaaaaatggcgataagagattatcgccattttatctttcctctcgcat

SEQ ID NO: 14438 - DNA, 49 bp, Xenorhabdus bovienii
  Terminator sequence Name=Xb4151_4152.C444.trmnator156; Position on contig=478218..478266bp; Strand=+; Gene name=MhpC
cgtattacccataacttgttagttatgggtaattgaccgtttatctgga

SEQ ID NO: 14439 - DNA, 32 bp, Xenorhabdus bovienii
  Terminator sequence Name=Xb4151_4152.C444.trmnator157; Position on contig=481827..481858bp; Strand=+
tattctgttctacggagtgaatattcgtcagg

SEQ ID NO: 14440 - DNA, 37 bp, Xenorhabdus bovienii
  Terminator sequence Name=Xb4151_4152.C444.trmnator158; Position on contig=485693..485729bp; Strand=+; Gene name=CDA1
taaagcagccatttctggctgcttatttcatccaaag

SEQ ID NO: 14441 - DNA, 30 bp, Xenorhabdus bovienii
  Terminator sequence Name=Xb4151_4152.C444.trmnator159; Position on contig=485685..485714bp; Strand=-; Gene name=CDA1
gcagccagaaatggctgctttaaatagcct

SEQ ID NO: 14442 - DNA, 36 bp, Xenorhabdus bovienii
  Terminator sequence Name=Xb4151_4152.C444.trmnator160; Position on contig=489425..489460bp; Strand=+; Gene name=Tra5
ggaggaagtatcgacttcctccagtttacccattgt

SEQ ID NO: 14443 - DNA, 32 bp, Xenorhabdus bovienii
  Terminator sequence Name=Xb4151_4152.C444.trmnator161; Position on contig=492499..492530bp; Strand=-; Gene name=FeoA
gcctcatatgttatcggggcttgtaatagcag

SEQ ID NO: 14444 - DNA, 39 bp, Xenorhabdus bovienii
  Terminator sequence Name=Xb4151_4152.C444.trmnator162; Position on contig=493509..493547bp; Strand=+
gcttatccacaaagattgtggataagtttatatggggta

SEQ ID NO: 14445 - DNA, 43 bp, Xenorhabdus bovienii
  Terminator sequence Name=Xb4151_4152.C444.trmnator163; Position on contig=495248..495290bp; Strand=-
ttaactaagcatataaaatatgcttagttagatttaaatgcaa

SEQ ID NO: 14446 - DNA, 36 bp, Xenorhabdus bovienii
  Terminator sequence Name=Xb4151_4152.C444.trmnator164; Position on contig=496735..496770bp; Strand=+
tgtttcttgattcaagaatacgcattaatttatcaa

SEQ ID NO: 14447 - DNA, 51 bp, Xenorhabdus bovienii
  Terminator sequence Name=Xb4151_4152.C444.trmnator165; Position on contig=515983..516033bp; Strand=+; Gene name=PhoU
gcctgaaacgcgggaattttattccggcgtttttggctttcttattcctaa

SEQ ID NO: 14448 - DNA, 31 bp, Xenorhabdus bovienii
  Terminator sequence Name=Xb4151_4152.C444.trmnator166; Position on contig=517011..517041bp; Strand=+; Gene name=ArtI
gccccgtttttgcggggctttgctgtttttt

SEQ ID NO: 14449 - DNA, 37 bp, Xenorhabdus bovienii
  Terminator sequence Name=Xb4151_4152.C444.trmnator167; Position on contig=518576..518612bp; Strand=+; Gene name=ArtM
ttccctgctgttaaaggcaggggattttttatatcac

SEQ ID NO: 14450 - DNA, 59 bp, Xenorhabdus bovienii
  Terminator sequence Name=Xb4151_4152.C444.trmnator168; Position on contig=522795..522853bp; Strand=+
tgtaaatattaacaatgtaaattgtttatggtgttgttttttgtaatattgttctataa

SEQ ID NO: 14451 - DNA, 639 bp, Xenorhabdus bovienii
  RNA gene sequence Name=Xb4151_4152.C382.rRNA1; Position on contig =20..658bp; Strand=-; Type=rRNA; Gene name=AY244379 [D:1..2905]; Product=23S ribosomal RNA
ctttacactggcattcgtgtcggcatgtgtaggataggtggtagactttgaagcagtggcgccagccattgtggagtcatccttgaaataccacccttgcctatatggatgtctaactgcggcccgttatccgggtccaggaccgtgtatggtgggtagtttgactggggcggtcgcctcctaaagagtaacggaggcgcgcgatggtaggctcagaacggtcggaaatcgttcgtcgagtgcaatggcataagcctgcctgactgcaagactgacaagtcgagcagagacgaaagtcggtcatagtgatccggtggtcccgcgtggaagggccatcgctcaacggataaaaggtacgccggggataacaggctgatgacccccaagagtccatatcgacggggttgtttggcacctcgatgtcgactcatcgcatcctggggctggagcaggtcccaagggtatggctgttcgccatttaaagcggtacgtgagttgggttcagaacgtcgtgagacagttcggtccctatctgccgtgggtgtaggaatattgacaggatctgtccctagtacgagaggaccgggatggacgtatctctggtggacctgttgtcgtgccaacggcatagcagggtag

SEQ ID NO: 14452 - DNA, 77 bp, Xenorhabdus bovienii
  RNA gene sequence Name=Xb4151_4152.C389.tRNA1; Position on contig =51..127bp; Strand=-; Type=tRNA; Gene name=Arg TCT; Product=tRNA-Val
cgccctttagctccatttggatagagcaacgggccctctaagccgtagggcacagggttcgaatcctgtaggggcgt

SEQ ID NO: 14453 - DNA, 75 bp, Xenorhabdus bovienii
  RNA gene sequence Name=Xb4151_4152.C391.tRNA1; Position on contig =168..242bp; Strand=+; Type=tRNA; Gene name=Gly TCC; Product=tRNA-Val
gcgggcatcgtataatggctattacctcagccttccaagctgatgatgcgggttcgattcccgctgcccgctcca

SEQ ID NO: 14454 - DNA, 76 bp, Xenorhabdus bovienii
  RNA gene sequence Name=Xb4151_4152.C391.tRNA2; Position on contig =249..324bp; Strand=+; Type=tRNA; Gene name=Thr GGT; Product=tRNA-Val
gctgatatagctcagttggtagagcacacccttggtaagggtgaggtcggcagttcgaatctgcctatcagcacca

SEQ ID NO: 14455 - DNA, 77 bp, Xenorhabdus bovienii
  RNA gene sequence Name=Xb4151_4152.C391.tRNA3; Position on contig =3657..3733bp; Strand=-; Type=tRNA; Gene name=Asp GTC; Product=tRNA -Val
ggtgcggtagttcagttggttagaataccggcctgtcacgccgggggtcgcgggttcgagtcccgtccgcaccgcca

SEQ ID NO: 14456 - DNA, 129 bp, Xenorhabdus bovienii
  RNA gene sequence Name=Xb4151_4152.C391.rRNA1; Position on contig =3804..3932bp; Strand=-; Type=rRNA; Gene name=AJ414159 [R:133614..133847]; Product=5S ribosomal RNA
acagaatttgtctggcggccatagcgcggtggtcccacctgatcccatgccgaactcagcagtgaaacgccgtagcgccgatggtagtgtggggtctccccatgtgagagtagggcactgccagacatc

SEQ ID NO: 14457 - DNA, 494 bp, Xenorhabdus bovienii
  RNA gene sequence Name=Xb4151_4152.C391.rRNA2; Position on contig =3989..4482bp; Strand=-; Type=rRNA; Gene name=LSU_RRNA; Product=23S ribosomal RNA
taaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacctgacaacaccgaaggtgttttg

SEQ ID NO: 14458 - DNA, 1497 bp, Xenorhabdus bovienii
  RNA gene sequence Name=Xb4151_4152.C393.rRNA1; Position on contig =179..1675bp; Strand=+; Type=rRNA; Gene name=AY278673 [D:1..1497]; Product=16S ribosomal RNA
agattgaacgctggcggcaggcctaacacatgcaagtcgagcggcagcggggggaagcttgcttccctgccggcgagcggcggacgggtgagtaatgtctggggatctgcccgatggagggggataaccactggaaacggtggctaataccgcataacctctttggagcaaagtgggggaccttcgggcctcacgccatcggatgaacccagatgggattagctagtaggtggggtaatggctcacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcaacagcgtaaacagcgttgttgattgacgttacccgcagaagaagcaccggctaactccgtgccagcagccgcggtaatacggagggtgcaagcgttaatcggaattactgggcgtaaagcgcacgcaggcggtcaattaagttagatgtgaaatccccgggctcaacctgggaacggcatctaaaactggttgactagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatcctcagaatctgccagagatggcggagtgccttcgggacctgagagacaggtgctgcatggctgtcgtcagctcgtgttgtgaaatgttgggttaagtcccgcaacgagcgcaacccttatcctttgttgccagcacgtgatggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacc

SEQ ID NO: 14459 - DNA, 76 bp, Xenorhabdus bovienii
  RNA gene sequence Name=Xb4151_4152.C393.tRNA1; Position on contig =1780..1855bp; Strand=+; Type=tRNA; Gene name=Glu TTC; Product=tRNA -Val
gtccccttcgtctagaggcctaggacaccgccctttcacggcggtaacaggggttcgaatcccctaggggacgcca

SEQ ID NO: 14460 - DNA, 125 bp, Xenorhabdus bovienii
  RNA gene sequence Name=Xb4151_4152.C395.rRNA1; Position on contig =3395..3519bp; Strand=-; Type=rRNA; Gene name=AJ414159 [R:133614..133847]; Product=5S ribosomal RNA
aaacagaatttgcttggcagcaatagcgcggcggtcccacctgaccccatgccgaactcagtagtgaaacgccgtagcgccgatggtagtgtggggtctccccatgtgagagtagggaactgcca

SEQ ID NO: 14461 - DNA, 76 bp, Xenorhabdus bovienii
  RNA gene sequence Name=Xb4151_4152.C395.tRNA1; Position on contig =3546..3621bp; Strand=-; Type=tRNA; Gene name=Thr GGT; Product=tRNA -Val
gctgatatggctcagttggtagagcacacccttggtaagggtgaggtccccagttcgaatctgggtatcagcacca

SEQ ID NO: 14462 - DNA, 129 bp, Xenorhabdus bovienii; identical to SEQ ID NO: 14456
  RNA gene sequence Name=Xb4151_4152.C395.rRNA2; Position on contig =3703..3831bp; Strand=-; Type=rRNA; Gene name=AJ414159 [R:133614..133847]; Product=5S ribosomal RNA

SEQ ID NO: 14463 - DNA, 541 bp, Xenorhabdus bovienii
  RNA gene sequence Name=Xb4151_4152.C395.rRNA3; Position on contig =3907..4447bp; Strand=-; Type=rRNA; Gene name=AJ414159 [R:133847..136753]; Product=23S ribosomal RNA
tcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacct

SEQ ID NO: 14464 - DNA, 74 bp, Xenorhabdus bovienii
  RNA gene sequence Name=Xb4151_4152.C400.tRNA1; Position on contig =908..981bp; Strand=-; Type=tRNA; Gene name=Gln CTG; Product=tRNA-Val
tggggtatcgccaagcggtaaggcaccggattctgattccggcatcccaggttcgaatcctggtaccccagcca

SEQ ID NO: 14465 - DNA, 77 bp, Xenorhabdus bovienii
  RNA gene sequence Name=Xb4151_4152.C400.tRNA2; Position on contig =995..1071bp; Strand=-; Type=tRNA; Gene name=Met CAT; Product=tRNA-Val
ggctacgtagctcagctggttagagcacagcactcataatgctggggtcacaggttcgaatcccgtcgtagccacca

SEQ ID NO: 14466 - DNA, 75 bp, Xenorhabdus bovienii
  RNA gene sequence Name=Xb4151_4152.C400.tRNA3; Position on contig =1125..1199bp; Strand=-; Type=tRNA; Gene name=Gln TTG; Product=tRNA -Val
tggggtatcgccaagcggtaaggcaccaggttttgatcctggcatgccctggttcgaatccaggtaccccagcca

SEQ ID NO: 14467 - DNA, 75 bp, Xenorhabdus bovienii; identical to SEQ ID NO: 14466
  RNA gene sequence Name=Xb4151_4152.C400.tRNA4; Position on contig =1230..1304bp; Strand=-; Type=tRNA; Gene name=Gln TTG; Product=tRNA -Val

SEQ ID NO: 14468 - DNA, 85 bp, Xenorhabdus bovienii
  RNA gene sequence Name=Xb4151_4152.C400.tRNA5; Position on contig =1376..1460bp; Strand=-; Type=tRNA; Gene name=Leu TAG; Product=tRNA -Val
gcgggagtggcgaaattggtagacgcaccagatttaggttctggcgccgcaaggtgtgcgagttcaagtctcgcctcccgcacca

SEQ ID NO: 14469 - DNA, 77 bp, Xenorhabdus bovienii
  RNA gene sequence Name=Xb4151_4152.C400.tRNA6; Position on contig =1466..1542bp; Strand=-; Type=tRNA; Gene name=Met CAT; Product=tRNA -Val
ggctacgtagctcagctggttagagcacagcactcataatgctggggtcacaggttcgattcccgtcgtagccacca

SEQ ID NO: 14470 - DNA, 76 bp, Xenorhabdus bovienii
  RNA gene sequence Name=Xb4151_4152.C403.tRNA1; Position on contig =17854..17929bp; Strand=-; Type=tRNA; Gene name=Lys TTT; Product=tRNA- Val
gggtcgttagctcagtcggtagagcagttgacttttaatcaattggtcgcaggttcgaatcctgcacgacccacca

SEQ ID NO: 14471 - DNA, 78 bp, Xenorhabdus bovienii
  RNA gene sequence Name=Xb4151_4152.C403.tRNA2; Position on contig =17961..18038bp; Strand=-; Type=tRNA; Gene name=Lys TTT; Product=tRNA- Val
ggaccccgttagctcattcggtagagcagttgacttttaatcaattggtcgcaggttcgaatcctgcacgacccacca

SEQ ID NO: 14472 - DNA, 76 bp, Xenorhabdus bovienii
  RNA gene sequence Name=Xb4151_4152.C404.tRNA1; Position on contig =396..471bp; Strand=-; Type=tRNA; Gene name=Thr TGT; Product=tRNA-Val
gccggcttagctcagttggtagagcaactgacttgtaatcagtaggtcaccagttcgactccggtagccggcacca

SEQ ID NO: 14473 - DNA, 88 bp, Xenorhabdus bovienii
  RNA gene sequence Name=Xb4151_4152.C404.tRNA2; Position on contig =478..565bp; Strand=-; Type=tRNA; Gene name=Ser TGA; Product=tRNA-Val
ggaaggatggccgagcggtcgaaggcagcggtcttgaaaaccgccgatgggaaaccatcctagagttcgaatctctatccttccgcca

SEQ ID NO: 14474 - DNA, 85 bp, Xenorhabdus bovienii
  RNA gene sequence Name=Xb4151_4152.C406.tRNA1; Position on contig =10619..10703bp; Strand=-; Type=tRNA; Gene name=Tyr GTA; Product=tRNA- Val
ggtggggttcccgagcggccaaagggagcagactgtaaatctgccgtcacagacttcgaaggttcgaatccttcccccaccacca

SEQ ID NO: 14475 - DNA, 77 bp, Xenorhabdus bovienii
  RNA gene sequence Name=Xb4151_4152.C414.tRNA1; Position on contig =47251..47327bp; Strand=+; Type=tRNA; Gene name=Val GAC; Product=tRNA- Val
gcgtccgtagctcagttggttagagcaccaccttgacatggtgggggtcggtggttcgagtccactcggacgcacca

SEQ ID NO: 14476 - DNA, 77 bp, Xenorhabdus bovienii; identical to SEQ ID NO: 14475
  RNA gene sequence Name=Xb4151_4152.C414.tRNA2; Position on contig =47358..47434bp; Strand=+; Type=tRNA; Gene name=Val GAC; Product=tRNA- Val

SEQ ID NO: 14477 - DNA, 78 bp, Xenorhabdus bovienii
  RNA gene sequence Name=Xb4151_4152.C418.tRNA1; Position on contig =210..287bp; Strand=+; Type=tRNA; Gene name=Arg ACG; Product=tRNA-Val
gcatccaaagctcagctggatagagtactcggctacgaaccgagcggtcggaggttcgaatccttcctggatgcacca

SEQ ID NO: 14478 - DNA, 77 bp, Xenorhabdus bovienii
  RNA gene sequence Name=Xb4151_4152.C418.tRNA2; Position on contig =373..449bp; Strand=+; Type=tRNA; Gene name=Arg ACG; Product=tRNA-Val
gcatccatagctcagctggatagagtactcggctacgaaccgagcggtcggaggttcgaatcctcctggatgcacca

SEQ ID NO: 14479 - DNA, 77 bp, Xenorhabdus bovienii; identical to SEQ ID NO: 14478
  RNA gene sequence Name=Xb4151_4152.C418.tRNA3; Position on contig =537..613bp; Strand=+; Type=tRNA; Gene name=Arg ACG; Product=tRNA-Val

SEQ ID NO: 14480 - DNA, 76 bp, Xenorhabdus bovienii
  RNA gene sequence Name=Xb4151_4152.C419.tRNA1; Position on contig =39498..39573bp; Strand=-; Type=tRNA; Gene name=Phe GAA; Product=tRNA- Val
ggaactttggcgtagagggttcgcgcggatgcctgaagagcatcaggactcggttcgattccgagaggttccacca

SEQ ID NO: 14481 - DNA, 88 bp, Xenorhabdus bovienii
  RNA gene sequence Name=Xb4151_4152.C421.tRNA1; Position on contig =33115..33202bp; Strand=+; Type=tRNA; Gene name=Ser TGA; Product=tRNA- Val
ggaggggtggccgagcggctgaaggcagcggtcttgaaaaccgccgatgggaaaccatccgagagttcgaatctctcctcctccgcca

SEQ ID NO: 14482 - DNA, 1104 bp, Xenorhabdus bovienii
  RNA gene sequence Name=Xb4151_4152.C422.rRNA1; Position on contig =7..1110bp; Strand=+; Type=rRNA; Gene name=AJ414141 [D:14272..17178]; Product=23S ribosomal RNA
aacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgcggacgccagtctgcacggagccatccttgaaataccacccttgaatgtttgatgttctaacgcaggcccgttatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacct

SEQ ID NO: 14483 - DNA, 129 bp, Xenorhabdus bovienii; identical to SEQ ID NO: 14456
  RNA gene sequence Name=Xb4151_4152.C422.rRNA2; Position on contig =1188..1316bp; Strand=+; Type=rRNA; Gene name=AJ414159 [R:133614..133847]; Product=5S ribosomal RNA

SEQ ID NO: 14484 - DNA, 76 bp, Xenorhabdus bovienii
  RNA gene sequence Name=Xb4151_4152.C424.tRNA1; Position on contig =68692..68767bp; Strand=-; Type=tRNA; Gene name=Val TAC; Product=tRNA- Val
gggcgattagctcagttggtagagcatctcccttacaaggagggggtcatcagttcgaatctggtatcgcccacca

SEQ ID NO: 14485 - DNA, 76 bp, Xenorhabdus bovienii; identical to SEQ ID NO: 14470
  RNA gene sequence Name=Xb4151_4152.C424.tRNA2; Position on contig =68774..68849bp; Strand=-; Type=tRNA; Gene name=Lys TTT; Product=tRNA- Val

SEQ ID NO: 14486 - DNA, 76 bp, Xenorhabdus bovienii; identical to SEQ ID NO: 14470
  RNA gene sequence Name=Xb4151_4152.C424.tRNA3; Position on contig =68879..68954bp; Strand=-; Type=tRNA; Gene name=Lys TTT; Product=tRNA- Val

SEQ ID NO: 14487 - DNA, 76 bp, Xenorhabdus bovienii; identical to SEQ ID NO: 14470
  RNA gene sequence Name=Xb4151_4152.C424.tRNA4; Position on contig =68985..69060bp; Strand=-; Type=tRNA; Gene name=Lys TTT; Product=tRNA- Val

SEQ ID NO: 14488 - DNA, 76 bp, Xenorhabdus bovienii; identical to SEQ ID NO: 14484
  RNA gene sequence Name=Xb4151_4152.C424.tRNA5; Position on contig =69103..69178bp; Strand=-; Type=tRNA; Gene name=Val TAC; Product=tRNA- Val

SEQ ID NO: 14489 - DNA, 76 bp, Xenorhabdus bovienii; identical to SEQ ID NO: 14484
  RNA gene sequence Name=Xb4151_4152.C424.tRNA6; Position on contig =69221..69296bp; Strand=-; Type=tRNA; Gene name=Val TAC; Product=tRNA- Val

SEQ ID NO: 14490 - DNA, 76 bp, Xenorhabdus bovienii; identical to SEQ ID NO: 14480
  RNA gene sequence Name=Xb4151_4152.C425.tRNA1; Position on contig =11997..12072bp; Strand=+; Type=tRNA; Gene name=Phe GAA; Product=tRNA- Val

SEQ ID NO: 14491 - DNA, 76 bp, Xenorhabdus bovienii
  RNA gene sequence Name=Xb4151_4152.C426.tRNA1; Position on contig =16..91bp; Strand=+; Type=tRNA; Gene name=Gly GCC; Product=tRNA-Val
gcgggaatagctcagttggtagagcacgaccttgccaaggtcggggtcgcgagttcgagtctcgtttcccgctcca

SEQ ID NO: 14492 - DNA, 74 bp, Xenorhabdus bovienii
  RNA gene sequence Name=Xb4151_4152.C426.tRNA2; Position on contig =97..170bp; Strand=+; Type=tRNA; Gene name=Cys GCA; Product=tRNA-Val
ggcgcgttggcatagtggccatgcagcggattgcaaatccgtttacctcggttcgactccgggacgcgcctcca

SEQ ID NO: 14493 - DNA, 87 bp, Xenorhabdus bovienii
  RNA gene sequence Name=Xb4151_4152.C426.tRNA3; Position on contig =178..264bp; Strand=+; Type=tRNA; Gene name=Leu TAA; Product=tRNA-Val
gcccaggtggtgaaatcggtagacacaagggatttaaaatccctcggctgtaaggctgtgcgggttcaagtcccgccctgggcacca

SEQ ID NO: 14494 - DNA, 73 bp, Xenorhabdus bovienii
  RNA gene sequence Name=Xb4151_4152.C427.tRNA1; Position on contig =31623..31695bp; Strand=+; Type=tRNA; Gene name=Pseudo GCC; Product =tRNA-Val
taaactgactgagttggtagagtacaactttgccaaagttagggtagcgagtttgaatctcgttttcactcca

SEQ ID NO: 14495 - DNA, 77 bp, Xenorhabdus bovienii
  RNA gene sequence Name=Xb4151_4152.C427.tRNA2; Position on contig =62699..62775bp; Strand=+; Type=tRNA; Gene name=Ile GAT; Product=tRNA- Val
aggcttgtagctcaggtggttagagcgcacccctgataagggtgaggtcggtggttcaagtccactcaggcctacca

SEQ ID NO: 14496 - DNA, 129 bp, Xenorhabdus bovienii; identical to SEQ ID NO: 14456
  RNA gene sequence Name=Xb4151_4152.C429.rRNA1; Position on contig =80894..81022bp; Strand=-; Type=rRNA; Gene name=AJ414159 [R:133614..133847]; Product=5S ribosomal RNA

SEQ ID NO: 14497 - DNA, 240 bp, Xenorhabdus bovienii
  RNA gene sequence Name=Xb4151_4152.C429.rRNA2; Position on contig =81100..81339bp; Strand=-; Type=rRNA; Gene name=ECORRG26 [D:1..240]; Product=23S ribosomal RNA
accggagtggacgcaccactggtgttcgggttgtcatgccaatggcactgccccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacct

SEQ ID NO: 14498 - DNA, 76 bp, Xenorhabdus bovienii
  RNA gene sequence Name=Xb4151_4152.C430.tRNA1; Position on contig =87756..87831bp; Strand=-; Type=tRNA; Gene name=Ala GGC; Product=tRNA- Val
ggggctatagctcagctgggagagcgcttgcatggcatgcaagaggtcagcggttcgatcccgcttagctccacca

SEQ ID NO: 14499 - DNA, 76 bp, Xenorhabdus bovienii; identical to SEQ ID NO: 14498
  RNA gene sequence Name=Xb4151_4152.C430.tRNA2; Position on contig =87902..87977bp; Strand=-; Type=tRNA; Gene name=Ala GGC; Product=tRNA- Val

SEQ ID NO: 14500 - DNA, 70 bp, Xenorhabdus bovienii
  RNA gene sequence Name=Xb4151_4152.C431.tRNA1; Position on contig =12680..12749bp; Strand=-; Type=tRNA; Gene name=Pseudo TGT; Product =tRNA-Val
cctccatagttcagttgtagaacgccgaattgtaatccgtatgtcactgttcgagtccagttgagaagca

SEQ ID NO: 14501 - DNA, 76 bp, Xenorhabdus bovienii
  RNA gene sequence Name=Xb4151_4152.C431.tRNA2; Position on contig =13058..13133bp; Strand=-; Type=tRNA; Gene name=Asn GTT; Product=tRNA- Val
tcctccatagttcagtcggtagaacggcggactgttaatccgtatgtcactggttcgagtccagttggaggagcca

SEQ ID NO: 14502 - DNA, 76 bp, Xenorhabdus bovienii; identical to SEQ ID NO: 14501
  RNA gene sequence Name=Xb4151_4152.C431.tRNA3; Position on contig =13359..13434bp; Strand=-; Type=tRNA; Gene name=Asn GTT; Product=tRNA- Val

SEQ ID NO: 14503 - DNA, 76 bp, Xenorhabdus bovienii; identical to SEQ ID NO: 14501
  RNA gene sequence Name=Xb4151_4152.C431.tRNA4; Position on contig =13830..13905bp; Strand=-; Type=tRNA; Gene name=Asn GTT; Product=tRNA- Val

SEQ ID NO: 14504 - DNA, 75 bp, Xenorhabdus bovienii
  RNA gene sequence Name=Xb4151_4152.C431.tRNA5; Position on contig =142963..143037bp; Strand=+; Type=tRNA; Gene name=Arg CCT; Product =tRNA-Val
gtccccttagttaaatggatataacgagcccctcctaagggctagttgtaggttcgattcctgcaggggacgcca

SEQ ID NO: 14505 - DNA, 76 bp, Xenorhabdus bovienii
  RNA gene sequence Name=Xb4151_4152.C432.tRNA1; Position on contig =64..139bp; Strand=+; Type=tRNA; Gene name=Met CAT; Product=tRNA-Val
ggccccttagctcagtggttagagcaggcgactcataatcgcttggtcgctggttcaagtccagcaggggccacca

SEQ ID NO: 14506 - DNA, 76 bp, Xenorhabdus bovienii
  RNA gene sequence Name=Xb4151_4152.C432.tRNA2; Position on contig =57542..57617bp; Strand=-; Type=tRNA; Gene name=Phe GAA; Product=tRNA- Val
gcccggatagctcagtcggtagagcaggggattgaaaatccccgtgtccttggttcgattccgagtccgggcacca

SEQ ID NO: 14507 - DNA, 76 bp, Xenorhabdus bovienii; identical to SEQ ID NO: 14480
  RNA gene sequence Name=Xb4151_4152.C432.tRNA3; Position on contig =101357..101432bp; Strand=+; Type=tRNA; Gene name=Phe GAA; Product =tRNA-Val

SEQ ID NO: 14508 - DNA, 538 bp, Xenorhabdus bovienii
  RNA gene sequence Name=Xb4151_4152.C433.rRNA1; Position on contig =1..538bp; Strand=+; Type=rRNA; Gene name=AJ414159 [R:133847..136753]; Product=23S ribosomal RNA
agcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacct

SEQ ID NO: 14509 - DNA, 129 bp, Xenorhabdus bovienii; identical to SEQ ID NO: 14456
  RNA gene sequence Name=Xb4151_4152.C433.rRNA2; Position on contig =614..742bp; Strand=+; Type=rRNA; Gene name=AJ414159 [R:133614..133847]; Product=5S ribosomal RNA

SEQ ID NO: 14510 - DNA, 76 bp, Xenorhabdus bovienii; identical to SEQ ID NO: 14480
  RNA gene sequence Name=Xb4151_4152.C433.tRNA1; Position on contig =32817..32892bp; Strand=+; Type=tRNA; Gene name=Phe GAA; Product=tRNA- Val

SEQ ID NO: 14511 - DNA, 1498 bp, Xenorhabdus bovienii
  RNA gene sequence Name=Xb4151_4152.C434.rRNA1; Position on contig =198..1695bp; Strand=+; Type=rRNA; Gene name=AY278673 [D:1..1497]; Product=16S ribosomal RNA
agattgaacgctggcggcaggcctaacacatgcaagtcgagcggcagcgggggggaagcttgcttccctgccggcgagcggcggacgggtgagtaatgtctggggatctgcccgatggagggggataaccactggaaacggtggctaataccgcataacctctctggagcaaagtgggggaccttcgggcctcacgccatcggatgaacccagatgggattagctagtaggtggggtaaaggctcacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcaacagcgtaaatagcgttgttgattgacgttacccgcagaagaagcaccggctaactccgtgccagcagccgcggtaatacggagggtgcaagcgttaatcggaattactgggcgtaaagcgcacgcaggcggtcaattaagttagatgtgaaatccccgggctcaacctgggaacggcatctaaaactggttgactagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatcctcagaatctgccagagatggcggagtgccttcgggacctgagagacaggtgctgcatggctgtcgtcagctcgtgttgtgaaatgttgggttaagtcccgcaacgagcgcaacccttatcctttgttgccagcacgtgatggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacc

SEQ ID NO: 14512 - DNA, 77 bp, Xenorhabdus bovienii; identical to SEQ ID NO: 14495
  RNA gene sequence Name=Xb4151_4152.C434.tRNA1; Position on contig =1782..1858bp; Strand=+; Type=tRNA; Gene name=Ile GAT; Product=tRNA -Val

SEQ ID NO: 14513 - DNA, 76 bp, Xenorhabdus bovienii
  RNA gene sequence Name=Xb4151_4152.C434.tRNA2; Position on contig =1984..2059bp; Strand=+; Type=tRNA; Gene name=Ala TGC; Product=tRNA -Val
ggggctatagctcagctgggagagcgcctgccttgcacgcaggaggtcagcggttcgatcccgcttagctccacca

SEQ ID NO: 14514 - DNA, 366 bp, Xenorhabdus bovienii
  RNA gene sequence Name=Xb4151_4152.C434.rRNA2; Position on contig =2396..2761bp; Strand=+; Type=rRNA; Gene name=LSU_RRNA; Product=23S ribosomal RNA
gaggcgaaccgggggaactgaaacatctcagtaccccgaggaaaagaaatcaaccgagattcccccagtagcggcgagcgaacggggaacagcccagaaccaacatcagcatcagcgtcaggagaacggtctggaaaggccggcagtaaagggtgatagccccgtatctgaagacactggtggtgtgagttcgacgagtagggcgggacacgtggtatcctgtctgaacatggggggaccatcctccaaggctaaatactcctgactgaccgatagtgaaccagtaccgtgagggaaaggcgaaaagaaccccggcgaggggagtgaaatagaacctgaaaccgtgtacgtacaagcagtgggagc

SEQ ID NO: 14515 - DNA, 1999 bp, Xenorhabdus bovienii
  RNA gene sequence Name=Xb4151_4152.C434.rRNA3; Position on contig =2776..4774bp; Strand=+; Type=rRNA; Gene name=LSU_RRNA; Product=23S ribosomal RNA
gtgactgcgtaccttttgtataatgggtcagcgacttatattctgtagcaaggttaaccgtttaggggagccgcagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatcttcgggggtagagcactgtttcggctagggggtcatcccgacttaccaacccgatgcaaactgcgaataccgaagaatgttatcacgggagacacacggcgggtgctaacgtccgtcgtgaagagggaaacaacccagaccgccagctaaggtccccaagtcatggttaagtgggaaacgaagtgggaaggctcagacagccaggatgttggcttagaagcagccatcatttaaagaaagcgtaatagctcactggtcgagtcggcctgcgcggaagatgtaacggggctaaaccatgcaccgaagctgcggcagcaacacttaggtgttgttgggtaggggagcgttctgtaagcctgcgaaggtgtgctgtgaggcatgctggaggtatcagaagtgcgaatgctgacataagtaacgataaagcgggtgaaaaacccgctcgccggaagaccaagggttcctgtccaacgttaatcggggcagggtgagtcgacccctaaggcgaggccgaaaggcgtagtcgatgggaaacgggttaatattcccgtactcggtgttactgcgaaggggggacggagaaggctagaccagccgggcgacggttgtcccggttcaagcgtgtaggtgggaagaattggtaaatccgttcttccgtgaacactgaggcgtgataacgaggcactacggtgctgaagtggttgatgccctgcttccaggaaaagcctctaagcatcaggtaacagtgaatcgtaccccaaaccgacacaggtggtcaggtagagaatactcaggcgcttgagagaactcgggtgaaggaactaggcaaaatggtgccgtaacttcgggagaaggcacgctggcgccaggtgacgggacttgctccccgagccgaggccagtcgcagataccagctggctgcaactgtttaataaaaacacagcactgtgcaaacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgcggacgccagtctgcacggagccatccttgaaataccacccttgaatgtttgatgttctaacgcaggcccgttatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggta

SEQ ID NO: 14516 - DNA, 129 bp, Xenorhabdus bovienii; identical to SEQ ID NO: 14456
  RNA gene sequence Name=Xb4151_4152.C434.rRNA4; Position on contig =5209..5337bp; Strand=+; Type=rRNA; Gene name=AJ414159 [R:133614..133847]; Product=5S ribosomal RNA

SEQ ID NO: 14517 - DNA, 77 bp, Xenorhabdus bovienii; identical to SEQ ID NO: 14455
  RNA gene sequence Name=Xb4151_4152.C434.tRNA3; Position on contig =5408..5484bp; Strand=+; Type=tRNA; Gene name=Asp GTC; Product=tRNA -Val

SEQ ID NO: 14518 - DNA, 76 bp, Xenorhabdus bovienii
  RNA gene sequence Name=Xb4151_4152.C434.tRNA4; Position on contig =5493..5568bp; Strand=+; Type=tRNA; Gene name=Trp CCA; Product=tRNA -Val
aggggcgtagttcaattggtagagcaccggtctccaaaaccgggtgttgggagttcgagtctctccgcccctgcca

SEQ ID NO: 14519 - DNA, 77 bp, Xenorhabdus bovienii
  RNA gene sequence Name=Xb4151_4152.C434.tRNA5; Position on contig =42756..42832bp; Strand=+; Type=tRNA; Gene name=Arg CCG; Product=tRNA- Val
gcgcccgtagctcagctggatagagcgctgccctccggaggcagaggtctcaggttcgaatcctgtcgggcgcacca

SEQ ID NO: 14520 - DNA, 76 bp, Xenorhabdus bovienii
  RNA gene sequence Name=Xb4151_4152.C434.tRNA6; Position on contig =42929..43004bp; Strand=+; Type=tRNA; Gene name=His GTG; Product=tRNA- Val
gtggctatagctcagttggtagagccctggattgtgattccagttgtcgtgggttcgagtcccattagccacccca

SEQ ID NO: 14521 - DNA, 87 bp, Xenorhabdus bovienii
  RNA gene sequence Name=Xb4151_4152.C434.tRNA7; Position on contig =43020..43106bp; Strand=+; Type=tRNA; Gene name=Leu CAG; Product=tRNA- Val
gcgatggtggcggaattggtagacgcgctagcttcaggtgttagtgtccttacggacgtgggggttcaattcccccccttcgcacca

SEQ ID NO: 14522 - DNA, 77 bp, Xenorhabdus bovienii
  RNA gene sequence Name=Xb4151_4152.C434.tRNA8; Position on contig =43150..43226bp; Strand=+; Type=tRNA; Gene name=Pro TGG; Product=tRNA- Val
cggcgagtagcgcagcttggtagcgcaactggtttgggaccagtgggtcggaggttcgaatcctctctcgccgacca

SEQ ID NO: 14523 - DNA, 76 bp, Xenorhabdus bovienii; identical to SEQ ID NO: 14491
  RNA gene sequence Name=Xb4151_4152.C434.tRNA9; Position on contig =68908..68983bp; Strand=-; Type=tRNA; Gene name=Gly GCC; Product=tRNA- Val

SEQ ID NO: 14524 - DNA, 1158 bp, Xenorhabdus bovienii
  RNA gene sequence Name=Xb4151_4152.C436.rRNA1; Position on contig =81..1238bp; Strand=+; Type=rRNA; Gene name=AJ414141 [D:14272..17178]; Product=23S ribosomal RNA
cagtcgcagataccagctggctgcaactgtgtaataaaaacacagcactgtgcaaacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgtggacgccagtctgcacggagccatccttgaaataccacccttgaatgtttgatgttctaacgcaggcccgttatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacct

SEQ ID NO: 14525 - DNA, 129 bp, Xenorhabdus bovienii; identical to SEQ ID NO: 14456
  RNA gene sequence Name=Xb4151_4152.C436.rRNA2; Position on contig =1316..1444bp; Strand=+; Type=rRNA; Gene name=AJ414159 [R:133614..133847]; Product=5S ribosomal RNA

SEQ ID NO: 14526 - DNA, 87 bp, Xenorhabdus bovienii
  RNA gene sequence Name=Xb4151_4152.C438.tRNA1; Position on contig =5457..5543bp; Strand=-; Type=tRNA; Gene name=Leu CAG; Product=tRNA -Val
gcgagggtggcggaattggtagacgcgctagcttcaggtgttagtgtccgtacggacgtgggggttcaagtcccccccttcgcacca

SEQ ID NO: 14527 - DNA, 87 bp, Xenorhabdus bovienii
  RNA gene sequence Name=Xb4151_4152.C438.tRNA2; Position on contig =5590..5676bp; Strand=-; Type=tRNA; Gene name=Leu CAG; Product=tRNA -Val
gcgagggtggcggaattggtagacgcgctagcttcaggtgttagtgttcttacggacgtgggggttcaagtcccccccttcgcacca

SEQ ID NO: 14528 - DNA, 77 bp, Xenorhabdus bovienii
  RNA gene sequence Name=Xb4151_4152.C438.tRNA3; Position on contig =77259..77335bp; Strand=-; Type=tRNA; Gene name=Met CAT; Product=tRNA- Val
cgcggggtggagcagcctggtagctcgtcgggctcataacccgaaggtcgtcggttcaaatccggcccccgcaacca

SEQ ID NO: 14529 - DNA, 77 bp, Xenorhabdus bovienii; identical to SEQ ID NO: 14528
  RNA gene sequence Name=Xb4151_4152.C438.tRNA4; Position on contig =77411..77487bp; Strand=-; Type=tRNA; Gene name=Met CAT; Product=tRNA- Val

SEQ ID NO: 14530 - DNA, 77 bp, Xenorhabdus bovienii; identical to SEQ ID NO: 14528
  RNA gene sequence Name=Xb4151_4152.C438.tRNA5; Position on contig =77564..77640bp; Strand=-; Type=tRNA; Gene name=Met CAT; Product=tRNA- Val

SEQ ID NO: 14531 - DNA, 90 bp, Xenorhabdus bovienii
  RNA gene sequence Name=Xb4151_4152.C438.tRNA6; Position on contig =163712..163801bp; Strand=-; Type=tRNA; Gene name=Ser GGA; Product =tRNA-Val
ggtgaggtgtccgagaggctgaaggagcacgcctggaaagtgtgtatacgtgaaaacgtatcgagggttcgaacccctctctcaccgcca

SEQ ID NO: 14532 - DNA, 90 bp, Xenorhabdus bovienii; identical to SEQ ID NO: 14531
  RNA gene sequence Name=Xb4151_4152.C438.tRNA7; Position on contig =163926..164015bp; Strand=-; Type=tRNA; Gene name=Ser GGA; Product =tRNA-Val

SEQ ID NO: 14533 - DNA, 77 bp, Xenorhabdus bovienii
  RNA gene sequence Name=Xb4151_4152.C440.tRNA1; Position on contig =184044..184120bp; Strand=-; Type=tRNA; Gene name=Pro GGG; Product =tRNA-Val
cggcatgtagcgcagcttggtagcgcaccgtcatggggtgtcgggggtcgtaggttcaaatcctatcatgccgacca

SEQ ID NO: 14534 - DNA, 77 bp, Xenorhabdus bovienii
  RNA gene sequence Name=Xb4151_4152.C442.tRNA1; Position on contig =116067..116143bp; Strand=+; Type=tRNA; Gene name=Asp GTC; Product =tRNA-Val
ggtgcggtagttcagttggttagaataccggcctgtcacgccgggggtcgcgggttcgagccccgtccgcaccgcca

SEQ ID NO: 14535 - DNA, 77 bp, Xenorhabdus bovienii; identical to SEQ ID NO: 14522
  RNA gene sequence Name=Xb4151_4152.C442.tRNA2; Position on contig =234958..235034bp; Strand=-; Type=tRNA; Gene name=Pro TGG; Product =tRNA-Val

SEQ ID NO: 14536 - DNA, 85 bp, Xenorhabdus bovienii
  RNA gene sequence Name=Xb4151_4152.C443.tRNA1; Position on contig =69675..69759bp; Strand=-; Type=tRNA; Gene name=Leu CAA; Product=tRNA- Val
gccgaagtggcgaaatcggtagacgcagttgattcaaaatcaaccgccttcgggtgtgccggttcgagtccggccttcggcacca

SEQ ID NO: 14537 - DNA, 77 bp, Xenorhabdus bovienii
  RNA gene sequence Name=Xb4151_4152.C443.tRNA2; Position on contig =152283..152359bp; Strand=-; Type=tRNA; Gene name=Met CAT; Product =tRNA-Val
cgcgggatggagcagcatggtagctcgtcgggctcataacccgaaggtcgtcggttcaaatccggctcccgcaacca

SEQ ID NO: 14538 - DNA, 90 bp, Xenorhabdus bovienii
  RNA gene sequence Name=Xb4151_4152.C443.tRNA3; Position on contig =152417..152506bp; Strand=-; Type=tRNA; Gene name=Leu GAG; Product =tRNA-Val
gccgaggtggtgaaattggtatacacgctaccttgaggtggtagtgcctaaacaacgggcgtacgggttcaagtcccgtcctcggcacca

SEQ ID NO: 14539 - DNA, 76 bp, Xenorhabdus bovienii
  RNA gene sequence Name=Xb4151_4152.C443.tRNA4; Position on contig =200743..200818bp; Strand=-; Type=tRNA; Gene name=Gly GCC; Product =tRNA-Val
gcgggaatagctcagttggtagagcacaaccttgccaaggttggggtcgcgagttcgagtctcgtttcccgctcca

SEQ ID NO: 14540 - DNA, 76 bp, Xenorhabdus bovienii; identical to SEQ ID NO: 14539
  RNA gene sequence Name=Xb4151_4152.C443.tRNA5; Position on contig =214192..214267bp; Strand=-; Type=tRNA; Gene name=Gly GCC; Product =tRNA-Val

SEQ ID NO: 14541 - DNA, 76 bp, Xenorhabdus bovienii; identical to SEQ ID NO: 14506
  RNA gene sequence Name=Xb4151_4152.C443.tRNA6; Position on contig =225850..225925bp; Strand=-; Type=tRNA; Gene name=Phe GAA; Product =tRNA-Val

SEQ ID NO: 14542 - DNA, 861 bp, Xenorhabdus bovienii
  unsure (1)..(861): unsure at all n locations
  Genomic contig Name=Xb4151_4152.C1
ngcnnnnnnnnnnnnnnnnnnnnnnnnnnnnnnnnnnnnttatttgcgcgttcaaatatagaataacgctgtttgccaatttatccagtaacagatgcaacgtagcaggttgggcatacatcatggattttattttggtgaacgccttactgcttcccccttcgaccatatacgtcgccagtgtccacggactacccgaaaaacctatcagaggaacttggcctgccagtgccttacggatcgcacgaacagcatccatgacatagcccagctccatctccggatcaggtacagggagtttttccacatctgtatgattgagaatcggagagtgaaaacgcggcccttccccagtttcgaaatacagcccaagccccattgcatcaggaatagtcaaaatatcggaaaacagaattgctgcatccagcggaaaccgacgcagaggctggagcgtcacttcacaggccagttcagtgtttttgcataacgagatgaaatctcccgcctcctgccgcgttgctttatattcaggcaaatatcgccccgcctgacgcatcgacatcaacaggctggcgtaataaggcgcgcagatagcggtcgtttttcaactcattcatgacaagctcccttgattaattggccgcaaaattctttggttacggtcggtttaactttcactataaaaaaccgacgcattgtaacatgccagaaatcgaacttctggcacaactgccaataacatgcgccattcgctcatcatctcagagcagttcacatgttaccatagcgcaaccgtctcttcgatcaaacgcgtgcaatcgtatccgactgnnaggatcagggaaggtcatcatagcgata

SEQ ID NO: 14543 - DNA, 841 bp, Xenorhabdus bovienii
  unsure (1)..(841): unsure at all n locations
  Genomic contig Name=Xb4151_4152.C2
ngcatatnnnnnnnnnnnnnnnnnnnnnnnnnnnnnnnnnnnntttatcggccgcgatggtgtgcttataataaccactatcaatttctttctgttgtacaatgtgattttcagtgaccacaattggtagaggacgggcgggtgtttctgtatcgacgcagtatgaaatataggctttaatcgtaatagaatcaccctcggctattttattcaggtcattagcggtagcggctactggcagccagacctcaattcctttgttaccgatactgtggatattgattgactgatatataccaataaataagccgaactggtcatgtacactttaaatctaaaatatccatcttcggcaaccgctacctccccgaagatcaggttttttttataaatgtgtttatcatcatccgtcacaaatccgatgatgaaatcaccgggatgtaaatgattattctgcgggatcatgaaatggaaataatcgggttgatctggccttgttaaagtggaggactgatatgtttcctcaatgatgggtggatcgaagtcgtcggaaacagcaattggagaagacgtaataaacataacttgtttttgattgtataccctccgactgaatattgtttcaaacccgatgaattgagcaataccggtagtggcgtatattttaaggttaacagccgattttgttgatttctggactaaatagtcataatactgttttttgatcatcaacttcataaggcaaaatttcaacatcgtctacagtaaatatccgcacaggacctgtggcacgaatctgaatatcatattttgaaatgaacctncgctcactcccatcgga

SEQ ID NO: 14544 - DNA, 883 bp, Xenorhabdus bovienii
  unsure (1)..(883): unsure at all n locations
  Genomic contig Name=Xb4151_4152.C3
agcttgaatgcctgcagatcgactctagatgaccctcttcttggcgttaagcaagaaaactaacagggcatcaaaacgcgagctctggtttaccagcagaaaatggccaaccagctgctctatagtgtcatcatctaataacgctaacgcgcttttcagccgctgtttcattattctgcctcctcaacctcagcatggaactcatgttctgctacggttaagcgaatgtcactgattgccgcgcctgcggccattttctgcaacagcagtaatgaaacaggcggtaatagtgcaccatcaatgatgcattccatcatacgggcgccggtttccgcacgattggcaccctgcaggatctcttccgatacttcatcgctgatcgtgacttctgccgataaagcgctgagacagcaggctatccagtcgagccagcttgctctgaatgatggttttcagcgtttcgtgacccaaaggcaggtaagggatcacttccatacgcgccatgaatgcggattttaaaaacgcngtcagttcaggagtacagccactctatacagttctctctgtgaccggcatgaccatggatagcccgatcactcagggataaccgagggaatcacgcgactgtctacatggggatgatacagcgttcgcttctgctgaaactctgtcagtcgagcgctgatagagccagtttttccatcagggattgctctttagagtggcttctgagtccacttgagcaatagcttccgtgctctgtctccccttgagacccctcctccaccgtattttcgatggtcttagcgagagttactgctgcaactgactcgatgctatcccccagaatttgaccgcccaattccgatgaactgttgtaccc

SEQ ID NO: 14545 - DNA, 878 bp, Xenorhabdus bovienii
  Genomic contig Name=Xb4151_4152.C4
cgcaaagcttgcatgtcctgcaggtgcgagctctagaggatacccccccagattgctcaatctgggatactgtctttattttcaacctcttgaattcctatgtattggacttggctagccagccctttcctcaaaagaacttaacatgcgttccctttcgggtttggctaattgataataagcttcaatccaaatcatgaacggatcctgacgcttattacgataatactcgaccgaactttactgacggccagctatttagaattgattttttcacaacaaactacttatgccatctcagcttatcactgctgtactcgcttacttttgcttgctcccaagacttaaatgcactatgcacttcacaccgaatggattagaggatacttgtggtctgaactctgatgttcaatgagatattttatgaagctccaaagccgactatgctgattatcgaaaacatgaatagtgatattcaataaccctgccttgaacacctgttcggttctgtctaaaccatccttcacgtttagctctggcattaactacttgtggtgacctatgtaactcacctacaccggacaactctcattgccgtttaccacatattaatcataatcactctctattttggaaaccaagttcttaaaagtaaacctgaaaaacaagtgagaaatattgatacgacagatactgctatgttatattctgaaaacagattagtgatcgtcattaaccttacactaacactctagctataccactactgagccttcaaaacgaatagataggactttaacaatgagtgtatatatcggactgacctactgctgatacatcgttgccgtacgcaccgcggtacgacactggctgacgaa

SEQ ID NO: 14546 - DNA, 1231 bp, Xenorhabdus bovienii
  unsure (1)..(1231): unsure at all n locations
  Genomic contig Name=Xb4151_4152.C5
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccttccgtgccggggggcgctccggggggctccccctgccgnnnnntgctggaagaggnnnnnnnntcacaaaaaannnggggcaaaactttgccagncccctggcaagggntcgnaacctcctaggaaggggaccccttccccttaaaattggcgcaagggaaagggttaaaacagnttttaaaaattattccccaggagaaagaccccctcacacaaaaataacccggggaaaaaaaaaaaaaaaatactggtggtgggggaaaaaacccccgcggaggaggagaaagattttccccccaaaaaaaaaaaaaaaataggggggggggggtaaaaaaaaggggtgggacaccccccccccccccccaaaaaaaaaaaanaaaaaaaaaaaaaggggcggggggggggngtggggtttggggtaacaaaaaaaacaaacaggcgggggggggggggggggggggttttttgtttttataaaaaaaaaaaaacccccccccccccgccaagagaggggaagaaaaaatattttccccccccccccccccttttttgtttttcttctctgtggngggggggggggggggggggnnnaaaaaaaaaaaaaaaaaaaaaaaaagaggggggggtgggggttgnnccccccccccccccccccgggggcccggnnnaaaaaaaaaaaaaaaaaaaaaaaaaannggggggggggggggggggggggggggggggggggggggggggnnnnccgcccccccacacacaaaaanaanaaaaaaagtggcgcgggtgccgctcccccccccccccccnnncnnaaaaaaaaaaaaaaaaaaaaaaaaaannnnnnnacccaccccccccccncccnnnnnnnnnnnnnnnannnnnttttttaataattaaaaannaaaaaaaaaaaaaaaaaannnnaaaaaacananaaacaannnnnncaccanntcnntnnnnttntntccngtggnntggtgtagagagggaggnnncgcncacnaaaaaaaaaaaaaaaananaaaacatcnnnctgtgcttgttncgtctcncnntcgctccccgccccncnccgnnnggtgggctcgcggcgcgcgcgcgccaccacccaaccacagccagaagaaaa

SEQ ID NO: 14547 - DNA, 1048 bp, Xenorhabdus bovienii
  unsure (1)..(1048): unsure at all n locations
  Genomic contig Name=Xb4151_4152.C6
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgacttggccatggccccgtnccaggnttcgaaacttcctagnaagggnaatcccccccacgtttcccaaacgnacggcccaacggtttcggttttttttaccctccgntttcctnnttgaaaaaacatccccntggaacccaaagnttacnaggggtntggcccccgggggtttttttaccggttcaaacccaaaataaatcgntttttttccccaggggaactgtgggaaaaattccaaaggggcttattccaggcgggtccggcggaggaaattccctttttggggggttctggggctccccacccccccggggagatgggggttatgggcgccccccaaaaattctatgggggtaaaggggggcggttaaaaaaaaaacctttggaagaaaaagggggggttttctcccgcgtgggagaatagggggcggttccccccctaggtatattcttgggaaaaaggggggggggtttttgggggccccctaattataaaaaaaaaaaaaacccttgcggggcgggggaaaaaacccccggtttttttaaaaaaaaaaaatttgtttaaaccccaccaacccccccccggggggaaaaaaagagttcccccccccccctttttttaataaaaaaaaaaccccccccccccccgggcggggggggggaaaaaaaaataatattcctcccctccccccggcgcgaaaaaaaataattaatagtcgggggacggggcaaacaaatattttttttggtgaggagagaaaantanttttttgcgcaaccacccccacccccccccgccggggttgttttttttgtggttt

SEQ ID NO: 14548 - DNA, 1385 bp, Xenorhabdus bovienii
  unsure (1)..(1385): unsure at all n locations
  Genomic contig Name=Xb4151_4152.C7
gaaaaagaaaatagagtgtggggaaggaagagaggggtgagaaagtagaagaaatgggagggttgatatgagaggggtagagtgagggaggtaggncggagggagcgtgtgggtgaggagtgagtagagttaagagacaagttaaagaactgaaataagaaagggataggagagggagaggaagcgggagaaggagaggggagggcgaaaagatgcacgggaaaaaagaaggacagaggggaaagtgagagggatcgcgtaagggaagacggactagaacatacgagaacagtagaagacgtgaatgataaagtcgggagagaggtagaaaatcagagccggaggggatgttgttttagaatatgtagcgaatgatatggaatattggaaaggacagaaagcggggtcagggttgagagcgggggtaagagagaagaaagtcgaaggggggtttttttttttttttttaaaaaaaatttttttgggacctttttaaaagaccccttctttggcccaaaaaattttttccggggaaaatttattcttttttttaaaaaggagggatgtgttttatatccccccccccccccgccaaaaatagaaaaaggacttttctcctctctanaataaangaagaaaggaaagaaattttttttttttcccaagagaaaaagaagagaaaagantgggagagaaaaaccccccccttgtggggggggggggccgccccttcttttttttttttaagaaaaaaaaagccccccccccccctttttgtttgtgcgctctttttttttaaaaaccacacctccccaataataatatatatttattttttacatctaacaacaataaattttattatttcggctgattggtgtctgtctttccttccccgcagaatgggggggaggaaagaaaaaaaattaaattagtgtatatagcaacgaaggcggnttgccgggagaaggagatgttattggtttgttttttttaaaaagaaaaagtgttgacgttatggttttctctatgtatactttttgatgtttttcacatctctattaaatatatcggattgattatgaagctcggcgtcgcgcggtgaacactttgttgtgagtgggggttctgagtcagaaggagcagcaaagcaaggacacacaaatatagagttcgcgtttgtgaagagagtctcgttagtgtttgcgtcagttatatgtttattatgagtggatggatgcggcgcggtatggcgacttgagaggcatagcgacgggttcgcgtaggagttacggatcagatgtcagatgttttgctacactgatcaaaattattgagttcgcagcaaagaagggtggtgggagacgagagtagcgtggaatcgg

SEQ ID NO: 14549 - DNA, 1021 bp, Xenorhabdus bovienii
  unsure (1)..(1021): unsure at all n locations
  Genomic contig Name=Xb4151_4152.C8
nnnnnnnnnnnnnnnnnnnnnnnnnnnnnnnnnnnnnnnnnnnnnnnnnnnnnnnnnnnnnnnnnnnnnnccttttttccaaagcngactcgttaccctcccatgtggtccccntggggcntaggacgcctgggtcttctcnncaaccgcgttcaacagtgggggggggtggccttggagagcgccnngnccatccaacgatgttctgttttgcaaaccancggcccactcaattttttaanaacnnntaaaaancccgggaattcgccgtttncaaccccccccggtttgggtttgggggcccccccttcctttttttaaattttgaaagagttaaaaaaaaccgtaaaaaanaaaaaggcctggtaattgggaaaaaatatatttttttttgggggtttttcctaaattcccccaaaaaaatttnaaaaaaaaaaaaaaaagtgtttttgggggggggtttttttnaaaaaaaaaaagaagttttttttctctccgccccgggtaaaaaaaaattttttggggaacccccggggtttttttttttggaaaaaaaaaaataaaaaattggttggggataaaaaaaaaaaaaaaaaattcttttttaaaaaaaaaaaagagagggggnngnnnnnnnnnnnnnttttttttttttttttaaaagaaganggggggggagaggggaaaaaaaaaaaaaaaaaaacacaaaactctttttttttttttttttttttgttttggtggncacaaaaaaaaaaatattcccccacaaacaaaattttattatggggggtgggggcgccccacttctctcttttcttttataataaaaaataanntttcttcccccccccccccccccccggtttttttttttataanngtgggggggggggnttttaaaaaaaaaaaaaaaaatnnnngnnnaaaaaaaaaaaaaaaatttttntttcttcccccccccccccccccctncgcgttgtgtttttttttgnctcccacaaaaaaaaaaaaaagaaaa

SEQ ID NO: 14550 - DNA, 1257 bp, Xenorhabdus bovienii
  unsure (1)..(1257): unsure at all n locations
  Genomic contig Name=Xb4151_4152.C9
nnnnnnnnnnnnggggnnnnnnnnnnnggggnnngggggnnnctttttttnggngggggggtggccnccncctttggagcnnnnngacnnnnnntttcagttcttttttngnnnnnggnttcataacgtgggccnnnantanacgagcacttncggtttttaccncncnataggtnntannccgngnntatnncganntatntntnncncaaacggnctttncnanactggncncgggnngantanacccttcctntncncgttnncaggncaggncgtttccaaaactgggcgcggttggttattccgnnaccgttgggggccccttgccccggttcgggcaattttggttggggggagagaggggattccccagccttccctttttaaaattttcctgggggggcgcgccttcgggtttttaaaatgggccctttccccgggggggggaaaaactttcccttttgcccccaaaaaaaagaggggggcgaaacgggggccccaaaaaaccccaaaaaaaaacttttttttacaatttgggggggccggccgccccccttttttttttgtgggggtgccccccccccttgtgtgggggcccctttgggaagaggggcggcgccatatatatgtttttttttttggccccccttttggtttttttttgaaaaagggaggggtttttctccccagagagggggggggggggtgtttttttaaaccccaccccaccacaccccttttttaaaaggggggttttttttttctaaaaaggcggcgccccccctttttttttcccccccccgcgccaaaaaaaaaaaaaaagggggggggggggggggggagggagaaaaaaaaaaaaaaagagcnnncttccccccccccttttttttttttggggaccaaagagggggggggggcacaaaagaatttttttttttttttttaaaaggaggagggggcgggccctcttttttttggttggtggggagagagagaaaccaaccacccccccctcccttctcttttctttggggggggggggggggggggcggggggnnnnnnnnnnccccncccccccccccctttccccaaatattttttttttttttnnnnccacaacaaaaaaaaaaaaaaaaaaaagaaacaacacgaactttttttttttttttttttttttttttttttttttnnnntgnnnnntttnttttttttttnnnnnnaaaaaaaaaaaaaaaaaaaaaaaaagatggggg

SEQ ID NO: 14551 - DNA, 988 bp, Xenorhabdus bovienii
  unsure (1)..(988): unsure at all n locations
  Genomic contig Name=Xb4151_4152.C10
gggcgcgcccggaccgccgggccaccggccggccgaacccccccccccccnggggcagttctgctggggtcgccagactgtcattcctgcaggatcgnactctaggaggaatctttctcttcatcccgaccgctgggatctttaagnaatttccaagtaattaaaaattttcacattttacaccaccccctccctatattttcttggagaggtgatttatatatctaccgtgagggtgattatctgatgacggagagtcgtttttttggtttgtttcctattgccctggtttctaatattgtttatataaaatagcgagttaccgcagaaatagggggcccagatattttttcgaaaattttagacccccccatctttttaaaaaagtgggggtgcgggggggtaaaaaaaaagggggggggaaaaataaatacggcgcccaaaaatttaaaatttttccacaaaattttggggagcccccccccctggagggggggtatttttccaaaaaaataatatccccgtaaaaaaaggggggggtttttgtgtgggagggccctctcccccggttttttctcaccctttaaaaaaaaaacaaaatcgcgccgttttttttttccagcagcccccctttttgtttgggggggaaaacacacccctcccncccaaaaaaaggggggggttttttttttcccccccccccttcttagttgggggcgggggtttttattctcttcttcttttccnnnncaacatccccacaaagccactttttttttttttttttttgtgcggtggtgtggcctanaacaccccccccctttttcaaacaaaaaaaaagaagaaccctgtgggggtttgttttggcctgaaagcgccaccctccccccggtcttggagatgtcgatgattaacaacccacccaataagaccgtgcttcgntgttccccctccctccccacccatttcaagattaaagctattcccn

SEQ ID NO: 14552 - DNA, 880 bp, Xenorhabdus bovienii
  unsure (1)..(880): unsure at all n locations
  Genomic contig Name=Xb4151_4152.C11
nngggggttancntgtgtgggcgggcccntttcgtctttttgnaccttngtccctccccccccctttttttggggggggggnggngggnnnnnnnnccccaannnnnnnnnnnnnnnnnnnnnnnnnnnnnnnnnntnanaaaaaaagaagaagagaagaatgaagatatctctatctccccccccctcccccccccccccccctcctccccccccctccccctgttnttttttttttttttatatttatatttatttttgatttttttttatttttttttttttgtgttatattttttntngttttttttttttggcagcggccgaccttnncttaacgatatgggcctccttntttttggggnnntttggnnnnnaggganngggggggnggatttnaaggnttttgttttttttttgggnggntttttttttttttttttnnnaggggnnnaattttttcccgnnnaaaaggggggttttttttttttgggtttttttttggccttctttgggccccttttgggggttnnttttttgggggcccccccaaaggggggngnaaatttttccccggttggggggacccccccccccaattttttttgggggttggggggggggtttttttacccctctttttaccccccctttttttttccccccccggggtttttttttttttgggggggggggcccccccccccaaaaaaagggggggggggnacccccgcccggggcccccccccccacaaaatttttttttttttttccccccccccccccccttttttttttttttttttttttggggggggcccccccccgggtgtttttttttttttttnnnnnnngggggnagggggggtgttttttcaac

SEQ ID NO: 14553 - DNA, 1063 bp, Xenorhabdus bovienii
  unsure (1)..(1063): unsure at all n locations
  Genomic contig Name=Xb4151_4152.C12
gggccaagacctctggcctaggcccttggncgagggtncgggacttctttattgagggaaagccccggtnacggcgagctcgggaccacaaaatataagggaaagaaaacaccccccccccagccccccggaaataagatacttttcccctttaaaaaaaaaacattttttttctggggataccttgggggggcggggcggaaatttttttttcttataaacaaaaaaaacccccccgggatattttttttattttttttcccccaacaccccaaaaaagaggtttggggggagggggggaacaacccccccccaaaaaaggggccccccccccctctccataaaaacccccgggggggggggggaaaaaaaacaaggggggttttttttcccaccctttttgtggtggggggggngaaaaaaaaaatttttttcccccaattgggggcgacaaccccccccctttttttttccccccccttctttcccccaacaaaagagagggcgccggcccgccccccccccacttttttccctttgggggggcgcacaaaaaacccccccacnnncgcccccgcggggggtgttttttttggggacaaacaacccaaccggggtgttttttttttcctttttttaaaaaaaaaaaaaaaaaaaaaaaagtgctccacagctttttttttcgttttttttataaaaaggggggggggggggggggggccccccccccccccccccccccaaaaaaaaaaaattccttcgtgggggggggggggggttttttttttttttctttcccccccccccccgccccacaaaaaaaaacaaactactatgtttgagggacaagaagggggggggaggggggggcntacccccctacgccgccccctacttggttttatatttaggaggcgcacnccgcccgcaccccggggcgcgcaggaaacacaaaaaaaaaaaagggaagaaggccccgccgcggcgccggcacccgattctcttgttttccgtcggtgcgccgccgcccgattatcccaccatacacatgcccatacagggg

SEQ ID NO: 14554 - DNA, 928 bp, Xenorhabdus bovienii
  unsure (1)..(928): unsure at all n locations
  Genomic contig Name=Xb4151_4152.C13
nnnnnnnttttttnnnnnnnnnnnnnnnnnnnnnnnnnnnnnnnnnnnnnnnnnnnnnnnnnnccgatcgagcagtcggacccgcgagcctcctgcacccgagtccgagccgcctagacttgcgaagcccatcatctccntntgtgggnnnnncccggaatccaaattcgnagcttcggtacccctgttactanacttactcngnaggggaactcgaatgagtatcggatagcacctgaataaacctgtcacattaccggaaccacctgggtgctggataaaggcggccatttgggaacaggtaatgggttcttctgggcatggngcccccatgcaccaatttaagggcccatggaattttccctccctttgggggggggacccggtaaaactcggaggggacgcgaattttttgggaaccggggggccccatggggggtggtcctggggttcccgggggggggggcgaaggggcccccccccccggggggaaaaaaaacccccaaggggggggggagtgttttccccccccccccctttgggccactggggggnaagggggggggtttttttctccccgggggggggatttttcgcgggggggggaaaaaaaaacgggcccccgttttttttccacaggggggggggcaaaaaccccaacacattaatttgtgtgttttataaaaaaaaagggggcggccgggcccgggttttttatttaaaaaaaaaaaacaccccccccccccccgggggggggggggtgtaataaaaacccccccccccccncaaaatgttttatnanccgcgcgccgggggggcgccgccctccccctggggagggggaaaggaaangnttgtagtttgttttctctctccccccccnccnccccgcgcggcgggagaggggggtaatgaagatcgccccccg

SEQ ID NO: 14555 - DNA, 831 bp, Xenorhabdus bovienii
  unsure (1)..(831): unsure at all n locations
  Genomic contig Name=Xb4151_4152.C14
gcnnnnnnnnnnnnnnnnnnnnnnnnnnnnnnnnnnnntgcagaaatgactgcttgaaacaaacgatattatctttatcaacgcattatctgttgtatgatatcgatccattgcacttgattttgatgtagagtttgctgctgctatccccgacagatcgtaccggaatgcttgtacatagccttcattcagatacatggatgtctgcctgttacttcaaagtactttagaatccgttcctataccttattccatattccctacacacccatacaaatttgnnnnnnnnnnnnntcgcgacataatgggtctatatctcgctccatacattatttaacctgggaccaaggtggcttttaaatttacgcgtaaaccttccaaaagagggttatttcctaaaaaagccccccctttggaaaagatccttaaaaatcttttttttcacccagaaaaaaaggggcccccatttcccccccaagttgtgggcacccctttttaccccctttaaccccttggggccttttttttggcggggggggggttccccaaaaaaaccgcaaaaatttccccccccccccacaaaaaaatgggggggaggggggggagaaatcccccctcgaaaaaaaaaaaggggggggggggctctccccccccaaagggggggcgcccccccaaaatttttttttgtgagaaaaaacccccccccttcttttttttttttataaaaaagatttttttctggggggggggaggtttttttacacttttttttacccccctctccctttttcaaaaccttttttttttttttctaccaaaaaaaaaaaattt

SEQ ID NO: 14556 - DNA, 920 bp, Xenorhabdus bovienii
  unsure (1)..(920): unsure at all n locations
  Genomic contig Name=Xb4151_4152.C15
cttcggcgaatcggctcggtaccagataattattaanatnnanantannccaannntttanngttangggaaaactataggggaaaaagaaccctttggaaaaagaacgggnngnaaattaanaaatttnnatanncccattnnaccgaggnnnaaatttttcccaatatttncccaaactttncctttncccttntttttngttatagaaaaaaaaaaaaaagcccgacnncccaaaaaaaaaccatttttnnaaaaaatttgaaatgtgnaaaaaattaatttaattaaaaaccccaaaaaaaaaaatttatttttttttgaaaaatattttttggagaggggnaaaaaaaaaaaaaaaaacacccccccaaanaaaaatatatggggggggggggtttcccccacaaaaaatatggtggggnggaaaataaatttcntttttttcccccaaaaaaaaaaaaaaaatttaaacccccccccccaaaaatatttaaaaaaacccccgcgggggggtgtaaaaaaaaaaatatnnatatttnaattattttttttttttaaaaaccccggggagggggggtncncccctcccccctttttttttccgggggggggcccaaaaananaaaaaaaaaatatttataanaacacccccccaaaaaaacccccccgccacaaaaaaaaaaaaaaaaatttttttttcccccccacccccttctttttnttnntttgntttttttgaaaaaatatatgttgtttagataaaatattttttgngggnnttgttttnttttttgtttgnnnaaataaaaccttctcccacacaaaaatatatatattttttttttcccccccccccatatggggagggggggagggggatatataaaaagaggggggcgcccgcgccgcggcacaca

SEQ ID NO: 14557 - DNA, 875 bp, Xenorhabdus bovienii
  unsure (1)..(875): unsure at all n locations
  Genomic contig Name=Xb4151_4152.C16
aacaaaatttcccccatccaacaanttagnnnnaaanaaacttaatctgaagcgatcaaaggaacttattaaaaaagaggtagagtaataggcgactgagagtgttcgtctaagggtggatttattggtgaagtaaaaataaatgtannntnnnatataatataaaaatatgggaccagaacttttgcncattgtcccccctgtgncccaaaaaaagggggggnntttcgggggaaaaaaaattttttccctttttaaaaaaanaaaagaaaggggngaaaattccccccctttcggggggggtttttaaagaatttttcttcaaaacaattaagtttggttttttccccgggcccaaaagggntttttttaaaaaaaggggaaaggtttttttttgttttgggggaaaaataaancctttaaaaaggaaaaaatttttttttaaaagggcccggggggcccctttaaatggggggggggngaaaaaacggggggttaaaattggggggggccccccccttggggttttttttcaaaaaaaaaaaaaaattttcaaaaattaaattttttggggaaaacccgggggggtttttttttttcccctcccccctcttttttttttaaaaaaaaaaaaagggttttttaaatatttttggggggggggaaaaaaaaaaaaaaaaatttttttttttttttttttgggggggggggggggcgggaaaacataatttttttttnttttcttggggggggtggttttttttccccccccttttaaaaaaaaagagggagggaaaaaacaccccccccccctttttttttaaaaaaaaggtttttaaaaaaaaaaaaaaaaaaggggggcgcttcaattattt

SEQ ID NO: 14558 - DNA, 906 bp, Xenorhabdus bovienii
  unsure (1)..(906): unsure at all n locations
  Genomic contig Name=Xb4151_4152.C17
ngcagcnnnnnnnnnnnnnnnnnnnnnnnnnnnnnnnnncgctggnaaacagnnttgtagaagggcgaatntggaccgnntctgcgcgaatnacttccgnaaacggttcccccacaaagncgttaatttttccgaatttggggggtttaaaagggnnaaaaaaaaaaaaagaagagggggttttttggggggggggggaaaaaaaaaaaattttttgttgtgggggngggggggggnnngngggngggngggnnggnnnnnnnnnnnggggggggggggggnnncccccccccccttttttttataaaaaaaaaaatattttttttttttnttgttgttggggggggggngntntggggggggggggggggnggggggccccttttgttgggtgggggggggggggaagaacaaaaaaaacaanaaatctttttttttttttttcttctttgggcgtgtgggggggnggggggaanaaaaaaaaaaacaacnccccccccgcgggcggggggnnngtgtttggttttttttttttttttgttggtggnggtgggggggtggnnnnttgttttnnccccnccccccccccttcctttttttttgttgtttgggggggggggngggcggngnccgcccccccccccggggggcgggggggngggnggnnggggngcgcnnccccccccccccccccccaaaaannaaaaaaaaaaaaaaaanaaanannnaaanannntttttntntttttttttnttttgggtgtgggtgggtggggggggnngcggcggggccgcccgcgggcnggcgggggngnggggggggggaggggnnngggggggggggcncgcgtggtggttgcgcgtgtggtggggggggggggggccnnnnancaaaagagagaaaat

SEQ ID NO: 14559 - DNA, 991 bp, Xenorhabdus bovienii
  unsure (1)..(991): unsure at all n locations
  Genomic contig Name=Xb4151_4152.C18
gaaagttttggnnngactcttgcgattcgagcnggttccccccgnaaacctgggancagnntnnaacccttncttncncggggncnaccncgggnnncnncaggtttnncnaccnccnccnaggtttnnagannntatgggggggnnttttnnccaanaaccccccttnttttnnccccggaancncccccgggncctctttgggnncccnaaacccccccaaaccttttttnttncccccccgggttgggggnaaaccgggggggtttgtgggnggggccccggggggggnccttttttccggcccaaccaatttccaatttccccaggggggggtttttttttttcccccgggggggctttggggccaaaatttgggggaacctttggggttggggggtttgggccctttttttttccggggggggtttgggggttttttgggggggccccccttttttcaaaaggggccccccggggttggggaaccctttgggggaaaccccggggttaaaaaaacaagggggtttttctttttttaaaggggttatattgggggggggggggtgtcccccccggggggggttttttttattttccccgggggggggggcccccgggggtgtttttttaattatattcccccgggtggggggggccccccgcggggggttataaaaaannnaaattttaagaggtgggnggggggtntttcaataggggggggggtgtgttttttccccccccccctttttgggggatttttttcccccccggcgggttttttttttttttttttggggggggggagagaaaaaannnncccccccccggggggcnncccgctttatatttacacccccggngagaaaaagaggaggagggggttgtgtttttttttngnagggttttttttcnccccccccccggggttttaagagagggcgggcccttttttttttataaaaaaaaaaaaaaaaaagagagggtt

SEQ ID NO: 14560 - DNA, 902 bp, Xenorhabdus bovienii
  unsure (1)..(902): unsure at all n locations
  Genomic contig Name=Xb4151_4152.C19
agcaaaactgctggtggnctgnaacatgaccggntatcttttcttnnccttgganngagnntancncncncgngnttananagnncttgnnctngnngnnnagannaanccnaggnncgnncnattcnacncncagannngaannaaaactttnnccaanatattnnccggnnataanccttttttgggnnaaaaaaatagggnnaatagggnaaaaacccgcgggaaaaactttgggggggttttttaaaccttggggccttttctttggggcccaatttttgggaaaaaaaactttaacttttcccccggggtttttattcttttttttttctttggggcccccggggggccccccaaaaggggccggaaaacccccgggcccgggcccaaaaagggttttgggtttttggggatatttaaaaccccttttttttcccctttttgcccggcggaaaggggggggtttttaaacccggggggnggggtggaaaaaaaaataaaaaattttttttcaggaggggggnatattttttttctcccccccccaaaaaatatggggggggggggtgttttttattttttttgggggggggaaaattatttttttctcccccaaagaaagaagaaaaccccccggggggggatatatatttgtttttttccccccccgcccccccccaacaatgttgggtgaaaaaccccccccccccttttttttttttttgtgggggggggtttttattaaaaaaattttttcccccccccccaaaaaaaaaaattttttttttttttttccccccccccccccccccccccgcgttttttttttttttggtgataaaaaaaaaaaaaatttccccccccccccttttttttttttttttttggggggagcgccc

SEQ ID NO: 14561 - DNA, 986 bp, Xenorhabdus bovienii
  unsure (1)..(986): unsure at all n locations
  Genomic contig Name=Xb4151_4152.C20
nnnnnnnnnnnnnnnnnnnnnnnnnnnnnnnnnnnnnnaaaaaaatanngngnncccccnnntaactcaagaanataccctatnngaagnagnataaaaacngagntcggttannaanannnaaaccacaaatcccatagnngccanntnttaatgnnnnnnnnnntntnccccccccccctttttttttnnnnnttttttttttttttccccccccccgnaaaaaaaaaaaaaaattttttttttcccccccccnaaaaaaaaaaaaaacttcccgnntacccccccccnnttntttcccccccccgnnttttttttccttggnaacgnnaannnaaccgntnttccccccctttccctttccgngnntttttaaagncccttttttttaaaattccccttntttccctttggaaaacccaaaattttggggggntttttttttcccccccttttttccccccctttttttaaatttgtngccccccccgccccccccaaaattttttttccccaaatttttctccccccccaaaaaggggaaaaaaaaaatttttttttcccccaaaatttttcccccccccccccccccccccccccgggntttttttttgggggngnncncnccccgggccccccacaaaaaattttttttaaacaccccccccaaaaaaaaggtgggnnnnntnttttattaaaaaaattttttttggggcgcccccccccccccgggggggggnccccccccccccccccncccccgccgggggggngggnaanaaaaaaacccccccccccgggnnnngggggggngggntttttttttttttgggggccgcngaaaaaaaaaaaaatatttttttccccccccccccgngncccccccccctttttttttttntttttttttgtttttttttggcgggcgggaaaaaataatatattatgattttgggcccccccaccacaaaaaatatatttttntt

SEQ ID NO: 14562 - DNA, 1002 bp, Xenorhabdus bovienii
  unsure (1)..(1002): unsure at all n locations
  Genomic contig Name=Xb4151_4152.C21
nnnnnnnnnnnnnnnnnnnnnnnnnnnnnnnnnnnnnnnnccagaaaaagaggggcgggacccgctggggcttctccatcccggagagacgcacttaaaagagtgtactaatgaaaaaggnnnnnnnnnnnnnnnnnnncaggataaaaattcgagctcgggtaccgntgnacaaggccatgcggaaagtgaaaggccggaatgacattgggggtttaaaaaggccgggggtatccatattggggaaaaaaaaccctttttttcccccccccccacccccccaaattggttccccccccccacccggggggggggtgttggttttttaaaagacaaataaaaaaggcggcgcccccaaaagggagaaaccaccccccccggagaaaaaaaaaacccggggggtttttttttttttttttttcacacccccccccccccaccgccgggggggggtgttttttttttttttttaattttgtttttttattttgaaccaaaaaaaaaaaagcgggggnnnnnaaaaaaagaaattttttttgtggggggggcgcggggggggggggggtttttttttctttttccaaaaaaaaaaataancacccccccccccccccccccactcctccaaaaaaaaaaaaaaaaaaaaagaaggggcgcgggccgcgggcggggctttttttttttttctcccccccccccgcgcgccgaaaaaaaaaaaaaaaaaaaaagaaagagggggccccctccgtgttttttnngnnncttttttttttgtgtggtgntnanacacaaaaaacaaaaaaaaaaaaaaaaacaaaagaaaaanncgngnngggggggggggggggggcgcgccgcnnccccccncccccccnnttcccccctctttttttctttcaacaaaaacaancacaacacaaacctatnaanaaannnntnnnnnnanntagnnnggggggggggaagaagagaggagagagagcagaccccaccctccccccg

SEQ ID NO: 14563 - DNA, 1016 bp, Xenorhabdus bovienii
  unsure (1)..(1016): unsure at all n locations
  Genomic contig Name=Xb4151_4152.C22
nnnnnnnnnnnnnnnggggnnnnnnnnnnnnnnggggnnggattttttggcctnnnggtttggggggtcttgggncnnnnnnntttttnnnccgttttntttttttttnnnaaaaaaanaaacctttttttgtgaggagnnnanatnacaagaacctnncgggttttcacccctggggttgggttaattnnctaacaanacttaagcctggggncttatnaaaaananacncngnnantnnatttttnncatnccccaaagnaaccaaaaccccaaaaaccgcggggncccaacccggtggcccgagagttttaaaaacacccccaaaaactttaaaaagggggggcccccttggggcctcttttaatacgcggcacaaaacaaaaaaccggcggaaaaaaatcctctttcgcgggggagaatattttataccaccaaaccccaccgtttaattgtggtgggaaaagagcgcgttttacccccccatttttggagaaaaaaccttttgagagcccccacaaaaaaaccggggttttgggccaaaaaagggaaaaactcctctttaaaaggccaaaagcccccccccaccttttttttttttaaaaggtggggggggggggggaaaaaaatggggtggggggagagaatatatccccgggggggggggggggggggggggaaaaaaaaaaaaaacccgggggttttaaataaaaaaattttgggggagaaaaaaaaaaaaaggggggcgccctctttttttttttttctttttgcggcggggggggggggggggggggnnnnnnnnngnnccccacaccacaaaccagggggggagaagaaaaaaaaaattttttttttttcttcaacccccccnnccaagggggaggaaaaaagaaaaaaannnnnntnaatnnttttttttttnttgngggngggggggggggggggnnnggggggggcgggcnncccccccctctccnnnnccgggggtnctgggaagaaaagaaaaaaaaaaa

SEQ ID NO: 14564 - DNA, 811 bp, Xenorhabdus bovienii
  unsure (1)..(811): unsure at all n locations
  Genomic contig Name=Xb4151_4152.C23
tgtatacgaattcactcgtaccctgaacagtgnaggnaacagnanaccttncctgtagcggcgcgagcggnttagnanatncctgnccaccatgggtccacttcccgncncgggggnaatncccgcgtcagnccgnatgggggccattcnanatnttncnagncccctgngnagnaaccaggcggaagnaacccagnagagggccaagcccattaattccgggggcccgttggaagggggcccgggttgccccagtccctttccgggggggggaaatgcccccaaatttggggggcccggggttccccccccccnaaaaaaggggtgggtttcccgggggnnaacccacaccttttctttggggggaaacctctttttccaagaggggatataaaaagggcccttttgtgggcgccgccccccccattttaattttcncccggggttttgtggaaaaatttttcccaccgggggccccccccccggggggggggagaaaaaaaaaaacacacccgcccgttttttttttttttttggggcgggaaaaaaacaaacccctttccccgaaaaaaaccttttttgtggcccccccccaaaaaanccccccccccaaagagaggggggggcccccccccacccccccccncaaaaaaacccccccccccctttttttttttaaaaaaaaaaaaaaaccccncacaanaaaaaaccaccccccctncggtgggcgggcnacacccccacaaaaaaaacatcttctactcaccagaaaccgcgngnnnanaaaaaaataaatttgggcgcgccccca

SEQ ID NO: 14565 - DNA, 955 bp, Xenorhabdus bovienii
  unsure (1)..(955): unsure at all n locations
  Genomic contig Name=Xb4151_4152.C24
nnnnnnnnnnnnnnnnnnnnnnnnnnnnnnnnnnnnnnnnnnnnnnnnnnnnnnnnnnnnnnncagcttttgtttctgtagggccactctagaggatctccttcatctaaagttatgtttgattgcagattttattggatttaattaaataacgtttgatttagatttggatatatttgatattattgagctgatagtatgttgagattgtgtttataatagcacttgtaggatttatttttcagaggaatgcatgttattgaatattgctgaatagaacttgtttttgatttaactgattattaactttatgtgaccggagttgctgatattttcctctagtggatttttatttttttttcatttattcttttgctccntnnttttncnncaattgagtgccgctttttgtcatttttttttattatagctgcaatgttttgttagctgtggggggtgggtggataactattttttatttttatttatttttgggggggggggggggggggggtgccctcccccccccccccccgagagaaaaagaaaaaancncccccccccccccccccnnnttttnnnggtggggggnntgtnnnnnnnncccccccccccccccaaaaaaaggggggggtggggggggggggggtcnnnnnnnnnccccccncccccccccccccccccnggggggggggtgggggggggggtggtgncccccccccccccccccccacaagaaaaaaagagggggggggggggnngnnnnnnnnnntttnnnnnnnnnnntttccccccccccccgcgcgcgggggggggggggngntttttttttttttttaaaaaaaaaaaacaaaacaaacccccccngttnnnggnttggngtngngtggggngccccccccccccccnggggnnnnnnnnnttttnnnttnnaataaaaaaggggtgagggggg

SEQ ID NO: 14566 - DNA, 823 bp, Xenorhabdus bovienii
  unsure (1)..(823): unsure at all n locations
  Genomic contig Name=Xb4151_4152.C25
nnnnnnggggnnnnnnnnnnnnnnnnnnnnccttttcgaatggggcttgnccccntgcggtttggctgggtgcggtaatggggtgggggcggctggtgggatgttnncggggccnnnnanaanagnaaagggggngcagaattttaaaagnnaanatnncgnnganncttncgngtnnnanncccttnctattnactttnnnaananactggnnnanataggtntnncaagnnctttnncnacaatnaacggnnngannnacgnnncnnanatncctnncccaaagaancccaaaacgggnaaggncccccattnccaaaaccaggggnngannaaaaaacccgggttttgggccggccccggnaggcccaccattcccaaaaaaaaccccccaaaaaaacggggggccccccaaaaaaaaaggggggttttttcccccccggggtatttttaaggggnnaaaagggggccccgggggggggtttgggggcccccttttttaaaaaaaaattttatttttccttttgggggaaaccccccaaaaacaccccatttttttttttaaaaaaaaaaaaacccccccccccccccaaaaaaaatattttttttttttttccccccccccccatatttgaggggggggnnaccacccccggggggggggggtggtttttttttccgggggggggggggggaaaaannannatnattttttttttttatttatttttgcggggggggggggcccnnnaaataaaatataattaaattgaannaaaccccccccccccccccccggggggggggggtgggggggggtttt

SEQ ID NO: 14567 - DNA, 959 bp, Xenorhabdus bovienii
  unsure (1)..(959): unsure at all n locations
  Genomic contig Name=Xb4151_4152.C26
nnnnnnnnnnnnnnnnnnnnnnaaaaaaaaaaaaaaannngnnggggggggngnnnnnggnggggggggggngggagccccccccnccncccccaaaaannnnnnaggccctaaacccggacccgaccccgcccgtgccggccacccccgaggaaaacccccccctatcaaatgggacccccccccggacccacccaacccccccgggcccaaccccccccccggccccggccccccccccctttaaaacccccccccccccccaaaaccaccccccccccccccgggccccccccgggatccccccccccccccccaaaaacccccccccccccaaaaacccccccccccccaaaatttccccccccccccattttccaaaaaaaaaccccccccccaaaaccccccccccccccccccccccccccccggggtttttttttaaaaaaaacccccccccataaaaatgggcgngggggaaaaaacccccccccccccccccccccccggggggcccgccccccccccccccccccaaaaaaaaaacccccccgggcccgaggggaaaaaaaaaaanggggggccccccccccccccccnnnnnnnntttaattttcctatcaaaantgcccccccccccccccccccccccaaaagggaaaaaaaaaaaaaaaaataattnccccccccccccccccccccccccccaaaaaaaaaannaaaaaaaaaaaaaagtggtagcccccccccccccccccccccccngggggggggggggggggtttttttttttttttctcttatttccccccccccccccccnnngccgacnccccccnccccccnccccccgggcaaaaggggcggccccccccccaaaagggnggggggaagttaaattttttttttttttttttttttttccccccccccccccccccccccncaaaacccaaaaa

SEQ ID NO: 14568 - DNA, 936 bp, Xenorhabdus bovienii
  unsure (1)..(936): unsure at all n locations
  Genomic contig Name=Xb4151_4152.C27
nnnnnnnnnnnnnnnnnnnnnnnnnnnnnnntcgatggctaagccatgaaataccctcccgactgcattggcccccaggggcaaaaaataattgcgtaaagacccgccaatttcaaacccccgccggggggtggtgcccgcccaaacttaaaaaaagggccttttttaatattttttaaacacccgtctccaagggggggaaaaaacccccacaaggggggggggaacccctcaaaaaaaaaaaaaatataccccccgcgcgggggaaaagattccctcccatttttggtggaggggggagaatatttctcttgttggtgggaggagaaaaccccccgcccccccccccctctaaaaaaaaaaacacaccaaaaaagaggctgtctctctcccccccacaaaaataagggggcgcgccccccccccctccctttaaagaaagaaaagggaaacccgtcccccccccccccccccaccccaccaaacggggggggggggggggggaaaaaccacccaccccccccctttttttttttttataanaaaaaaaaagagtgtttgccgtctctcccctcctcataaaaaaaaaaaaaaacagaaagacggcgcccccgcccccccccccccccccctcttgtgtcgcctggnaagnaaanaaacaaatacccacccccacacccaccctaccccacaattataagacagggcgccggggcgggggagaaanacagcgccntccccaaaccaaaaacacagacacatcccccccccttcccctccgccncgcccgggcccccgcccccccccccccccccccggcctncttcnttttttttttataaaaaataaaaaaanacaccccccccctcgggnngggggcgcggcgccccccntccctcccccccccnccccccccccaaagaagaaaagagaaaa

SEQ ID NO: 14569 - DNA, 1271 bp, Xenorhabdus bovienii
  unsure (1)..(1271): unsure at all n locations
  Genomic contig Name=Xb4151_4152.C28
nnnnnnnnnnnnnnnnnnnnnnnnnnnnnngggggggagggcaaanantcccctnnnnnaagggagaggggccccnnccagggaaagggggtttttcctccggaagggatgccccccgtaaggggcaggcgcgccgttttttcctcggttggaagaaccgcccactttcaatgctggcgtgcggacacaaacccgtaccctcaaccatcgggtngagggccaaagcccttttccaattggccccccgtggccaaaggganttcggncaaccttcccttaagnnagagggggnnaattccccttcctcctctnccttnntaaattaatttggngggnttaaagncaatgggccccttggcgccccctttgggttgggnnncccccaaagggtttaagggccccccctttgtggncccgggggggccncaaaaaatttttaaaaaaggggggcccccccggccccttaaaattttccccggggggnnttgtgggaaaaaaacccttgggcccaaaatttttttccctttggggggggtttataaagggtcttttttggggttttggggaaaaaattttggggccccccccgggcgttttgggggggttttttttttaaaaaaaaaacccacacagagggggggggtttttgtggggggggcccccggcgggtttcccacaaaaaaaaattttttttttgtgtgggggggggaaaaaaaaaaaaaaaaacactttttttcccccccaaaaaatttttttttttttcttttttttccccccaaaatttttttccccccccctttgggggggggggggggtttttttctttttccccccaaaaaaggggggtttttacaaaaaaaaaaagaaatcccaaaaacccccgcgggggggggggacacaaaaatttatttgtgggggggcgcccccccccccccccaaaaaacaaaaaaagggggggttataaaaaaatattttttttttctttttggggggggggtgccccccccccccccccccggggggagggtgttttttcccctctcccttttttttttttttttttctccttcgcccggagaaaaaatataattatttccccccaacaaaacaataacaaaaaaaaaaacccctgtggtgggggcggcgctcttcttttttgtggtgtaaaacaaaacccaccccggcgggggggggggccgacataaaaaatatattgttgtgggggaaaaaaaaataatattatggtgggtcggcgcctccccttttttttt

SEQ ID NO: 14570 - DNA, 926 bp, Xenorhabdus bovienii
  unsure (1)..(926): unsure at all n locations
  Genomic contig Name=Xb4151_4152.C29
tttggcatgggcctgtcagggttgcaactctagtaggatcccctcacctatncaagggggagagggttcccggggcccaataaggccgcggcccaaaaaaggggaaaaaaaagggggtttttttaaaggggggaaaaaaacccttttattgggcccccccaaaaaaaggggaaaaaaaaaaaaaaaagagggggggggggttaaaaaaattttaaaaaaaaaaccccccaaagggggccccacaacgcccccccgggggggggtttttaaaaaaaaaaaagagtgcccccccccctcaacccccgaaaaaaangtggaaaaaaagaggggggggttttaaaataatagcgggggggggggtgttttttcccccccccccccgccccgggggggggggggggaggnnnnnnntttttttttttgtggggggggggggggggggggggagaaaaaaaaaaaaaagagagaaggcgcgcgccgccccccccccccccccaccacaaaagggagtgtgtttttggttttttttcccccacaaaaaaaaaaaaaaaaaaaaaaaaattttttttttcccccccncnccctccccccacactntcccccacaaccacctacttatatttctctnaaaaaannannannnnnccccaaaaaaaaaaaaaaaaaaaaaaanngttgggggggggggggggggggggggggggggggggggtgggcaatatttttttttttttaccttcccccccccccccccccccaaaaaaaaaaaaaaaacccacaaaaaggntccccggcgggggggggggggagngagggccgcccccccccccccccccccccccccccccaaaaaaaaaatttttttttttttttttttttttttttttttagagaagagagggggggcgaggccccccccccccccc

SEQ ID NO: 14571 - DNA, 998 bp, Xenorhabdus bovienii
  unsure (1)..(998): unsure at all n locations
  Genomic contig Name=Xb4151_4152.C30
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnggttccttnnnnnnnnttnnnnnnnnnnnnnnnnnnnnnnnnnnnnnnnnnnnnnnnnnacggtacaattcgactcggtacccattatgaatctcgtcagtatgttgtggagagcacaccagctgacgccaagcgaacacgggtgatgatgcataaatcaggatttagtcgggaaacccacgggtgggccccccctgttaaaaaaaacccgggaaatgaccaatttgggatgggaaaagggttattttttggaagggcccttttctggggtttgggccccctccgggggggttttcccccccgggggggcccccccgcgggggggggttttaagggggaaatttacccttttttttnccaaaaaaaggccccgggggggggtttttttttcttttttgggggggtgataataaaaaaaagaacccccccccccccccccaaaaaaaaggggggggggggggggccccccccccccccgggggtttttttccccccccccccccccacgagagggggggggggaaaggaaaaaaaaaaaaaaaataaaaaaaaccccccccccccccccccccccggggggggaggggatataaataattttatctcccccccgcgcggcgggaggggggggggggagaaaaaaaaaaaanntttttttttttttttttttttttttttttcaacacaccaccccccacacccccccgcgccgcttaaaaaaaaaaaaaaaaaaaaaaaaaaaaaaaggggggtttttcgggggcgggcgggcgcggcccnnttnntttnnggggggccgaagaaagagaaagagaagaataaaaataatattgtntgggaggggcggcgcgccgccctcca

SEQ ID NO: 14572 - DNA, 872 bp, Xenorhabdus bovienii
  unsure (1)..(872): unsure at all n locations
  Genomic contig Name=Xb4151_4152.C31
ggggnnnnnnnnnnnnnnnnnnnnnnaaaggccagtcctaggttgncttggcctgacacgactgctataatgagaagcatctcacttgagggctacctaatataatcctgatgtatatatttatttgatggtttgctatctccaatactaacagaatctgagtgctctatgaattacagctagaatgccgctagcttaacgagccctctgaataaacgcttactgaaataaagatacggtaagtataccagtcacttattctttccgttgcactgcaaacctgacaattaacgagttcacttactggtgcacagtacatgctgatatgccgggtgaagggggtattgatgaacaacagctggggggggtacatgctcttttcaattcctttatttacagtctaattaaaaactgcgactggattgatgtgggggggcccctaaagaaactcttgggnncctagaagccccttcgggggcccggaagtttttnccggnnnaatttncctcttggaaagggaggtttaatcccccccccccccgcggttttttttagggnncaccccgcnttttaatttgggnngaaaaccgggaaaattaaacctttttttttttttgggggggtttaatttggggttttttttttggggatttaaaaaccttttgggggggttgggggccccaaaattttttttttggggggggcccggggaaaaaaaaaaaaaaatattttttttttttcccccccttttttttttttttttggggccccccccgccttaataaaaaaagagggggggttttttccacaaaaagggggttttttttttggggggggggccttcttttttttatttttaaaaaagagggccc

SEQ ID NO: 14573 - DNA, 1024 bp, Xenorhabdus bovienii
  unsure (1)..(1024): unsure at all n locations
  Genomic contig Name=Xb4151_4152.C32
nnnnnnnnnnnnnnnnnnnnnnnnnnnnnnnnnnnnnnnnnnnnnnnnggggggnnnnnggggggggnnggnnnnannnaccgcgcccggcagcccggcgggcgccgccagaggggcctcccgcgagcgggggannanagnnaggggnnnggccagctggcaggcctggcagggtcgnactcctaaaggnatcctccacacacacacgntcgaaaaaactgggacttaaaagcctaaagggaaatttcccaaacctaacccggaattttaaaattaaaccccccacaaaatttaagggggtaaaacaccacccccaaaaaaaaaaaattccccctggggatccccccccccaattaaaggggaaaattaaagcgcgggcggataaaaaaaaggggggggggggagggggggtttttaaaaaaaaggggggaaaaaggaggtgccccccccaaaaaaaaacaaaaagaggggcggcgggggggaaaaaacaacacccacaaacctggggggggggggggggggggcgcaaaaaaaaaaaaaaaacacccccccccccccccgcggggagaagaaggggcctcttttttttccaccaaacacaacaagagggggggggggggggatccccccaccccccccacaaaaactccccccccgagggggggggggggaaaaacaaaaaaggggggggggggggggggagaaaaaaaaaaaaaaaaagaagaggggggggggggggcgccccctcccccccccaacccttttaataaaaacaaaaaaagaaaaacagggggggggcggggctggtataacccacaccaacacaaaaaaaaaaagggggcgggggggcgcccctttaaaaaaaaaaaaaaaacaaaccccccgggggggggggggggggggggaaaaaaaaaaaaaaaaaaaaaaaaagggggggtggggggggggcgggccgctttnttgctcataaaagagccgccgcccgcgccgccccnccccccaaacataaaanaccgcccgcgcg

SEQ ID NO: 14574 - DNA, 791 bp, Xenorhabdus bovienii
  unsure (1)..(791): unsure at all n locations
  Genomic contig Name=Xb4151_4152.C33
nnnnnnnnnnnnnnnnnnnnnnnnnnnnnnnnnnnnnnnnnnnnnnnggggggcgggggggcccnggggccccnnngngnnggnnnnngnnctgnngnngnnnnnnnngggnnnnntnnnngnnngggngnnngnnanaaaagagananaggnngnnncnnnnnnnnnnntnnnnggggggggggggggggggcccccccccccccccaaaaaaaaaaaaaaaaaaaccccccccccctttttttttttgtggggggtgcccccccccccaaaaggtccccctggccagggtcggaacctcctaaaaaagggaaatcccccctttttttttcggccaaggncaattttccaggggccggggggnaaaaggggggttgggaattccccgggcccccaaccggaaatttgggttggaaaaaaaaaaatttccaattttcccttttccatgggggggccggggccttgggggaaaaacaagggccaaaaatttttcccccaaacccgaaaaaaacggggggaaatttcccttttttggggcgccgggggggttaaaaaaggggggggccctcttgtgggaaaaggttttaaaaaaaaaaaaaaaaattccccggggtttccttgggggggggtttgggaaaccccaagggccaaaaaaaaagggttctccaagggggggaaaattcctccccaaaaatgggggggggccccaaaaaggggggggaaaaccccgcggggggggggccactttttttataaaaaaaaaanaatttttttttgggggcccccccccg

SEQ ID NO: 14575 - DNA, 907 bp, Xenorhabdus bovienii
  unsure (1)..(907): unsure at all n locations
  Genomic contig Name=Xb4151_4152.C34
ggcnnnnnnnnnnnnnnnnnnnnnnnnnnnnnnnnntcattcatgcctgtctagtttgctgctttgaaactttgactctgactcgcacctgatcatgagagacgtgccgaatagaacccacgacgatgcgccaatcttactgacactgacgacatatgacttgctatcccagtgatgaacagtcgatcgcatgtacaacagcaagactctccgcagatgacagctgcatcggaagcatcactttagcataaatatcactagccagccctgatgtatcccaaacctgaatgcagttgaatttacaaccttttttattcgcctaacacccctgagtctggcaggtttataaagtttcccttaacccccccccgaaaaaggcctgaatttttggcttggggaaaatgggggaaaaaaaccccccggtttggtcccccccctgggggcaagaggaaaacccccttcccccccccttttataaaaaaaaaaagagaaaaaaaaacccccccctcccacccccaaatatttttgtgagaaaaaaaaaatatattggggggggggggtgtgattttcccccccccccccccccccttttttttttttgaaaaagaaaaaaaaaaaaaaaaaaacaggggtgtgggggggccgggggcggtattaaataaaaataaaaagggcgcccgccccccccccccccngggcganannnnnnncccccaccccccaccccccccncnnncnnngggggggaaggaagagaaaaaactctttctttttttttttctttttggggggtgggngnnnntggtggncccccttccccacacaaccaaaaaaaaaaaaaaaaaancgccggccgggggggggtgtgttataaaaaaaaaacaaaaaaaaagaagaaaggggggcg

SEQ ID NO: 14576 - DNA, 649 bp, Xenorhabdus bovienii
  unsure (1)..(649): unsure at all n locations
  Genomic contig Name=Xb4151_4152.C35
gacttgntgnacnnnaaaacaccactttttttttccgccctttgccttggncgggnttacgncaccccanncncanactggnttttnncgtnnaaaaccgtgttnctttnattnganncccctgcccttnaggtaaagnctgttnnnttnnggggtgaaaattaaaaaccagttnaatttgtncacttattttnnatttaaaccccttatttttttccccctgtgtttttttaaaccctttttaattncccccgggccaaacccccttttttcctttaaaaaacctttttcaattccgggccccccccatttttttggggaaatttttccccaaaaaacccttttaaaaaaaattttttttnanaaagaantaaaaaagggggggttttcctccccacccccttttttattattggggggggggtttttttttttttccggggggggggggggggggggggtttttttttaaaaaagagggtgttgtggggcccccccccccccccccctnttttttttttgtgggggggggnnnnanaaaaacacccccctcctttttcttttgcccggcgcggcgcccnnaaaaataaaaaggagggggggggggagttttttttttttccccccccccccccccccgccagtttgg

SEQ ID NO: 14577 - DNA, 1117 bp, Xenorhabdus bovienii
  unsure (1)..(1117): unsure at all n locations
  Genomic contig Name=Xb4151_4152.C36
nnnnnggggggnngnnnnnnnnnnngttttgnnngggttttttggggattgaaacggcagttttcgnngggggggcccccnatttggggttgcccactttaaggttttttaaaanaaggtcttggggtgnctaaaatcccggtttcggatctngagaggtaccccaccccctgccccctcctaagttggtggggaacctaatttccaaagaggcccaggggtaggggttcccgggggtttttttacggggggaggcccatataaaaaaggggggggaaaaaggggggaggcccggcaaaatttggggaaaaaagcccgggggggaaaaccgccccccctcgggaaaaaccgcggggggggaaaaccccccctttttttttttttgggaaacaaccttttggggggggggggggggcgccccaaaaaataattatttttttttaaaggggggggggggggaaaaaannnnnnnntttttttttttttctttccgcggggggcaaaaaaaaaaaaaaaaaaaaaaaagggggtggtgggcgccccccccccccccccgggagggggggggagaaaaaaaaaagaaccccccccccaaaaaaaaaaaaaaaccccaccntttttttaaaaaaaaaaaaaaaaaaaaaacaaagaaaaaaaaaaaaaaaaatatatgtgggggggggggggnggggggataatttttctcttttttttccccccccccaggggggggggggggggggggggaggaaaaaaaaaaaaaaaaaaaaaaaaaaggagggggggggggggggggggggggggggggacaaaagaaatttttttttttatttggggtgtggttttttgtttttgtaaaaaaaaaaaaaaaagaacccccccgcccgcnncnnnttttnnnnaaaanggaaaatttttttttttttntnnnaacagaaaagaaggaagnaaccccaanacccaaaaaaaaaaaaaaaaaaaaaaaaaattattttttttttttttttttgtttttagaggggggggggggggaacagaaaaaaaaaaaaaannnnnnnnagncgcgcagagcccgcgggggggggggntgnnnnnnnnnnnnnnnnnnnnnnnnnnn

SEQ ID NO: 14578 - DNA, 929 bp, Xenorhabdus bovienii
  unsure (1)..(929): unsure at all n locations
  Genomic contig Name=Xb4151_4152.C37
nnnnnnnnnnnnnnnnnnnnnnnnnnnnnnnnnnnnnnnnnnggggnnnttttnnnttttnnnnnnggggggtnnnnnnttttttttgngggggnnntnntntgggggnnnnnnnnnnnnnnnnnnnngggtctattttaaaaaaaattgtttttagtagtntggaaataaaaacctcgttctagnttnggnnaattnttngaaggagctacccccctttttttttggggggnnaagaggaggggnaaaaaaaatttttctttagggggggggggttttggggggggggggggggaaatttttggaaagggggggtttggggggaagggccaagccaagggggaaaaaaacccaagattttttaaagggtggaaaaaaaggggggggggggggttaaaaaaaaaaagtggggaaaaaagagagggggtggtttataaaacctctttttaaaaacggggggaatataaaaaaaaagggggtttttttttttttttgggggggggggggaatatatttttttagagggggggggggggggttatataaatattttttttttctttaaaaaaaaaaaaaaatatnttaaaaggggggggggaaaaaaaaaaacccccccaagaagaagaaaattcttttttgggggggagaaaaaaaaaaaaaaatggtttttttttttttccgggcgcaaaaaaaaaaaaaaaaaaaaatttttttctaaaaaaaaaaaaaatggggggggggtgctttattataaaaaaaaaaaaaaaaagggggggggggggggggggttttttttttaataaaaaaaaaaaaaaatattttttttttattttttggaaaaaaagagagaggaggagtttttttttttttttgtttttcgggggggcgggggggaaaaaaaaaaaaaaaaaaaattctatatttttttt

SEQ ID NO: 14579 - DNA, 716 bp, Xenorhabdus bovienii
  unsure (1)..(716): unsure at all n locations
  Genomic contig Name=Xb4151_4152.C38
cgaacatcgagctcggntacccccccttaagggnntaaccaaaaattttttatttcttaaagggggggnnaaaattttttccccaaaaaaaaccccaaaatttttcccccaaaatttggggggnnaaaattttttaaaaacccccggggggggggnccccggggggtntaaaaaaaaaaaaannananggagggggggggaaaaaaattttcctggattttggcctaaattcccttttccattttttnnttaggggggaaaaggccttcaaaactggaagggcctggggaaaaggccgtttttttcaaccggaaaaaacctggggcttggggaaaaataacggggggcaaggaagggcttttaaaatttaaaaaaccccccccgtgggggggggaaaacgggggggggggcaaattttaaaatttttggggggccaaaaaattttagggaaaagaggggggggggaaatggggaaaaattttccaaaaacccccccacaaaaattcccccccttaaaaaaaccggggcccccgtgggggaaaaaaaattttccccccccccgaggggggttttaaaaaaacccctttttttacccccccaattcccccattttttttgaaaggggggggttaataaaaaataaaaattttttcgcggcgccccccaccagggggggggggggggaaaaaaaacccccccccccccccacttttttt

SEQ ID NO: 14580 - DNA, 931 bp, Xenorhabdus bovienii
  unsure (1)..(931): unsure at all n locations
  Genomic contig Name=Xb4151_4152.C39
acactttgtacgattacgacctcgttacccgtaatgantctatggcacgcccgcggagcggccacttcagtctcccggccagtccgtgtccgtcgggggagtgggtatactatatatgcaactataaggcgaaattccgtgggaggatagcgttaaagtctgtagtcgcccggcgcgggtttaaaaggcatatcttttggggagcgtcctgctctttaattttgtgtgtccccggggggaggggcaacacaccgtttttaacccccgaaaagaaaacggggtttttcccccggggggggcccccccacaaaggagaattttttcccgggaaaaaaaaaaactcttctctcccccccagggggtgggccaaaaaatattttttgccggaaaaaaaaacccaccccccccctccccccccctctcttttttttatttttttctccccccccacaccccacacccttctctataaaaaaaaaaaaaaaaaaaatttttttgtggttgttgggcgcgcccccaaccacaccagcccccccccccggaaaaaaaattttttttttcttctcccccccccaaaagagaaaaagaaagattgtttgttcctccccccccccccccccccatataaaaaaaaaaaaaaaaaaaaaaagaggcggcggttgtttttttttttttttttttttttttaaaaaaagaaaaaaaaaaaaaaaaaaaggccccccggggggggagaaaaaccccccccccccctcctttttttttttaaattctccgcccaccgnnntttttttcttttttttttttgtggggggggggagaaaaaaaaaacccccccccccccccccggggggggggggggaaccccccccccccctccccccgnnnntnntnncccccacctatattttttttttaanaggagtggggggga

SEQ ID NO: 14581 - DNA, 1302 bp, Xenorhabdus bovienii
  unsure (1)..(1302): unsure at all n locations
  Genomic contig Name=Xb4151_4152.C40
nnnnnnnnnnnnnnnnnnnnnnnnnnnnnnnnnnnnnnnnnnnnnnnnnnnnnnnnnnnnnnnnnnnnnggggnnnnnnnnccggggnggggggnnncnnnnnnnngaaacccagaaggnccnnaaaagnnncgncccaggancnaacagcgcnaagggaagcannngggcagaagaacccaaanagnagnaaagacgaggaggaaccacacaggagagcaagggcgaaaaaaagaagnanagagggaaaagaaaaaggnnacaagaaaaaaaannngcgaggggnnnnnnnnnnnnnnnnnnnnnnnnnccaagggaaataggaaaaatgggngaganctggggggaaaccccgcgcccccaaggggggtggggtccttctggaaaaaagggggagaaaaaaatttttttttggggggggggggggaaaaaaaaaaaaaaaaaaatttttgggggacaaaattaaagaagggggggggggggggtgttcacaaaacaaaaagggggagaaagggggggcaaaaaccctttttttagaggggggggttaaaaaggagagaaaaaacccgggggggaacaacgccgggtgggaggagggaggggggtttttttggggcggggccccccccacaaaaaaagggnnncggcccggggggataaaaaaaaacggggggcgggggggaggggggnngaaaantttttaaaaaataccccccccccccccccggggggggggaggagggagggggttggggggtttttttttttaaacacaaccaaaacaaaaaatattttgtgttcggggggggggggggggggggtttttttttnttttttaaatttcaaaaaaaaaaaaaaaaagggggggggggggcggggagcacaacaacaaaaaaaattnaaaaaaaaacccccncncccccccccccgccgcccgggggtaaaatttttcttcccccccccccccccgcgccggaggggggggggtggganaaaacaaaaaaaacaccacccgcggccgccaaagaagataagaaaaaaannnnnncnnnaaaggggnnggngggggggggggggggggggggcggncccgcgcccctcccccntcaaaatcaataatatataataaaaaatataangaggaggggggggtgggggggtgtgtntggnagagagaagagaaagnananaanaaaaaaaaananannannnnnnnnnnnnnnnnnnncccnnnnnnnnnnnnnnntttttgngcgggggggnggggggggggcggggggnggntggaagaggagaaaaaaa

SEQ ID NO: 14582 - DNA, 826 bp, Xenorhabdus bovienii
  unsure (1)..(826): unsure at all n locations
  Genomic contig Name=Xb4151_4152.C41
nnnnnngggggggggggnnnnngggggaaaagggggcgggtttaagagannngnnnnganaagtaatcagtggacgaaatccgacgtgtacgatgagactaaggaaagatatcggtggaaaggggatgatggggaaaaaagtaaaagggcccccacgggcggggggtaaaaaagggggactttttttttcccaaaagggggggggaaaaaaaaaggggggttttcccccggggagaaaaaaggggcccccccaaaaaaaaaaaataatatttttttttttttttttctcccccccccccgcgaaaaaaaaagagaaaattcccccccccccccttcttcctttcccttctgggtgttaaaaaaaaaaaaggggggggagaagaggcgcccacacctttttttttgtgggggaggagaacaccccccctcccccccccctccccccccgcggggggggggggggggggaggagggaggaaacaaaagaggaagagaaaaccactctttttttttttttttttntccgagggtgggaggggggggggaggaggagaaaataatggtttgttgtgggtttctgaaagggaaaaaaaaaaaaaaaaaaagaaaaaaaggggggccccccccccccccccccccccccccccccctccgcccccccnnnttttaaaaaaaaaaaaaaaaaaaaaaaaaaaaaaaaaaggttggngtttttttttttttcggggggcccccccacacaaaaaaaccttnnntctnanaaanaaaaaacanaccacaaccaannnnnccnnnnnnncnngggngnggggtggatggtttgtgt

SEQ ID NO: 14583 - DNA, 1313 bp, Xenorhabdus bovienii
  unsure (1)..(1313): unsure at all n locations
  Genomic contig Name=Xb4151_4152.C42
nnnnnaaacagcgnaaaggggnnaggncnnnnnnnnncnnnncnagnnnnnnncgnnnnnnnnnnnnnnnagnnngactaggggcggtgnnnnnngtgtctaagcgcnnnattatntntntttnnnnnnnggggcaaactttggctggccctggcaagggtncgnaacttccttaaaaaagggaaacccccccttcttttttttaaaaagggaaaatggggggggcccaccatttnnttacacancaataaaacccaccccctggggaattgggcgcgttcaaacaaaactaaccgagaaaacgcgggcgggggagattattttttttgtgccggccgttggtgtgcccccccccgccccctggtgaaaataacaatttcccttcttcaaggcgctgttaaaaaaaaaaaaagaaggcgagaattttcctcccggcgggggagaagaaaaaatatttggttgtgttattggagaaattttttttcaagaaaacaacaaaaaaaaacttggtgggggaggagttttgtagataaaaaagaggggaggaaacacccgggggggaataaacacccccccccccccacggggggggggtttggggcgccccacaaaaggggggggggggggggggaaaaaaaaaaataaaaaaacccccacccctttttttttttttctttttttataaaaaaaagaggaggtgtttttttttttccccccccccccccccccctccctggggggggaaaataaaaaaacacccccgaggagaagaaaaaaacaccccccgcgggggggggaaaaacacaaatccctcctcttcttttttaaaaataaaaccccctagttgggggaggcgnncgtgtggggttttttttttttttttttctcccccccccccccccccccgccncgnggggggagaaaaaaaaaaaaaaaaaaaaaaaataattttctcccccccccccccccccacannttctcccccccccccccccgccccgctgtgggcgtgggggtaaagatattgttgtttctttttttgtttgtggcggcgccccaccccggccccctcattacctcttcttnatttgnntggggaatcaaacnaaaaaaacaacacctctgttaatcacaaaatanaaaagantataataactcttctcctccctctctgtacccggcgcgccgcgccgctgcctttcctctcttctcttctctttanagtgtaaataaaaaaagacaaaaccacccgcccccccccgccccccctcnacaatnagcagtgggagaggatgattataacactaatgaag

SEQ ID NO: 14584 - DNA, 791 bp, Xenorhabdus bovienii
  unsure (1)..(791): unsure at all n locations
  Genomic contig Name=Xb4151_4152.C43
ggggggggcncccccccccncnctnatnnnnnnnncgnnnncanccnncccccncccccggggttttccnnnccctccccttctttccttttcttctcagnccggcggntgtngtgcgcgccgcggcgnnnnncnccnccccccctagggagggntaatnnnntgttgtgngntattaaagaggaggngccccgcccccccnnnnnnnnnnnatttnaataatttttagnnnnnngccccccccccgngnngggaaaaaccccccnngcccgggtttnnnccccccccgagnnccncccctaancgnnccnnccnaccccnnngannnnnaanagaaacccccgncggttnccaaccccccccccacccnggnccctgncccccggganccccccctttttnnccttngggnnttatatttncccccccttttaaaaataatttnnnnncccaacccccccccacccnaaaananaaaaattggggggggccccccgaggnaagagaccccgcggggggtntttaacccccccccccccccaattttccccccccccgccccctttccccccaggggtttttccccccncccccccccccatattncccccctttnccccccccccccgaggttgggggccccccccccccnttnntnnnnnnnttttnnnccccccacccccccccccaaaccccccccccctttttttaaaaaaaattttttttttatttcccccccccccagggggccccccaaaccccccccccctctgggggggcccccccccccc

SEQ ID NO: 14585 - DNA, 881 bp, Xenorhabdus bovienii
  unsure (1)..(881): unsure at all n locations
  Genomic contig Name=Xb4151_4152.C44
ggggnnnngggggggggggggnnnnnnnnnnnnnnnngttggnnncctctcttcggannanaggcccncccccccgnaagggaagaccccccccccccgagagcnnaggaaacntacttcatccagggtttcntttttttttttnnnnnccnnnnnnnnnnnnnnaaaaanngaaagaaaaaaaatttcccccctttatttttttngngngggtaaaaangnccccaccnnnnnnnnnnaaaaaaaaaaaanngcccccnggggaaaaaaaccccccngnggcccccgttttttttttncccccccccccccaaannaaacantntntgnnaangatnncnctntncccccnggnttaaaattttttncctnccccttncccccccaannnnnaaacccgncccctgnggaacccccccttttgggggnnaaaaccaaaacccaaaaaagncccccccccaaaaaaaaaaaatnccaaacccccccccccaaaaaaccccaaaaaaccccccctttttcccgcccccaaaaaccccaaaaatttnngtgtttttttcccccccctccccttttttaaaaaacccccccccggggncaaaaaaaacccccaaaaaagtgcccccccccaaaaaaaacccccccccccttggccccccccggnnnnnnccccccccctcgttttaaaaaaaacaccccccccccccccttaaaaaaattttaaaaaaaacaaacaaaaattttttccccccccctccctcttttngnnnnggggttntnnaaaaaaaaaanaaataattttttttttttggtgtgnnggggncccccccccccctttttttaaaaaaaaaaaacaccccccccccaaaaaaaaacccctttat

SEQ ID NO: 14586 - DNA, 1011 bp, Xenorhabdus bovienii
  unsure (1)..(1011): unsure at all n locations
  Genomic contig Name=Xb4151_4152.C45
ccttttttatacgaantatncgggaccttcgtttacccccaatccgaaatgggggtttttaaataaaccctttgggnntgnttggataaaatttaagttttggaggaaatgtttcaaaaccgggccaaaaaataacagattgggggattttattgggggattcaatatattggggcaaaaaaatataaaagataccccccccttttggaaaatagtggcacaaccccttttttttttaattttggggggggaaaaaattttctcccccccggggttttttaaaaaaaaaaaatttttccccccccccacataactcgttgtgtttggcacaacacctccttgtggggggggagggcggggggtggggtttttttttttttttctgcgaaaaaaaaaaaaaaggggggggggggtcaccaaaaaaaaaaaaaaaaaaaaaatttttttttttgggggggaagggacccccccccccccccccccaaacaaaaaaaagaaaaaaataaatattattggnnnnnnnnnnnnncgccccgccccccccccccccccccgggcgggngggtgtgtgttttgttttttattttctcctaaaacaacaacacccaacaaaaaaaaaaaaaaaaaaacaagaggggtggggtttttttttttttctcttctcccccccgcccccgcgcgggggggggggggggtgggggggggcggggggctctcctcccccccccccccccccaacacaaacacaaaaaaaaaatatatttatttttttcttttttttttatatatctaatataaaaaaaaaaaaaaaaaaaataatatataanngtggggtgggggggtgggggtgggggnggggggggggggggcgggggggnagggcctccacaacacacccaaaaaaaaagaagagaaaaagagaaaaaaaannnnngaggnnnnnnnnnnnnnnnnnnnnnnnnnnnnnnnnnnnnnnnnnnnnnnnnnnnnnnnnnnnnnnnnnnnnnnnnn

SEQ ID NO: 14587 - DNA, 967 bp, Xenorhabdus bovienii
  unsure (1)..(967): unsure at all n locations
  Genomic contig Name=Xb4151_4152.C46
nnnnnnnnnnnnnnnnnnnnnnnnnnnnnnnnnnnnnnnnnnnnnnnnnnnnnnnnnnnnnggggnnnnnnnnnnnnnnnnnnnnnnncccgggggnncccgggggcccccctcaagcangctgggggggggnccnnnnnnnnngggnngggccaacttggcaggcctggcaaggttcgcaactcctaagaagggaacttcaaattttaataacccgggggctgggcccgggaacccaaaaccctgggagggggagggggggcccaaagggggggtttttttttccccctctttgtaaaaaaaggggggggtttcccgcgggggggggaaacccccaaaaaaaaaaaagggggggggaaaaaaagtgggggggggggggggggggggaatattcttccccgggggggacccccccccccccggggggagaaaaaaaaaagggggggggggggggggggggttttaaaaaaaaaaaaggggggggggggaaaaaaaaaaaaaaaacaaaccnccnnnngggggnngggggnnnnnnnnnaanccttttttnnnnttctctcttttttttttttttttttnnaataaaaaaaaaaagggggggggggggggggcnccccnttnnnccccccccccccttttttnnncttgtgtggggggtgttgggtggngnngggggaggggggaaaaaaagggannagannnncnccccccccccctccctttttttttntnttttaannggggggggggggggggtgnngnnnnaaattnntaaataaaaaaataantatcttnnnnncccccccccccccccncccccnncttttnttttttttttttcctgnnnctggtgtgggtgggggtgggccggggggaggggggcgggnctctctcccccctncncccccgggccgacgcccccgccgggcgcgctccgnnnggcgggggggggagtaaaaagagagaa

SEQ ID NO: 14588 - DNA, 1349 bp, Xenorhabdus bovienii
  unsure (1)..(1349): unsure at all n locations
  Genomic contig Name=Xb4151_4152.C47
naaaaaattttttgggggtttatatttttttaattattatttagaaataaaanaagggggcccaaaacttgggcttggcccttgccaggtttgcactttttttagggagaaaaccccctttttataaaagggaagatcttttttttttttttttaaaaaaggggggggggggggggaaaaaaaattgtgggggggccccccctttttttgggggggccaaaaggggcggggtaaaaaaaaccagtttttttttgggggggggggtggttttttttttttttttttttttgggggggggggggggggggggggttttttttttttttttgnggctcncanggccccccccacccaccaacttgttttttttttttgggggggttannttatanggacngcccccccccctctcgtggttgggttttttttttttttttaaattttttgttgtgtacagtcctctttttgtgttttttctatttagaaaaaaagaaaaaaaaaaaaaaattttacgttttctcttctttcttccttcctctccncttttttatccgtttgttgttaatttatttatcggacgcacagaagccgcgcggggggggggtgcttgttttttttttgcaacaagaaaaagggggggtgggggtcggtgcgttgtgggttgttctttatctgcggcgcaggagccggcgcgcgggttcgtttgatttcgtctgtgtctttttatttcgggtttgttatgagtgtcattaatgggatggtggtatgtccctgatagtttgctctcttgcaccgacagccatctgtgttgtcgccacgacgcaggtgcaggtgggaggtgggtggattcatttttacgtatattcgattttttgctgtgtgctgtatatgtttggtccggtgttaggcaacgggtgaagtatacgcagtcgattatttgtctcggcgctgtctagttatattctactcgtatgatttcggcgatgtgtgatggaaggttgtgacgagggactgcgcaatcgcagaacntcaccgtttcgtcagcgctcaatgtttatagtggtgattgtgtagttattgttgattgagctggtctttacgttcgtgtttgatatatggtatacagttgctagcgagtagttaccctcaatgacagtgtcggtatctcttcgctgtgatctcatttatgttatgttataattcttcttaaatctctactttgtctatcgctcttgttattatcagtatgacagtcgagactttccgcggaggtgcgcaacgtggcgctgtgtgttttggactttctgtttcgcgtgttgagattctatcgattgtactcgagaacgagn

SEQ ID NO: 14589 - DNA, 685 bp, Xenorhabdus bovienii
  unsure (1)..(685): unsure at all n locations
  Genomic contig Name=Xb4151_4152.C48
attaccatttgcatgncnctggcaggntgtcgaactnctagnaaggaatngncccctcgtttaaatggtgtattaagatnnaacaatatatcatagttnaaaaaaaaaacagtcatgcagcgcgcttgtgtgaaacttgaatacagaaccaatacagtactcttgggtnnnaaatgaggccggggaaaatattttnccttttgtgaaaaaatgaagaaaagaaccggaagataaaattttgcgcccccggaggttcccttggggactttccttgcctattttnccaaaggggcttttaattttaaaaaaaggagaacctttttttttttaaaaaaaaaaatattttttccaaggccccccagaaaaaattccgcgggggggtttttttaaaaaaaaaaaaataaataatttatccccctggcgggggggggagaggaggccctttntttttctctcccccccccccgccaagaaaaaaaaaaaagagtgggggggggggcgggnncccgccccaatggggggataattncccccaaaaaaaaaaacaaaaaaccccgggngggggggggggcnncaacaacaaaaaagagggttttttttttttaaaaaaaaaaaaaacaaacncaccnactnaccccccnncccccctttcttttttggtgggggggaccaaaacaacacacac

SEQ ID NO: 14590 - DNA, 879 bp, Xenorhabdus bovienii
  unsure (1)..(879): unsure at all n locations
  Genomic contig Name=Xb4151_4152.C49
nnnnnnnnnnnnnnnnnnnnnnnnnnnnnnnnnnnnnnnnnnnnnnnnnnnnnnnnnnncccgtacaatcgagtcgaccacggagatgtttccaggggccaccatgattgncnnnnnggnnnnncnatcgattcgactcggaccgggcggggatctcattggctgggctctgtgctgaggatgtgaactacgattcctgcgctgtcgggaaggtaaagcgtttgatcctaagcatacgatcccctcgggggaccatttttttgctggcccaatttgtccccccaggaattcccccccttccgacccggaagggctttaaaccccccttgggatttttttcccccccggggggccccccttttgtgtgtccaaaaggccccccgaaaaaaaaatttccccccccggggggggggggaaaaaaaaaaggttttttaaaaggccccccccaaaaaagttttcccacaaatttttttttctccttttagaaaaaccccccggcccccccccccctttttgtggggggggcccccggaaaaaaaacaccccccggggtgggaagaacaaaaaaagggggggggtgcgtgttttttttaaaaaacacaaattttttttttgttttgttttgtaccacccacccccccctccttctttttttttttcgccccgcgcgtgggggaaaaaaaaaaaaaagaaaaaagagggggggggggggagacccccccccctcttntttgtggggagagaaaaatttttttttttttttggtcgcaccccacacggcggcgggggggtaatagtgtataatgaaataaaagggggggggggggtgggggttgttttttttttttttntncaccacccccacaccgcgcgccccgc

SEQ ID NO: 14591 - DNA, 935 bp, Xenorhabdus bovienii
  unsure (1)..(935): unsure at all n locations
  Genomic contig Name=Xb4151_4152.C50
gatacgaattcgagctcggtcccccattgagtgttgtggtcagttcattacagccacaggaagaagatatctatcctctggcgggtgatgaaaaactgctgcaagtccgtggagaatatttaccgctactggaattgtaccggatatttgatatttcgagcggagaaacctcgccaaccaaaggtattgccgtcattgtccagagcgcggggcgccgctatgctttgctggtggataaactggtcggacagcatcaggtggtcgttaaaaatatcgagagcaattaccgtaaagtacctggcatttcggctgccaccattatgggagacggtagtgttgccctgatcattgatattcctgctttgcagaaactcaatcatgaacagttggctacgcgtaaggcggagctggtgtaataaaaaaatatactcagtgaaaggtaacatcttgtacaataccgacatcatcaacgaaatgctgctgttgtaaaaccgtattgctgaaaaaaacccgtcgaacctgatccggctagtaccgacgtaggactttgagacgctaatcattgatataaaaatattttccatttagcactttctcaaatcctttatctatctgctaatcacaacaggagagcaaagtgtttaaatcccattattgacttgaggatcaaattctcgcaggaaaacgtcacttataacgacaacaccgtcgtgattgtcctgaacctgcttaatcgtgtggtggngattgtgntcgatggtgtgtccgatgtgctgtctctgaaaggacgatcaatttgtccagcgncgnagtttgcngntaccttgtcactgaatatctgacagggttaggntccattgatgaacgaatgctgattctggtagatatcgaaaaactcctgnaacagtgagaaatgcattggntgattctgtccc

SEQ ID NO: 14592 - DNA, 822 bp, Xenorhabdus bovienii
  unsure (1)..(822): unsure at all n locations
  Genomic contig Name=Xb4151_4152.C51
aacctatcgnnnnnnnnnnnnnnnnnnnnnnnnnnnnnnnnnnnncctcacacaacaaataccatatactgcagacgcatcaatagagaaactaaaggggcgggcattctgcgaaagtacaacagccaaagaggaagattatatacacccaaacaaaaggggctctttaaaaaactcttggggccctaaaacccccccgccccccagagtttcccccaacactctttttaaaggagaaaaaacaccccccccgcggtaacacaaaaaatttttttaaagggggggttcaagggggaaaaaaaaaaccctccaaagagggggggggggggtttttttttcccccccccccctcttcattttttttataccacgcagagaaaagagaaaaaaaaatttttttttgggcccccccccccnggggggcgctgggagaaaaaaaaaaaaataatcttatctncccccccccccccccnccnnnnnntntnctnncccccccccccctctccnccnncgcnttnnnnngggggaagaaaaaaaaaaaaaaaaaaaagagggggcgggcggcgcgcgcctttttttttttttttttttttttttttatattataaaaacanacaaggacacccggcgggggggcgggggggggcnncccnttctaattttatttaataaataaaacnataacaaaanccccccccccccggctgcgtgttttttttttttttggcgttttctttttcttcnnccaccaaccnncccccccacaaaaaaaaaccacaanaaacaaaaacaaaaaaaaaaggcaaaactatctattttttt

SEQ ID NO: 14593 - DNA, 861 bp, Xenorhabdus bovienii
  unsure (1)..(861): unsure at all n locations
  Genomic contig Name=Xb4151_4152.C52
ggggggggggtgaaatctgggtgggggtttngnnnnnnnttaacttttctcnnnaggttcccctttttttttttttnnnnnaggnnnnnnnnacnnnnnnnaaagnnnnnagnnngnnnggnnggngnngnggccnagggncgggnncnnggnngcgnncggcgcccggnnngngggggggttttttttcccccccccccccccccccccccccccccccccccctttttttnttttngggggggggggggggaaagaaaaaaaaaaggnnnnnnnnnccccccccccccccccaacannnnnttnnnnaaaaagaaaaaacaccccacccgtccgcctgggccccccccctttgggnttttaattnngaaacccaccncccccacttgggttggggnccccccccgggggnnnaaaaaaaaacccccccgggnnnnaaaaaaaagggcccccaaaattttttttntaaaaanccccctttttggggccccggtttggggggggggnttgggggggggggncccccccaaaaaaagaagagggggggnaaaaaaaaaaaaaaccccctcntnccccaaaaaatccccccaaaaatncaaaccccccccaaaaaataaaccccccaaaagggggggtttttccccccccaaaaaggggggggggtttttttttttaaaaaaaaaaaagaaaggaggggnnttnttaaaaaaaatttnnccccccaaagaaaaccccccccaaaaaagggggnnncccccgggcccccccccctggggggggggggnaaaaaaaaaacccccccccccaaaaaaaaaaaaaaaaaaggggggggggggtggttttttttttttttaaaaacaa

SEQ ID NO: 14594 - DNA, 832 bp, Xenorhabdus bovienii
  unsure (1)..(832): unsure at all n locations
  Genomic contig Name=Xb4151_4152.C53
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttatgtaatggtacaacgccccgcgcagaagacggnatnacgagctagccgggttctccgggaattgtttacttacacccccacacccaacaantcggaatttaagaaggaggaattaggcggcctctaagggggggaaaacacattattttccccaaggttccgggggcgccccccccgaaggaaaaatttggggccaaaggcctctaaaaaaggcccaaacccccccaaaagggccgggggggggggggggggttttaatatttttccccccccccccccgnggcgcttcaaaaaattaggccctgnaaaagggaaaaggggnccngccccccccccggggcttttttttaaacacccccccggggcccccccgggaaaaaaaaattttggggcctcttttttttttttaacccccccccccttcttaaaaaaagaaccccgccgcggcggggtttttttcttttttgtaataaaccccccccctttttggaaaaactaaaaaaaagaagagggggggnnaaaataagaaanaaggggggaacaacccagtttggctaaaaacaaaaaaaaggtggctggggcccaccca

SEQ ID NO: 14595 - DNA, 1388 bp, Xenorhabdus bovienii
  unsure (1)..(1388): unsure at all n locations
  Genomic contig Name=Xb4151_4152.C54
nnnnnnnnnnnnnnnnnnnnnnnnnnnnnnnnnnnnnnnnnnnnnnnnnnnnnnnnnnnntctctatccagaccctccccagcaccacactcctaaacaggaaacccataaccacatagactgtactgtgacatttagatagaatatggctacttgttcctatcctatggaggatctctctctcccactagtcgcgtgcgtgaagaaagatcagcaagacatgacctggcaaatctcacacagcagcctcaattaatccctatgtataagaggggcgaagaaactcactgggggggggcgcccccaaaaaaatttttgtggacatattaaaaaaaaaccctctcccncgcgagggagggggggcctccctctctttttgtaagaaagaaaagaaacccccccccccttttttttttttttgggagaaaaaaaaaggggggggggtgctgttgaaaaagcacccccccctttttctatacaaaaaaaaaatccacccccaccccccccccccctactgggtgcgcgagtgcgggggagcacttttttttattagttaatcacagaataacagcaactcagggggagagtgtcgataaataaaaacaactgcccaccccgtgagggcctccgtcttggttgtacttattaataaaaaaaaaataacaatgcgcgcactcccccccccctcttctcacgcgcggtgccggctgagtcgtctggttgtgtatgccatctaaattctaaataatactcttaaatggagctgtggggtgactgtggctaacgcgcaggcccgaccccgccttcgcccgttccctccgtcgctcaggtttgcaagacattacatagataaagcgatagcacgcccaacaaagttgtcatgctcacggcgtgacgacgcgtcggcagaagaaaggccaaagaaacgaagagtatcgagcgtacggcgcgacagacaagtctacaaaacgcctcgatgcgctgagaagatcacccactcccgtcccctcccctcctccactgccgcatccgcacatcgttgcgacagactagtgaagggctacacgagcgacacactcttaataacaacagacaatagactgcggacatagtngcggcggttaaatcccgtgtattattacggcggggtgtgaaaggtgtgctgtgcgaagtacaccctgagtggatggtaatgggttaacgaanaggaaagtgtgactagtcccgaactaggagagggcacgtgaacgtgcaggcgctagacctaagaggcaaatatcgatgaatccttgtacatactacacacaatgtcaaacactgccccgctctcaacatagataaacgaattcaataaaaccttacttgtagcatcatccagtgtaccaact

SEQ ID NO: 14596 - DNA, 1091 bp, Xenorhabdus bovienii
  unsure (1)..(1091): unsure at all n locations
  Genomic contig Name=Xb4151_4152.C55
nnnnnnnnnnnnnnnnnnnnnnnnnnnnnnnnnnnnnnnnnaaaggggagggaggnnnnnnnnnncnnnnnnnnngngcncncnggggggggggggccccccggggggaggccccccgggggggggggggcnagggnggncnnnnnnnngcnnnnnnnnntcgggggcgnnagannnnnanggggccccctagaaaaaccccggggcccgggaccccccgggccggggggttccgcncacccccggaaggggggaaacccccccccccgcctttgggggccccgggccggggaaaaaaccaaaggggggaaaaaaaagaacccccgccgccccgggggggacccacaaaggggggaaaaaaccccccgggggggggccaaaaaaaccaggggcccccccccaaaaaagggggagaccccaaaaaaaggggggggggaaaaaggggagagaaaaaaaaggcccccccccnaaaaaaaaggcacccccccccccaaaacccccngggggggttggggggggggggggggcgcgcaacaaaaaaaccccntntataaaccaaaaaggagaagccccctccgaacccccctttctaaaaaaaaaaaagaancggcgcgcggggggaagaaaaaaaaaaaaaggcgggggtcccggcggcacgccccnactaaaaaaggggggggaaggagggaggttaggggggcgggnncccccgccncccgggggggnnncgcgcgggcgcggcccagggnanacgggcggggggggggggngcgggncgtnggtttggtntatttgnnnnnnnnnnnaggaagaggagggggcggggggnncggggccccccnaaaagaaaaaaaaggnnncgcggggggggnggcccccgcggaannaagaaaaaaacncnncccccccccttctcttttacattaaaaaaaagagggggggggggggggggggggttggtntttngnnnnncccncccccccacnncccgcgccccgccccgcccancaanaaannnannnnnnnnnnnnnggnnnnnnggnncccggccgggcggggggcggggtnnncgggnagnnaggaagaaggaa

SEQ ID NO: 14597 - DNA, 1625 bp, Xenorhabdus bovienii
  unsure (1)..(1625): unsure at all n locations
  Genomic contig Name=Xb4151_4152.C56
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtaactaggggagaagagaagacccccccccgggaaggagagagggagaggagggaancgaggggaaagcgagaaaggaagaaaaaaagggggcaccccaaaaaaaacacttttggggctttaagaaacaccctcgggggccggaagagggtggcgggagaaaaaactctttagaaaggaaaggaaaaaaaacacccccaaaaaaacctctttttttggggggaaaaaaaacaaaaaagaaagtttttaaaaaaacaaaacaaaaaaaaaaaagggggtaaaaaaaaaaaaaaaatagaaaaaagggggggaggggaaaaaaaaagaggagggagattttttttnnaaaaagcccnccaaaaaatatataaaaaaacaaccggagggggtttttttttgtgaaaaaaaaaagagggggaagaaaaaaaaatanaaacaacaaccttttttcttttttttaaaaaaaaacagaaagaggggggggggagaaaaaaaaaaaaaataaattttgggggcgcccccaaaaaaaaaaaaaagagaagagaggggggaaaaaaaaaggggggggggggggaggggttagcttattatgaagagaagaaaaggaggggggagaagaaaaaaaacactgtgtgttacgtgagacagaaaaacaaaaaacccaagaggacggagagagaggagaggggagaggggaaagaggaaggatgaggggaaggggaagagagagggagaggaggcgaggagagaaagagaaggaaagcggggaaggaagaaagagagagagggagagggagagaaagaggaaggggaaaaggagaagaaggaaaagagagaagggagagagagggggagggggaaggaagagagagagaagaggagaaaagagaagagaagaaaaaggaagggagggagggagatgaaggtaagagagggaaaaggaaggagggaagattgaagggaagggaagaagaagaaaggaagagagaagaaagaaaagagagagaaacgggaggagaacacaagagaaggggaggaaaaggcatgggaagaagcggaaaaagaaggaggggaagcggaagaggaagggcggggcgcaggagggcgacaaggcagaggaaagaaggaaggagaggaggtgagcaaggagggcggaaaagaggagagaaagagaaaggagacgggaaaagaaagagaggggataggaggaaaagggggaagaggagttcgagagagggaaagatgcgaggcgagcgtgagggagaagcgcacagagcggaggagtgatagaaaccggaagcggangagagagggaggagaggaggggacgagaanaggtggaaaagggaggcgccaaatgagaggaagggaagaaaagaaagagtggcaagtgagagnagaacnagaagtgcagaaaaggagagggagacgtgctggaggnaanagggagggtggagcaagaggacgaaaagataaaacgacgtaagcgcggatggan

SEQ ID NO: 14598 - DNA, 425 bp, Xenorhabdus bovienii
  unsure (1)..(425): unsure at all n locations
  Genomic contig Name=Xb4151_4152.C57
tttttccatatcgactcgtnaccctgggngagngatnagtgttnctaatatatnncgttaangatnaggnatagttttgnattncaatanatnntttntttttggnaaagaggaaaaggnaccgttgnaattggggnaaagggaaaattttgggnaaaacttttaaaaaaaaagttttttaaccccggggtttggggaaacccccatttgaagganaaaaaatttttggtgggggcccttggcccccttttaaaaaaatttccccctttccccctatttttnagaaggcccccccaatttttccccgggcctttttttttcccccccggggggttttggggccccccctttttggggggggggagaggnnnnaaaaaaaaaagaggggggaaaaaaattttttnnccccccccccttttatttta

SEQ ID NO: 14599 - DNA, 717 bp, Xenorhabdus bovienii
  unsure (1)..(717): unsure at all n locations
  Genomic contig Name=Xb4151_4152.C58
tgctatacgaaatcggactcgtnaccncancangacgtgntattttnactnttncttncaactncggncttaaaaaacccttaaccatncagtnactgnacagnacncgcactttncacatttnannttgctgnaccaatggttggnaaacgncctggncccctgggtnccattcggnnnnaaaaaaacggccccccccatagggttttttaaccccgnnnnccctttcccaagccgaaattaaccttggggggaaaacccgcctttagggcccccccccggggggcccccaaaagggggcgccgggaatatataattttttggggggggggcctttttntttnccccccccaaaaaacccgggtttttttcccccccggccgggggggggttttttttttttaccccccccacaanaaaattttcgcccccccctcctttcttttgtttttgncccncccccccccccccccncccccaccaaaaaaaaagaaaaagagagggttttttttttataaaaaccaaacctccctctctgtggggggggngggggnnnnnncccnccnccnnnnnaacaaaaaaaaaaaaaaaacacccccccccccgcgcgggggggggggggnnggttattattatttattattatnaaataaaggannagngggngggggggggggngggggggnnncgcgccccccnccgcaccgcagagataaa

SEQ ID NO: 14600 - DNA, 911 bp, Xenorhabdus bovienii
  unsure (1)..(911): unsure at all n locations
  Genomic contig Name=Xb4151_4152.C59
nnnnnnnnnnnnnnnnnnnnnnnnnnnnnnnnnnnnggcagtgcgccgcagcaccagagaccccccatgcccgcccatcaccgacaccacgcggatccgttaacctgccggccacacggggaaatgnctggcgcccctgacnnannnnnnnnnnnnnggccagctgcagcccgncagntcgcctctagaaggaccccccttcccccccagggggaaaaaaaaaaatgcccaacccctacccccggggatacccttttaaccccccgcgggcccccccccgaaaaaaacccccccccctggggggggcccaaggggaaaaccccccccccccccggggggaaaaccccccgcccgcaaaaaaggggggaaaaaaaaaacaccccccccggccccggggaggagaggcaaagggcggttttttaatttaaaccccccccccccccccggaggaaaaaattttttttctccccggggcggcggggggcgcaaaaaaaaaaaaaaaaaaaaaaggcgggcccccggccgcgggggttgtgttaaaacaaaaaaaaccccccccccccccctcttttttttttttnaanaanagggggggggggngagaaaaaacaaacaacaacaaaaagngggggggggggggngggggacaccccaccccccccccccctttgtggtgggggggcggtgggggggggggggggcgtggnccccccccccccccccccccccgnaggcaanaagaaaaaaanaaaannnnngggncgagntggccgccccgcccgcgcggtggnggcgccgggntgggnagaanaagaaaaaaaaaagnaagannagggngagaggagggggggaagggggagngaannaagnaaaantaaacaccacaccccatacccccactcttgctcccc

SEQ ID NO: 14601 - DNA, 839 bp, Xenorhabdus bovienii
  unsure (1)..(839): unsure at all n locations
  Genomic contig Name=Xb4151_4152.C60
caggattaacgaaaattccgaagagctttcggggggntttaaaccccccccnttgggnnncccnttttgtggnnaaaaacccgcgggnnntggggggggnnnnaaaaaaaaaaattttgtgtgggggggnnncccccccccccccccccccaaaaaaaaaaaaaaaaaaaatttttttggggggggggnnnnaaaaaaaaagagaaaagaagggnttttttttttcccccccaaaaaattttccaaaaacggttccgnncccaaaccaaaattgggggnnaaaattggggnaaaaaaccccaaaaaaaaaaangnttggggcccaaaaggccccggggntttaaaaaaagtttttttaaaacccccctttgggcccaaaaaattttaaaaaggggtttttctccccaaaaatttttcccccacaaanaaaatttttaaaaaaaaaggggcccccttttgtggccccaaatttttttattaaaaaaggcccccgggggccccccccttttttttccccctttgtggggggggaaaaaaatttccccggccgcccgccgcggaaaaaaatatttntgtggggccccacaaaaaccaaccctccttttttttttctcacaaaaagggggggccccccggggggttttttgggggcccccccccaaatttttccccaaacccccccccaaaaaagaaagattttttttttttttttttaaaaaaaggggaaaaaaaaacaccccccccccggggggggggggnnttttctcccccaaaatttttttccccacaaaaaaattttttgggtggggggggngncccccccccccccccaaaagaaa

SEQ ID NO: 14602 - DNA, 965 bp, Xenorhabdus bovienii
  unsure (1)..(965): unsure at all n locations
  Genomic contig Name=Xb4151_4152.C61
nnnnnnnnnnnnnnnnnnnnnnnnggggnnnnnnnnnnnnnnnnnnnccccctgtaggttggggtgggcccccttgacgggtttccccttgtggcacttctattacgtactatgagatggtggttagtacttatactagagcggtgagctagcggttgcttttccagaggtccttggggtgaaatccgcctatcaatggaannnaccccgcgtttttttcccaaatttttcgcggggtttccctgggggaaaccccccccccnnannnccccgggggggggtgctttccccccccgggggggggggggnnnnggggggggggggggttttttcccccccacaaatttttttttgttgtttttttctcccccccccgggggggggggggggggggggcggcacccccctcccttttttttttattatatttttgaaaaacgggggtgtttttttttttggtggggggccgcccccccccccccccccccccccccccccggggggggggggggggggggggggggggggtgggacaaaaaaccccccccccccccccccccccccggggcccttttttntngggggggngggggnggcgcgggcnnccnccnnnnttttnnnnnccccccnntttttccccactcccccggccttttcnagggggggggagggagcccccccccccaccgccccnncnnttttttttttnnnnnaaanaaatatatttnttttattgggagtgaggggggggggggggggnnnggggggnccgcggcactttttttttttttttttttttttttttttgttttttttttttaaaanaaaanaaangggggggggggngggcgccccgcncccccccccccccccccnancccnnnnnnaaaaaaannnnnncaaaannnnnnaaaaaaaannnnnngggnggggggcggtttgtggtttgtttttttttgttaaaa

SEQ ID NO: 14603 - DNA, 760 bp, Xenorhabdus bovienii
  unsure (1)..(760): unsure at all n locations
  Genomic contig Name=Xb4151_4152.C62
cgatacatcgagtcgtacctctattctctgtcatttaactaggatggtatctgctgtcgataaaaccctgcgggatcgagctagttaccggggctggaaccccgggtgtggagtgtttttaaaaaaggccccatggttttttgggcccgaaaaacccccccctttttgggttttttaaaataatccacccccgggaaaaaaggagggggtattttcccccgggggcttttttcccccgccccccattttttagttttttttgcgccgcgcccccccgccctccccccctcttttttttttgtgggcggcgacaatttattttttttcggggggggggggggggaaaaaaaaaaaaaaaaagaggaggagggccccccccccctcaccaaaaagggggggcgggcgcgccccaaaaaaaaaaaaggagcccggcccccccccccccccgcgggggggggggggggggaaagaaaaaaaaaaaaaaccccccgttttttttttttttttttaataaaaaaaaaaaaaagaagggggggggggggggcgcccccccccccccccccccccaccaccccacataacataaaagaaaaaaagagaaatntggggggggggggggtgggtggntgccccccccccccccccccnnaaaaaaaaaaaaaaaaaacaaaaaacaaaccccccccgcggggggggggggggttttttgtttttttttttttcccccccccccccccccggggggggaaagagggggggg

SEQ ID NO: 14604 - DNA, 740 bp, Xenorhabdus bovienii
  unsure (1)..(740): unsure at all n locations
  Genomic contig Name=Xb4151_4152.C63
tgttcattcagtcggtacccacgnggnnnnaantttnntttnntttnnttttggggnnnnaaaaccgggggnnnnccccaaaaggggngnnccccccaaaaatattttttttttttaaaaaaaaaaaaaatttttttcccccacaaaaaaaacccccccgccctcccacaaaaaaaaaaccccccccccccccaaaaaaanaccacccccccttttttttttaaaaaaaaaaaaaccccaattttccanaaacgcggnncaaaaattcnaacggaaattcaanttncnaatttncgngggnttaaaggnttggggttttttaacccccaatttcccaatttccaaaattaaagggtttccaatttgaaaacccccaaggggtttaaaatttcccccggaaagaggttttggggcctttgggaattgggtggggggnccccccccccaacccaatttttttaaacccggggaaaaaaaaaaaatttttcggggaaaatttaaaccgggttttttggggcccttttttgttgggaaacggggggggaattttttttcccccccccccccccttttttttaaccccccaaaaaagggggggggggggttttccaaattttttccaaaaaaagggggggggngggttttgggggaaaaaaaaaaaaaaaattttttttttgtgggaacacccggggccccaaaaaaaaaaaacaaccgcgggtgtttttataaaaaacaaaaat

SEQ ID NO: 14605 - DNA, 1206 bp, Xenorhabdus bovienii
  unsure (1)..(1206): unsure at all n locations
  Genomic contig Name=Xb4151_4152.C64
aggaaanngagagaagaaatgntaaagagaggggngggaagggggggtgnnaggggacaaagcgaaaggggggacnnnaaanaactgccccaccggannaggaaannnnnnnagtaccccaagaagggggagnaangganngaagaaaaagaangggggagaagaggaatttaccccaagagagaggggacaggagaaggccaccccgaacgaccccaagaacgcggaagccgaaaaaaaaaggggggagcgaacagaagcgaccagaacaaagacaagcacagggaaaaccccacaaggaacccgaaaaaacaaacacacggaaagggggagcgcgaggccggaaagagacagacaagcaggaaccaaggacgagcaacagacgcagcggaaaaagaacaaaagaagaaggaaaganaggaaattttttttttccccccccccccccccccnagagaggaaaaaggaagaggacaacgggaagggggcccgggcagaaacaaaaaaaaaacaaagaacacgcggggggggaaagcaaaaaaggaaaaaaagcagaggacaacaaccaaccganaaaagaccagaaaaaaaccgcgagacgaaaggccggacgcaacaaaaaaaaaaagcaaaggacggaaaccgaaaaaaacagaaaaagcgcgcggagaggaacacaaaaacccccgcggcacacaaacagaaacgggagcgggggcggcgagacccgaccaacaagcggaaaangaagaaaccgggcaagaagaagaagacacaaaagagagaaacacccaagacgacaacagggcaaaaaccaaccggagaaagcgcacaacagaaacaagaagagcaaaaacaaagagacaggaggccagcaacaaaccngaggggcngagagacaaacaccaaaaacccgaagacggagcncgccccaacaacacgcgcaaagcgcgaacaagacgccagacaccggcgcgaaagagacaaggcgagaacaaaacaaagagcgggaacagaaagaaccgacggaaggngacgcaccaagaaaaaaaacaaagggggcaacaagaaaaacaacggagccgaaggagaaaaaaggacccaaaaaaagaaaacggcgaaccaacaaaaagaagcgccccgaaagcacaaaaagaggagaacaaaaaagagccgaaggaagaaggaaaaaaaaaagggaaagan

SEQ ID NO: 14606 - DNA, 949 bp, Xenorhabdus bovienii
  unsure (1)..(949): unsure at all n locations
  Genomic contig Name=Xb4151_4152.C65
gccggggggcgtgccgggngcggnnggnccgcgggnngcgtgggcgngggggccggggncggctcgccgggcggnggtgctgcggcgngtgcgggccccccccgcccgcacgcgaaccggggggggcncttccccccctnctcccccccancgcgcctcccctcctgggggnnnnnnntggaggcccccaaaanacctctggncccttgaancccttngnnnncgngaagnttnnnccnnnccatttttnngaangggagnnttatcccccccncctggnnnnatattancttnaaaggccggtnnnaaanaaacttttggttnnncccttttnncctaattttntnnccgnncnactttnnattnnttttnaaaaccccagnntaanttttttttgnntttaggnnaacctttttnnaaaaaacccaataaccggnattnnaaaaacccccggnnnccccaaagntaattttnttttttttncctttcccgcccctttgggccttttgggngcccccccctttttaatatattnnnnaattaaaaaattgggaaaaggggaaaaccccgggttttttaaggaaacaccccaagggccccccccccccccttttttgggggccccccctcctttgccccccttaaattttaaatatttccccaaaattttctttttttcccaaccccaaagccccaaaaaacccctttgggggaaaaattttttttttttaaaaaaaaaaaccccccccccggggggggnnnaaaaaaagaagggtatttttttaaaaacncccanccccccccccccgggggggcgccccccccccccaacataaacccccccncaaccccccggggtttttttttttnngggggggcccccccaaaaaattttttttnnaaaaaaaaacaaccccgcgggggggnnnnnncnccccaactttttttt

SEQ ID NO: 14607 - DNA, 975 bp, Xenorhabdus bovienii
  unsure (1)..(975): unsure at all n locations
  Genomic contig Name=Xb4151_4152.C66
ncttgtttatggacnnaatatnncnngancttncggtnnaccccttcncngnncacgncnnctgtntttgncnaccantntnntgtnctgggncccgnatatntttgggttgggccgcctttncttgtnacttccgggcaatttggtaactggnnggaaattttttggctggagccccatggtnatccgnacctaacttccaaaattcccgcttttggggcggatccaaccctttgtggggcttttcagggcccgatttgggaaataatttgaatttggcttgaaagcgcctccccggtttatttggaaggcctttttggaatccggggccattttttttggggggggagggggggaatttattttggtgggggggggggcaaaattgggccctttttttgtttttgggcccccggagaaattaagccccccgaaaaaaaagcccgcccgtttaataaaggggggggggggtttttttttaccccccggggtttttttctcccgcgggcggaaaaaataaatgggggcgcccccagagtttttaacccctctctttttccgcgggttgttaaagggggggaaaaaagagggggggccccgccttttttttttataaaaaaacaaaaaataattatgccggcgggccccccccccggggggggggtttttttttttttttttttttttccccccccccttatataaacccccaggggggggggggggaaaaaaaaattggggggggggcggtgttttttttttttttttccccccccccccccaccaggaagggtttcttntttncctnnnatnaataaaaaaaaaacacccaccccccccccccggggggggggggggtgctctctctttgaaaaggggggggggggggggaataaccccacacccccctctctttgtgttngggggggggggggnnnncccaaaaaaaaacaacaaatttctctgggggaaaaa

SEQ ID NO: 14608 - DNA, 1538 bp, Xenorhabdus bovienii
  unsure (1)..(1538): unsure at all n locations
  Genomic contig Name=Xb4151_4152.C67
nnnnnnnnnnnnnnnnnnnnnnnnnnnnnnnnnnnnnnnnnnnngggccccccccnnnnnnnnnnnnnnnnnnnnnnnnnnnnnnnnnnnnnnnnncctttnatttctnnaatataccttttaaatttcttttctccccccctttacctactatatatctaccncccncctnnnnttcatcccttctattcatcccaaccccccacttacccccatttcacctctatcactcactacttccatactcccaaccacccattaaacaaattttattaaaccctcaccctacccccaccctacaaatataacctcctatttagacaatctggggggggggggggggttctctccccccccccccaaaaaaaaaaaaaaaaaaaaaacacccccccccccctttttttttgttgacaatgcnnnctgtgcccgagagngtttgcggnaaccttnctcttaaaggnagagaaggganaaatatcnnnnnccttttttttggcncnncaaaaaggncnnnccnngggcggnttttggnnnatnaactttnccnnnnncttnnaactcnnnacagnngntntnttngnnantnnncnncaannnntntnacnnnaangncncccnttnngcnnncnnnttnnnncnnttcnntncnnganggctccnnntttgnngtagcnccnaaannncgngcnaagnaggnnnccgcncacangnngnggagnnngtntacattnntncnngacatcgtnncntnntgnggttanntnnaacncnncgnngcngannaanngcgcgctaaatttcataagaggaggagnnggccnngggggggaagggcttantnnaaccaantannctttncnaacgngggaggngngttgtgngntgnggnnnnttttgnggggtgcacacaaatttacncaaaatacnttgccggggggcgnnccnnncnnnttttnccgntgcggcatcaagccgtttttttgtggggcaaagaagtgtgttcttctnncgcgggggaattgggggntnnnaataccnntntctgggggggtgatatttaaaaaacagngngtgtcatgnttgtgggnaaaanttgtgtttgttngttttttttntcaaaaaaaagganttgttntgtggggtatattttctctccncccgcggagaaaaaagaagggggggggggagagaggttttttttttcttcttttttttccccnngngtggggtgttggtgtttatatataaaaaggcgcttctctcttctnccnnacaaaacacaaaaaagaggggagaagggggggggtgtgagagaaaaattatattntttttttatattctcttanacaaaaccccaaacttataattcttctgtggtaaggnnggaccnncaccacccccccgntgtggttgtggtgtgctgaaagnaantcttttttcataagngngggggggagggcgcgcaacagaacgnggcccctctttnngggtggnggttggggggagagggagaaanttntctcctacccnntnacaan

SEQ ID NO: 14609 - DNA, 1136 bp, Xenorhabdus bovienii
  unsure (1)..(1136): unsure at all n locations
  Genomic contig Name=Xb4151_4152.C68
nnnnnnnnnnnnnnnnnnnnnnnnnnnnnnnnnnnnnnnnnnnnnnnnnnnnnccccctccnntnnnnnnntnnnnggcnccnccgnccccccggtnggggggggtnncccccnctggggggggggnnggggcccccnnnnngngggtcgggattnnnannnnnaacncctgantngagccggnaattanggggganctncgggttnaccccggnccggaccaactnaaaagaaccgcgccaggaaagggccanccagggtgggaacggggggagaaaaaaacttaggggggtttacataccccccaaaaccctttaaggggggagggggcccccctggggtgtcgggggaaaatcggggggaaaaaatattggggggggggggccccctttatgggggcggccgagggggccccccccccccggggnnggcccccccgtttggggggggggggggaaaaaattcgggggggtattggggggggggagaggttttttggggggggggggagaaaaaaaaaaaaaaagttttttttttggaaaaaaccccccccctttttgttttnnnaaaaaaggggggggggggggccccccccccccccccccttttttttccggggcggggggggggggggggnaaaaaaaaaaaaaaaancncaaaccccccggcccccccccccccccccgttttngggggggggggggggggggggcccccccccccccccccaacaaaaaaaaaaaaataaatatcctttttgcggggggggggggggggggggggggggggggggggttttttttttttttnnnggggggtggggggggggggggggggggggggggagggggggggcccccttctttttcaaaatttttttttttggtggggggggggggggggggggggggggggggaggnggggntttttnctaccaataaaataaatacacacccccaccccncgcggggggggggggggggggggggggggggggnnnnnnnnnttttntttttttttctttttttnnntttnntnnnccccccccccccccccccccccccnncnnggggggggggggggngngnngnnnnnanaaanggnnnnnnccncnnnacaaacaaaaaaaaaaaaa

SEQ ID NO: 14610 - DNA, 887 bp, Xenorhabdus bovienii
  unsure (1)..(887): unsure at all n locations
  Genomic contig Name=Xb4151_4152.C69
nnnnnnnttttttnnnnnnnnnnnnnnnnnnnnntttccctacccaccactcnaccaccnaggcaacacccccccatccacgccccccgccctgctccccgtctctcccccggccgtacagaccggtacggtccccccgccccacctataggggccctcctaatnatnnnnccctttttaccaattcgaagctcggntaccccatatgncatgnnaactgccactacaaagccttaaataaatggatggccgaaccgnacgcggtgcggcagtggagcctaggaaaacacaaatgggattaatccattttacctttctttcatcccaaaagcctgtaaagggcgcccaagcccaaaaaaataaaagtttgaagggattttttgtgtccaaagtttggggaaaaaaacaagggggaaaagccccttttaaaaacccaataaagtttttcccaaaatttcctctccccaaaaggaacccggggcttttttggggggaaaaaaaaacaaagggtttgtggcccccccaatatttttttttttttttctaacaaaaacaattgggggggggggggggaaaaaaaaaaaaaaagaggggcccccccccctggggagaaaaaaaaaaaaaaacccccccccccgttttctttttttttttgttggtgggggggggggaaaaaaaacacaccccccctccccangcggggggggggggggtttttttcctcccccgcgcgagggaaaaaaaaaaaaaaaaaanggggggttttttttttttttttttnaaaaaaaaanaaaaaccnnacccccccccccacacaacaaaaanacggcgatctggccgcccgaccaaatataatattatatagccgccccgccccccgcacagaa

SEQ ID NO: 14611 - DNA, 939 bp, Xenorhabdus bovienii
  unsure (1)..(939): unsure at all n locations
  Genomic contig Name=Xb4151_4152.C70
ctctcttttataccgaatnccacctgcggtaccctcataggacaatttncgcacgcatgnnngaaagtttnnnggnnnnnnnnttaaagggggggggnnnnaaaaacccccgcggnnnnggggggggnnnggggggggnggtttttttggggggtgttttttnngggggttnttnnngnnnnngggcggnnnnnnggggggtttttttttggggggnngggggggggggggggcgtggtttttttttttttgggggggnnnnnnggggcccgcctctttttttctctccccnnnnnnncgggggggggttaagtnnnncaaaagacacccaaggggnnggggnggcccccgcnngggggnccgcggggaagacccccggggttttttgggagaatanaaacccccccggcggngggcgggtattttttnnccccnnnngcccgcccccccccctttttttttttnncccttttttttttttnntataaaggncccccccttggggnngggcccctttttttttttaaaaaagggnnaaaaaaaaaaaagccccctcttgggnnggngggggagnnnaaaaaacccggggggngggcccccccccaaaanngaaaaccccccaaaaaccccacaaaaagggggttggggggccccggccccccttttttnnacaaaacaacctttgggnnnnttggggggnnannccccccccccccccccnntnnnnnnngggggggggggnggagaaaaaaaaaccccccccccccccccccttatatgatagggggngggnaaaaaacaaataaaatatagtgtggggccaaaaaaaaaagaaaggggnggccggggagaaataaatattatttnngnnngccccccccccccccgccccccncgggnggggggggncgcccccccctctttttctttttttttttt

SEQ ID NO: 14612 - DNA, 1012 bp, Xenorhabdus bovienii
  unsure (1)..(1012): unsure at all n locations
  Genomic contig Name=Xb4151_4152.C71
nnnnnnnnnnnnnnnnnnnnnnnnnnnnnnnnnnnnnnnnnnnnnnnnnnnnnnnnnnaaacccgagccccgggggnccacccaggaggcccccccncnaggnaacgcncccngaaaccggnnggagggcaaccccggnnanccagcggccaccgcgccccccacagagnnccccacagncacngnccgaaaagaagcacgaccccgnccannnnnnnnnnccacaannnnnnnnnnggggggcccaaagaaccttttttccaagtgtgtcccccttggnnccagagggntttccggnaaactttcctttaaagaaaaggnaaattcccccccggnntttttttccaactggccaaaantcanccgnncttcaaacgntaaaaggtttttggggtaaaattaaccccgggggggcgggcaattctggggtttagtggaattccggccctttcggcttaccgggggggttggaatcggttcccggggtggttaaatcccggtttttaccggcccaaaaaaaaatttttttggggccccgaaaattcaaaaaaatttccccccgagattccccgggggtgtgaaaactattttttatataaccccccccacagaaaaaaaaaaaaccccccccctcttttcccgtgtgggaacccctgggagagggggttgttttcttatatttgggggggggaaaaaaaaataacaccccccccttttataaaaaaaagagttttttgttcccccacccaccccacggcggggtggggtggggaaaaaaaaaaaaaaaaaagatgtgtggtggggggggggccccccccccttttgttttttttcacacccccccccttaaatatattcatgcggggggaaaaataaactaaaanaaccaagggtggtgctccccccccccccntaataaaaaaaaaaaaagaatttttttttttttttttcccccccccaaaaaaanaaaaagaanattgtttcctttnctcncccccccccaaacaaaaat

SEQ ID NO: 14613 - DNA, 1233 bp, Xenorhabdus bovienii
  unsure (1)..(1233): unsure at all n locations
  Genomic contig Name=Xb4151_4152.C72
gtcctaagagggaatggccccctccgcttaattttctggatggcccaggaataaaaggggttccctttttttttgttgttacccccagaaaaagggggctttttaaccatttcggcttttaagggggctggagccgcccccccccataaaataggccgcgccccacccggggttctgggggtttttttcctccccccctcatagaaagaaatatattcttttgttattaaacaccccctctcctatttggtggggggggatttttgtgtataanccccccttctttttttttttgtgcacaaaaaaaaaagagggagagagaaaaaatccccccccccctttattagggggggggttgtggggccccacccaccactccttccccggaaaaacagcccttttttttgaaaaaggggggggggttttctactgtttgtggggggggggggggggggtcttttattaaaaagaaaggaggggggggggggcccttccggggagaagggagggggaaattcgtgggggaaaacaacaaaaaataaaaaaaaataccattttttctttttttttggggggggggggggggggagaaaaaaaaaaaaagaaaaaaaaaactctctttttttgttgttgtgtgtgcggccccccccagaggacgcgacgacccacccacaccgccccacccccgtgggggcgggtggggtgcggtggaggcggcgcggtagggagagaaacaacaaccaaccgccgcgccgccccgggcgggggggcggagagtggtttgttgtcttcttttgtggatataaaagagagaaaagaggtgagagggtggggagaggtgcgcggtccgcttcacttttcaacaggtcgcgcacgaaggaagaggcgagccggggcgcccncctcgccttctctctgcgcgtttnttccgggagagagctgagcagggcaataagactatccccacacaccatcggacgtcagggtgcaatacccaccgttgcactcaaacgcgcgcgcgactgtcagacctccgccacggctacagcgtgcgccgtccgagcggcgagacacgtggcngactgtgcccgagacgcgtgggtgcgcgggggaggagcgggcgccggaggggaagtcgtgatggatagtagtcgcagtcagtgcagcggnctagatagcggtgggaggcggcgcggggagacaggnggtacgtggacgactatcactgttatn

SEQ ID NO: 14614 - DNA, 800 bp, Xenorhabdus bovienii
  unsure (1)..(800): unsure at all n locations
  Genomic contig Name=Xb4151_4152.C73
nnnnnnnnnnnnnnnnnnnnnnnnnnnnnnnnnnnnnnnnnnnnnnnnnnnnnnnnnnnnnnnnnnnnnnnaatttatctaagttttcaaaaggtcctcttccccatataattgtcgtttggcttttggggggactaaaactaggaccccttacctgggtcaatggcaagcgcaagcccccacccgccccccggccaaacaaggagaattccttttttgggggggggggcccccccccaaaaaaaaaaaacccctttttttgggggtccccccaaaaggggggggtnccccccccgtgacaggtcgaaactctagaaggggaattccntntcttgggggaacagggaaaaaacaaaggaagccggtttgtaaaacaaatttcaaacaaatcaaaacctgggggaaagttataacacctctcggtggggaaaccctcaacggtntaaaaaacaaaggccaaacaattctcaaggccaaaaaaaaatagttgggcaaacaattctnnttaaaaattnttgggggggttacaaaaaacacctggggggaaaaacggggggggntttccttttttccttttnnttttncttttcaaaaaaaaaaaaaaattttccaaaaaaaacaaaatctcggaannaaccgaagcgcggggggggcccccaaattaataaaaaannaaaaggggggggtctnnncccaaaaaatttttaaaaaaaaaaaaatttttcggggtgttgggtggggngaaaaaaaaaatcctaaacaaaccttgggggggggccaacaaaaacaattttntattt

SEQ ID NO: 14615 - DNA, 1030 bp, Xenorhabdus bovienii
  unsure (1)..(1030): unsure at all n locations
  Genomic contig Name=Xb4151_4152.C74
nnnnnnnnnnnnnnnnnnnnnnnnnnnnnnnnnnnnnnnnnnnntgggggggggggttagaaacacacaaaaaaaagacctaggcgctggcaaggaaacaaccgtctttggagctggccctagaccccgggcccgggttttctggcctaaaactgnactcnccggcgaagggggggagaataaatccccccccacccccgggggggggggggcgggaagaanaaaaactcccccctcccaaaaggnncccccccggggggggggaaaaaaaaaaaaaaaaggaggggggcgccccccccccgggcgggaaaaaaaaaaaagggagggggggggaaaaaaacaccccccccaaaatacggtngggggggcccccccccccaaaaagggggggggggcgggttttattaaaaactttggggggggggctttaaatccttccnnnnncnncgggggggggtncngcnnnattttattttanatgtctacttttgggggggaannaaaattttttttgtgannnnnnnnctgttgggcaagngagggggggcccnnnnccgggggggggggggggaaaaaaaaacaaaccacaatnaaccactctcttgggggggggggggggggggggnaaaaaaaaacaccccaaccccccttttggggggggggttttcctccccaaagaggggggggggtgtttttttttgggggggggggggaaaaaaaaaaaaaacaccggaggtgtcgggagncgcacccaccccccgcttcctctcaaaaacagaaaaaaaaaaaaaagagggaggggggggggggggtggggggaacccnaaaaaaagaacccgccccggggggggggggggccccccccccccccccctcccccctntgggtggttgtggtttgtgggaaaaaaaaaaacaacaaaccccccccccccgcggggcggggggggggtgtgtgttttcgtcgccccccccacacgggcaacaccgggagngggcgggggggggggggaggaacgggcggctgtttt

SEQ ID NO: 14616 - DNA, 907 bp, Xenorhabdus bovienii
  unsure (1)..(907): unsure at all n locations
  Genomic contig Name=Xb4151_4152.C75
nttttttnnnnnnnnnttggggnnnnntttaggccatcattggtcgacccttggaattttgtgtgggtggtaagaaggtttactttttgagtactaatcgtcccttatctgtgtatcttacctacaacttattgcgggtgtatttttttttttttcccccagtttgnattattttaaccggnaaaaatattttttccgccggaaaaaaaanccccttttttttcggggggttaaccccccccccttaacaccgntaaatccacnttccttccctttccccggtnttcggcccggggggaaatttaaggttgggaaaaaaaaataaccaacccgggcccaaaggnaaccaagggtttttcgaaagggcgggttttttttttttcaaaccattttcccccttgggaagaaaaattttttttttcccgggggaaatttttttataaaacccctttttttcccgggggnnccgggggggaaaaagaaaaaaatttctggcgggggcccccccttggggaaaaaaattttttggaaacatcttggggaaaaacttttgtggtgaaaaaaaaaaatttttttctacccccnccccccaaaaaaaaaaaatttnaaaaaatttttttcccaaaatttaaaaggggggggggcgtttttttttttttttttttaaacaaaaacaccccccctttgtgtgagantttttggggaaaaaggtttttttttttttcacagagaggggggggcaaatatatttgtgggggggggcgccccccccccccccaaaaaaaaaatattttttttttttttattcccgccggcgggcgggggggggggtgttttttttaaaaaaaaaaaagaaaaggggggggggggttnccccccccccccccccccacaacttaaatttttg

SEQ ID NO: 14617 - DNA, 1028 bp, Xenorhabdus bovienii
  unsure (1)..(1028): unsure at all n locations
  Genomic contig Name=Xb4151_4152.C76
nnnnnnnnnnnnnnnnnnnnnnnggggnnnnnnnnnnnnnnnnnnnnnnnnggggnnnnnaaaagggggnnnngngggggggggnaaattttttcngnnnnnnnnnnnnnnnnnnnnnncccggatacaaattcnaagctcggtacccaatcagtaatnngtcccagcgaaangtnggccaccnacgtntntggncctggttaatggcgngngaaactggncnccccatganatccaataaaaatggnctcattccacgcaaaaaagcgggggagtgttccaaaaatatttggaacgcacttgtggggggacaaaaaaaaaaaagggttttttttccaaattttcccgggggcctctttaaaaacggaaaacaaaaaggggggtgggggaaaaaacagggggagaaaaaaacacaaattggtggggagagctcttcccctctcccgtggtggggggggaaaaagaggggggaaaaaacatttttttttctcccccacaccccccccccaaaaaaaaaaagttgttgtccccccggagggggggggggggaaaaaaaaaaaaaaaaaaatatccctcttttttttacccccccccccccccccggggggcggaagaggggtttttttttttttttaagagaaaaaaaaccaacccccccccccccccccccccccaaaaaaaaaaaaaaaaaacccccccccccccccaaaaaaaaaaaaaaaaaaaaaaaaanntggggggggggggggggggggcccccgcccccccccccccccccaaaaaaaaaaaaaaaaaaaaaaaaaaaagagggggggggggggggggggggggggaaaaaaaaactcccccccggggggggggggggggggggggggggggggnnaaaaaaaaaaaaaaaaaaaaaaaaaaaaaaaaaaaaggaaaaaanttttgtgccgggccccccccccccccccccccccccccccaaaaaaaaaaaaaaaaaaaaaaaaaaaaaaaacaaaccccccccccccgcgggcgggcgc

SEQ ID NO: 14618 - DNA, 955 bp, Xenorhabdus bovienii
  unsure (1)..(955): unsure at all n locations
  Genomic contig Name=Xb4151_4152.C77
agnnnnnnnnnnnnnnnnnnnnnnnnnnnnnnnnnnnnnnncattgatctcgtgattgcgcatactcccatggcgattcctttggagagctcctatgatttttcggccggacggagaaagattcctatatacatgattcacgaaacgctctacgtgggcgtatacccttagtaatcacgagacttcatgtgtttactagacacttacaaggaacggggttcgggctgactggccttatagagagtatgtatgaatatctattatatcagcccagacaccgaggatcaggtctacctgatgagtgatgatatgctacgcggcgtgaatctgcagcatatgcgacgttctggactattgcacntaccgctgagatacaggctcangtagtctgatcatagagctagattcaagtagctagcatttaggcgattgctacgtgtcatgacaagtcgatagnactatccttagaacagttgctggatacgttgacgataaccccggatgcagttctggcggtgcagggatttgagcggattgcctaatttaactggtcaaacagttaacggggttgggacgggaacttaagccacctttttcttttggggggtattaaaccgggcgggaaatacaggcaattttttgggggggtttttttcgcccccaaaaaggggcgcctcccccccccttttttttttctctggtttaaaacaaaaaaaaccccccgggtgtgattaaaaaaaaaagggggtgttataaaaaaccccccccccattttttttttttttttttagaaaaacccncccccnnaaaaaaaacaaacaacccccccccccctcttttttttttttgtggggggcccccccccccccccccctaaaaaaaaaaaaaaaaaaaagaaaannnnggggggaggaaaaaaaaaaaaaaaaaccccccctctcttttctttttttta

SEQ ID NO: 14619 - DNA, 917 bp, Xenorhabdus bovienii
  unsure (1)..(917): unsure at all n locations
  Genomic contig Name=Xb4151_4152.C78
aggaagaagcgatgtgngagaacggngntngntccnaggggagtngcagcccacacacagtccatccgnatggcgcggggcgggggggtttttttgttnttaataaaccagagggggganagggggggggccttttgatttttggggtgtnaggaagaggggggggggaagtggcacgcaggagggagggcgcatctcgcggaccccccccggcgcgggccctttttcccgtggnttttgggggaggggccccccnnnnaaaaataangccccggnaaccccccgctgtttttnnccccccccccgttntttnttaggnnaccccccttttnttttnggnnnaaagannaaaaaccccccaacccctnccctnttaaccccgccccaaaaataagggnttaaaaaacccccggcccggccccctttttttgggggttttccccctttttgggggcccccccaaancaccccccggggnnngggggggttttttttttaaaaaaaatattttttttccccccgcccccccccccggnggtaaaagagggcccccccccgccncncccttnccccccttaaataatttcccccccgggaaacccccccaaacccccggggggttttggggcccccccccaaaggggaaaaaagggccccccccccaaaaaggggggggcccccccccccccccggggggggggggaaaaaaaattttggggggggggggggaaaaaaaaatttgggggggggggagaaccccccccccccnaaaaanccccccccccccccctgtttttttggggggggaccccccccccccccccggggggnggangggnccacccccccccccctttttcccccccccccagnaaaaacgccccgcccctccccctttgggggcccccccccacacc

SEQ ID NO: 14620 - DNA, 1080 bp, Xenorhabdus bovienii
  unsure (1)..(1080): unsure at all n locations
  Genomic contig Name=Xb4151_4152.C79
ggcaaggcnttggcatggccctgggcagggnnttncccgcgcgnnnnnnnaaaaaaaaccacccnnttttttccccccccccccnnttttttaaaaaagagaaagagnannnnnnnaaaaaaaaagaaaaaagaggaggggggggggggngnnnaaaaaaaaaaaaaaaaaaaaataagggnccccccccccccccccccccgnntttttttttttttttttttttttttttttttttttttttctcccccccctccccccccccacccccccacacnnnnnnnnnnnnnnnaggggggggggggggagaagaagaggaagggggagaaaaaanananagggcgcaagcgggggcccgtggntncaattgggggncnccgnnncnncccccaaaaacctaaggntaacacccccccccggnncccgngaaaaattaaaccccggggaaagaaggtttnccaattggggcccccaagtgggttaaaatgggaaaacccccccagggtttaaattaaggaaaaaaaaaacccccgggggaaacacccggggcaaatccccctggggccctccaaaccgcgggcgggaaacccgggggcggcggggggcntnttaaaccccntcccggggtgaaaaggcatggaggcaaaaaccgggggtcccccccctcccggaaacggggaacgccccccgaaggggggggaggagaaccccggggcgggaaagggggtggcaaacagggaaacccgggtacaggggggcccaaaaaaaaggacccccccccccccaaaatcccccaaaaaagggggaagaaggggggaaaaacacacnnnnaaaaggggggaaataccccccgcccactaaaaaaaaaaaaaaaggcggggcgaaagaaaaacccccccgggggggaaaaaaaacatataaccacccccccccgcccggggaggagagaaaaaacccccccgggggcgggggggggggggaaaaaaaaaaaaaaaaataaaaaaccttnttaaaaacccccccgcccccgccgcggttattaaaaaaaagggaaagaccccccccccggcgggagagaaa

SEQ ID NO: 14621 - DNA, 957 bp, Xenorhabdus bovienii
  unsure (1)..(957): unsure at all n locations
  Genomic contig Name=Xb4151_4152.C80
ngggggggggggggnnnnnnnnnnnnnnnnnnnnnnnnnnnaaggagggagggnnnnnaggaggncttccataggcagnnaggggggggtggcnaggnnnnnnnnnnnngggggggnccgggatccaattcgnagctcggtaccctggcataagcnccacgtcatccatggaaataccctttgggccggccaaggggttttaaaggnntttccccccccaaaatttcggggcccaggggcccccaaaaggnaggtgggggggggggccnccttttttttcccccgttgttttgtgtttttgtccccccgccaaaaacacaaagaggggggccgggggcgggtgttataaaaatattttcccccccccccccccaaaaaaaaaggggggggggggggggggggnccntntttttttttttttggtggggggggggggccccccccacaaaaaagaaaacccccccccccctttttggggggggggggggggagaaaaaaaaaaagtgggtggggggggtggggggnngtggcgccggaaaacccccccccccccaccccccccanaaanatggtgaaggnnaggggtgggnngnnggnaggaaagctatttttggttgtgggnngggnnnnggggcgcnngncgccgccccccgccccnnngnnnnnnnnnanaaaaaaaaaaaaaaaaanagggggggggggggggggggcgcngccgggtttctttnnnnttttttttttttttgtctttgtagaaaaaaaaaaaaaaaaaaanacncccccgcggccggggggggcgggnnggncnccggggnnnngcggnnncnnncgccgccgaggaaccaanagaaaaaagananagnggtgtggttggggggggcgaccccccccggccgccgggcgagagaggaaggaggaagggaggggnntgnnnnnnnnnnnnnnnnnnnnnnnnnn

SEQ ID NO: 14622 - DNA, 976 bp, Xenorhabdus bovienii
  unsure (1)..(976): unsure at all n locations
  Genomic contig Name=Xb4151_4152.C81
aggttttagagagaaaagcggtnngtcggcgtgaggatccaacaccggaaagggataggaagactttagcctgtacaggtaatcaatncatgtagctaccaaacaatgtatcagcattgatctgtcatgagcgccatagccctttgatggatgcacttgctaagcatgaaacactacacgcgggtggcggagtggacttcattaacatgtcggaaggaggcggtcacgctcctgcacataaagcccttctttgaaatcgcaggttaagtgcggcgttatctgtaaataaaagttctcgccctagcataccgcaacgccagatggattgtgcccccgagccaaaaatctattcgcccctaacaggggccgcgggtgtaaaaagaaattttgggggcggcgtttacaagtggttttttaaaaaggcggtcccacggccctcacccccccagggggaatatatatagggtgggtggaggcaccccgggaaaaggctttttcctcttttgaaccccccaaaattttcccccggggacacaaaatccccaagtgtgtttttcaccccttttgtaaaaaaaaaccccccccggcggggggggtttttttttttggaagggggcggtgaaaacaatttttttaaacaaaaagaagatttttctgttgaaaaaaaaaaaacaataattttgcgggccgttttaaaaaaaaaagaaaacaagttttttttccccaatttttttaaaaaaaccacccggggggggggttccccccccgcggggtttattaattaaaaaaaaaaaacaccctttttataaggaaagaaaaatttattgtattctcccccccaccaaaaaaaaaaaaaaagcgggcggcgcgtattttaaaagnngaaaaaataaaaataaaaagacgcgccccccaaagaaaaaaaaaaaaatatgggtgtgtgggggggcgctaaaaaaaaaaaacccccatcttt

SEQ ID NO: 14623 - DNA, 892 bp, Xenorhabdus bovienii
  unsure (1)..(892): unsure at all n locations
  Genomic contig Name=Xb4151_4152.C82
nnnnnnnnnnnnnnnnnnnnnnnnnnnnnnnaaaannnnnnnccaaccattcggctggccgcccaggggcaccaaggtctatcctagagaagcagtcggagcagtagctgacgggtgtcggtcgggggcagccctgccctccgcaggcgaagggaccagcacggccgtntnnnncccgttgtgtttttcccgcaaaaaaatttttccccgaaaaaacccttttccccgggggntttaccccacaggtcacggttttaggcacaccaatgaaggcacctattaatttggccaccggaaaaacaaaaggggtcttaaccaaaaaccaccccgccccaaatgggggaatttttgaaaaagacaaccaagccctttggccctcccatgtgttgggattaaaagaaaaacaagcgccttttttcccgagggggaaaaaccccttaacaaaatttccccccccccccccagagatattatttttaaaaaaaagggggccccccccaaaaggggagaaaaaaaatttctttccccacaagggggggtaatttttttcccccaaaattattataaatttttgtgggaaaaaaaaaaccccctttctaaaaaaagagagggggggggggggaaaaaaaaaaaagagggggggaaaaaaaaaaagggggggggaaaaaaaaattttttttttttttgggagaaaaaaaaaataaaaaatttttttttttaaagagcggggggtggggagcgcccacataaataataattttcccccccccgccggccgcgggaaaaaaaaaatatgggggagggggcgctccccccttccatcccnnggggggggaaaaaaaaaatatattatttttcttcctccctcccacaccagagaagaaatatttta

SEQ ID NO: 14624 - DNA, 742 bp, Xenorhabdus bovienii
  unsure (1)..(742): unsure at all n locations
  Genomic contig Name=Xb4151_4152.C83
nnnnnnnnnnnnnnnnnnnnnnnnnnnnnnnnnnnggaaaggggcccgaccnagnaggnnnnnnnnnnnggccgaaatcatgacctaatcggaacaggtcatatggtaactaacgagattcttccgagcatagggattccagtttcccaaagaatctggtggaaggtcggaaaaggccccaaaaaatggccaaagggaaatggggaccgggggtttccccaaaaggttggggggtttttccccccccccttagaggggaaaaaaatgttttccacaccttaaaaaaaaaaaaccccgggggggggggggttttttccttcccccccggaagaaaaaaagaatttttttttaaaaaaaaaaaaaaaaaaaggggggggggggtataaaaaaaaaaaaaaaagccccccccccccaaccccaggaggggggggggggggaaaaaaaaaaaacccccccgaggggtgtggggtataattaaaaaaaaaaaaaaaaaacacaccccccccccccccccccccctttaaaattatttttttttttttttnnaggggggggggggaggaagaataaattttctctttcccccccccccccccccccccaaaccaaaaaaaaaaaaaaaaaaaaaaaaaaaaatagtgtgtgttgggggggtgggggcgcgcgcccccaccaaaaaaacaaaaaaaaaaaaaaaaaaaaaattttttttttttttttctttctgtgggggggggggggg

SEQ ID NO: 14625 - DNA, 1292 bp, Xenorhabdus bovienii
  unsure (1)..(1292): unsure at all n locations
  Genomic contig Name=Xb4151_4152.C84
agcacttatgngcctatagncnattgnncncttgncnangnntncgnnactgncttannngagnatncccccttnaaccacggaggaaaataggccgttaactttcatttttgggaagggataaggcccttaaaaatttttaaaagccggcttttatggtaggccccttttttttggaaaaccaacccccccgcccccgtgggggtataaaaaaaaaaaattttttcatttttcccccctctctttttttnccacacccaaaaaaaaaagaaaaaatcttttttctccggggggcccctttttttttttttttttttttttttgaaaaaaaaggtgtttttttttctccaaaaaagagaaaaaaaaaaaaagaagggggggggggggggcggtgtattttttttttttttttttttttttttttccccccccccacactttttattttttgttggcaaaaaaaacaaaaaagattttgtttgttggggaaaaaaaaaaattatttatttttttttttttgttttttgtggagaagagagaaaagaagaacagccacgggggggggggggggggggcctcccttttcttttttttttttttttggggggggggggggaggaggcgcggggaagcaaaaacanagcattattctcgtcttttttttttttttttccccccacacaaccggaaaaaaaattgatatccctgtcgttttttntctctccccgcacccgcccccccccaccggccccagggagcgagggaaggtagggggggggcgtcgccttctcgctggtttgagcggggcgagggggcaagcaggtagaggaccccggcgcggaacactcaccacctctctgttttgttggtgtttggttgggtcgttgttgtcggggcggggggggtgtgtggtgctagtctatttggttgtcgtgnttgggcgctcccgtggttgttgttcttgtgtttttttcncgcgctggtttctttatcagcacagaatccacgcacacttgggcgcgcggccgcgaggcgagatgcgcaaggaagtgccgcccgttttctttgccgtggttctgtcgttgcctccgctgtcctgcgtgagtagtatgcggcggtatctgtattgagatattctcatgtttacgatcataccgccgtggctcatgcgtaacgagtttattacagtacgggtggcgacgcgtcgacaagattgtttgtgttggagaaacgtaggtagtgtgagttcgtgcgcgcgggcgcgcgagctgcccgctgtgtccgttggttgg

SEQ ID NO: 14626 - DNA, 1017 bp, Xenorhabdus bovienii
  unsure (1)..(1017): unsure at all n locations
  Genomic contig Name=Xb4151_4152.C85
nnnnnnnnnnnnnnnnnnnnnnnnnnnnnnnnnnnnnnnnnnnnnnnnnnnnnnnccccttgaaaggaggggagccggcccccncntgatttgttcccggngntgnncctgtggtgtcctggcctagcgtcgggcgggcggacgggggggaancggggctgggcgcttggtggaggttgncnnncaanncnnnnnnnnnngggggggnnnnnncccttttttaggnattcgggggtttgggtacncggnttttccggcnaactgggggcccgttgttttttttttggtggggggggggtttttttttttgggggggggtgccccatttttgtggggggggggggcccttttttggggggggggggattttttgggggtgtggggggggccttttcccccctttttttttttttgggggggggttttccccggggggtggggggggggtttttttttttttttttttttggggggggggggggggcgcaccccccaggggggggggggggtggtggtgtggtgttgggggggttttttttttaaaaaaaaggggggggggggggggggggggtgtgggtttttttttttttttttttttggggggggggggggggggttggtgtttttcccccccccctttttttttttttttttttttttttaaaagacggggggggggggggggggggggggggggggggggggggggggggccccccccccccccccccttttttttttttttttttttttttttttttttttttccccncccccccccccgaaggggagggggaagaaaggccccnccggccccccccttctcttttttttttcttttttttttttttnnntttngggggggggggggggggggnnagaagaaaaaaggcccccccncccccccccacaaccccccncnccncnnnnnnnnnnnnnnnnnnnnncgctgttttttttttnttgttgttggnggtgnggcccgnggggggcncggggcgcgctttgtacacgaat

SEQ ID NO: 14627 - DNA, 655 bp, Xenorhabdus bovienii
  Genomic contig Name=Xb4151_4152.C86
ctgtacatcagtcggaccagctatgcgcgactatgcctggagagctagacagactggtgatattctgtcggaccaaatcatactgatgaccacagaaccccgtttccattcccggaaattgtaaaccccggtgccctttggcaatgttggggggaaaattttccccaacacgcgcctttgggggggtcctcccccccaacccccccccgggttgtttgggtggaaaacccccggggggggaaaaaaattttttttttgggggggggttttttttttttaagggggggggggggttttctcccggggggggggggggggaaaaaaaaccccgccccctcttttttttgggccccccccccccccccttttttataaaaaaaaaaaccgggggaaaaaaaaaaaggccccattttttccctttccttcccaaaaaaaaaaaaaaaaaaagggttataaaatttttcctctccccccccctcacaacaaaaaaaaaaaaaggggggggggggggaggggggggggggggttttttttcggggggggcggcgccccgccgcccccccccccaaaaaatttttttttatatacccacaaaaacccgggggggggggggggtttttcctcaaaaaaaaaaaaaaaaccccccccccccccc

SEQ ID NO: 14628 - DNA, 899 bp, Xenorhabdus bovienii
  unsure (1)..(899): unsure at all n locations
  Genomic contig Name=Xb4151_4152.C87
nnnnnnnnnnnnnnnnnnnnnnnnnnnnnnnnnnnnnnnnnnnnnnnnggggggtaccngnnnnnnnnnnnnnnnnaagatgatcgagtgtaccactcagaatctactatgcatgaaatagggatcccatgagccaagccattccaaatttaggggtttttaggtaacctgggggggggaaattttaaaaaccttttaaaccccttaaaggagaaatggggggggggggaaaaaaactttttaaagggggaaaaaattttttgggggaaaatttttttctgcggggaaaaaaaaaaaaaagaaaaaaaattttgttaaaaaaaaaaaaaaccccccccctttttggggggggtttttttataaaaaaaaaaaaactctttttaaaaaaaaaaaaaaaaaagagaaaaaagaaccctcttccctcgggaaaagaaaaaaaaatataattattccccccccccgcaaagaagaaaatatttttttttcttcccccccccccagagaggagtaagaatatatattatttttttttttccccgccccccccgcccgcgggggggttttttttatttttttcttttcttcctttggagaaaaaaaagaaaaagagggaaaaaagccccaaactttttttttttttttgttttttttgttttcctttttccccccccccccccccnnggncccccnccccccccccccntcaaacaatattattatatgggttgtgggtgggggtgggggggtggggggggggggcgccgagaccnacccccacctcccccccccttatttttttttttttttttttttttttttttttttttttttttaatataataaaaaannnnnnnnnaaanacccnnnnnnnnnnnnncgggggggtggtggcggtgggg

SEQ ID NO: 14629 - DNA, 1040 bp, Xenorhabdus bovienii
  unsure (1)..(1040): unsure at all n locations
  Genomic contig Name=Xb4151_4152.C88
gaagggaagannannnnannaaanaaaaannngggnnngggggggggccggttagtgnntggggggggtttcgggggtcttcctagagctggccagtcttgataatagacccctccatcttttcacgaatttcctgagtgattttgcttttgtgatgcgttgtcattacgtgatattgtactcntnanngngggcaagcttgcctgcccgtcagttcgaactctaggaggaatcttcccccaatgggaaatgggaatccgttttcattaaaaaaaaaatttcccccttgggggaacagggggaaaaaatttccgcgccccccccttttttaaagagggaaaaagggggggcccccaattggggtttttttcccgggggtggccccccccgggaaaaaaaagacaaaaggatttccccccccggaaaaaaattaattcaccccccccctttttttaaaaaaaaaaaatattttctcccccgcggtgtggggtgggggggggtttttttaaaaaaaaaaaaaacggggggggtggggggggggaaaaaaaaaaaaaacttcttcttttttttttaaaaagaaaaaaaaaaggggggggggggggggcgttcctcccttcccccccggacccaaaaaaatttctttccccccccccccaaaaaaaaaaaaaaaaaaaattgtggttttttttttcttttttttccatcgcgagaaaaaaaaagaacggctcccacttttttctttttttttgttggngggggggggggcccctggggttttttttttttattcaccgcccccccccgcggcgcggggttgctgtgttgtttggtttttaatacaaaaaaaaaaaaataaaannnngntctgaaaagcggggcgcgcccgcccgcccgccccccccccccccttcctgttttttttttttttttttttatttataaaaaaaaanaaannnnnnnnntcnancttgtgtgttttttggtttttgggtgnngggagagggagaaaagaaaacagagaagaacaacatcccgcccgc

SEQ ID NO: 14630 - DNA, 899 bp, Xenorhabdus bovienii
  unsure (1)..(899): unsure at all n locations
  Genomic contig Name=Xb4151_4152.C89
nnnnnnnnnnnnnnnnnnnnnnnnnnnnnnnnggcatgctctgcgcatcaagacctcccccggatgggggcccgcaactacnacgtctnnnnaaaaaattnngggcagctgcnnnnnnnnnnnnnnnnnnnnnnnnnnnnnttcaaatcgtagnagaaccgctaagcgcactgtgtgggcgcaagttcgncnnggtccggaatcccgcttnnccgactcgtaagggagcggttttaccggtnntctgattttctcccggcatgtttaacaaaagaatggcgncgntggnattccaagntaacgaagnaatttccgncaccttcaaccaaaacacgggtcctggggggtttggaccaattcggtttgggggccccaaaccccggaagaaaaaacccggtttggaagggcctccctggaagggcgggccctgggggaaatcttgggctttgggtttgggggggtaaaaaaaccgggggcaaaaaaaaccaagccccggggggggtttaaaaacccccggggggtcttttttttaaaaccaaatttttggaaaaagggtgtggtgaaaaaaccccaggggggggttgggggggtttttaaaaacccgcgggagaaaaaaaaaaaagggggggggaaaaaagtataaattccccccaaattttttttctcccccnggaaaaaaaaaaaaaggggggggggttgtttttttttattaataccacccccccccctaataaaaaaaaggggtggtttttttcttctccccaaaaaaaaacccccccaaaaagaagaaaaaaacaacccccccccccctctttaaatatattctacccccgccgggggggcgggttnttaaaaaaaaccccccccccccccctagggggggggtggggggggggggt

SEQ ID NO: 14631 - DNA, 1150 bp, Xenorhabdus bovienii
  unsure (1)..(1150): unsure at all n locations
  Genomic contig Name=Xb4151_4152.C90
gggaaaaagnnnggggngngnnnnnnnnnnnnnngngnnggnggggnnnggngccccccccccccccacgggggnnnnngggcccccccgccgcccccnnccncnngggggggggggcccgccccncgttggggcgcccgncnncccgncggtacaagacacggggaaacagagttcttcccgcagngaaaaaaaaaaaaaggtttctccctctgagggggagcccgnngnnnccccctgaanaaaccacccgcccncccgagnaattttttttcccgcggnggnnccactnngnncccnngggaaaanggggaagaannnnnttaaancccccccccccnnccgnntnnnttgnngngttnnnnccncaanggnttttttttgggnnnccnaccctnnnncnccnnccggnntnntttnnnnttaatgggnnnttatttttnnncncccccnnctnnnnntaaatttnttnntttnttnnnnttntttnnnaatatattttnntttnntttnnttttnnnaaataaannnaaatnnnnaaaaaaaaannnaaaaaaaaaaaaaagggnnnaaaanaaaacccccaatatttttntttttttnnaacccccaaaatnaaaaaaccccccnncccggggggggtttnnnaaaaaaaaaaaacccccggaacccaaaaaaaaaaaatgggggggggtaaaaaaaaaaaaccccccgggggtttttnnnnnaaaaaaaattaaaaatnnnaaaaaaagccccccaanaaaaaaaaaaaaacccccccccccacaagaaggnggtttttttttttttnnnnaaaaaaaaaggggggggnnnnttttttttttnttttttttnntggggggggggggtntntatttnaccccccccccccnnnctgagggaaaaaaaaaaaaaaaagcgncgncccccttcggggggggggggcctannnagaaaaagaaaaaggggtttttttttttaaaaaanagacaccccccccccacaaaaaaaccccccccccccgagagaaaaaaaagaaaagaaagggcgcccccaaaaccccccccccaaaaaaaaaaaggagaggggtttttttgcangnnnnaaaaaaaaagggggggggggaaaaaaaaaagaaaccaaacaa

SEQ ID NO: 14632 - DNA, 845 bp, Xenorhabdus bovienii
  unsure (1)..(845): unsure at all n locations
  Genomic contig Name=Xb4151_4152.C91
ncagctgatgctgcagtcgatctagagatcctgctangatnagcgcgtagaaacattttcccagaaaacctctgtaagacaaattttccccttttaggttaaatggttttaaaccgcaaatgggaaatttcaggggcccccaattttggcacaaagggggtttttcccccggggaaaacccgggattttggaacaaccccggggggggttttccccccgtggaaaaaaaaaagtgttttttaaaaaaacatccttttggggggggcgccccaaaagtgtggtgtcacaaaaaaaaaagaggggggggggggtggtttttttttttttttttttttttctaacaaaaaacaagaaaggggggggggggggggggcgcgccccccctcctcctctttttattattaggagaggagagggggagaagagggcgccgcggccccccccccccccccctcctccacccgccggtggttttttgttttgttgtttttttttttttgggggggggagggggnggaaagaaaaaaaccactcttttctttttttttttttttttttttttttttttttaataaaagggagagggtgggggctctcttcctctcctttcttcccnnnaaaaaaagataaaaaagggtgttgtttttatttttaaaaagagaaaaaaaaaaaaatctccccacccccccttctttttttttnnnnnnnnnnggggggttggggcccccccccccccccccaatctcggggggtgtccccccccccaaacgaaaaaaaaaaaaaataaattctctttttnttttcccccccccaccaaaaggggggaagggtggtggggggtgggg

SEQ ID NO: 14633 - DNA, 924 bp, Xenorhabdus bovienii
  unsure (1)..(924): unsure at all n locations
  Genomic contig Name=Xb4151_4152.C92
cnnnnnnnnnnnnnnnnnnnnnnnnnctcgcataaactttatgtttttaccgaagaacacattatatgtgtatattgttccttttccactcaacatctccgaatccatagtgtcgtaccttgactttttttgtgtgtgtctttgaggtcattatcttgggtacgcgtgctttcaaagtagtagatttgacctacggataggttaaaacgttcaactaaatcttcatcataaatgcgggtggtgatgccactggtaaactgattagcagatgaaatgcgatccagcccactgaagaagcgatcccggaacaatccaatatcgatatcaacactgtctcctaatgcaatgaaataggaaaaaccaatattacggtggatggaccaatccagaatggaattggatattgatgctgtctgtgagatgcttgctagtatacatgttgaggatcagacaccattttcaaatggcatttaaacagtggcatgacacgagtgtactgatttctctagcgtagagttctgtgtcgtggcaggaatatcttgctgatagtgggttgccatcaatttaaattcattattgaggcttgcccagcgattggagagcggcagattgatagtcggttccacatgccaacgtgttgcctctgggtaatctttgcctacgctggtgaacttggcaatttgagcgtgggttcggaaatcaacggccccagatcatttttgtagtaattcagatcaagttgaggctctgcacggtaagcttttctatttttccngncagtaaagatctggaattgcttgctttgcaagntgcatcccagntctgntgngcatagccatactgaatttnnctggtgcataacccgtcgtactggtgccgtatttgcgagtaaatcagtgaantaattgggatcactaactttgt

SEQ ID NO: 14634 - DNA, 1214 bp, Xenorhabdus bovienii
  unsure (1)..(1214): unsure at all n locations
  Genomic contig Name=Xb4151_4152.C93
atggcttcgaaattccgaagncntgncgangggnttttaaaaaaaccccccccccctcatcccccctttttcccccntataaaaaaaataaacaaaaaaagagagggaaaggggggcgctgttttttttttcccccccccccctttttttgtgtggggggggggaaccccccccccccccccccccccccccaaaaaaaaaaaaaccccccccaaaaaaaaaacaaccccccccccccccctctttttttttttttggtgtgtgggggggaaanaaagccacgcacaaacccaccccacaacaacacaatataatctttttatttttttctgaataaaaaaaaaaaaaaaaaaaaaaaatccccccacccccccccccgcggggggggggggggggggaaggtataacaatatatatatataacatccagcactcccccccccccgccgcgggtgggggtgtgtgttttctccgtctcgtgttcngccacaccccaaaaaagaacaaaaagaaagaaagtcnacaaggcgnngttgtttgngctttgtgtttttatcctgacttgtaattngaataattaataataatatttattaataaaaaatatttaagttggggggggggggggggggggggaggaaaccaacataaatcaaccccacccccccacccgggggggggggtggggggtgggggcttcnttcttttaaaaaaaaaaaataaaaaaaacacaccccccccccccaccgccccctcaatcaccttnaatagaattatatatacaaaaaaaaaaaattcattcccccccctccccccccccccccctccccacccacaaacaaaaagaaaacacanntgtgtgntgggttgtttttttttctttctttctctttggttgncggcttcggtaaaaaaaagaaagaaaagagagcgagtcggccggccccccccccgcccccccccccncnnncnnnaacanactnnatatacaagaatatcattttactgagagaggaagaggaganagaatagncacaacacgggcacacatctcatacttaattcaatatcactcccacccataacttcttcctcacacatactcgccgcggacgcggagtgagtggcgaggcccacacacnacnaatcacacacacactcccatgcgacatcagcgtggaccgagcaccgcacatatacaacgctcctccctg

SEQ ID NO: 14635 - DNA, 484 bp, Xenorhabdus bovienii
  unsure (1)..(484): unsure at all n locations
  Genomic contig Name=Xb4151_4152.C94
nactgtgtagcgactctaaacctatttatggaagtgactgctggggggaaggaaataatgccccaattctggaacgaatcccctttggccccccgttaaaaaatttaaaaccccggnnaaaaaaaaagggggggnttttatcaaactaacttttttttgatctcccgaagctttatcaagaaagggcttatgggtggcgaattgggtccgaaccaattcaaaccaagaaattggggcttggttttaaaaaattccaaaagcccggctttggaattccttccggggcccgggggggggcccccaaaaaggggggggggggaaaaaattttttccggggaaaaaaaattcccttaaaaaactgtggccccggcaaaaaaaaattggggggcgaaataagggggggaaaataaaaaggggggccccccccaaaatttttcctaaatatgggggggaaaaaaattttttttttcccccgaaaaaaaaa

SEQ ID NO: 14636 - DNA, 693 bp, Xenorhabdus bovienii
  unsure (1)..(693): unsure at all n locations
  Genomic contig Name=Xb4151_4152.C95
nnnnnnnnnnnnnnnnnnnnnnnnnnnnnnnnnnnnncccccttgtgccgggcnccttgggtcccctgggtgggttgctgtcttcgnctnnnnnnnnnnnnnngggccagccttgcatggcctgccaggtcgnactctaggaggtaccttcggaaaaaatttcgcataccccttcgggcccaaaagggagggactttcgacaggagggaccccctccaaaccccgggggggccccccaaaaaaattggggggaactttaaggggagaaaaattttgggggttggggctccccaaaaaggggggggggggaaaaaaaagggggggggggcccccccccccataaggggggggggggttttccccccccccccgggggggggggggggggggccccttaaaaaaaaaaaaaaaaccccccccggggggggggggttanaaagaaaaaaaaaaaaaaaaaaannnannttttttttttttttttttcccccccggccggggggtggatttctatttttttcnccccctcctttttttttttttttttngtntgtttgggcgaatttttgatttnnnttttttttttcttttttttnccctccccncnncccgcgggggggagatttgttnaataaaagnaacatcccnccccccccccccccccccccnnnaaaaatanntttattttattttttg

SEQ ID NO: 14637 - DNA, 906 bp, Xenorhabdus bovienii
  unsure (1)..(906): unsure at all n locations
  Genomic contig Name=Xb4151_4152.C96
ngcagcggtagctgaagccaactcaaggtatcctgctattaccgagtaagcgcgctcccccctttgtggccaaaaaacgctttggggccatttccccccaaatggctttttcccccccctctttaantaaaaaaanccccccttttctctttncccccccccttccgggggggggggggggggagagttttttcccctcttgtgggaggccccccgcgccccccccccccaaaaattttttttgttgttgtggggaaaaaagtctctcgggggtggaccccccccccccccgcccccgcagaaanttncgcgccngggggagagtttttcttcttccctcctcccccgggggggggggggggcgcgcccccccccccccccccacaaaaaaacaccctttttttttttttttttaaaaagggggggggggggtttttcttttttttttttccccccccctcaccaccaacaaaaaaaaaaaaaaaaaaaaaaggggggggtttttttttttcgtctccccccccccccgcgggtttgtttttgttttttttttntanaaaattacccccataaacaanaccccccccaccccgccgcggcggcgggcgggcgtcttgtatttgtttttttttctatttattttctcttnannntttctctctctctctcccccccccgcgccccccgggggagagngagagagagaagaaataaaaggttggttttgttgtggtttctttgtgtctccctgctctgcctcctccctcctcccctccctcttattcntnnttgccggtgggngtcgncccgccgcgggcctcttttcttgtttgtgtttggtgttttctccttncgcgcgcgccgccccgcgccgtcgtctgctgtgccttccttcttcttgtttta

SEQ ID NO: 14638 - DNA, 984 bp, Xenorhabdus bovienii
  unsure (1)..(984): unsure at all n locations
  Genomic contig Name=Xb4151_4152.C97
ggctacagcgttggcatggccctggcaggttcgaccactaagggcgaacgccccctaaccggtcttccctggactcgggtgaacttgcctgacagcccacttttctgacaccgaagttcttcttgcttgcccacacaactccccttctaagacttccaaaccagactaacccgccttcacttcttaaaacaaagccgaagcccaccttcaaaaagggtggctggccgacttctaaactcccgtaccttcttaccgagataaccagtacttggcttctttggcgggtaatactttttccccggcagggagaccttgaattaagaagagggggggaaatgtggntggggggaaattggggggaaatttgaaaagccctttttttttaaaatatgggggcgcccaaaaaaaaaagaccttttataaccctcttgggggaaagaccccccccaagagggggagaaaagaaaatattaaaaaaaaaaggccccccccaccaaaaaacacaaaaaataattttgtggggggggcacaatttgtgggtgtttttaaagagatttttttaaaaaaaagaaaaaataaggggggggaaaaaaaaacccacaagagcccccccccgaagaaaaaaaaaaaaaatataaacaccaaaacccgnngnnggnggggnggnggtttgtggggggccccttctctcttccttcccccaaaaaaaaagaaaagggggggcgggcccccccccccccccacaaaatttncnaaaaaaantttttttttttttttttaaaaaaaaaaaaaaaaaaaaattttnnnccccacccccccggggggggggggtttttttttttttttttgttgggggggccacccccccaaacccccccccccccttgggaggggggggngcgtcctttttttttaaaaaaaaaaaacccaccccacccgcggggggagaagaaaaatttttttttctcccccccccccccccaa

SEQ ID NO: 14639 - DNA, 823 bp, Xenorhabdus bovienii
  unsure (1)..(823): unsure at all n locations
  Genomic contig Name=Xb4151_4152.C98
gtgcatgncgttgcatgncctgncaggnttcgnacttctgangaggtancnncccganaaccgtttttttnttaccaaaccccttttggncnccggggtttnttttcccccatataaaaacaccccctncttggtttccttggggaaaatatccgggtggggggttttttttttaaagggaaaaaaagtttttaaaaaaaacccgcggaataaaaccccccaaaaaaattttttcccacctttaaaaaatggggggtaaatttttttttttaaaaaaaatcccttttaaaaaaaggggtcccttaagggggggggtgtttttttattttttcccccccaaggagaaaaacctcttttccacaccaagagggggttttttttcccctttttttttttttgggggggccccccccccgttttttgggggggggggaaaatatattttaccccccccccagaggagaaaaacatcccttctctccccccttaaaaaaaaaaactcttttttttttaaaaaataaaaaanaaaaagagggggggggggggggaaataattttttttttttttgggggggaggggaccctctctttttggtggagggaaaaacaccccccccccctctattaaaaaaaaaaaaaaaagggggggggggggggggggtttttttntttttttatagaaaaagagagggggggggngtntnnnnaattttataaaaatttttttttttntttnntnatanaaacaaaaacaaacccctttttttctgttttgttggggggggggnaaaatnaaaatttctctctccttctggcgcgggga

SEQ ID NO: 14640 - DNA, 906 bp, Xenorhabdus bovienii
  unsure (1)..(906): unsure at all n locations
  Genomic contig Name=Xb4151_4152.C99
nnnnnnnnnnnnnnnnnnnnnnnnnnnnnnnnnnnnnttctgacggccgtgcgatgatcaccaatatgaccgcctacccggagcaatccctcctagtgtaacgagacttacaacaagatactgcccctgcttacagacgtgaaacgtcaccgtaatctgccgcagttcccagccggcacatgcgtacacgtaaaaatctgattgacatgggaaacccgggggccctcccccccaccaaaaggagaagacaacggtttttattccacccccccacccacccgaggaaaaaaagcggttatcccccctggggaaaccccccttggaaaaaaaaaaaaaaacagggggggtggcccgcccccccctcctcttagagagaaataaacgcccccggcgaaaccccttttttattaggnaggggggggccccccctttttttgcccccctgggccccggggggaaataaaaaaaccccctccttttttttttctcagnaaaaanaatgggtggcggcgcccccnccctttttttcaccccccctcccccccccccttttctttttaaacccccccccccccttcttttgggtgcgggaaaaaaaaaaaacaccccccccccccgcgggaaaagaaaaatagcagcgcanaaaatagtatttgggagaagaaaaaagnnnacaacaaaaaaaaacaccccccccccaccccccgggggtagggagnttataaaaatataaataaaagcctcccccccccaaacaaaaaaaaaaaaataaaaattatttaatttttttccccgccccgccggcgggggccggggnggcggggnncaaannaaaaaaaaaataaataacaccaccnccccccaccccccccccccnccggggggtgactgcgcaacaacccccac

SEQ ID NO: 14641 - DNA, 932 bp, Xenorhabdus bovienii
  unsure (1)..(932): unsure at all n locations
  Genomic contig Name=Xb4151_4152.C100
gcttttagttaaaaaancttgcctgggggggagannnnnnnaaaaagcnnnnnnnnnnaaaaattaaaaaannnntgggcccctcggggggggaaaaaaaactctttctcnnnnnngcggggggggggggggttttttnnnnngngggggggggaaacaaaaaaaccccccccccgcgggggggggttnccgggggggngggaaaaaaaaaattttgagaagatttttggnggaaattgggccttggttatttnttncttttnaaannaaaacncggttgggnccgagttttggccctgggaaaggnaaaaaaaaaattcctttnccccttggggtaaaccttggccaaaaggttaaaattggggggttttttcccccaatattgggggggttgggaaaaaagggcccccaaaaaaccgggggcaattcaaggcccaaggtttttccaaggccgggtttttttttaaaaaaaaaaaaaggaaaagtaatttggccggccccccggggaaaattntttaaatatctttggtgtggccccaaaaatataaatagtttttgggggaaaaaaggggtaaaaaaccccccccgggggttaaaaaagagacctcccctatgggaatacccgccccccaaaagtgggtaaagggcccgaaaaaaatttttaaaaacgggggggcccccctaaaagaggaaaaacggggttgggcgcctttgagaaatggtttttttctttggggccaaaaaaaagaccccccccaaaaagattttttgtgggtggggctctctcccccnccggaaggggagaaaccccacttttttaaaaaaaaaaatatgggnggggggggtgggggaaaaaaaaaaaaagaggggtggggtggaaaaaaaaaaaacaacccgccggggggggggtttttttttttgttcgaaaaaaa

SEQ ID NO: 14642 - DNA, 917 bp, Xenorhabdus bovienii
  unsure (1)..(917): unsure at all n locations
  Genomic contig Name=Xb4151_4152.C101
nnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnggcagttgctgagcatctaagacccttcaccgctcattcttgagcatgcgtacgcatacagaccttcgcttgttttaagcgggatttcccgaaggggggcctttattttcccaaaggttccgggggggcacccgggggggttttaattcccaaaattttgggcgccaaaaaggggggtttttaaaagggggggaaaaaaaaaccccccccctaaaaagggggggctctccctctggttgggtggttgggggggaaaaaaacttcttttttaaaaaaccccccccccccctcctcctcttttttataaaaaaaaaaaaaatactccccccgcgggggggaaaaaaaaaaaaannnnnnnnnnaaaaaaaaaaccccccccccccacaaaaaccccccccgggggttggtttttgttttgttttttgttctcctcccccccccccccccccccccaaaaaaaaaaaaaaaaaacccccccccccccccccccccccccccctctccttttgtttttttgtttggtggggggggggggggggggggaggaaaaaaaaccccccccccccacacccccccccccccccgggggggggggttatataaataaaattttttttttttggggggggggggggggggggggggggacacggcccccccccaccccnccaaaaacaaagaatttttaaatattttttttttttttntnnnttnggggggggggggggggggggcctcttttttttttnntntttttttttttttttntttnncgnngggaaaagaaaaacaaaa

SEQ ID NO: 14643 - DNA, 1175 bp, Xenorhabdus bovienii
  unsure (1)..(1175): unsure at all n locations
  Genomic contig Name=Xb4151_4152.C102
gnnnnnnnnnnnnnnnnnnnnnnnnnnnnnnnnnnnnnnnnnnnnagatacctagatagcgtgaattccgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaacctaactaagtatagatattgaagacaattaccaactataaccgtagctaaaacatacctgtaagcaaaacttgacttcatagcatgaagtgttnagtgtgttaacaaacaatagttaattccattttacccccccccgccctgttgggccccctttgtaattggaacccaccccaaccgccccataataaatcgtgggggaaaccacaccctctgtggggggaaaccccctggggggggcccccccccctcggagaaggccctaaaccaggggggggggggggggaaaaatttcttttggggcgctttttcccttataattggggggggcccccccccaaaaaaggcccggccccccccctgggagggctttttttttttgtggggggggggggggggttttctccccccccggggggtttttttattttcacggggggggggggcgccgtttttttttttaaaaaaaagggggcccccccccccggttttttttaaaaaaggggggggggggtttttttttttgttttttgccccccccccccccggggggaggaaacaaaaagttggcggcggccggcgcgaaagaaataacaaaaaagatatcgccggcggcggcggggcccggagaacacaaacaaaaatattttttttttttttttttancacccccccccccgcccccaaggggggggggggggggtgcccgccacctcacccccaccccaccaaaaacagcggaaggagggcctctcccgcgcctctctccttcaccgatagaagaacgccacgcaccccgcggggggggggcgccgccgcccggcctgtgtcctcccttgcaaatagggacaatggcgccgcgggccgccgcggccccgccccccntcccctctttgtgtcggtccagacggacgaaggagtgctgtgatggggcggacccgctccgcgcggcgcgcctgcgacctgacaccgccctgctggtggattggtaccactacaa

SEQ ID NO: 14644 - DNA, 1000 bp, Xenorhabdus bovienii
  unsure (1)..(1000): unsure at all n locations
  Genomic contig Name=Xb4151_4152.C103
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacaaacnnnggaaccacacgnnngcgcccgggcgggggggtcccccccnccccctcgagggggggccaggggnacccnaggcaccaaaaaggttatttttttaaaaaaaaaaaaaaaaaaaaaatcgtgggttttgaaggnaccnnnnaaaanaaccccccaacctntcctttgtttnnaccccccccctaanccggngnaataancctcggnggtngntnncctggngncccgnaaaantnaaanccttntnnntnnnnncccnnccccggggggntttttnggnnaacaccaaaagnncccnnaaaaaagaaaatttttttggggnnnnnnaaaaaaaaacccttgggggggggnnnncccccgcgggtttttaagggggggggaaacccccttttttttggggnccccccccccccccccaaaaaaagggggggncccccccctttggtgggnnaaaacacccccaaaaaccccctttggggggnnnnaaaaaataaaaaaaccccccccccggggttttttnnnccccccccccccccgggggncccccccaaaaattcccccaaaaaaaatccccccccaaaaaaaaaccccccttttttttnnnccccccccccgntcaaaaatannaaaaatacccccccccaaaaaaaaaatttttttttaccccccccccccccctttttttggaaaaaaatannnnaaaaaaaaaaaaaataaggggngggtaaaaaattattaaaaaaaaaaaaataaatnttttttaaaaaaaaccccccccccccccccctgaggggggtgttttttttttaaaaaaaaaaaaattttnttttncccccccccccaaaaaaaaaatgggggggcccccccctccttttaacc

SEQ ID NO: 14645 - DNA, 1043 bp, Xenorhabdus bovienii
  unsure (1)..(1043): unsure at all n locations
  Genomic contig Name=Xb4151_4152.C104
nnnnnnnnnnnnnnnnnnnnnnnnnnnnnnnnnnnnnnnnnnnnnnnnnnnnnnnnnggggggnnnnnnnggggnngnnngggnnnnnnnnnnngggnnnnnntttnnnnnnnnnnnnnnnnnnnnnnnnngggcaactgcagcctgcaggtcnactctanaggnatcccccactggtgctcgggacccattcggccaatggcagatcaagcaacatgtttggctgaaccgattcacatgcaggaaaaatattatgtggggcggccaaccttaacggggggggaggctacccttggaaaaagcttcctgggaaaaaacccggggggggaaaaatttgggacccggggcctgaattttgcgtgggtaaccaacgggccctcccccttgaaaagggtataagagggctgtgaatttatggcaaatatttggtgcgaaaaaaagggtgggaagtcttcccggggggggcagagggggaacctttttgaaaagggggggggtttccggaaccccccgggttttttaaaaaagcttttttttgggcccccccccttaaaataatattgggggggggggcccaaaatttgtgtttgtgaggggcgcgtttaaaaaaaaaaaaccccccccccccccaagagggggggggagaaaaaaaaatttttggggggggggcccaaaaaaggggggccccccccgttttttgtgaaaaaaaaaaaatctaatccccccccccccnaaaaaagttttcccccccccccccctttggtagggaaaggttgtttttttttctttccccgggggggggggnatttctttaaatctcccaaacataggagggagagaccacactcnttaaaaaaacccccgccgggggcggggnagntttttttttttttttttttgggggggggggggaaaaaaaaaaaaaaaaaaactcccccccccnaaaacnngaaaaaaagnnggggggggggggggngcccccaccacananaaaaaanaaaaaaanccncgcgccccccgtgtttgnatataaaaacgtatgg

SEQ ID NO: 14646 - DNA, 665 bp, Xenorhabdus bovienii
  unsure (1)..(665): unsure at all n locations
  Genomic contig Name=Xb4151_4152.C105
ngcnnnnnnnnnnnnnnnnnnnnnnnnnnnnnnnnnnnnnnncttgtggaattgcaacaggcgncttgggaggattgaacgaggtcggggaataaaaatttatttttccaacagggaaagggcccgtgggccgggttaaatggggggcccccccgggggggcccctaaaaaaaaataccccaatttggcaaaagggaaagcaancaaagtccaacatgtttgggcttcatttggcggggcctcgccccttgggccgaaaagggggggacccgtgaattagaggcccgcccgggaagaaggcccttgtaaactgggttggttgttttagccccaaagggggtttttggggggccatggggggggaaaacccncctatagaaatacagtggggggaaaaaataaaaaaaagggggccgggtttttccccccgggggaggggggaaaaaaagtgggggggagggggtttttaaaaaaagggaaaaatgttttttgggggggtttttttngaaaaaggcccccaccttgggggggggggggccccccccccccccggtggtggtggaaaacccacttttttttttttttttcttaaaaaaaaaaaaaggtttttttttttgggggggggagaaaaaaagaagaanaaaggggtggctcttttcaaaaag

SEQ ID NO: 14647 - DNA, 1047 bp, Xenorhabdus bovienii
  unsure (1)..(1047): unsure at all n locations
  Genomic contig Name=Xb4151_4152.C106
nggaaaggaaancctanaagtttcggccctgctttttaaaaaaaagnnagggttactntggtttttttggagataaaggccccccccgaactngnggggtggnnnnngggggggaaaaaaagccccccccccccccccccctctttgggggacgacggggggaaaaaaaccccctcagaacagggggnnnnnnnccccccnncnnnnnnnnggggaganannagagccccaccgccccccccccccnaaaacaaaaaacaaaaaaaannnnnnnnncccccccgggccgggnccccccccccccccnnnnnnnnncccccccngnggngncgggnnccccccccgnggggggccccgcggggggccccccccccccnncccccccnnnncccccgggnccccccnggggggcccccccggccccccccggngngcccccccccggcccccgnggggnccccccccgggcccccccccccctggggccccnnnccccccccccccccccccggggggggggggggggcccccccnnnnnncctttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14648 - DNA, 1120 bp, Xenorhabdus bovienii
  unsure (1)..(1120): unsure at all n locations
  Genomic contig Name=Xb4151_4152.C107
gggtaacgggtggacgaagagcgtgggggnnnnggggcaagacttgacatgcctccgaggtggactctaggagnaccccctttataaatttggcaaattttgtgttatgtcttccgggggatatctttaaaaaaacccctcattttttttgtggagaaccacacacaccctcgggggggggggggggtgggttgctacaccctctcatggggattatattatatatgtgggggggtgtttattaaaaaaaaaaaaaaaagaggatcccggggggggggcagaaaacaaaaaaaaaaccccccctctttttttttattaaaaaaaaaaaagacacggggggggggggtgacctaacctcgggagggggagaaacaggcgcatttttaattaaaaaaaaaacaccacccccgcgcggcgggtgatgtgttgtgttataccgcaacaaaccatactaacggtgggcgccgtttttagtggggggcgttattgttggggagtgggggtgcgggagcaggggggggggggtgtgtggtgttaaaagagcccctcgggggaggcggggaggggagttgcggctagaacacaccaggcccctatttgccgtgttggggaaaaaaaatggtggtctggcacgcccctcgctgtttgttttattttataagggaagccagggggagcggctgatcttgcgtggggtggtggaaatagaaggggtagaggcttgtggcgcgcgcgggaggcgtgggggcgcctgggaaaagcggaagggtgggtggtggtatgacaagtccaggtcgcctatcgcacggcagagcccgacgtggctgtggtctgttcgccgctcgagggagaagggagagaggtggggtcggttttgtcgtctggtccttgtacttcctaccgagagaggggaataataaaggtacgattgtgtgccgtggggggcggttccgtagtatgatgcgcaagaagaacagagaatagttgcaacagtgcgtgtggcgtaaggtatggtgacgagtaaggtatgggtcgtgagaggatgggtgagggtctgcggcgctgtgtcgcgttgatttgtattacattcttattncttgaactcacttctatcatcctc

SEQ ID NO: 14649 - DNA, 1150 bp, Xenorhabdus bovienii
  unsure (1)..(1150): unsure at all n locations
  Genomic contig Name=Xb4151_4152.C108
ggagccgaccttccttggggaannngnnnnnnnnnnnnnnnntttnaaaanaatnngaagtnnnnntcccnnncnnnnnannancannnnntcaanaaanaanatnnnatannaaaccattnnaactannaatacatactnaatttaaacacnnacaattaananaaggcatacanaaactattataagctnnanataannccnaaaanaaaaaaaaaaaatttttttttctccccccggggggggggggggaaaaaaaaaaaancnnnncttttttttttttttttnnncccttttttttttttaaaaaaaaaaaaaagnggccccactnnnnnanttgattgnangcgnngnaagctnncncggttnnnaccagncccctntttnggnnnnnaantttattttanttttnnnnancgagngggagnatnttttntagccnccccggggngttttnnnanncacgcccccccnncccggtgttntggggggncccccccncnaaggnnnnnncgacctcnnnanngagccnnatttatatttnttnnccccctcttttttttntnannggggattgntanggggnnnggnnnnnnggnaaannggnannnngnnnannntnttaggtnntnanggnnnnnnnggcnccccccccatgatttatanttntttatagnnaaannaaaggggnnnnnnnttntttnnnccnccccncggggaggggnggaannnnnnnnnnntatngtgttaannggggnnnntggtttttttgtgggaaggacccccaccccaaaaacaaanncccnggannaaaagggaaaaaaattttataataatttttttttggnntgaaaagaggnnaacaacccccccccccccncccccctctttttttttttttaaaatgagggnnnnnaggggnnnnaaaagnggagaccaccccacggcccgctggtttttttnttgttnnnggggnnnnnngggggagggatttttttttttttttttnttagtgtgtgggggnggggaaaggngagggtttttttatttttttttttgtnttggggnngggggnaatattttattggtataaggggntngtggtttnttntttnnttttntttgttgtggggnnggggnnagagggttt

SEQ ID NO: 14650 - DNA, 827 bp, Xenorhabdus bovienii
  unsure (1)..(827): unsure at all n locations
  Genomic contig Name=Xb4151_4152.C109
nnnnnnnnnnnnnnnnnnnnnnnnnnnnnnnnnnnnnnnnnnnnnnnnnnnggcagtgtgcgcgcgctcgggtcccccggannnaanangtnacccactccggtgtgggggacccccgatggcgaaccctaggttgtgccnagagagacctccggagtgnaaaggtggggtnnnnccattatatnnnnnggggcccagccttgnnnnnnnnnnnnnnnnnnnnnnnnnnnnnntccgnaataccnttccggntggaacttctgggcagacttattactgataaggtttgggcactggggccgcccccattggtggggtttgtaaagttggaaaaccccgcccccccccgnagnaaccaaccaattatattttttaacgggggggccaaaaaattttggccttttgggtccaggggcttcccctaaacccggttttgaaaacattttactttttttccccccccccttcccctttttggggaaagtttaaaagaggtttttgtcccaaaaaaaaacccgggggggggtgggaacccccctttaatattttaaaaaaaaaatttttttttggccgcgagagccccccccccctccggggggacccaaaaaaaaaaatttttttctcccccccccttttttttttttttctcccccccccccgcgggggggggggtcgcccccccccccccccccaaaaaaaaaaataaattaattatnnnggggggggggttttctccctcctccnnnnaaaaaacccccccccccgttttttttttttcttctcccccngggcgggaaaaaggggtgtgttttttttttattattaat

SEQ ID NO: 14651 - DNA, 747 bp, Xenorhabdus bovienii
  unsure (1)..(747): unsure at all n locations
  Genomic contig Name=Xb4151_4152.C110
nnnnnnnnnnnnnnnnnnnnnnnnnnnnnnnnnnnnncccacccttgggnnaanagccccttttnnnnnngggnggnggnggnntttttnangggttgggggggggctntntcttgggganccgacaccctttangggtttttttaaaaannnnccttgtttaacgnaaaancccgactccgtnccccaactanaacgccantgggcgtggaaaaccaataaagggnccccttaagaaggggtctgtccaaacctctggtgggcccaaaccattgcccccaacccggaaaaaccccccaagggaaaaatnttttttccaaccaaaaaaagggttttttttttggcccatttttcccccaaaacccctaagagggccccccccccccacacaaaaaaaagggttttttccctctggaaaaaaaacccccccccccccaaaaaaaaaggggggggaaaagccccccaaaaaccccccccccccctattggaaaaacaaaaattttttcccccaaaaaaaaaaaaaattttaaaaaaaaaaatcttttttcccccccaaaaaaaatttttttttttaaaaaaaaagggtttttttttaaaaaaaaaaaaaaaaccccccccccccaaaaccccccccccccccccaactttaaaaaaaaaaaaccccccccccccnnncannnnntttatttttttttttttatnnnngngnnnccccccccccccccaaaaaannngggattttccccc

SEQ ID NO: 14652 - DNA, 950 bp, Xenorhabdus bovienii
  unsure (1)..(950): unsure at all n locations
  Genomic contig Name=Xb4151_4152.C111
tgatacgaattcagctcggaccctattcaacgattattcttctgaataatatggccatncggncctggnttnncnaanaaaaaanaannnccaaggnnnnnnaaaagagaggggggggnnntnnnnnnnnnnnnnnntattatttaannnnnnnaaaaaaaaaaccccccttttttttttnnnnnnnncccctttttttttttgggggggggggnaaaaaaaaaaattttttttccccaaaattnttnataaancccaagggccaaccgggtgggcccaaggnatatnaatataaaaacacctgggggggcccaaccccccaaatggggngccctctctttaaaaacacccccccgcggggggccaaaaanaatatgggggggggggggggnnnnanaaaaaaaaaaaaaaaaaaaaaaacgcggnaatatttgggggggttnaaaaattttaccccaaaatattttattttttttttaaaaaaaaaaaaacacccccccaataggtgggnggcgccacaaaaaaaacccacaaagcggggggaaaaccggcgggaaatatatttttaaaaaaaaaaaaaaaaaacgcgggcggcgnncccccccctctcttgtggggggggggggtgtttttttnccacaaaaaggggggaaaaaggggggccccccccaaaaaaaataatatntntttttttttttncccccccccccaaaaaaataataaaaaattctccccccctcttttttttttataaaaaaaaacccccccccctctttaaaaaaaaatatttttttttngaggggggggggggcgccccccccccccccaaaaaaaaaaaaaatattttttttttttttttaaaaaaaaaaaataaatttttttttttttttttttccccccccccctcttttttggggggggggagagaaaaaaaaaagggggtgggtttt

SEQ ID NO: 14653 - DNA, 1032 bp, Xenorhabdus bovienii
  unsure (1)..(1032): unsure at all n locations
  Genomic contig Name=Xb4151_4152.C112
cccttagcttgnctgacctgccagtttgcatccttangangtaccccaggtaattcccacattgttgccgctnaacactgtgaaactctcagcgggggctcaaaaatccattttccccctcttttataataggccccccaaaaattttctcaaaatctcgggggggatgggcctcccccggagaccctcggggggtggggccacattttttttaagggttaatattttttccagcgccaaaggggggggggaaaaaatttttttcccctcttgagggcggaggactctgttaaaaaccccaaaaattttttttaaagaggaaaaagagaggcgtttttcccccaaaaaataaatttttgttattcgcgccccccttatgggggagaaataatccccccccccgggggggggaaaatttttcccccccccccgtttttgtttttccccccaaaaaaggggggggtttattttttatatatattaaagggggaggaaattttttgtggggggagaaaaaaaaaaaaaaagaaatttttctgtggcgccaacaaaaaaaaaagggaaagagaaatcgtccccccccccccccaacaaaaaaaaaaaaaaagaggggggggggggcctttttttttaataaaacccctcncaccacacaaaaaaaaaggaagaaacaaaaaaaannnnntgaaaaggtggggggggccgcttccccccccccccccccccggcggagagaggaaaaaaaataaaaaaaatttttatttttttttgtgggagagggagaggggggtttgtttttttttttttttttaaaaaaattaaaaaaaaaaaccaccccccccccccttttttttttttttttttttttttataaaaaaaaaaaaaaaaaaaagagagggggggggggggaggggggtgggtgttttttttttttttaaaaaaaaaaaaataccccccnnnncccccccccccgccgcccggccggggggggnaaaaaataatgtagtggtagcgtacccccctattcatatt

SEQ ID NO: 14654 - DNA, 952 bp, Xenorhabdus bovienii
  unsure (1)..(952): unsure at all n locations
  Genomic contig Name=Xb4151_4152.C113
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaggaaggggggagggggnnnntnggagganannngaagnnagggnnnaaagaagnnnnaggngnngnnnaganngnnagnnaaggnagaggggnnanngagananannnngnnnagnnnnggggaagaggggnnnataggaaaaaagggggcannngaggaaagggggnnnggnnggnagggggnannaannnnanggnaggnaggggnnnnnnnnannnnnnnnaaaaaaannnnnnnngggggccaaaaacccttggtcccatgggccccctggncccaggggnttccgnnaacctttcttaaganaaaagggaaatcccccccccctggnaaaaaacccgggggntgggaaaaaaaaaaattttttaaatgggggtaaaatggggaaaccttaaaaaggggggccaaattcccaagtggggaaaattttaaaacccggttaaaatttttttcccccccctttttccccgggcggggggggggggtttttcccccccttgggggggggtttttttcccccccccccgggggggaccccccccgccggaaaaaaagggggggggggtttttnnaaaaaaaaaaaaaaaccccccccccccacaaaacaanggggggggggggggggttttttgggggggttttttcccccccccctttttttttttctccccgggggggggggtttttttttataaaaaaaaaaaaaaaaaaaaaacctcggtgtgggggggggggggnnnnnggnnnnnaaaaaaaaaaaggggggggggggcgcccccccccgggggggggggggggggggaaaaaaaaaaaaaaaaacaaaaaaaaaaaacggggggggggggggt

SEQ ID NO: 14655 - DNA, 1065 bp, Xenorhabdus bovienii
  unsure (1)..(1065): unsure at all n locations
  Genomic contig Name=Xb4151_4152.C114
ggggggggtcccgcctttttttttttaccgggggggggggnngnnnnccgcgcggcgccccaccctttaccaccaccctttttggggggggggggggnnggggcnnnnnnnnnnnnnnaaaataaaaaaaaaaaagagacacaagngcggngcgcccnnnnnnnttttggtgtgttgtttttttttggggggggggggggggggggggnnnnnnnnnnnnnnggggggggggngnnnntnntnnntntnnnnaaaaaaaaaaagagagggantncccccccccccgccgnntgggggggggggggggggnnnnnccnccgtgtggtccgagacccaaaaaaacacccctttcaccccaattttttttaacacccggcccccggggaaaaaaaaccaaagggccgcgggggttgaagaggtttggggccccccggccccaaaaaaaaacaagaactttttttgagagggggcccagggccaaaaaaaacaccctaaaaaagcccccgggggaaaaaacaaaaaccccccccgggggccgggggtaaaaaacaaaaaaaaaaacccccgggggccccccgggggggggaaaaaacaaccccccccccaaaaaaaggnaaaaaaggggggggggggggaaaaaaaaaaaaaaaggnggaaaccccccccgggggggggggggggaaaagaaaaaaatattggtcccccccccggggggggggaggaaaaaagaaaaaaaaaacccccgggggggggggagaagaaaaaagaaaaaacacacaccacaaccgggggggggggaagaaaaaaaaaaaaaaaaccacccgccggcggggggagaagaaaaaaaaaaaaaaaaannccccccaaaaaaaaaaaaaaaaaacaccgggggggggggcgggaaaaaaaaaaaaaaaaaagaggggggaaaagaaaaaaaaaaaaaaaaaaaacccccacacccctttntaaaaaacacaaccaccaccaccccccggccggagaggggggggggggagaaaaaaaaaaaattaaaaagggggggggggcgccgcacaccaaaac

SEQ ID NO: 14656 - DNA, 772 bp, Xenorhabdus bovienii
  unsure (1)..(772): unsure at all n locations
  Genomic contig Name=Xb4151_4152.C115
cttaggaaaacacttaccttatggctacataacataagaagctataactatgtccaacttttgcacctgatttgatgatgtggcttggtaaaacatccggggcactttgggaacggatgcccggccctaaaaaatttcccccctgaaaagccaaaaaaacccccggtttaaagaaaattttttttggggggtatcaaagggaaaaaccccatatttaaaaaaaaaaatcttttaaaaaaaaagggggggggcgtttttaataaaaaaaaaaacaccccccaaaagggcggggggggggttttttttatcaaaaaaaacaaaggggggggggtggtgggcgcccccccccccccccccattttttttttggggcaaccaccacaaaaaaaaaaaaatttgtttttttttttgggggttttccctcttttaaaaaaaaaaacccccccggccgccaaaaaaaaaatttttttataaaaaaaaaaaaaaaaggggagaaaaaaaaaaaaaaaaaataaaaaaannnaaangncnccccccccccctacaaaaaaaaaaaaaaaaaaaaaaanccccccccccccccccccgggtggggggggcgccccccccccaaaaaaaaaaaaaaaaaaaaaaaannnaggatgttttttttttttttttcttctccgggcgaaaaaaaaaaaaagaaaaaaaaatgttgtggcgccccccccccccccccgccgcggaagaggaagagagagattagttttttatatatataaacacacca

SEQ ID NO: 14657 - DNA, 880 bp, Xenorhabdus bovienii
  unsure (1)..(880): unsure at all n locations
  Genomic contig Name=Xb4151_4152.C116
gacataagtgcagacgccaggngtacgctanagatacccccattaatatttttttaatactgtgtattagaaaatgtgtggggcgagggtgtgcttaaatacacaaagacgcattataggcggggtntntggttttntatatntttnatctttnaaaaaacaaggtttttttgggttcccaattggaaaattttttgggttttatgggggggattttaatttttggggaaaaattttcccgagaatttggggggggttaaaaaaattttttggttaaaaacccctttggccaaaaaaacacccaaactttnttttgggggttttaaaaaaacctttgtgttgtcctaaaaaaaccccttttttgtgggggggggttaacacttaaaaaaatatttttgtgtgtgtattattaacaaaaaaaaaaaaaaaagggggtgtttttttttaaaaacaaaaccccccccccctctttttttttggggggggggggggggccggtggttnaaaaaaaaaattttttttttttttttttatctcccccctggtttntaaaaagaaggggggggggggggaaaggaggtggggggggtgtgttcttttttttaaaaaaaaatattttttttttttgttgggtgnntgggggggggggggtttttttttttttttatttcccaaaaaaaaaaattgtttttgtgggggggggggggggtgttggtgggggggggggtgataaaaaagaaaaagaaaaaaaaatttttttttttttttttttgtttttgggggtgggngggggggggggggggtgtggtgntaggttatttttgttgggtgttggggtgtagaaaaaaaaagagatttattttcctctcccccccccccc

SEQ ID NO: 14658 - DNA, 1257 bp, Xenorhabdus bovienii
  unsure (1)..(1257): unsure at all n locations
  Genomic contig Name=Xb4151_4152.C117
nnnnnnnnnnnnnnnnnnnnnnnnnnnnnnnnnnnnnnnnnnnnnnnnnnnnnnnnnnnnnnnnnnnnnnnnnnnnnnnnnnnnnnccttttctttcngggnggggnggagggncnngnnncnncnnnnnnnnnnnncccncgggcgagaagggnnnnnnnnnnnnnnnnnnnnnnnnnnnnnnnnnnnnnnnnnnnngtttttncttttttttttnnnnnnnnnnnnnnnnnnaaggggccccccccttttttttttaaattcctttagaaacccctttaaaaanncccctttcgggnnnccccgaaagntttnnnccgnnnnccacttttttttnggaaaagggaaaaagttcttaaaacccccccccccccgccccgnncccccggggngntttttataaattataagggggggnntttaaanaaaaaaccccaacccccaaaagggggaaaaaannaanaaaaaattncccctttttttggggggggcccttttggggntttggggggntttattgnaaaaaataatgcccctttgggggccccgccccatatatggggngggcccctttttaaaaaaaaatttttttttttttaaacccacccacccccccccggggtttattattttcccaaacaccccacaattgtggggggggcccccccgggggatatattacccaatatttttttccccccccatattttttcccccaattttgtgcacccccccccaaaaaaaaaaccccccccaaaaaaaaatattttttttttttttttcacacccccccccccttttttttttttgttttctcccccccccctttttttttttaaaaaaaaaaaagttttttttttttttgnggggtttttttttaaaaaaaaaaaaaaccccccccccccccccctttttnttttgttgaagaaaacaccaaaaatatttctccctctccctcttccaaaaaaaaaaaacaccacccctctctccttctccnnnaaaaaaaaaaaaaaaaagggaggggaggggccgccccccctctttttttttttattttnnannaaaaaaaaccccctccacccccctctttttttaaaaaaaaaaccctcccctccctgtggttttttccgcctccccccccccacgcccngttgtttttttttttttttcccccccctccccccaccccaaaaaaaaaaaaattatttctctttcttttaacccacacaccccccccccncnnttttcttttttttt

SEQ ID NO: 14659 - DNA, 1366 bp, Xenorhabdus bovienii
  unsure (1)..(1366): unsure at all n locations
  Genomic contig Name=Xb4151_4152.C118
ncccccaannnnnnnnnnnnnnnnnnnnnnnnnnnnnnnnnnnnnnnnnnaaaactnnnacgnntggttnnnnnnnnnnnnngnnngggaaaaagaganggggggggnnnnnnnnnnnnnnntgggggggggggggnnnnggggcngnnnnnnnnngnnntntgggaaagggtaaacgtgtttaaaaaaaggaaaaaaaaaacccaaaatcctcggtaatttttttggggggggnnnnnnnnggggnaaaaaaaaaaaaaaaccggcgcccccccctttttttttttaaccccccccccaaaccggggaagnaaaaaaacccccaaaccccccccgccccccttttcccccgtggggccccctttaaccacccccgngggccgggtttaaaaaaaaagaaaaaaacccccccccccccccccaaaaagnnggggggggaaaaaaaaaacccaaaaaaaaacaatttttaaaaaaacaaaaaaaaaaaaaagggggggggggcaagaaaaaaaaaaaaaaaaacccacccccccccaccaaaaaaaaaaaaaaaaaaaaaaaaaannnnnncccgggggggagggggggggggggggggggaaagagaaaagaaaaaaaaaaaaatnatcctcccccaccacaaacaaaaacaaaaaaaaaaagaagaaggtgttttcttccccccccccccccccccccccccctctccctctttggggggggggggagagaaaaaaaaaaaaaaaaaaaaaannnaaaattcaaaaaaaaccccnnnngnggcgcccccccgcgccgcggggcgggggggagnccnctcccccccccccccccccccccccccccccacncnaaaaaaggggngggnggngaaaaaaaaaaaaaaaaaaaaacanannnannnnnnnnnnnnntngnctcaatacctntttctcnnncccccccccccccccccccccccccccccgccccgcccgagngggngaaaaggnngggggnnnnncccccccncccacacaccccaccacaccccaacccnnncngcgtttttgggggggggggggggggggngggggggggggaggaagaaaaaggngagaaaaaaaaaaaanaaaaacaaaaacccccccccccccngcccccccccccccccccggcgctgccgggngntgnggnncncncccntnntggnnnaaaaaaaaaaaaaaaaaaaaanagaaaaaanaanaananccccccccccccccgacaaccaccacaacaaaaaaaaaaanagagataattaaaaaaaaangaaangaannnnnnnnnnacacancaaaacggggcgaagacccccaggacaacaacacaacacaaaacaaac

SEQ ID NO: 14660 - DNA, 1069 bp, Xenorhabdus bovienii
  unsure (1)..(1069): unsure at all n locations
  Genomic contig Name=Xb4151_4152.C119
nnnnnnnnnnnnnnnnnnnnnnnnnnnnnnnnnnnnnnnnnnnnnnnnnggggccccaaactttncccggggcccctncgagggnccccccctctaanaaaaataccccgccgggatgacctcctccagggggggctanccnnnnnnccnnncttcctccanaaagaannnaaaagccccttttaatttagnacttannccttngnncgagntncgnacttcttgangaanctaancccccnttagannaaanaacntnntattnacncaaatgnatnncannncaaaaagnncncctttgtgtccttcttnggnaaaaaaacctgnctgnttnctttgncttnncancnccctgnaattttcagccattgaatttaccaaacccccgttgggggcaattatttgcctttttttttgttncaagtttcaggtgaaacttttttcatccagaaatataagcttataaaaccccattttaaagaatgaaatcaattttattaaaaaccttgtttatacttggcataaccggggtttttcccccaatccaagggaaaaaccccttttcccttaaaaatngccataaaccccaaacccccctttgcccctttttcccccctcttttgaattttaaaaaaaagggaaaacccccttttttgggggtttcccttttttaaaaaaaccccccatttttggggtttaaaaaaaataatgcccccccccccccaaaaaaaaaaataaattttctcccccaaaaaaagggggggaaaaaaaaaattcccccccttttttttttttagggaaattttcctccctcccccccaaattttttttgggggtttttttttttttttttttaaaaaaaaaaaacctccccccctttttttaaaaaaaaaaaattttttttttaaccacccacaaaaaaaaccccccctatttatctttttttttctttcnaannctctttttttttttaaatttnngaanaagggaaaaaaacccccccaaaaacncacccccccccccccgnttttttttttttttttttttttccccccaacaaaagaaacca

SEQ ID NO: 14661 - DNA, 1224 bp, Xenorhabdus bovienii
  unsure (1)..(1224): unsure at all n locations
  Genomic contig Name=Xb4151_4152.C120
cacaaaaagcggggtgccccgccccangggcgcgnnnnnccgggccccccgcgggcccaccccccccaaaaccccaccaggggaaaaccagcccccccccccacaccccccgcagggccccccccccccccgggggaccccggaccaccaggcaaacagactcatcttttttaaaaaaaaaaaaaaaaggatcctccaaaagacccgggggnccaagaccacatcgccccccaaaatttttccggaacaaccctcaaaaaaaaaaaaaaaaacccccccccccaaaaaagggggaaaaaaaaaaaaaaataattttttttaaaaaggggccagagggggncccccccaaaatataaaaaaaaaaaaaggggcgcccccccccccaaccccccccaaaaaaaacaacacacccccccccccctcaaaaaaaaaaaaaaccacncccctccccccgcgggggaattaccacataaaaaaacaaccccccccgcccaaaaaaaaaaaaatttccccccccccaaaaaaaaaaaaaaaaaaaaaacaaccccgcccccgccggggcacaaagaaaaaaaaaaaaaaaaaaacccctcgcccccaccccccccccccaccctcctcacaatccgcgcggnggggggggggggggaaccacaaaaaacaacacccaccaacccccccctcatgttcccacaaataaaaaccccccccccccccaaccaccaacgcccacaaccacggccacccccccgccacacaaaacccaccaccccccccctccgngtaacactaaaaaaaacaaaaaaaaaaaccacccgcacaaaatgccccccccaccgctccaacgcaccacacacacaaaacaacaaacagacacgcagacgacgggcgaaacgaccacggcaccacgccacaacccacaccgaaaacacaaagcaaaaagaaataaaaaaaagaccacaccccaaacaaaacccccacaaccaccaacacccaaataaaattaccccccccaccaacacaacaaatacaaaacaacaacaccaccccaccctcacaaacaacaccaccacaataaccccacaccaccccccgcgcccccccctcaactcatcccccaacaacccaccaaaacaccccacgtcccaacaacacgaggcatacaaatcaacaacacaccacacacccgcaaaaaacccacaccaccccccccaccccaccccc

SEQ ID NO: 14662 - DNA, 1024 bp, Xenorhabdus bovienii
  unsure (1)..(1024): unsure at all n locations
  Genomic contig Name=Xb4151_4152.C121
ggggaccttttcgaatnaagtacngcaggcacttgcggctannagnataacacgccnnnnnnncatancacaaagncanntctcttnaccacccccacacccacccggggtttgggggggggtttctttcctttttacaaaaaaaaaaacaacaaaacccccccccttttttatattccctttttatttcccccccggaaaaaccccaaaaannnnnnnnnnnananccccattgggggggtttttcctccacccccaaanaaaanaaaaaaaaaaaaaagggggggggtggtgggggccgcccaaaacaacacccccccccnttttctttttttttncccatttggcggggggggcctcctccctttctccccccccccccccgcnnnnnnaaaannnnnnnanaaaaaaaaaaaccaccacaccccccccggggggggggggggggggggggggaagaacatataacacccggggggtttttaaaaaaaaaggggaggaaaatattttcgcggggggggggagatttttttttggggggggggggggcccccccccccccccccccttctttttttagtttntttttagtggaaaaaaaaaaaaaaggggggggggtggttttttatgagggggggccgcgggccgcgccctccttttatattattttttnttttnnnntnnnggggttgtaagagagaaaaaaaaaacacagaggagagnngaaataaaggagggaggganngacgnncttttttgtggtggggggggtgcttcttccctttcttcttcttatataacaacacgcccgagagtggggcgtggtatatccctgcttttttattactctttnnnnnnnnccgcggcctgtggggcgtggtnnnnnnnnnnnttnnnnnnnnnnnggatnttgtgttttggttgtcgcccctcgccgggggggcggggcgnnnnngccnnnnnncgtggggggggtgtgggggtgggggcgggctccgcgccacacaaaaaacaaaacaacaca

SEQ ID NO: 14663 - DNA, 1025 bp, Xenorhabdus bovienii
  unsure (1)..(1025): unsure at all n locations
  Genomic contig Name=Xb4151_4152.C122
cgatacgattcgagctcggtacccttctctcccttctattgtttaaaatgaatacggaatatctcctttattaannaattgggggggggggggnnnnnnnnnnttggggggnnnnnnnnnggggggggggggggggaaaaaannnttttttttntttttttttttaaaaaaaaatttttttttttgtgggggggggggggaaaaaaaaaaaaaaaaaatttttttttttttnntttttttttttaaaaaaaaaaaaaaaaaatttttttttttnnntntttttttnnntttaatatttgaccgngcacattntacattttttacctttaannaaacaacccaggggaaattttttcccatttaaaatcccaacccaaaagaggagggggaattccaatacttccaattttggggaaaaaggaccccatttaagaatgtgggattaggcccccgggtcccatttttttaaaattaaaataaggcaattgccaanaccctcctttaattttttttattccggttcaccgggggaaaaccctttaatttttttttaattccccctgggaaacaaaaggggggggtgtatttccccaccgcaccctttggggaatttttttntttatttttttctccccccggggaaagannttttttttttattttatcaccccgctggggaaagacgggggagaaacccctccccgttgtttttttttcgcccgcccccctataaggggggggaaaaaaaaaaattttttcctctcccccccaaaggggggcgcccccccttttttttatttataggggggcgcgccctccttttttataatggcgccgccccccaccccccncannnnnataattnttnctcccccctctnnnnnnnttccntcnnnctntnnnntcacccccccaccttcatccttccagcaattgcccnnatcactcccccccccctnccttcgcccctcccctctcccctccccattcctcactcacactcataatattactctccacacctc

SEQ ID NO: 14664 - DNA, 1117 bp, Xenorhabdus bovienii
  unsure (1)..(1117): unsure at all n locations
  Genomic contig Name=Xb4151_4152.C123
atcggctgtaaanntcagcggaggtgggggtnnnngggaaaagcccgttttttgttttttttttttggnngtttttttgttggggctttggnaaattttttgggggggggggggggggggggggccccggnaaggggaaaaaancttttttttttgttgctttgggtgggaaaggtgnnnnaaccccaaaaaaaacccccggnaaaaaaaaaaattttttttnnnnttttgggggggggggggccccggggggtttttttttgtgaacccccccccccccaaaaaaggggggggggtgtttttttttttttgtttttaaaccccttttaaannnnaagggggttgggggggggggggggccnccccccgngggggttttttttggggaaaaaaatccccctgtgttttttcccccccccccgtggggggggggggggcggtttttttgggggtttttttttgggagaggggtggtgggggtgccccccccccccccggcgggggggggggccccccccccccccttttttttttgtgtgggtgggggtgtggttggttgtgaaaacggcgacacccccccccccccccccccccttgttttgttttttttttgttgtgtggggggggggggggnntcttcaaaaaattttgtnttatagagtaggaactttttgttttctttttttcttttatcactatattatgttgtttttttgttgttatttgtngggggnnngncgctgtttttgttgtgttgggtggtggggggtggggttgttgttgtttgtttgttttggngttgggtnntctgggtggccccttccttcccncacgatggtnttaagagataaagaaaggagatttttctttttggtttttttgttgttttttttttctttagtgttggtcgcgacggggtggcgcgttgtgtggtgttcttttctttcttttttcnntggtgtttggttgttgcccgggtggtttgtggtggttgttgtttggtcgcggtttttgtgctgcggtgggggaggtttgtgttgggntccggttgtgttgtgtttttntttttgttggtgcggctggttgcctgttgtctctatacccccaaccaaaacct

SEQ ID NO: 14665 - DNA, 974 bp, Xenorhabdus bovienii
  unsure (1)..(974): unsure at all n locations
  Genomic contig Name=Xb4151_4152.C124
ctgaactccaaattagacgcctggcccccccagctgacagcgtatacaagcacagacagaccaagcaccgaactgcccaccgaagagtacaccataaaggggggtacacgccacgaactcacgacgctaactagagacgcagaccaaagtcagctcagcgcaacatgccagcgcgagcacgcccccgacacaggcgaggcacctaagaagagaacgcaccgaagcccgcggcaacaccccgcagggcacgaaggtgccggacaggctagcgaactcgacgcccgcgccaggacaaccaaaggggggggcgcccaccaccacacagccgtgcgtgggggggggggggggctttcctacgcgancccccatatcccaaaccacgataacacacacaaanngggcttttttttttttgggggggagaaaaaaaaacctccccgtancttttagagcacacccnnnnaaaaataaaaaanccgcggggcaaccccnccggggtttttcacgccccctaaagggccctctngggnggaaggcccccaaaaaatttttggggggncacccactgggtttggccccgaaannccccaaacacgcctataaaaccccccccggggcccccaaccccaaaagggggccccccccagaggggcccccaaaatatcccaagaccacacaccccgtggggnccccgcgcggggtttcccccccggggttccccccaaaataccgcctttnntgggggggggccccaatatacccaaaaaaccctggggagaccacccaaaaaccccacaaagattttataaaaaaaaggaaaaaccccgcgncggggccccccccggttccccccccggggggggngggggttttttttttcccccccacaaagaccccccccgcgggaagaaaagaggggggntaaataatggggggcgccacccccctccgtggggccccccgaaaaaacccca

SEQ ID NO: 14666 - DNA, 712 bp, Xenorhabdus bovienii
  unsure (1)..(712): unsure at all n locations
  Genomic contig Name=Xb4151_4152.C125
nnnnnnnnnnnnnnnnnnnnnnnnnnnnnnnnnnnnnnncattgtgatttaggggaccagaggattttttagggngnaggaaaggggtgggggggnggnnnnnnnnnncccccggtttttnnatttttttaccgggnaaaaattttttttcggaggagaaccttttgggggggttaacccccccccctttttttttttggggggtttattctcttcaataaaaaaggggttttttaaaaatttttaaaaattacatttttcccctgggggccggngnnnnttaaatttttttttttgggaaaacccggtccccggggggttttattttaaaaactgggttaaaaaaaaagaaatnttattttttttctcgggggggaaaaaatttttttccaaaaaaaaattttccctttttaaaaaaaggtgccctttttggggaaaattatatggggggggccccccccacaaaaatttttttttcctttgtggaaaaaattttttttccaaaaaagtggggggggtcaaattttttttgtggggggggaattttttttttttttccccccccggggggcccccccccccccttttttttttttttgtttggccccctcctggggggggggggtttttttttttttttaaaaaaaaagaggggaggggggnnnancncccccccccccccccccttntttgtttttgttttttaaaaaac

SEQ ID NO: 14667 - DNA, 1149 bp, Xenorhabdus bovienii
  unsure (1)..(1149): unsure at all n locations
  Genomic contig Name=Xb4151_4152.C126
nnnaaaaaaaaaagnngnggggggnannnnnnaagggggggcacnnnccccagaaggaagcaggcagcgagggggcccctgaggaggtatccacccagacgccggagggagaagaagaaacacacacaagagagagagagcggagagggaagggacggcgagcaagagaaagcacggagagagagagacaggcaggagagggaggcagaaaagggagccagagataggccgggcggcatagccagaccacgaggaggaaagaggaaggangaggccaagccacacaagagcagagcagagcagcaaacacccagacaagcacgaggcaaacaacaacacaagacaaagaaagagcacccgacgcgccctnccctcacaggaaggggacaagccaacaagaacacgcagaagaaacaaaataagcgggaagaacaaaaagaagaaacggcagggtgaaaccagagaagcacacaaggaaagagaaaaggaagaaaatcaacgccacaaaataatttataagggggaaggggagagagggagngtaaaaatttccctcttctcttttcatnncccccccaaaggnnggnnnaaagannnnngggggnnnnnnnnnnnnnnnnnnnnnnnnnnnnnnnnnnnnnnnnnnnnnnnnnnggttttttttttttttttttctccccccccccccccccccaaaaaaaaaaaaaaaaaaaaaggagagggggggggggggggnnnnnnngnnnnnnnnnnnnnnnnnnnnnnnannagaaaagaaaaagaaaaggggaaaaaaaagaaaaaagggaaaagagagaaggaaanannagaagagaaagagaaagaaaagaaggaagaaaaggagnagagaaagagagagaaaaaagaaaaaaaaaggagaggaggaaaagaaaaaagaaagaagaaaagaaaaaaaagaaaagaagagggagnaggaaaatattttttttttttttttttttattgtttttgaaggnngngggggagncccccgcccccccccccccccccccccccgnggggganaaanaannaataataaaagaaaanatantaacacagccntnngngggcgggcggggccaaggnggcgcccacaagtaaaccacacacacagaataagaaana

SEQ ID NO: 14668 - DNA, 1164 bp, Xenorhabdus bovienii
  unsure (1)..(1164): unsure at all n locations
  Genomic contig Name=Xb4151_4152.C127
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttccaaatatcnagggtcnnnnacncnnttntttattntatccnttatccggggancnttgggannntnantgnannntnnnntggttnttnnnnnnnnnnnnnccgggnaattacgggantntcggngggcntnggggntnaccncncaggcncaggggggncnaatcnanacncnncaggnttggggatnaggggggggggggnncaanaaanaagggggtgggggcccncgggncccaatttccggggnttttggggggaaacggggggggcttttttcccctttttgggggggggacttttggggggggggggggaangggggggggggttccgggggggccggggggggatttattggggggaatggggggccagggggagggggggggtttcccggggggggcctggggggcccggggggggtaaaaaaaaatttttcccctttccttggggcaaattggggcccccgggggagggggggggggtaagggtttttcattttttttccggggggggggggggggggcnccccgggggggtttntgggggggtcccgcggggggggggggccccccccctttcgggggggggggaaaagggggggttttttggggggtcggggggggggggtaaaaaaaaaaaggggggggggggggggaccccacccctttttttttggggggggacgggggggggggggggttttttaaaacccccgggggggggggggggggggggggttttcccccggggggggggntttggggggggggggggggggggtttgggggggggggccccccncccccttattttttattttttttaaaaaaaaaaatttttttttttttttctttgggggggggggagggggnnttttctttctctcccaacaaaggggggggggggggggggggggggggtaaaaaaaacncccncnncccccacaagaaccacaaaatggggggggggggggtttgggggggggggggaaaatatggttttttttttggggggggggggggggg

SEQ ID NO: 14669 - DNA, 917 bp, Xenorhabdus bovienii
  unsure (1)..(917): unsure at all n locations
  Genomic contig Name=Xb4151_4152.C128
tgnnnnnnnnnnnnnnnnnnnnnnnnnnnnattcttacatataattttacagcataataggatgacgcccgtcgatattttactagcaatttcatatcatctgctccaaaattttcccctatgaacttgatactgatgaatataggttcagatgatgatcggtctatcaaactcgcattagtatgacacacaggaatgagaaaacactcttcgctttcttggagagatcgattccctaaactctaggtgactatgctcatcacatcgcgaatagcaatgcgattatgaaactatcttgcccatactcctaaagtgcgaaatcaattgtgataaatccccatatcccacgaaaagagactgaatatctgtaaggcggcgtaattcctctaggccaaaagagacgtatgcccacagttatcatcactacccatctaattatgactacccaattgaatttacttgtaagcgaaccgccaggcaccggccaaaggggaaattttgttgccccctcccaaaataatgggncgcccacccccggggggcccccccgccaaaatttttttagaccacccaacaaataaggggcccccctttttttggggggggggaacccctacaaaaaaaaaattttttttctctcaaaaaaaaaaaaaaccccttttgccgcgccccccttttttttttttggggngggaaaaaaaaaacacccccccgccccggccaggagaaaaaacaaacaaacaaaacaggggggggggggggggtggggtgntccccccccacaaagaaggggcgttgtttaaaaaaacacaacccccccccccccgaagagaagaagaaaaatcttcttctttttctttctttgganaaaataattttttttttttttgtggggtggggagagaaaaaaaaaacaa

SEQ ID NO: 14670 - DNA, 980 bp, Xenorhabdus bovienii
  unsure (1)..(980): unsure at all n locations
  Genomic contig Name=Xb4151_4152.C129
aaacttggtatgaccnaaataataaaccccccggaacctttttgtttacccnnccactnnggntnncagacttggnccnnnnccccttnnnnnnnnnaaaaaannaaaanattataaataatttntnnnntttnnnnngggggggnnggggggggggttttttttttgtgggggggggggggggnnnnnnnnnnnnnntgnnnnaaaaaaaaaaaaaaggggggaaaagaaaaanaatntntnttttttttatttattaaaaaaaaaaaannncctccctccttcttttttttgggggggggggggggggnnnnnnntttttttccccaccaacccaaaccccctatttgggnnaaaggaaaggnaaaacttggggccccagtttnaaaccttatatgggccccttttgggaatttttnncccccccccaaaaccttgggcccgggggaaaaggttggcccccgcggttttacccaaccccctttggtccccctggggggggataatttcctggattgaaaaagtggccttttgccccctgggaaaataagacggggcccattccccccccttggttttcccccctctttgaaaaccgggggtcttctttttggggccgcgggataccctcccggggggccctggttcccccttttcccccaccacttttgggataaaaaatgggatattggggttctaaaaattgccgcaccccctcccgagaaaaaaaacaaaagggggccccctctttggagaaaaaaaacactctttggtggcacccctcaccaacaaaaaaaaaatttttgtcccgccttttttttataaaaaaaaagtgccccccccctccaccacaaaatagatattgtntttttttatactccccgcggttatgtatattttaggcgggcggccgcccccgcgccnnaagaaaaaaaaaaaattctccccccccccttntggaagnaatatttattctccca

SEQ ID NO: 14671 - DNA, 880 bp, Xenorhabdus bovienii
  Genomic contig Name=Xb4151_4152.C130
ctgttcgaattcgactgtaccctgaggattgtttgatgtgatttacatgagtgacgtagaattgatctctggacacgtatcgatcatctcattttttagcccccttacccttgcttttcccgtggggaaggccccttgttttaaaaaggggttggggggaaaaataaagctgcccacccccccctgggggatttttttagagggggggggccccaaaatatggggggggggggggtttgataaaaaaaaactttttggggggggggggttttttttttttggggggggggggaaaaaaaacccctccttttgggggggggggggggatttttttccccccccgggggggggggtgttttttttccctccaaaaaaagaagggggggggggttgggttcttcccaccacaaccccttctcttaggtagagtatagagttggaggaaatagtttttgttttttatatataaaataaaaggagcgggcgcctcgcttttttttttttttttttctacaatcttcacacaccacatcaaaaaataattttttttttttttttttttaaacatattacaggagggggagcgggttggtgtgtcttttcttttgcttcttcttttcttcccccctccgccctgcttattgaatctacgcatttagatcttaagagattgtatgtgggtggggtgggggcggtacggttgcaagtattgtcctgctctgtctcctcgttattcttttttattctctggcgctggttgtggggctgtgtagtcgtgtgtctgtgctggtggagcaatggaaggttattctgttatgaaagggatgatcggttcttgtgtgctttccgatcttcatcgtcgtctcggatggcaactatg

SEQ ID NO: 14672 - DNA, 1133 bp, Xenorhabdus bovienii
  unsure (1)..(1133): unsure at all n locations
  Genomic contig Name=Xb4151_4152.C131
gaggtaancntgatagtagncgnnaacagctgaacggnggncgcttaaggcgcttggggcggagttgtnttatacggttttnacaaacggcctcncnncanggggannnnnnnnnnnnnnnnnnnnnnnnnnnnnnnnnnnnnnnnnaaannnannacacacaaccacgcgggggaggngnnncnncnccccncncnctctcctctctcttctnnnnnnnnnnaaanaaaataatattattaaataannaaattttttttatattatataataaaannccnccccccccccccccncacaacaaaaaaaaatatatatattaatataaaatattntnnttttttntntnntttntttnttttttttttttttnnnnntttttttttataatatatatattatattttttttnnanaaaaaaacaaaaaaacacctctctcttttttttnnttttttntntntntgggggggggggggggggggggnnnnnnnnnnnnnnnnnnnnnnaaanaaaaaaaaaattatttttttttttttnnnnnnaaaaaaaaaaaaaaaaaacccccccccccccaagagaaaaaaanaaaaaaaccncnnnncccccccccccccccccccccccncnnnncccggggnnccccnnccccncttttttttttttttttttttttttttnngggagcgcgcgccccccccccccccccccccctcttttntttntggggggggggggggggggggggggggttntttttnngnggggggggggggggggggggggataataataaataataaaggggggggggggggggggggggggggnccnccccnccccccccccccccccggggcgggggggggggggggggggngggggggnngggngggggggngggnngnnnnnnnggnntttngggttgggggggggggggggggngnnggggggtgtnnnnttnttttnttttttntttttttnntctnttnnnnnnaaaaaaaaaaaaaaaaaaataaatatnnttnttttntttttnnnntntnnnnnnnttntntntntnntnnnnntnnnnnnnnnggggggggggggggggggnggggggggnnngntggnntttggggggttattattg

SEQ ID NO: 14673 - DNA, 615 bp, Xenorhabdus bovienii
  unsure (1)..(615): unsure at all n locations
  Genomic contig Name=Xb4151_4152.C132
acatcaatcagctcggaccggagatttgtctgggcatttaacgaggtttttnaacggccaaatatttnnaagggnncccttttntaaaacccccnccccccccccccgggggggccccccaaaaaaaaatttattttntnncccccccccaagaaggggggnnnnaaaaaaaggagattaatggggaatgggggcccccgggggttnaaccatatgggccccttttttaaaaaaatttttnaaacccaaaaatttnattttaaacccttgggggggggggaaaatagggtgtttttttaagggataataattttttttggtgggcctttcccaaatacctttggggggaacacagggggggccccatttggggggggttaaaatttttccgggaggagagtttttttcccggcggttttttttaaaggggccccccccaaaagggggaaaaaaaggggccccccccccaaaaaaaaaacccccccgggggaaaaaaaaaacccccctggggggggggatatattttttttgggggggggccctctttttttttttnntnggggggggccctttttgggggggnttatttgggggaaaaaaaaaccccgggggggg

SEQ ID NO: 14674 - DNA, 879 bp, Xenorhabdus bovienii
  unsure (1)..(879): unsure at all n locations
  Genomic contig Name=Xb4151_4152.C133
ntttccttaaaaatnnnnttttnaaaaaannnncaacacnnnnngaaaaaaaaannnnnccccccncggggggaaaaaaaaccccttccnnnngcgcgccgaggggtttttttnnnnnnnnaaaaaaaaccccccnccccccggcgggtttttttgagggggggggggttttttttttttttggggggggnnngaggaaaaaggaggnnnnnnnccaaaaaacctttggggggggtttttttggggggtttttttttnncnnaaaaaaaaaaaagggcccgntnccgggttggttttggnaacactctgggaataaaaaaacccgccaaaaaaaaaaaattcccgccttttccttgcctttggaaaaccccccccgttccgccaaaagngccaaaaaccccaaaaaatcccggtttttgcccccaaaaaaaaaaaaaccgtgaaaaaacttgggccccttgaaaaaaaaaaaaaaaagcccccctttttttaaaaacaaaacacccgaaaaaaaaaaaaaattttttaaaaaaaaaaaaaaaaaaaaaaccccctgggggggggccccaaaaaaaaaaaacccttccccctctataaaaaaaaaaaagcccccccccgttttttttcttcctccccccccccaaaaaaaaaaaaaagaggggggggaaaaaaaaaaacaacccccccccgttgaaaaagagtttttaaaaaaaaaaaactggttcaccacccccccgaaaaaaaaaaaaaaaaaaaaaaaaaaaaggtgggggaaaaaaaaaaaaaaaaaaaaaaccccccccccccccccccctcccccccaaaaaaaaaaaaaaaacctcttttttttnnnnnnnnnnnnnnnnnnnnnnnnnnnnn

SEQ ID NO: 14675 - DNA, 832 bp, Xenorhabdus bovienii
  unsure (1)..(832): unsure at all n locations
  Genomic contig Name=Xb4151_4152.C134
nnnggggnnnaaaaaatttttctgnagtccccnaacctaanacaattncaaggaagantataccctgtccngaataaacagaactgataaaatctcagtaaaagcaatgagatgtaacnngagngcagtctaaataggagattggatcagcaggaggggaatatggagttaccgtattgattattgnaaagacngcaaacaccntttttttttttcgcccccngcgcgtaccatttttgtaagnccacnnnnaaattaaagcccgggaanctttncgtgtttnnncccncccccnaagnaannnaaaaaaaaaataaaaaactctnnnccntataannccgagaggnnnccttaatttggggggnnnaaaacggnaaaacatacatttncccggggggggggnnnaaaataaaaccaaaatatttggggcctttgggggagagttttttggggggnttntttttttttaaaatcctcttnnaacccncgccgggccccgcgggaggggaggaccnancctaatcncntttnntaactaatcccnnccnnagaggagngnnaaaaaattcttatttaaaaaaaaaaaaaagagagaagttttgggggttttggggggttttttnntttttttggggggggggtttttgggggccnnccaaaacaacaggcgggagaggaatggaantgtttnntttnnnnttaaacaaacgggcgggaatattaaaananataataatatttttttataannnnnnattttaacccccctcccccccttttgggggggggggggaatataaatttttttggggggggaaaaaaataaggaggg

SEQ ID NO: 14676 - DNA, 891 bp, Xenorhabdus bovienii
  unsure (1)..(891): unsure at all n locations
  Genomic contig Name=Xb4151_4152.C135
tgagggggctcttttggggatggtagattaaattttttccgnnnnngccctttttatnaccnattngcggattncgtttacccttgaaactctatggcgtttaaatctctgggatggggatttttgggcccaaattaaaaattgggccaagtggggttttccctcaaaaaaatttaggggttttaaaagcggcgcccattttccaaaaattttttttttttttattttttttgtgggcccccccccttctccccttttttttttttttttggtggggggggggaggagacacctcttttttttttttgaacccccacaccccaaatattttttgcgggcggttgttttttgntttggtctttctccaccccccccccccccccaatataaaaaaaagagggggggggggggtgtgggggggataaaaataacccccccccccccccccgcgctggtgtgttttctctttctccaacaaaaaaaaaagaaaggccccccccccccccccccccccgcgggggggggggggtttgttttttttttttttttggggggggggggggaaaaagaaaaaaaaaaaaaaaaaannnnaaaactcctttccccctccccccccccccccccccccnanngggggaagggagaaaaaaaaaaaaaagggggggggccnacccccccccccccattattttttttttttttttttttttgggggggggggggggggggcccccccccccccccccacacaaaaaaaaagggggnaagggggggggggggggnggggngannnnnnnnnntttttttttttcttctcccccccccaaaaacaacaaannnnnnanagggggggggggggggggggggggggtttttctctccctccctccc

SEQ ID NO: 14677 - DNA, 1187 bp, Xenorhabdus bovienii
  unsure (1)..(1187): unsure at all n locations
  Genomic contig Name=Xb4151_4152.C136
aaaaaaaaaaggggancaaaaaaacaaaaacaaaccaagaccagaggcccaaaccttgcatagcccgccagagtcgacccttaaaaagaacccctttaaaaggggggggggcgcccaaaaaaaaaaaaaaaagaagtggggcccccttttttggggggggggagtttttttccccccccctgatatatacccccaccccccgggggggaggggggaaaaaaaaaacacacacctccacccccgggggggggggggggggggggccctccccaccccgggggggcggatgttttttttttttaaaaaacccccccccccccccccctcttttttttttnnttttagccaaaaaaaagcccgccccccccccctcttctcttttttttttttaattatagaaaaacaccccccgcgccccccttctttttttttttttttctttttttgnnaattttttgtgttatttctttttccggccgcccccccggcgcacagacaagccaaaaaaaacacgcggagcagccgagaggagncncgcggcgcgcgccgccagcaacgtctccgcgtccccccccgcccccatgatgataattgggcaaccgtcgagacatgcacgcccgctctgacgcctccgtcgcatgagcgtcccggcggcgtcgcccacgcgcgaacgcggcccgagatcgccctgctgccacccacgctccttattttcctctctccaccatcagctttcccccatcactcctcacgccgtttgtatgtgctcatggcggcaagacccacgcgagacactaccagataggaaggcaatcacaccgaccgacgggccatagtcggctgagactaaggaaacgccctctttcttcaccccgccggcacgtcgtttttccgcgaacgggagcgtcgcatcgacccgggtgtgtgcacccccgccgcccctgtactacccacacgcacgaggcggcttactagtgagagtcgacgcaatcggatgatccgctgttacttgcggccctttcttccccatttgttttatcccgcctctactactaccacttctttgttatagttcgctattcaacgccncgcantagataagaatacaagtgtgactcgcggatcactgttcgtttccaccctcccccgataccgagttatcacacgtgtctcggtgagcgttcgcg

SEQ ID NO: 14678 - DNA, 1396 bp, Xenorhabdus bovienii
  unsure (1)..(1396): unsure at all n locations
  Genomic contig Name=Xb4151_4152.C137
aggcaccaaatgaanccttttgggnccttgggncncttggngcganggntnnncgnnaactnnncttgaanngagggaatttccccccngttntnttacgggcccttcggggncnatttggngccaaggngaacaactcttggggggcccacacaatgtgtgggggnatattccaaaaggatgttttggtggtggcgacaaaaataggcgcttttttttctatacacaccgcgcggggggggggggaatacctcgggtggtttttctcttcccaaacactttatttgtgggcgcgataaaaaaaaacactttttttaataatatatgtttttgccacagaaaagaatacacagcgggggtttggtgtttttctttttctcttttttttaaatagagagagggggcccccgcgcgggtttttttttccccggaaaaaaaccacccccttctaaaaaaaaaaataatattttctttgtggggggggggagcgacccccccccccacaaaaaaaaaaaaaaaagaggggngggggggggagaggagattttttgtggtacacaaaacacaaacacacacggggggggggggggggggccgttctttttttttttttnctcattgaaggaaagangggcaagacatccctcgctcctgcttttntttttaaaagnngaaaaggaaagaagaggggggggggggnntnngggtgtttttttttttttttgttggaagaggggagagcacaccccaaaacaaaaaacaaacatcctttgccgcctttttgtttttgttgagaaaaaaaaaagaagccagcgccgcgcctccctcttcgcttcccgggaaggtgtcggggggcaggggggtccggccccaccctttgccgcgggcccttttctataaattcttcccccgcgcttgcaagcacgcgcttgtgcccaccctttctctgtataaacaccagcatacgggcgcgcaccgggccgcgtcggtctctcgccgcctcttgtgcgcgtcgtgccgcactacacaaagtggggccgggccgacgcaaaaacaaaggggaagaaagagcgacagtgtgtgccttcgtgatgtcgtcttaagtgtcanggttgtggagtccacccagggctgtttcatacggcggggcgcagcacgggcgccacgcacccaccggcgcaggggtcgccggcggaacagcgcgtagagggcnaactgaggtatgtcaacgaggagcgtgtttaggcacaccatgcgtcctcgatgtcgcagcggcgtcgcnccccgcgtgcgcaacacgactctcctacgtgtgtaacgacgagaagtgactgtcagacgcgcgctggacatgaaagcgccgcagagactatttgtgctacgccacgccctgcat

SEQ ID NO: 14679 - DNA, 978 bp, Xenorhabdus bovienii
  unsure (1)..(978): unsure at all n locations
  Genomic contig Name=Xb4151_4152.C138
nnnnnnnttttttnnnnnnnnnnnnnnnnnaaagccgggcgggccggcacncngtccccgcaaaagaaggcccacccaaaaaacggggggccaagaaaanaaacaacaagccccctntnnnaanaagaagggccctaaggactctngnnccagcccccggccaaattncgaaatactcaaggaaagaaaacccccctgccaaggggagagaaacccaaaaaaacccccgggccccccaaaaaaagggggaaaaaaaaccccccctccttttttaaaaaacggagggccccgggggggggggaaaaaaaaaaaaaaacaccccccccgcgggggtttaagtgggaaaaaaaaaaaaaaaaaaggnnaaaaaaaaagggggggggggcaaaacccgccgaaaaaaaaaaaagagggggggggggggcggcgccgcgggggaaatataaaaatggggggggcgcccccccccaaaaaaaaaaagaaaaaaataaaacaaacaacaaccccccccccccccccccggaaaaaaaaaaaaaaagaggggcggcggggggggggggccccttctcctccccctaaaaaaaaaaaaaaaaaacaccccccccgaagaaaagaaaaaannnnaggggnggggggggggggggagaaaaagaaatctaaaatatttttctctcccccccccccccgggggggggttgaccgaaaaaaaaaaaagaaaaaccccccccccccccgttggtgggggtgaagaaaaaaaaaaaaaaaaccaaccccccttccctgggacccaaaaaaaaaaaaaaaaaaaaaaaaanaaagaaagggggggcggggggacaaaaacaaaaaaaaaaaaaaaaaaaaaaaaaagccnncacnccccctccccccccccctctgttttcnctgctctgtgggggcggggggggggggggaggacaaggaaaaaaaacacaaccaaacaaacacgccacccca

SEQ ID NO: 14680 - DNA, 1100 bp, Xenorhabdus bovienii
  unsure (1)..(1100): unsure at all n locations
  Genomic contig Name=Xb4151_4152.C139
nnnnnnnnnnnnnnnnnnnnnnnnnnnnnnnnnnnnnnggggnnnnnnnnnnnnnnnnnnnnnnnnnnnnnnngggggnnnaaaaacacggggnnnnaaaacccccnggggnagggtgnnngannannttcctggggaggtttttggaaannnnnttttttaaaaggttaattttttaaaaaaaaaaaagncggtccaacaaaggagccttggccccaaaaccccccccncccaagtttcccgacaancccggaagaaataaacccccccntaaatttncaaaacccccaaaccncccggggccccaaaaccccccaaaccccccacccaaaaccccccaaaaaaaaaaaccccccccgggggggaaccaaaaaaaaaagcccccccccccccccccaaaaaggttaccacccccccgggcacccaccacggggaaccccaccccccccaaaaataaaacacaaccccccgggggagaaaaaaaaaagaagccgcccccaaaaaaacaaaccccaattttggggaaaaaaagaacccccccccccccccccccccgggtttttttttgggggaaaaaacccccccccaaaaaacccgggggcaaaaaaaaaaaaagggccccccccccccctttttaaaagaaaaaaaaatatgcccccccccccccccgggaaaaaaaaaaaaaaaaaaaaaaaaaacccccccccccccacgcgcgaacaccccccccccacacaaattatngagaaaaaaaaaaaaaaaaaaaaaggggngggggtggtggtnaacaacacaatatcccacccccccccccccggggaaaaaaaaaaaaaaacaaaaaaaaaaaaaacacaaccccaccccccccccccccnaaatataaaaaaaaattaaaaccncggcgggggggagagaaaaaaaaaaaaanannttncatttnttttttttttttttttgnaaagggggggggggngacaacaacccacccccccccccccacacaaaaaaaaaaaaaaaaaaaggaggggacgggggggcgccggccaccatcctccccgnnccnaaaaaaaaagaagaaaaaaaanaagcccccagagtga

SEQ ID NO: 14681 - DNA, 958 bp, Xenorhabdus bovienii
  unsure (1)..(958): unsure at all n locations
  Genomic contig Name=Xb4151_4152.C140
atatcttgggcgttgaaataaaccccgtcttttncgnactttngangagnatcccctttntccctgtcagtcatactggaccgtaaatttccatttctgggaagggtggatgggatgggcaagtggctttcccagaagcacaaaatccttggctttaacaggtatattcgggccatggggcccggggaattcaaaaattctttgggccaatttcgggtcgggtttttttttggcacatgagaaancaatttgtttttgaaaaaaaaaatttgggaaacccccccggcgccttttttgtataatataaaaaattggtttgggaaaccctttattttcgtgggggcggcccccttttctggggggttttttttccccccccgccaacaaaaaatatggtgggggggggaaaaaaaaaagggcccctcttaagtataaaaaaaaaacaccccccgggggggggaaaaacacaaacaaaaaatatttttttttagaaaaaatatattttttttgttggggggggggggnggggtgttttttttcttctcctccgggcggggggggggggggaaaagaaaaaaaaacacccctctttttttttttttttttntctctcaccccaccnaaagaagaannannnnggggggggggggggccctgccggtttgtttttttatatatataaaaaaaaaaagaaccccccccccccccgcccnnnnggggggggggggagaaaaaaaaaaaaaacaaacaaaagcgcggggggtgggggtgngtgggtgtgttnaaacaaaacaaaaacanactatcaccccctccctcccccnctctnnggggggtggggggtggtggggggtntnttttttttttttttttctacaaaacacaaacnaaaacggaagaaaacgnccccncccgcccccccccccgcncgntgttgtttttttttttttgtatgtta

SEQ ID NO: 14682 - DNA, 592 bp, Xenorhabdus bovienii
  unsure (1)..(592): unsure at all n locations
  Genomic contig Name=Xb4151_4152.C141
gagctgatgctgagcatctaagatccctatgaactanatggtaggaaaccaaatcccaaaaaggcctcgtccaaagataaaaagaaacctccccccctttcttaaaaaggaaaggtttcctggggggacgaaaattttttaggggccctttttcggttttaaaaaaaattggccactttttttaaaaaaaaaatttccccccccccaaatttttgtgggggggccccccccccctctttggggcgaaaaaaaaaatggggggggggggaaaaaaaaaaattttttttttttcccccccaaaaaaaaaaaatattttttttttaaaaaaaaaaaaaaaaaaagggtgtgttagaaaaaaaaaaaaaaaaagggggctttttttttttttttttttttttaaaaaaaaaaaaaaaaaaaccccccccccctacccnnnnnaaacccccccccccccccccccccggagaagaaaaaaaatattttttttttttanagnnntnaaaaaaaaaaaaaaaacaaaacgcggaggggggggccccccccccccccccccacncttttttttttttttttttcgagcaagagaacacca

SEQ ID NO: 14683 - DNA, 1441 bp, Xenorhabdus bovienii
  unsure (1)..(1441): unsure at all n locations
  Genomic contig Name=Xb4151_4152.C142
nnnnnnnnnnnnnnnnnnnnnnnnnnnnnnnnnnnnnnnnnnnnnnnnntctctttnnnnnnnaaaggagcggcctgttngnnnnnnnnnngttgggggggggtttggnggcccnnggnttttccggtgtgggtttcgggggccccccggcggattaactntgnntgtnnnnnnagnnngggaancacgttcccgctccttctgggggggnnnnnnnnngnnngaagagaaggggccccggggcccctcttcggtcctggtnnaacgagggggggggcagttttatttgggggccgggggcgcaaatannncccnttnnnncgggggggtaagggggggttttgttnnnggattaaccccccggaagagcaaaagaaaaaatttccccggggggggggggggggagattgtctttttccacaggggggggcggagagcgggggggagtttntacaatttttgctgcagaggggggggggagaaaacacaaagggggggaaggttgtccgcgggagtgcccccaaccccgggggggaagggtgggggcggggggcggagagggaacaaagcgggggggggggaagatattccccccccccccaaaagtgtgtggtgtgtggtcccccacaaaaaaaccttttttcaaaaccaaaaatttttatagggtataaacgcccccctgcgggnnnnnnnnaacaaccctccctccaaaaaaaaaatataggggggggggggggaggaagcgggggnaaaaaaaaaacccccccccggggggggggggggaggggggggaaggggggcccncccccccgccccccccccccaggggggggggggggcgcggggggccccttttttnnnttntntnataannnnnnccttttttttcgcgggggggggggggggcgaaaataataatattttttggttnnaagaaaaaaaggggggggggcgcggcccgggggggggggggnngggcgcccaacattttttgggggggggggggggggggagcccccccccccgcccgggtgttgttntnnataaaaaaaanaaggggggggggtggggggggggtggggcggcgccccaccccccccaaaaaaaaaaaaaaggggaggaggaggaggagatgtttttttttgtttttttttgcgccggggccggacgaaaaaanaaaagacgcgcccccccacgcgggggggggggnggnnggggagggagaagagggagggggggggttgttttttttttttttctcccccccccccgcgcgcgccggagcggtgttggngggggggaggggggagggagaggagagggggagggngtgaggtgtgtttggngngggaggcgggggcggggcttggtggngtgtttttttgttgttttagcgttcgggctccgggcggcgcgcggggcggtggggagagaagggagc

SEQ ID NO: 14684 - DNA, 871 bp, Xenorhabdus bovienii
  unsure (1)..(871): unsure at all n locations
  Genomic contig Name=Xb4151_4152.C143
atcgaattcgaaggttcggtacccttaacttccttattaagcatctaatagtaaccagggatggaacnnngnnnnnnnnnnncctggtaaacgaaattcgnagnctcgggttacccgnatagccgaatttaggggttaccccctggacccggtaaaaaaccggcctattggggtttgtcccaacgtttgggggggaacttttttattttctcccccccccccgcgggaaattttgtggggaaggggccccaaaaaaagggggggcgccatttaaaatttggtttgggcacaaaccggggggggggggggttaaaaaaggggcccccccaaaaggcccttgtgaaaaagaaaaaaaaaggggggccccccaaatgttttttttaacccccccccccctttttttttttttttcaaaaaagggggccccccccccccccccccccaaaaaaacctccccctctttttaaaaaaaaaaaaaaaaaaaaaaggcgcggcgcgggggggggggaaaaaaaaaaaaaaaagatattggggggggggggggaaaaaaaaaattttttttttccccccccccccacaaaaaaaaaaaaagaaggannttttgtgtggtgggngcccgcccctttttttnnctccaggtttgggannaaaaaaaaaaaaaaaantnccgcgggggggggggnnntgggggggggggggggggntttttttttttttccccncaaaccccccaaaaaaaaaaaaaaancgcgngcggcgggggggnnannccccntgtttttgtttcgcccccccgcccgggggggcccccgngcggncggggttctttttttattttatgtgntgggtggggtggggcgggaggggagcc

SEQ ID NO: 14685 - DNA, 1032 bp, Xenorhabdus bovienii
  unsure (1)..(1032): unsure at all n locations
  Genomic contig Name=Xb4151_4152.C144
ngnnnnnnnnnnnnnnnnnnnnnnnnnnnnnnnnnnnnnnnccttncacagnccagctaaaaagaaaaggtggcagccatggaggaaaattttttttttagcctggaaaatttttcccctttggggaaacggggtaccccgatattttttaaaccccggggggttaaaaaagggcggcaaattaaaattttccctgtgggggggggggttatccccccaagggggggggggggaaaacaagggggggagaaaacccccccccaaaaaatttttttggaaaaaaaaaaatggccggcccccccgggggggggaccccccccccgggggaaaaaaaaaaaaaaaaaaaaaaaatttgggggtggggggggaaacaaaccccccgggcccaaaaaaaaaaaaaaagaaaaggttttggcccccccccacaaaaaaaaaaaaaaaaaaaggaggaggggggggggggtgcttttctccccccccctcgtgggggggggggggggagaggagaaaaaaaattttttttgtgtggggggggcggcggggggccggcgccgcccgccctccctctttatataatttgtggtgttggggggggggggggggggggggtggtggggtggntnnnncccccccccctccccccccccccccccccccccccccttttttttttttttttttttttttttttaataaaaaagaaaagagggggaggggggggggggggtgtggtgtgttttttttttttttttttttttatttttctccagaaaaggaggaggaggggggggggggggggggggggtttctctcttttttctcttttttcctctctctccgcgcttggcggggagagaggaaggaagaaaaaaagagaaaaaaaaaanntttnnnnnnnnnnnnnnnnncccccccccccaaaaaacccncncaaanaaaaaaaaaaaccccctcttttttttttttttttttttnatattttattantntanaaaannncccccccccccgcgccccccgcgcgccgggggt

SEQ ID NO: 14686 - DNA, 1435 bp, Xenorhabdus bovienii
  unsure (1)..(1435): unsure at all n locations
  Genomic contig Name=Xb4151_4152.C145
nnnnnnnnnnnnnnnnnnnnnnnnnnnnnnnnnnnnnnnnccccnnnnnnnnnnnnnnnnaaaaggggngagaaacncgcgagacaagggcgagaaaacaaaacaccacaaaaaaaggaactcacggcggagnnnnnnnnnnnnnntnnnnannnnnnnnnnnggggcaaaacaaattggttaagatggcccgggcaaaagagggcgggaaaacccccggaaaagggaaaaaataacaaaaaaaaagaaaagggggggggggggggggggggcnancccccccgtaaaaaaggggaaaaaaaaacccccaaaanaaaaaaacccctccccccccccccggggggggccccaaaaaaaaaaagggggaaaaaaccgccggggggggggggggggggggagaaaagaacccccccccaaaaaaaagggggggggaaaaaaaaaaaaaaaaaaaaaaaaaaaaaaaaaaacccccccccccccctcccaaaaaaaaaaaaaaaaaaaagaaagaagaaagggggggggggggaaaaaaaaaaagggggggagaaaagaaaaaaaataaanaaccccccccccccgcgcgggcgcgggtgtttannaaagaagggggaaaaaaaaaaaaaaaaaaaaaaaaaagagaaacaaaaanccnccccccccccttcttaaaaaaagagaaaaaaagaaaagagaagacttttctttttttttttttntnnnnnnnnnnnnnnnnnnnnnnggggaggaaggaggagggagagaggggaaagaagaataaaaagattccaccaaccnccccccccccncccccttntngtgggtgtgggggtgggggtgtttnnttntaaaannncacaacccctcccccctcccctctctccttgggtgcgcgcgggggggggggggggggggggggggggggggngnnangnncnncncncncccncnccccccaccgaaaancccaaaaaaaaaaaaaaaaaaaaaaaaaanatnaanaccaccnaccannaaaaaaaaaantaaaaaaaanataattattntttttttttttntnttgtaanaagaaaaaaaaaaaaaaacaaannaaaaaaaaanancnagggggggggggggggggggggnngggggnncctccccgtgttcctccccctctctccctccctcccnccnnnccnnnnnnnnnnnaaaaaaaaaaaaaaaaaannanaaaaaaaaaaancaaaaaagacaaagagagnnaagaaagaaagacaccagcacnnnancgaaacnnnnacaaacaaccaaacaaaatatttaacaagagaganaagaagagaaaaaagacgggggcggnnggggcggccgcgggggcggggaggatagngaaaaaggagcccgnnccccgcgccggcggcncaagncacaaacacaaaaaaaaaaaaaaaaa

SEQ ID NO: 14687 - DNA, 1261 bp, Xenorhabdus bovienii
  unsure (1)..(1261): unsure at all n locations
  Genomic contig Name=Xb4151_4152.C146
nnnnnnnnnnnnnnnnnnnnnnnnnnnnnnnnnnnnnnnnnnnnnnnnnnnnnnnnnnnnnnnnnnnnnnnnnccgccctctcgggnngggnnnngngncgcgccccnnnncccctcggggggggggaggagnaagaacaaacccaggtcggcttctagaaaaaaaagnnaacgngcctggcggcgcggggggnnaaaaaaaaaaacacccgggttttggggggacccccagaaagaaaaaaccccccccccctcccaaaaaaaaagccccccccccacagcgagaaatttcggggggggggggcccnccccnccccccggcggggggagacaaaaaaaaaaaaagattttttttttcccccccccccccccctctcccgcgttgttttcttnngggggggggggaaagagaggaggncgccccccccccgcggggggggnggnaaaaaagatgggggccccccccacaccacaaaaggcgggggggggcgaagacgccccccgcccccccgnncccccccgggggggggggggggcggggggattttctagaggaggggagccccgcccccgacggagagcggacaaaaactaccgctcncaccggacagcgcgcctcnccccccgccccccggcggggggggggcgggggncgccgcgggggggccgggcgcgcgagcannaccacncnccccccccccccccccgccgcccgccgccccgcccccnccggncgntttttttcttngacaacccccccagaccaccacaagaccggggaagagncgggccgagcagcgggagggccggacggggcnggccggggggagggaccacccgggcacccggccggccgcgcccgccccnncggccacacggccgcaacgnnngacggcgtaagacaacanagaggaagnngngccgcggaccccgccacgaggcccacgcggccccagcacncncaccccaccgccgccaggcgcccgcgaccggacgcgggcacgaacgcgcgacgcagacgcgccccggaacgatggccgnnngcgnnggcggcccgccgccgcctcccgcaggcggcccggagcncgncggcgaggcngngcgggggnggggccgcgccgccgcgccccgcgcccaggcgnagggacggagngcgcgccccggccgcccnncccgcgncaacgaacacgccaacaaccgcnctcgnacacacaggcggngggcgggccgcgcggcacacaaaggacaacacaaccagaca

SEQ ID NO: 14688 - DNA, 879 bp, Xenorhabdus bovienii
  unsure (1)..(879): unsure at all n locations
  Genomic contig Name=Xb4151_4152.C147
nnnaaaaaaannnnnnnnnnnnnnnnnnnnnnnnnnnnnnnnnnnnnnnnnnnaacctccctcggcccgngggggcccctcccccttcccccnnncnnnncgggggcacgacanccanaacaacncctttgggggggagtttgggggcaacccttcaaagaaggtttttttttaaaaaaaaaaaaaaaaacaccccctggnttgaaaacccccgntaaaaaaccccgcgaaccccccccgggtttcccacccccacaaagggccccccccccccttccccccccccgccgcggaaaaaaaaaaagggggggggtcccccaaaaaaaaccccaccacaaaaagaggtccccccccccccccccccccccgaaaaacccccccccaaattttaaagggggaaaaaaaaagggggggggggacccccccctgtttaaaacaaaaaaaatttcccggggggggggcccccccccaaaaaaaaaaaaccccccccctcccttttttttcggagaggggggggggggggacttttttcncccccccccaaacannnnggggggggggggggggggttttttttttttntgtgggggggaagggaaaaaccccacccaagggccggggtggggcggtggccccgccgcgggcggcccncacccacaacactaaccacaccccacgccacacacccacacacaccacacaacaacaaaganaagagagaagaggagagagagcgcgcgccccgcgcgcgcccccnccccgcgcgcgcgcgccccccgcgcgcccgccgccgcgcgcgcgcgagcgcgcgctacgcgcgacacngncgcgcgagacacacnatagcaaatacaagnataanacaagaaccgccgacca

SEQ ID NO: 14689 - DNA, 1073 bp, Xenorhabdus bovienii
  unsure (1)..(1073): unsure at all n locations
  Genomic contig Name=Xb4151_4152.C148
nnnnnnnnnnnnnnnnnnnnnnnnnnnnnnnnnnnnnnnnnnnnnnnnnnnnnnnnnnnnnnnnnnnnnnnnnnnnnnnnnnngggcaaannnnnnnnnnnnnnnnnnnnnnnnnnnnnnnttctggnnangggnggnnnnnnnnnnnnnnnnnnnnnnnnnnnnnnnnnnnnnnnnnnnnnngggcaaacttggcatgccntgncaggntcgnnactctagaaagganntttcgncaatcgtangtggcaggnctcgnnggggnnaattttgcagtttgcactnacctggcggtaaattggctggncaatgacnaaagggnnaancggtnacccccatgttttgccccgaattggtnaagggactttaaccccggaacggggagggttttaaaaaaaatgggggggcggccggccccccaaattgtggggggccccaaacctttttttagggggaaaattttttttggccccccccaaaaagtttcccccggggggaaaaatttttaggagaaccccccccgtgtaaaaaaaaaaaaaggagaaattttttgccgggggagaggcgcccccaaaaaaaaaaggggggcccctttataaaaaaaattttctcccgccccccaaaaaaaaaaagggggggggggagggggggttttttttaacacaccccaaaatgggtttttttccccccccccccccccccacacaaaaaaaaaagggggggggtgttgtttttttttttttttttttttttttaataggaggggggggggggggggggggtttttttataaaaaaaaaaaaaagggggggggggggggaaaacacccccccccccccccccccnaaaataaatttattttttgggggggggggaaaaancngggtttttttttttttttttttttttttttttggcgcgcccccccccgaaaaaaaaaaaaaaaaaaaaaaaataacacccccgcggggggttgggggggggggggaggaagagaggggtaagaanttttctctcaaccaaaaaaaaaaaaaaaaaatttttantngcccagggggggtgggaaaaaaaat

SEQ ID NO: 14690 - DNA, 915 bp, Xenorhabdus bovienii
  unsure (1)..(915): unsure at all n locations
  Genomic contig Name=Xb4151_4152.C149
ngcnnnnnnnnnnnnnnnnnnnnnnnnnnnnnngaccccctggcagtgtagttataatgatacgaactacgattctgccattaccccccggggtttttctttgtttttcgaaaaatattgtttttgcggcccccggattaaatggcccgaagggtccccccagggcacacacaccaaaagtttttccgggggaaaggggggggaaaaaactcttttcgggggggttttggcccttaaaaaaatctttttttttcccgaggggggggggcgcccccaacgggagatttttttcccccctctaaaaaaaaaaaacccccatattttttcccccgctattttgagagaccttatttttttttttcgtgggggggggggggaaaaaaaaaaatagggggggaaaaagggggggggggcccccccccaaaaaaaaaaacccgggggggggggccaaaaaaaaaatatgggggggggggggggaaaaaaaaaaaaaaaaannacccccccccccccccctgggggggaaattttttttttgtgggggggggaccccccccccccccccccccccctcccaaaaaaaaagnagaggggggggggggnnaaaacnaaccacacaaaaataattatttttttnnnttttttctttttggtccgccctccccccgcccaaccgggnnnnanaataaattttttttttctttcttttttttctttcccacccggggcgggggggcggggggcgcgtcttttttttttttttttttttggtaaaaaaaaaaaaaccccacccccccccttatataatataaaaaaaaannaggggggggggggggagaatttcacctcttttgtttttatatggggagagnggaggnnngnnnnncntnnncctaaaccccccacttcattaaaaaa

SEQ ID NO: 14691 - DNA, 1057 bp, Xenorhabdus bovienii
  unsure (1)..(1057): unsure at all n locations
  Genomic contig Name=Xb4151_4152.C150
nnnnnnnnnnnnnnnnnnnnnnnnnnnnnggggnnnnnnnnnnnnnnnnnnnnnnnnnnnnncctttcttcttttaccnaatatcgggagtttgnnncccccctgtgggcnnggggggaancgaatagaatttttatttttttaaaagaantnnnttcaagnnttgannacnnnnagagnccgggatcttctggttnncgcccttnccaaaataaaaacctttgctttcccggggggaaaaaaagcccctccccaccatatggatggccaccaaaaaagttttccctttacaaaaaaaaaaaggccccccttttttcaatttgggggaaaaaacacgcttaaaaaaaaaagagggccccgcggcggaaaaaaaaataaaaagggggtgttttttttccggggggggggaaaaaaaaaaaaaaaacacaatggggggggctccccccacaacaaaattttttggggggggaaaaaccaccccccccccagggtgtttttatacaaaagaggggccccccccccccaaaaaaaaaaaaatttttttttttgggggggggggaggagaagaaaaaaaaaaaattttttttttttttttcccccccccccccccccaaaatatattattttttttgggcccccccccccccccccccccgggggggcggggcgggggagagaaaaaaaaaaaaaaaaaaaaaatttttttttttttttttgggggggggggggggggggaaaaaaaaaaaacattttttttttttttttttttttttttttttttttttttttttttataaaaaaaaaaaaaacaacccccccccccccccccccccggggcggggggggggggaaaaaaaaaaaaaaaaaaaananttnnnnnnnccccccccccccccccccccccccccccccccccccccggggggggggggggggggggggggggggggaanaaaaacacacttttttttttttttttggggcggggnnnnnnnnnnnntgtggttgtttttttttttttttgggngggtggngggggggggacaacgaaaaacaa

SEQ ID NO: 14692 - DNA, 704 bp, Xenorhabdus bovienii
  unsure (1)..(704): unsure at all n locations
  Genomic contig Name=Xb4151_4152.C151
gactgtgcgagcaccaagacccaccacggcgtatatctgagacacgacacctgcaggagataaaaacacgcgacgttatctttggcccgggacaggggggggcaaaacccctgggggggtgggggggaaattggaaaaactttttttggggcccctttaaaaaaacccttaaaaaaaaaaattttttaagagggtaaaatccccccccccaaaaatttaaaaaatttaaaggggtaaaaagggtaaaaggggtaaaaagggggaaaaagggggtaaaagggggaaaaagaggataaaacggggtataaaggggttaaaaggggtataaaagagaaaaaaccaccccccctcttttttgtgtgtggcccccccccccccccccccccataaaaaaaaaagaccccccccccccggggtttttttttttttttttttaaaaaaaaaaaaaacaacccccccccccccccttgttaaaaaaaaaaaaaaaaaaaatattttccccccgcgggggcggggggaaaaaaaaaaaaaaaaaaaaccccccccccccgcgggggggggggggggggttcttcctctccccccccccccccccccccacccaacaaaaatttgtttgtttttctttgtgccccgcccggaaaaaacaaaaaaaaaaaaaaaagaataagagnnnnnntttaccccctccccacccccccccc

SEQ ID NO: 14693 - DNA, 1131 bp, Xenorhabdus bovienii
  unsure (1)..(1131): unsure at all n locations
  Genomic contig Name=Xb4151_4152.C152
naaaaaaaaggnggnnnnnnnnnnnnnngnngggggggggnnnnaaaagttggggggaannggggnnnnnntttgncggtcgacataacaaaaaaaacaaaagtgagggggggnncaannaagagcgggcccgtttntggggggnnnnnnnngnggngagngnngggccccnnnnnaaggggcggggnaaaaanngnnncccggggncngggcncccggggcgcgggggnaaaaaaaaaaangacgccagcccggggggggngaaggggaaaaaaaaggggcaaacncccnggggnnggccggggggggcgcgggcggggncccccngggggnaaaacccnnngggcccccccccccngggggggggaaccccggaaaaaacaaaccaaacaccgggggggnnaaaaagaggggaaaaaaaaaccccnccgccccccccccgggggggaaagggggggggggggggcccccccnnnnnngggcgcggcggnaaaannnnngggcccccccccccccccccaaaaaaaaaaaggggggggggggggaggaaaaaaccccccncccccccacaccaaaaaagggggggaaaagaaaaacacaaccaaaaaaaaaaaaaccccccccccccccccaaaaaaaaaaaaaaggggggggggggggagggggggnngggggcgcccgcgcncnnnngnnnnggggggggggggggaggaaagaaaaaaaaaaaaaaaaaccccccncgccgccgggggngnggggggggggggggggggggggggggggggggggggaaaaaaaaaaaaaaagggggggggggggagagaaaaaaagaagangggggggcggcgcggggggggggggagaagaagaggaaaggggaggggcggnnnnnnnnnggggngggggggggggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14694 - DNA, 1022 bp, Xenorhabdus bovienii
  unsure (1)..(1022): unsure at all n locations
  Genomic contig Name=Xb4151_4152.C153
nnnnnnnnnnnnnnnnnnnnnnnnnnnnnnnnnnnnncgacccggcnnnggnccggcagtgccccnngngggggccncgaacngcaaaaagtcccaaaaaaaaaaaaactgggagggggnccnancccngcccgattttcgncacnctngaagagncaaaccccgaaacganccttntataatgggtggnaanccagnaacngnaaaccgtgncnaaaaaaaaacttggggggnaattnctccgnaaaaaacaaaaaaatgcaaaaacccccccaaaaaaaaaggggttnccccgggggtaaacaaaactctggaaggttaaacccaattccggccgcccaanaattaaaaaaaacaagggaaaccaaccgaaaacccggggggccccggggaaaggccccgggggaaaaagcgccccaaaaaaaaaaaaccggggcccccggtaaaaaaaaggggggcccaaaaacccggggggcgccccggcggttaaaaacccggaaaaggcccaaaatttaaaaaaaaaccggggggggggggggagaagcgccaaaaaaaccccgcaaaaaaaacacaaaaaaagggggggccccccaaacgggggggggggggaaaaaaggggggggcccccccccgggggaaaaaaaaaaaaaaagggaggcccccccccccaaaaaaaaaaaaaaaaaaaaaanaaaaaaaaaattgggcggccccccccccgagagagggaggaaaaaaaaaaaaaaaccgcggggcggcgccccccccctctcttttnttttncccttttttttcacccccccccccncaaaaaaaagtgtgccacaacacaaacaaaaaaagaagaggggggggccccccaccccccgcgcggggcgaaaaaaaaaaaaaaaatccgcgcacgaaggagaatgttgttttctcccgctttncnntgcaagaagagaaggaaaacacggccggggggcggcgcacacccccaaaaccnnnnacacaaaacaaaaatcaacgggggggggcgg

SEQ ID NO: 14695 - DNA, 829 bp, Xenorhabdus bovienii
  unsure (1)..(829): unsure at all n locations
  Genomic contig Name=Xb4151_4152.C154
cgtacatcagtccgacacctggatctttatgctccggggcaaaaatccccttaacgggtttgtgcccctgggggggccaaaaagggtgggcggcccccttttttgtgccacgaggtgggatttttttgggcggggggcccggaaaacaccaccccccttttttctttttttccnnggggtggggggcggggtccccgccgtttttcttccccccccccagtgagcccccccgggtgggtccccccccccccccgctaaaaaaaaaaaaaaaaatttttttttttggtttttgggccccccgccccccgccccctttctctttttcaaacacccccccccccaaaacacacggggggggagaagaaataataaacccgccccaaaaaacacccnncaccttttttttctttttttttttaacgaaggggggggtggtgtttttttttttaatattatcccccccccccnccccccacaaaaaaaaaaaaaanngggggcccccccccccccttnngggggaaagccccccccccccaaaaagagaaaatttttttttttcccccccaccacaccagcgggggggcgcaaaaaaaaagggggtgggggggggggcgcccccccccccccccccggtggttttttctttttttaaaagggccggcggggggggagaaaaaaaaatatatttttttttgttgtggaggcgccccccccanaaaaatatattggggtgggtggaaaaacaccaccaacacaaaanacacaaaaaaacaattttttttttgtttgggtgttgtggggcgcgtgggggggggccgcgcaaattatg

SEQ ID NO: 14696 - DNA, 1100 bp, Xenorhabdus bovienii
  unsure (1)..(1100): unsure at all n locations
  Genomic contig Name=Xb4151_4152.C155
gcacggccaggacgagnnccccccggcggcctgnggcgcttttttttaaagaaaatctcatttttttcccccagtattgatgatgtaaaaccttgtacatctatcatatatttaattgataatattgtctctctggaaaaaggagactttattaaccaatctgcaagaaaaaaccattttgtgggggggggactggatacactgacttcgccaaaataataccaacataactcnacttcttcataacaaaaagggtttaatatctttgtttaagctcacaataacaagaaaaaaattttttttcctaaattttttaaaacacaccaaaaatattcccccgggaatttttttccccgcggggtgttggcacccccccccccccgcttttttataaaaaacacncctctctttctctcccaaaaaaaataaaacccctccacaaaatatacacacccgcggggggaaaatattataaacaccccccccccgcccctctttggnnggnttaaaaaaaaaaacccaccacgccgccgcgncgcgcttnnttttttttttttnttttctttcttccccccccccccctcccgcgaggaaaaaaaaaaaaaaaaaaagaagatcctttttcttttttttttttttttcccccccccccccgcccccttcttttttggtgggggcgcccgcctccttttgttttttataaaaaaaaacccccccccacacacagtggggggggcccccccatctctnattataccccaccccccgcgcgggagaagaaatatatttttttttttttnncnnccccccacctatattatttcttctcnacgaggagatggngccgcgccccccttctttttttttatttttttnnnnnnaaaaaaaaaagaggagggggggggggggggcgccaccacaacaccccccatctataaaataaaaaataaaaggacccctcccctttttttttttttcccccccccccccccctatttctctgttggggggggggggggggcccccccccccccccctctctttttttaaaaaataaaaaaaaaaaaaannannacccctccttttttttttttatgggg

SEQ ID NO: 14697 - DNA, 1030 bp, Xenorhabdus bovienii
  unsure (1)..(1030): unsure at all n locations
  Genomic contig Name=Xb4151_4152.C156
gggggacccctccctcttttttatgttanaagaaaacgcctcccccttttgggggggannnnccccctttttgggagaannnnnnccccccctcctcctccggggggcgnnnnnnncccccccccggngggagggaggaaannnncttnctttnttttnnttnccccgccccgcggggnngngnnnnncccccccctccttttntgggnnnncctccccctcgnnngggggggggnggaaaaaaaaaanaggggggggggggggggagagaanaannnnnnnttctntctttnataaaaaaaccccccccccccctccttnacctaaaccggaaaacccttanctcccttntttnnnaanaacccccccagganncccccnnagagggggggnnccccctcatatnnnanaaaatattttttntttttttcttcttggggggcccccccgcggtttnaccgcggttttttnttttttttccccccacacctcctttgggggnttattannanaaaaaatatatnaaatattntcttgggggggggtggggggggtttttnaaacccccacccaatatattcccctttncccccccccccctcttcccccgagagaaccccacacccccccgcgggggggggggggttttaatattttttcccccccccccaaggtttccccccggatatagggggtntctcccccaaaaacccccccacccccccacanaaccccctcggggggggagaaaaccccccctatttnctccccgggggggggggggnnnaaaataaagagcccgcgcgcggtttttccccccacannanaannaaaaaaaaaataatntattcgcccnaaaaaaacccccccccaccanaaaaactttttggggggnggttttgtgggggggntattggggggggaaaaannaaaanaacccccccccccgcaagttgtgggggcccccgcccccccctccccgcggggggtataacccccccccccccttttttatatacccatatatatt

SEQ ID NO: 14698 - DNA, 581 bp, Xenorhabdus bovienii
  unsure (1)..(581): unsure at all n locations
  Genomic contig Name=Xb4151_4152.C157
cattagtacgnaattacgnacctnncggtacccctntnngtttagtntcctcctnctaaaaacgtttncnatnaattttaaagaagagcaatgcctggttccccctgggggcatttttttttattgccccccaggaataaccggaccctattttaaaccccctggttaataaggccttggggtattgcccttccggggaaggcaaaccttttccccctaaaggaaccccccaaaaaggaaattcccccgggaaaagggcgacccccccatttttcttttgggggggggggtttttttttttaaaaaaaactgcggggaataaagagttttttcccccacccacccttttttttcgggggggaaagagaaaaacctcctccccgggggggtggaaaaaaaattcccaaaaaaaaaaaaacaaaacgcccgcccccccccccatttttttttttttccccaaaaaaaaaaaggaaaaaaaaccttttttttttttttttataggggggaagaaccaacaccccccccccctttttttttttttgaggaggggggggttttttttttttttttttataaaaaaa

SEQ ID NO: 14699 - DNA, 1085 bp, Xenorhabdus bovienii
  unsure (1)..(1085): unsure at all n locations
  Genomic contig Name=Xb4151_4152.C158
ttgggaaggnnnnttnngggnggggttnngggggnnnnnnngccctgtctggggggggccttaacaaatttcgggggnggngggcgccggcctctttnttttttttgctngggcggccctctcccccctcctcctcccccccgcggcgggtctccctcgcggcgtggggtgtcttgcgccttctcctcttctctgcccctgcctccccggctnctcctgctctcctgtgtgcgctctcgggcggcgggggcctggcgtcgcgtccggccctctttccttcgtgcccggtggccctgggggtgtctttttgggcgggggggggggggcctcctcttggcccggggggcccgctcgccccgctcctcctctccctctggctgcccccttcccccctctcccctttcccttttctcccctgggggggggccgggggggggggccctcccccccccccgggggaaaaaacccggggggaaaaaaaaaaaaaaagttttttttttttttggggggcnnnnnaaaaaaaanaagnnctntttntttttgcttaaacgcgttcngnngaaaacnnngntncgnnaagncncnncngtncnannancnnancnagnnaaggcgntngcntcagcnngncanctangncgcttcnnngannnaangannagnctanacancgnnncnnnncnncngccttttnnnannnngttngnaannccacagttcgngggagnnnnatnaancanaacacncgnaattaaggcacnnnaanattagnnnannnnacaacgncnacnnaannnaagnaancnngncgaannnaaangnncaancnnaaannnanacnggnnggaactggnnnacnnnaacacnncatnngncnncnnnncggcttnnnnnnancancnnnagnanncnncnctnnnnnnngnnnnncaagcnnncnntagcnnnncnngnaannngnnncannaatnncngntnntgcannnngtcnnnnngnnnaaaannnttnacnngcnnncnttnnnnnnnncaantnnnnnnnnnncaaacnnnnntnnncgnnnnagnannnngcactggcggga

SEQ ID NO: 14700 - DNA, 1262 bp, Xenorhabdus bovienii
  unsure (1)..(1262): unsure at all n locations
  Genomic contig Name=Xb4151_4152.C159
gcccagcggggggaggtggcctctctaaggcccgcgttgnnnnaganaggggaagttttgtttttttttgggggggcnnnnanaaggggggggaaaaanctttttattttttcttattttttanaannnggngggggggggggggggggggnnnnnnnnnnnnnnnnnnnnnnnnnnnnnnnnnccnnnnnnnnnnnnnnnnnnggggggggnngngnnggnnngagaaaaacaaaaaaaaacaacagacgggcgcccccccccccccccccccgagggagaggaaagaaaaaacttttttttcttttttttttttttttcttttttngnngggngggccgcacgcgcgggnngnggccnccgcctcctgcgcggaaanggcaagnncttaaacccnccccccccgccccggagagaatgggggntnnnnnnnacacactgtggggggggcgggttgagnncggagtgggggggcncctaatttctttnnngaaaccctcttgggggcccttgaatgtttctcttttggttgnccnaaggagaactttcccccgggtgncgggagaaacacccccagaaaccctttgggtgtggggggggcggggggggcaaaatttggggcccccacccccccccgncaaaaaccttaaaaaaaacccacaaagaggcgggggccccggtttttaaataaccggggggcccctcgggcggcccgaagaaccccccccagagaggnggcgcccgcccatcttttcgggggggggggggggggggaaatacttcgcggggagagcgcnccggtgatatatcgcgccgcgggggggnccncaaagaggggagggggttgaaataagaggaggggccctcttcttggtgcgggggcgggggnggggtaaatatatggggggggcccggcggcgccgcgagnnttggtctccaaacaaaaaaaaaacgggcgcggctggatataacgcggaggggggccctctttgttggggggngcgcacnccccgggggaggggnnctcattcatgcttcctcggggcagggagnagaccgcccccccgcgccgcgngggnnctcccttcttttcatatagtgaggggaggggcggcacaacccatccctngtataataattaccccccacccgccgncgggcggggtggcgtctcttttctcccgcgggcgcggggggggggctcctctncggngcttctgcttncccccccccaaacaagaagttggggggggaggggaggg

SEQ ID NO: 14701 - DNA, 936 bp, Xenorhabdus bovienii
  unsure (1)..(936): unsure at all n locations
  Genomic contig Name=Xb4151_4152.C160
tgatatcgaaattcgagctccggtacccctgttctttgatatcgtatcctcgtcccctcgccttcggctttagatagtcgattttcgagaatagtccacctctatgctcccggtggcgcctgttgcctatccatctcgttgtgagattgatcctgtgtgcgctgttattgacccttatatctcccacctgtgataggatgaccgtgtttcactcatgtgtgagctgctgctggatcatgcgcatctggaccgagccgttcgcgctgatcatctcctactgaacctgcatccttacttcaccactgaagcgaccatttatcctccctgttctcttactctcgtagcccctgccacacttctactgcatcttctccacaccgaacttcctaaaaggatttgtatccgcgaccaaccttcacgtttgatccatcccctcaattaccatccactacatacaccgaattatgccgtatcgacgcatgctcaatgataagactacagtcgacttacctgtcgctgagctgtgacttcctgatcatcgccatgctgaatcattctgactttatcacgatctcacgtgatcgctaccctgtgtaaactcctactgaatctctcctctgcagagtgtatcgcttccctctaactctacctatctcccatgcttctgagtaacctctttcccctcatcggattgttatatctactccgattttcaggtaaatttgaattttttttgccgcgggcttgaacctccccccccccccgcaccctaaaaatggggccttccccccccgggggggggngggnnnnaaaaaaaaaaaaaaaannaannnnacgggcgcggggggcggggnngnnnnnnnnnnnnnnnnnnnnnnnnnnnnnnnnnnnnnnnncnnnnnnngnnnnnnnnnnccnnncncnnnnnnncnncca

SEQ ID NO: 14702 - DNA, 1147 bp, Xenorhabdus bovienii
  unsure (1)..(1147): unsure at all n locations
  Genomic contig Name=Xb4151_4152.C161
tggtcctatgagcccttagcacttggcccctcgcccagggtcccgcaccctcttttgaaagggtatcctccccccacacaaaaaaacctctttttattttctccccccggccccctcttcccccctctgtttaaaaaaacaccgccttatatcaccccccccccaccaaaaaaaaaaacccatctctttttttgtgggggggaaaaaaccccccccataatatgtgggggggggcgccgnnnccccccccttattcaccaacacccccnccccccaaaaaaaaaaaatattttttttttttttccccccccccccccaaaaagccccccccccagagggggggcccaaaaaattttttttcgcccccccccgacccccccgcctnttttgtggggggaggaggganagcccccccccctcctttctcccctcctctcccaaaagcccgcggggggggggggttgttgtttttgtccccccccccccccncncccccccccgaccaagagagcacgggaggagtggtggcgcccgccggcgcgccgcctcccctnaaagaccccaaccccccaccccacccccggncggccgccgcgacggccgcgcccccccccccnccccgcntcctccccccctnntccnccccgaaacccccgaacacgacctactaccctttntnacnngtccgctgtccccccttgggngnccccgcccccgnnccccgnnnncccgntanngcgcggctctccgcccccgaccccccgcgcgcgcggccgcgccgcgtnggccgnctcgccccccgctnnnnccccgccccccccccaataacaaccgccgctantncctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14703 - DNA, 1165 bp, Xenorhabdus bovienii
  unsure (1)..(1165): unsure at all n locations
  Genomic contig Name=Xb4151_4152.C162
aggggagggaggaagggntnnnnngtggagtgctcccnnaaaggcagaataagatatcgcttaaaaaagncaatcgtggtnagaaaagctgcnctcngggnnanaaaaaagcggccccnnttgnnnngnntntttggggggnnnnnnnnnaaaagaaacgaagaccgggaaaaaaaaaaaannnnngggggggnnnncncnnnnnnnnnnnnnnncnccnncggcccccncccccaaccccaaaaaaaaaagggagaaaaaacccncaacaaaaaaaaaaaaaaaaacnnngggaaaaaaaaananacctgggggaagaaggagaaaaaattttttttttnnnnncccccncccccccaaaaaaaaaaaaaaaaggggggggaggaaaaaaaacccccccnggngggggnggggggggggggggggggnggggggggggggggcnggggggggggggggggacaaaaaaaaaaaaaaaaaaggggggggggaaaaaaaaaaaaaaaaaaaaatttttttttaaccccccnncccccaccncccccncaanncncccccccnccncccccccccccccccccccccaaccccccncnnccnccccccnnnccnnnccnnccccccccccnccnnncnncaccacnannacaccnanncncncnncccnnnncccccccccccccncncacnccnncnnnaacnacaanccaaccaaaaannnaacnaannccncaaaacnnnccaacccnnnccacacccacnaancaaccacaccccaaccnccccncacncaaancacnnnnnncaacaaaccaacacccacaacaccccccccacnnccccacacancaaaaaaaanacannnannnncaaatannaaaaaaannaaaaacnncccncccccccncaacaacaaccacccacaacccccccccaaccaacacaccaccccccaccaacacacccanaaaaacccancaacnccaaacaccncccccccnncaccccaaacaannccccccccaacnnccaacancacaacnancaaaacacaccaaatcncnacncaacncnnccacaaaacctncacacanaccaccccacaaaaccactcacaccaaacaaaccctacaaataanaacagaacacaaaaaaaaaaaaaaaa

SEQ ID NO: 14704 - DNA, 884 bp, Xenorhabdus bovienii
  unsure (1)..(884): unsure at all n locations
  Genomic contig Name=Xb4151_4152.C163
ngcnnnnnnnnnnnnnnnnnnnnnnnnnnnnnnnnnnnnnnnnnttagtctatgttccacaactggactgaactagttagacgctcgtatgaagatcccgccttgcgatgatgaacccttcagtattgaccaactaccttgggaccttttcgcgcccttggttaattgcttttgtgcgaaaaattaaagggggggccctcaaataataaggccccccccgcgcctcgcttttgggaaaaacttaggggaaaaacccctgggggttttacagaatacccggggaggaaaaaataaatttctcccccccctttttgctttttttgtgggggcccaattatttcccctcttaggagggggcgtgagaaaaaaaagacccttgtttttgtttatattttttggggggagggggggccaaatttttttttttgtgggggcaaaaaaagaaaaaaaaaaaaatttttttccccccccttaaaaaaacccgtgtgttttttaaaaaaaaaaaaaaagaccgggggggngggtttgtttttttttctttccnaaaaaaaacctcccccccccccccgcggggagggaaaanatatttttgtttttgtgtgggcgggcggcgcgacaannaaaaaaaaaaagggcctctccccccttcccctcccccccgagggaggaaggaggaggggggggcccccccccccccccccccaagattttttttttttttttttatattaaagaagaaaaactcctctcttttttttgttttttgtgttnncnnnntcaccaaaaaacacaaacaacagacgcctgtgtttgttttttttcttntnccccctcctttctataantanncataanataattnttttnattattttttgtgtggt

SEQ ID NO: 14705 - DNA, 1069 bp, Xenorhabdus bovienii
  unsure (1)..(1069): unsure at all n locations
  Genomic contig Name=Xb4151_4152.C164
nnnnnnnnnnnnnnnnnnnnnnnnnnnnnnnnnnnnnnnnnnnnnnnnnnnnnnnnnnnnnnnnnccccccnnnnnttttttnnnnnngnnnnnngnaannnnnnnnnnnngnnnannnnnnnnncnnnnnntttttntnggnnnntnnnngggnnnnnnnnnnnnnactttattttcgnnattttggnagccttcgggnttaccccccccgncgggnncagtttttttttancngncccttgnnnagnttggngggntattgnggggnnganggnccaaaaaaaattttaacncngggaatttttttttggggcgnnatttagnncttgnattttggcnacncaccaaattcaatttttaaatcttncgggtgtgggccttttttttggggcaatttttaaaaatttttccagatttttttttttattttttttaaaaacccgggtttttttttttttttttaggggngggggtttttttttttagtttttttttttagaaaaaaaccggggagttttttttttttttgattttttcccatttttttaggggggaaaaaccgggttttttttttttttttttccctttttttttgaaaaaaaaaaaaaggggggggaaaaaaaaaaatcctttttttttttttttccccccttttttttttttttttaaanaatttttttttttttttttttttaaaaaaaaacaaaatttttttttttttttttggggcttttttttttttctttcggggcgggggtttttttttttttatttttttttttttttccccgcgggggggggggggggggttttttttttttnaaaattttacaaaaccacacaggggggggtggggnnnnaaaaaaattaaaaaaaattttttttttttttttggggcggcggnntttttttttttttttttttttttttttttttttccgggcggngggggnnggnttnnnnnttttttttttttttttttttttataaaaaaaaaaaaaaaaaaaaaaaaaaccgccccccnnncnncccccccccccccccccggcgctgttttttttttttttt

SEQ ID NO: 14706 - DNA, 1210 bp, Xenorhabdus bovienii
  unsure (1)..(1210): unsure at all n locations
  Genomic contig Name=Xb4151_4152.C165
gggaaaccccccgcgggggcccgccccccnggnnggggnngggnnnnncccccccccccccgcgcggggccccccggngcccccccccgngggngccnnccccgcggggggcggggggcccccccgcgcccccccgggccncnnnncccccgcccccccccggggggccccccccccgcggggggccncccccnncnccccgcgccccccccccccccgggcccgggccgcccgggccccccnnnccccccccccccccccgggggggggnnnncggggcgcccccncggggggcnngccccccccccgggggggggcccccccgccccccccccgcgggggtgtcaagcaccaactgttttaaaccccggggggggggggcccccccccccccccgcgaggacaggaacccctttggggggtagcacgancnccgnnnnggnnnnccccccgnagagnnncaccaacacaagccagaccccgcgagaagttttttttcccttttncncccaccnggccccnnnnngnaaannggaaaaannnttaaaaacccnncccccnnccgcttttgccccttnccccnaaanaaaaaaaanaaaggaaagngggaaagaaaccacacaaaaaattttttttttnaaaaaaaaaaggggntaaaatttttttgggggnaaaaaaaattttttttttnnnttaaaaattgnaaaaaaaaaatnaaaaaaaaaaaaacccccaaaagggggttttttaaaggangcccccgacancaagaatttntttaaaaaaaaaaagtggtggtcccccccaaaaataaaaaaaaaaaaaaaatttggggggggggccccccgcgnnnnaacacccccacaaaaaaaaaaaaaaaaaaaaattttttttttttaaatcccccccgcccccccctgggggggaaaaaaaaaaaaaccccccccccacaannaaaaaaaaaaaaaannnnnattnngnaaaaaaagggccccccccaaaaaactcccgccaccccccccccccaaaaaaanaaaaaaaancccccccccgcggggggccccccccccgnnnnnnnnnntcccaacaaaaaaagcggggcgaaaaaaaaaaaaaatatcgcgggggcggggccggcgtcnnaaaaaaaaaaaacaaaagcctccccccccccccctagagaaaaaaaaaaaaaaccccccccccccca

SEQ ID NO: 14707 - DNA, 1305 bp, Xenorhabdus bovienii
  unsure (1)..(1305): unsure at all n locations
  Genomic contig Name=Xb4151_4152.C166
gaaaaangnccccccgggggcnccccccggcncccnngcccgggcgggcccaccccgcgnggnncnnnnncnncnnncccnnccnccggccggccccccccccccccccccccccggcggccccnnnnnnaaacccctnnccncacaaccacaggtaaaaaaatttaaaaaaaaaaacaaaaaaaaaaaaataacttaaatacgcngnngnnccccnnagaaaccaacacacaccccgnnagtttttttcccngggccacgggnccnnnggaannngggaaannntttaaanccccccnccccccaaaaaaaaaattttaaaacccaaaaaaatttaattgggccccccccaannggaaaaaaaaagggtgtttttctggggnaaaaanaaaaaaaaaaccccccggcccccggggccccccccccaaaaaagaaaaaccccaaacacccccggaaaaaaacccccccaaatttcaccaaaaaaaaacccccccgggnggggggggggaaaaaaaaaaaaaaaaccaaaaaaaggggggggaaaaaaaaaaccccccccaaaaaaacccccccttgcccccccccaattttttcccccccccccccaaaaaaaaaaccccccccccgggaaaaaaaaaaaaagggggttttttgggaaaaaaaaaaaaaaaaccccccccccccccccccgggggaaaaaaaaaaaaacccccccccccccccccgngngggnggggcccccccccaccacccaaaaaaaatttttttaaaaaaaaaaaattccccccccccccccgcccccccaaaaaaaaagagggngggcccccccaccccccccccccccccccttgaacgcccccaaacaaaaaaaaagggngnttntaaaacaccacaaaaaaaaaaaaaaaaaaacctatttaaaaaaaaaaaaacaaccccccccccccccgggggggagggggaaaaaaaaaaaaaaaaaaaaaaaaaaaaaatttgtggggggggggcccccccccccccccccccccccccccccccccnnnnnnnnnnnnnaaannngnnngnnaaaaagaaaaaaaggnngggggcccgggaaaacaacaacaaaaaaaaaaaaaaaanangaaaaaccccccccccccccccccccccccccccncggggnggggggngngnggggggnnngnnnngaaaacccnnngnggggngggcggggggggggcgcccccccccccccccccccccccccccccccncccccnnnggggngnnggggaaaaaaaaaaaagaaggggcgcaccccga

SEQ ID NO: 14708 - DNA, 1021 bp, Xenorhabdus bovienii
  unsure (1)..(1021): unsure at all n locations
  Genomic contig Name=Xb4151_4152.C167
gggaaaaaaccgcccncnnncggggggggggnncngggggnncccggnccccccaacgccggcngccccccccgcggcggagccngggaacnncaggcaaaaggtatttttaaaaaaaaaaaaaaaacgaacccgagcgtngggnccnannnnccccaaccaaaaggcgccccgcccccgnggagagaagntnntttgttattatatcccctccttntgnngnnggccccccacatacaaggggngggcnctccccccccnnnngggggggggggaaaaaaaaaaaangggggggggggagagagaaaannnaagnggnnnnnngttcttnnngtgaagnaaaaaaaanaaaaacgnnnccccccgnnnccccccgnnnncccccgnnnccgccnnccccccccccccgaaaaaaannnnaaaaaaaataaaaaaaacccccccccccccgnnnncggnntnnnnnccccaaccaaacccaaggggnnnncccccccccccccccttccaaaaaagnaaaaaaaanaacacccccccccccccctnncgcgggggnnngggggggggcncnccggggggggcccgggggggggncccncggggggggcnnggggggggggnncggggggggggnnggggggggcnngnnnnncctttcttcctcaatnaagaaaaaanaagnngcgaagagaaagaaaaaaaaaaaaattttttttttttnnnnggagagccccccccccccccctttttnntgnnggccccccccccccccccccccccaaaaaaaaaaaaaaaatnttcctncccgggggcggggggggggggggcggcncccccnnnnctcttaaaatgnaaangaaaaaaaannnnnnaanaaaacaccccccccccccccggggaaaggaaaacacaccacccccncccttctctttttggtgggngggggggnnggccggcccccccggccccccgggngaangggnnnnnnnnnnnnnnnnnnnnnnnnnnnnnnnnnnnnnnn

SEQ ID NO: 14709 - DNA, 1161 bp, Xenorhabdus bovienii
  unsure (1)..(1161): unsure at all n locations
  Genomic contig Name=Xb4151_4152.C168
aagggggnnggnngnagggnnnnnnnnnngggggtgnnnctgttaagggatganaattatactgtttanannagnctaatttgtnttnnttagggcnggttnntgnggnnnnnnnaaaaaagccngccccccnnnttnnnnnnnnnnnncttgngngnnnnaannnnnnaaaaagggccgggcgggggggnattaaaaaaaaanannnggggggggnnnnnnnnnnaaaaannnnnnnnnnnnnnnnnnnnnnnnnnnnnnnnnnnnnnnnnnnnnnnnnnnnnngggnnnnnnnnnnnnnnnnnnnnnnnnnnnnnnnnnnntttttgggggggnnnnnnnnnttttttggtggggggggggaaaaaaattttttttttttnnnnnnnnnnnnnnnnaaaaaaaaaaaaaaaaaaaancncccnnnnnnnaaaaaccccccccaaaannncccnnnnnnnnnnnnnnnannnnaaaancccgggggggnnnnnntnnnaaaaaaaaaaattttttnnancnannnncggggggggggcgaaaaaaaaaaaacaactttttttttttncagagaaaaaagncttttcttgggnggggggggggggggggggggggggggaaaaaaaggnccgngncggnnnngcnggccgcgggggggggggggtggaaaaaaaaaaaaaaangggggggggggggggggccccccgtcccctgtggggncggnggggcgggggggggcgggtggcggnggcgggcggggggccgcgcgcgcctgcgggcgcgncggcgcgtgcgncgggcgggngggggcggggcgngggcggcccggggcgggccgcgccgcgcgccgcgcgcggggcgncgnngggggggccggggcgggcgcggccggccgccggcggccgggcgggccccgccccccncncgtgcgggtgccgtgccccgcgggggggcggcggggggcgggcggcncgctctcgtggcccgcccccccggccggcncntccgcgccgcgcgcgcggtgtcccgtcgcccggggcggcgcgtgnggtccgtcgtccccggggtgcgcgctggcgtgcgnngcngtcgcgcgcgnctgcgcnncgccccccncccctcgcccccgctggcggtgacgcggaaaaagggtagacaaaa

SEQ ID NO: 14710 - DNA, 1015 bp, Xenorhabdus bovienii
  unsure (1)..(1015): unsure at all n locations
  Genomic contig Name=Xb4151_4152.C169
aagggctnnnncccgaggtctcccccaaggcagagaaaacttcgccaaaaanttgcactcggggnaaagaggcgcccctcagaaaaaannaaaaaccgccccnnnnnngnnnnnnnnctctggggnnnnannngggaagaagcccgancngngaaaaaaaannnnnggggggnnnnnnnnnnnnnnnnnnnnnnnnnnnggggnnannnnnnnnnnnnnnnnnnnnnngggggnnnnnnnnnnnnnnnnnnnngnnnnnnnnnnnnggnnnnnnnnnnncgcgggagagggggnnnnnnnntctcctttaannncnnccnnntcccccccccccccccccccccnccncnnnaaaaaaccccccaaaatnnnnnnnnnnnnnnnnnnnnnnnnnnnnnnnnnnnnnnnnnnnnnnnnnnttanaaaaaaaaaaaggggggggaaaaaaaaaaaaaaattttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14711 - DNA, 481 bp, Xenorhabdus bovienii
  unsure (1)..(481): unsure at all n locations
  Genomic contig Name=Xb4151_4152.C170
tgtgctgagtcatctagtcctggaatacatgtcgtatcgcttcgcgacggtgatatacacgagctttcccctgtggnttggaagtcctgtggtgccaaatgtacaaggcttcccggatgccgggttttccgttagaatgttcgggaaaaaaatcggggcaaaaacccggggagaaggggtaaaatttttggggcttaaagggggaaaaaaaggggggttcccccgttttttcggggggggggggaaaaatctggccaaaaaccccaaaaatttttaaagcccccctcacaaagggggggtgggggaaaaaaaaaaaagggggggggggctccttttttgttttaaaaaaaatattttccccccccctttaaaaaaaaaaaagggggggtcttccccgaaaagaatttctccccgccggggttgtgaatatcccccccccattttttttgtctaaaaaaaaaacatccgggaaaaaaatttc

SEQ ID NO: 14712 - DNA, 1126 bp, Xenorhabdus bovienii
  unsure (1)..(1126): unsure at all n locations
  Genomic contig Name=Xb4151_4152.C171
ggggannnnaaggnnnnnctgggtnccttaggagagaaagtggttaaattgcacctgttnnaagctcaaccgngtaanngaaaaccggnnnnnnngnnnnnntncctgnggggnnannnnggggagggcgggggggnnaaaaaaaaannnnnggggggnnnnnnnnnnnnnnnnnnnnnnnnnnnnntttnnnnnnnnnnnnnnnnttnnntttggggnntttnnnnnnnnnnnnttgtnnnnttttttttgggnnnnnnnnnttttttggttaagaaagggaaaaaaantttttttnnnnnnnnnnnnnntttnnnnnaaaaaagagagggggggggggananggggccccccccaaaggnnnnnnnnnngnnnnngngnnnngngggggggggggggggggnggnngaaaatttagaaaaaaaaaaaagggggggggggaaaaaaaaaaaaaaatttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnntnnnnnnnnnnnnntnnnnnnnnntnntnnnangaaaaantaatntna

SEQ ID NO: 14713 - DNA, 980 bp, Xenorhabdus bovienii
  unsure (1)..(980): unsure at all n locations
  Genomic contig Name=Xb4151_4152.C172
ggcaaggggnnnnnggggggccnnnnggggnnnnnncgaatgcggtgcccccccgcgcgaggaaggaaaaagaaaaagtctttagggaaaagggcctaatggggggnctgaacacagccgagntttttnacggctngangagntaacccccnncaaagnctnatncatgnaacnncggnnagncgncncanacnctgncnatnnctgggtgggnnaagnaanatntncnncaacaggggnattttaanacccatttcccctggaaaaancagtgttcaaaatcggggtaaaaacccggagncagacaagcttaaactggcgaaggaaaaaaaatccccccctttaatggaagggggaaagggggccgggcggcgcccccacaaatatcaaaaaaaacaaaatctcggggggcgcaaaaggggggcgcccgcacaaaaaaaaaatgcccccccgcggccctaggaaaaaaagtggggtggggggccgccccctttataaaaaaaaagaaagaggggcgcgggggggcggccacaacacccgggggggagaaaaaaacaaaaaaaaaacaacaaaaaaattttgggggggggggggacccacacccccccccggtttttntttggggggagaggaaaaaacccagcccccccccccccccnaaaaaaaaaaaaaaccccccccctatnggggggggcgccccaccaccccccttttgtggggggggcaccccaaaaaaaaggggggggggggggggggggcgccccccccccccccccgaaaaaaaaaattttgtggggggggaaaaaaccacccaccaccccccccctccccnctannnnnncccccacccccacaaaagagaaaaaggggggggggggaaaaaccccgcccccccccgccgcggggggggggggggggggggcgccccccccccccccgggggggtgaggggggggaggaaaaaaaaccccgcaccctca

SEQ ID NO: 14714 - DNA, 759 bp, Xenorhabdus bovienii
  unsure (1)..(759): unsure at all n locations
  Genomic contig Name=Xb4151_4152.C173
cgctgcnnnnnnnnnnnnnnnnnnnnnnnnnnnnttgaccgtaggngctccctgggccccgactcgtcgccgtaatcccccggggctatgctggcccggccgggaaccaaaccccccggggcaaacgggaaactttggcccgggagggcccccccccccttttttaaaccggggttcccgggggggtacccccccccaaaaaaaataggggggaaacccccccccccatttccccccccccccccccgtgttcccgcccccccccccccccaaaaaaaaaaaaaacccccccccccccccccaaaaccacggggggggtccccctcccaaaacccgggggggggccctccccccccccccccccccggcgggggggggttttttttttggggggaggggggagaagaaaaaaacccccccccccccccccgcgcgcgggggcgggggaggatatccccccccccccccccggagggcgcgccccccccccccccctctntttttttttttgggcggggggggacccccccccccccccnccnnnntnnncnccttttttttttccnccccccccccccggcgggncggggngnnnnnnnnnnnncccccaccccccccacccccctttttttttttgggggggggggnggggagagaaacaaaaatcaccttttttttttcncgtcgcggccgcgcccgcccccttncntaanaataaaaaagaaaagggaggggggggggggccccccccgccgcccc

SEQ ID NO: 14715 - DNA, 1188 bp, Xenorhabdus bovienii
  unsure (1)..(1188): unsure at all n locations
  Genomic contig Name=Xb4151_4152.C174
ggggaaggggaaagctggggnnnnntnnnngggnnnnnnnnnnnnnnncccgggggggggggtntncgggggggggcccccctcntncccccccttcnncccnnccccnncggccgcccggcggnccggnnggggggggggggggcccgcccngctccncccccccccgggcgcggggtggggggggggggcgggggccncgggggggagaggcgggggggcggggccccccccccncccnggggggggggggggggggtgtttttgggnngggcggggggcttgtcctctttttcttttttttttttcgggggggggggggggggggccgcnnccaccnncnccggcccnccncnnncgggggggggggggggggggggggaaaaaaaaaaaaaaannnaaaaaaaaaaaaaaaatcctttttatcctctcttgnnngtaagncacnnnnnaatnaataaagccccgcaaacctnttccctgttttttttnnnnngccccccccccccnntttataaaagccgcgaatttttagaaanaacccaagncccgctttnnnnannaaaaggaanngcagnaatnnaaccttncccgacgcgaacccccccccgngnagngaaactaaanagagnnccaccaatttngntncccaacccanngnccccaaaanngaanttatgnttttttttttttnatatnacccggataatttagnaaaaactcttcccccaaattannnaaacttaaaaaagtttttgcccccaataanccnctattaannngcccccccccanaaccccctttttnncccccgtttgaccccccaaaacncnctccgtttttaccccctncccctcaagtttttaaannntatttaccccgcccctaaaaataaaaagggagnncaaccaaccccccgttttttttcacccaaaaagcccccnccccacattaatccccccaccaagaacgcccccnccaggnaagancaccccaaaanccccctcttctctttttagacccctctctaaataaaccgccccccaggggncccgccctcctctccaaaaagaatntaacaccaaccctttcgctcttttgttttaaacaaaaaaaccaacaaacatattgggngaaatataanggggntataatatataatataactcncgccctcgctaagaaaga

SEQ ID NO: 14716 - DNA, 687 bp, Xenorhabdus bovienii
  unsure (1)..(687): unsure at all n locations
  Genomic contig Name=Xb4151_4152.C175
ggataagaagagacccccggttgactctagaggatcccctgcatatatcattaactatacatcatttccaagttattttgtcggtgttattttctttgttaatgcttttttagttattttatttgagcttcctattaataaaaaaatgaataatgtaaacagtaggctttcattaattctggggcttttattagcgggaggaggattttcattaatgattgatattaatagtgctattattcttataatggctaccatattatggtctttgggagagatgataatatttccatctataacacactatgttagttggatttgttcgaaactaagatcgaacagttggcagatgtgattgaaaatatttacagcgtactggaatccctgagtcgagttatcatggaaggcaagcagggggatgaatttgactcagcgctttcaaaccttgccgagcaggaagatatcggctggaaagtccgtctgtgtctgatggatagccagcgcgcgctcaacttcctcgtgcgtcgcgcccgcctgcccgctaatcagcttgaacaggcccgcgaaatcctgcgagatatcgaatctctgttgccgcataacgaatccctgttccagaaagtcaactttctgatgcaggcggctatgggtttcatcaatatcgaacagagccgcattatcaaaatn

SEQ ID NO: 14717 - DNA, 1068 bp, Xenorhabdus bovienii
  unsure (1)..(1068): unsure at all n locations
  Genomic contig Name=Xb4151_4152.C176
nnaaaaagggggggnnnnnnnnnggggggtngggggnnactttctggnntggggaggcngnctccccnctggggaggggcnaanccaaattaaaggtatttttggaaaaaaaggtcttctgggggagnnaatancggggactncgggttgcnncccggttatgtcagagttagttggggcggcgggccgcgaagatcaggagacacgtggatcaagcaggtcggccgcacgggggggtnaaagcgagattggcaggtagcggggggagggttcagaccggggggggggcccggcaagggggggaacgggggcgggtgggacctacggggggaaaccggagaggggcgccaggggaaaaaaagaggggcccaaaaagggcccggggggggcaacaatacggagcggcccaaggaaaggggggggggggcgaaacaacggggggggggggggggggagagctcggggggcaaatggggggtctccccaaaagggggggcaaaaaggggaaaaaaggggggcccttttaaataaaagggggcaacaaggggggggaaaatnngcnaaaaaaaccccaaaaaagggggggggggggggggaaaaaaggggggtgggggaaaaggccccccttttttcgggccccccccccccggggagggggcaaaaagggggagggggtggcggggccccctccggggacaaaaaaagaaagggggggggggggaaaaaaaaaggggggggaataaaaaaggggggggggggggggggggcaccccttttttaaaaaaaggcccncaaatgggggggggttttctcgcccgggggggggggggaaaaaaacaccacctcctaaaggggggggggggggggggggggtgaaaaaaaaaaaaaggggggggggggccccccnttnnttttgggggaaaaaaaaaaggaaagagagggggggggttttncgggggggggggggggggggggggccgccccacataaaaaataatataatatttttgggnnnnggggggggggggggtcgggggnnnncgggggngncaagggggggaacagaaa

SEQ ID NO: 14718 - DNA, 1126 bp, Xenorhabdus bovienii
  unsure (1)..(1126): unsure at all n locations
  Genomic contig Name=Xb4151_4152.C177
actgaattaccgaatttnncgangcnttcggnntacccnngaantngnnactattnnctnnngagtggnntcangaattaacngtatggtntngggaaaancnctaatatncnanantctggnnaagntatacagntttatacacacccgcgaaaattataagtggggccccggnaacaacctcccgcctttannatttgcccacctcgcggggtctcttgaaaagggtgactctgtctgagcgccccccatattttgtaatagtgggggaacacaaacccgcgtttttggtgcgcggggggggatgttttccccgccaggaggggggctcttctctccgagaagaaaatgggtgggggtgggggcccccacaaaccactcccccccccgaaatatttctctctctcttttttttattaaagagtaaaaaaaaggggtgtggtgtgtgtggaagagaaacacccccctcttcttctttgtgtgggagagagggagagggaggggggggggcgcgcgcctcctcctctctctctttgtgtttataaaataaaaaaaaaagaaaaaaaaatttttttttttttgttttctctccctcacaaaggaggggggggggcgggtcgcttatatataaataaaaaaaccccacgccccccccccccccccccggggggggggggggaacattttcacacaaccccncggtgtttttttttttttctccctctcccccccccggggggtgtttttttttttttgtttgtggggggggggagacccacacccccccccctctttctttttttttntttttgtggggnggnggggggggnggngnnnnnnaaaaaaaaagagcacccccccccccctccccaccccctcccccggcgggggggggagaagaaggtgtttttttttattttttgtttttttttttttccaaaaaaaaaaaaaaaaggggggggggggggggggctctctcctccctcccttcctcccacaaaaaaaaaaaaaaaccacccaccccccccccccccccccttttttttttgttttggggggtgggggggaaaaaaaaaaaaattatttttttttnnnnnnnnnccccccccccccgccggcggaaaaa

SEQ ID NO: 14719 - DNA, 875 bp, Xenorhabdus bovienii
  unsure (1)..(875): unsure at all n locations
  Genomic contig Name=Xb4151_4152.C178
nccccnccccnnnnnnnnnnnnnnnnnnnnnnnnnnnnnnnnggggccnggnctttggcgtggcgctgcggtgacttaagatccctgcccagttatccgcaattatgactgaaccatccctgagagcatagatgaaaatactcccgacgcggccggaatgatattggcctcaagttgggggacgttttaaatggcgtacctatgggctgtgactcctaattaaagggggggggtctagctgacatacgtaatgaatgaatgtgtttctttttctaggnanaaatggaggggccccccttagaaaactttcttgggnncctttgggannncccctttggnncngagntttnncgggnnnncactttccttnngaagnggaaaggttttatnccccnccccgggccccttttttggggngggaaanaaacncttattctctggnggggggggggctttcaaaaaaaagaaccagaggagggnnnnnncttttttattaaaaaancttttttttttataaancnnncntttttttttttataaataaaacccnncccccaaaaaaaaaaaaaaaaagggggggggggggntttttttttttttttttnncgcagaaaaaaaaaagaaaatctcccngggggggaaaaaaaaaatttttataaatttttttttttccccaatattnggggnnggtttttttttttgtggggggttaataaatgggggaaaaatttttttttttnnaactaaatatttttgngggggggggngtttggggggaaataaancccccttttttttttaagagaaacctctctttattatatagnnggggnnaananannanaagagagaggtttttcttcccccacaaaaaa

SEQ ID NO: 14720 - DNA, 892 bp, Xenorhabdus bovienii
  unsure (1)..(892): unsure at all n locations
  Genomic contig Name=Xb4151_4152.C179
ggacttactgggcgnnatatacgacanctttgttttnacnccctnnctaancncctaanttattnnaacggnnccnccggnnnacncccaaaaaanaaacacccgcnnnncactttnaaaanaaataanccggggggggggntttaannaaaagggngttaatntattnnattatgggggggggggncccctttnccccccgggntttaagaggagcccaaaaaaacttttttggggggggtttttttttttcccctttttggccagggaattttaaaggtgggttccctggggcccaaaaaaataaaaccccctataacccgggggggttttcctttcccccaaagcccattgggggaaaaaaaaacccccccccccaaaaggggccgggaaaacgcggttttttttgggggccacaacccctttaaaaacctggggggggacccccaaaaatttaaccccccccccacaaaacaataatatttttttttttgggggggcgttttctacaattttttttaccccccccccccccattatttttttntgttttccccccccccccctctggggtggggggccccccccccaaaaaaaaaaaaaaccccttcttttttttttnccccaccccccccccaaggagagggggaatatccccaccccctctctctttttattttntgtttaggagagaaaaaatatattctcccccaacaaaaaatatgggggggggcggggcccctttctnntttttnntttcatcccccaccccccatttttttttttnntattaatatnnnnncccccctcccccttcttttttttaaaaaaaaaaagaaacgcggcggcgggggcggctttttgtttncttctaaaacacaaaaaagaaaaa

SEQ ID NO: 14721 - DNA, 1329 bp, Xenorhabdus bovienii
  unsure (1)..(1329): unsure at all n locations
  Genomic contig Name=Xb4151_4152.C180
ggggannnnnnngggggtgncccttgagggaggnnaaatgcgggttaaaagaggacctggggtnaagaagcgcgcaccttgggnnannngaaaaaggcgggcccccantaaggaaaaannttctcnnggggnnaaannnngggggggagaccgaacncggnaaaaaaaaaannnnnnnggggggnnnnnnnnnnnnnnnnnannnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnggggnnncncnnnnnnnggggggaaagaanagggggaaaaaaacccttttttttttncccncccccccccccncncncnnnaaaaaaaaaaaannccnccnnncnnnnnnnnnanacccccccccccccnncnnnnccnnnnnnnnnnnnnnnnnnnnnnnnnnnnnnnnnnnnnnnnnnnnnnnnnnnnnnnnnnnnnnaaanaaaaaaaaaaaaaaaggggggggnnanaaaacaaaaaaaaacaaaattttttttttcnncnnncnncnnnnggnncnncncnnnnnnnccncncccnnncccnnccncnncccccncnncccnccccccccccccgggcgggnnnncnnnncnnnnnnnncncnnncncnnncnccnnnnnnncctccctctccctcccctctccccccccccccccccggccccccccccccccccnccccnccggggcggggggggngggccggggcgggccggggngcgcggggcgggccgcggagcgccggggcgcgngcgcgggcggggtggngggccggggggggncgcgcggggccgcggggggccgcgcgggcgacgtcgcgcccggcggcgcngcggcggggnggcgcgcgggaggggggcggntggcggcggngcggnngncggggcgggcgcgcgcggcgcggggncccgcggcgtggncgggnggaggntgggggggggggggggggggcggtggcgtntnnccgntggtcagcggcgnggaacggacgcgcgcgccgccgccggccggtgcgcggcgcnccgngcgggggggggggccgcngggcgccggggagaggcgggggnnnggcggcgggggagncggacgcgcacggggcggccgagcgagcacgaggcggcgcgcgnggccggggggggagggacgaggagggnnagaagggcggaggaagagcggggagggngcgagagacntgggtgtgagcgccgnccagcaccactaagctaggcacagaacaaacaagacagacacaaga

SEQ ID NO: 14722 - DNA, 923 bp, Xenorhabdus bovienii
  unsure (1)..(923): unsure at all n locations
  Genomic contig Name=Xb4151_4152.C181
gccctaagaacctttgacctaggcccctggnncgggntncgnaacttccttgaggaggntangcccnncgtnctnnaacnatnatnnaccctctcttcccctctngnnactaatnttcttaatnaanaaactgatttaaaaaaaaagccagggcaactttnttaaaattgggccccttgggcctttttttttttttgggggaccaaaattttttttttttaaccaaaagaaaaccttttaaccaggggaaacccccaaaaagggccgggccttttgggaattccccctggctacccctaaggtaaaatggcccgggttaaaaagggttatttatttaaaaccatttttctctttcattaaaggggaaatttttttgggaaaaaaaaaaaaaactcctttctttcgaaaaaccgcttttttaaaaaaaaaaatccccgcgttccccctttttttggggggggggcgctggggctttttttaagggggggggggggttatataaagcgcccccctatttataaaaaaccgcttttttttttttcggggggagaaaaatttttttttcttggagggggggggnaaaaatatacccaactttttttcgaaaagaaaaaaaaaataaaatatcctacccacacccaaaaaaccggggggggctcttcttttattaaggggggggaggaaaaaaaaaaaacaaaaaaccgcggcggggggggggggtgccccacccttatgngggggggggggggagaaaaataatatttttttttcnncagaaggaaagggagagagaagnnagagnnnnatntntttttttctctcccggggggggaggaaaaaaaaaaaaaccccccgccgtggtttttttnactaacaccccccccnnnngggngagagaagagaanaaaaaagagtggggggcg

SEQ ID NO: 14723 - DNA, 720 bp, Xenorhabdus bovienii
  unsure (1)..(720): unsure at all n locations
  Genomic contig Name=Xb4151_4152.C182
tgatacgaattcgagctcnggtacncccggacatggactggagatgccaatgccgatgaacatgacactgtgtagtcttccgtatggtctatcgagtacacgacgagaacagtgcatgaaagccacgcgcgagagattcatctcgtgtgagcagctcaagacangattaagacccgatgcatcgagattgctccctgacccgttgcgacaattaggggccaaggtaccctgaacggttcccatgacgccgggtgacctaaaattgaaaaaaaatggcttccggttacccggggacgtaagcccttttaggaaaattgccaaaaaaaaaaaaacatccccccaatggaaaaaaaccctcccggggttccccctttataaataaanaaaaaaggcccccccccgccgaatttttttttttttttggggaaaantttttattttcccccccaggaagactccctttttgggggggggcaacacaaacaaagatggtgtggggggggggcgccccccttttgggggaaaaaaaaaaaaaaaaggattttttttttttttgtggggggggggggggcgggcgcggnnncccccgcgggggaaaaaatttttttccgcggcgtttttttttttttgggggggggggggggggagaagaaaaaaaaaaccccctccccttctaaagaaggagaggggnnnnnnnnnnnnnnnnnnnnnnnnnnnnnn

SEQ ID NO: 14724 - DNA, 1148 bp, Xenorhabdus bovienii
  unsure (1)..(1148): unsure at all n locations
  Genomic contig Name=Xb4151_4152.C183
tataataataacntnttttnttatnctcctaatttttttaatttttacacnnnnnnccaactttttaattcnnccnanncttcnatnnattaaattttnttattcccccangaaaagaaactttatctnangtaaaaaggagtggaatantggggggtgggtgnataggccaccacccctgctaatgggaggtggggggttaggtganaagtgaagtggcgtatgcgctggcccgttcgctccgttctccagattaattaaaataaattataaaatggggggggaggatataagtagaagcacaaaaaacacataaaagttttttttttttttttacaacaaacacaccacaccccccccgtggggtgggggggggggacgggggaaaacagcgccgcccccaaacaccccgccagagagaaaaattttttttttttttttttaaaaaagcctttggtttcagaagggggggtatcccccccgnccnctagggnnnaaaaaganngaaccgttttgnccccggcccccaaacttntgngccttgtgctttgcccccggtaaaaataccttttttcccccgcgttttttcccgtttcccaacccccgaaaaccccaaatttttccccaaaaaaaattggcccccccccccacccattttaaccccccccccacccaaattttttttttttgtggggggcgcccttttttttttccnnnnnnnccgcgnggcccaaattaataataaattttttttttccccccccccccacaaaaaaaataaattattttttggggggggggtgccgccccacccatatattataaatatataatcncccaccccccccgcggggggggggggggttctcccaaaaaaattttttccccccccgcggaaatataaagagaccccccccattttaattattttggggggccccccccggggggccccccggtttttttttttttaaaaaaaaaacccccccttggggttttcccccccccaaaataaaaggggggccccccccccataaaaaaaaaagaatagttttggggccgcccacccccttttttttttttttaaaaaaagaggggccccccccctctcgcggggcgcccacaccatattttttttggcttccccc

SEQ ID NO: 14725 - DNA, 893 bp, Xenorhabdus bovienii
  unsure (1)..(893): unsure at all n locations
  Genomic contig Name=Xb4151_4152.C184
gatcgatcgagtcggacatgccatatgcagcgtatcgttcagaagtgtttgattactgggcctttctgatagcaggcaggcctacacaatgttttttgattcggcaaagggcattccctcgtgggtggggatatttttccaaaagcaaaaatacacccccattttaaaaggtgttccccgaataaaacggggggtgttttcacaaaacacccccggttatttttgtagagaaatatatcccgccggtgtggtgtggtatattaaaaaatttctcctcctccccgccgcccccaaaaaaaccccgggggggagaaacaccccggggtgtttttttccgcgggggggggggtttttttcccaaacggggggggtggttttttaccccccccccccccctttttgtgtttgtagaacaaaaaagagaaaagaagaagagagggggtgtggtgtgtttttttgcccccccgccccccaccccaccccgccgcccggggggggggggggggtggtgttttttttttcttttttttttttttggggggggggggggggggggaaaggattccttttttttttccccccgggggttcttttccccccacttttccgggagggaggacccggggggggggaaaattttttttttttttgtcctcggggggcgccctcccccaggaacaaaccacaattattgtttttttttgtgtgtggggggcgggctgagtactctcatacctctttctcccgagggggnggntatnnnntnntatacngttggcgggncgtcgggtaatcgccagagtatgtaattaatattatgggtgggggggggggttgatcgttcactgatattcagatggattcaccagccggcacggcgacgaggacgcgtt

SEQ ID NO: 14726 - DNA, 826 bp, Xenorhabdus bovienii
  unsure (1)..(826): unsure at all n locations
  Genomic contig Name=Xb4151_4152.C185
tgannnnnnnnnnnnnnnnnnnnnncctcgtaccctttgctctgcatgatctctgtcttttcctgtaacatcattacagtctcctgtgagtaacattgcaaacaccggaggaaattgcgcctactgactgttaaaactattaccaccacgattactcaccgatacagagcctcggatgctctgtaacattacacagcagatcgaatacccgttatgtatgctgccttatcctgcctcatcccagatgtactgccagcatatgctgtacgacagcaaggcgacataggacgaactgatctgtactgatcaccgtcttgatgatctgatgatgcatatgaacttgcaacatcgcttactccgaggattttgtcttttcgaaaacggcaaaacgaattcctgaaaaccaccggcgttttgttaaaaatggctaaaacaagccctccggtaaaagagtcccccttttaagggggtttccccccgggaaacaacccaatggggggcaatttttttttccaaaccccccccccccccttggttttttcccccccccgggatccccaattttttcccccccaaaatttttttttttttaaaaaggggggggaaaaaaaaccccccccccccccccctcttgttgtataaaaaaaaccccgcccctttatatttatctttttcccccgccaaaattttttctccaaacaaaaaagggccccccccccctgtttttgttaaaaaaaaaaaaanccnnngggggttttcccgcgcagagttttttttttttgtgtgcgccccggggggtcttccctctcccaaaaagaaagaaaaa

SEQ ID NO: 14727 - DNA, 1093 bp, Xenorhabdus bovienii
  unsure (1)..(1093): unsure at all n locations
  Genomic contig Name=Xb4151_4152.C186
nnnnnnnnnnnnnnnnnnnnnnnnnnnnnnnnnnnnnnnnnnnnnnnnnnnnnntttttttttgnnggnnnnnnnncnnnnnnnttnnnnnnnnnnnnnnnnnnnnnnnnnnnnnnnnnnnnnnnnnnnnnnnnnnnnnnnnnnnnnnnnnnnnnnnnnnnnnnnnnngnngnnnnnnnnnnnnnnnnnnnnnnnnggnnnnnggggngggttgnnnnnnnnnttgtttgggggggttttgggggnnnnnnntttaaangggtttctttttttgggggggnncgncaangatcattggtagggcnnnnaattanaaaaaagccgcnnctgttttncgcgcggtnntntggnccncgnncggggnttnnaccactngnncntannctntnccacggnnncgnggntntncaaatnttnccactggnnagatnctnnncgggggtggggagaaaacagncnnctggggcccaattcattttaacggccccattttcggtgggccagggttccgggnaaacctttacccccggaacaagggggaaatatttcggccttaaccctttaagggaacacccggtttattaagttttaaccggggcccgggccgggtttttcctgggggggggcttttccgaaaaccaaaaaaaaaacttttcccccggtttttttcccccccctttaaaaaaccccccccaaaaaaaaaaaaaaaaaaaactttttttaaaaaaaaaaaaccgggggggaaaaagaggggtgtgttcaaaaacaccccccggttataaaaagggggccccaaaaattatttttttttggggggtgttttggaacacaaaaaaggggggggggggggggttttntttttaatttataaaaaaaaacaagagtgttggcgcgccacccccccacggggggggggttaattttttttaaaaaaaaaagggggggccccccccccntttttttgtggggggggggggaaagaaaaaaaaaaaaaaaccccccaaaaaaaaaatttctggggggggcccccacaaacaagagggnttccccctctttttttttttttncccccccccacacgagaagaaagaga

SEQ ID NO: 14728 - DNA, 772 bp, Xenorhabdus bovienii
  unsure (1)..(772): unsure at all n locations
  Genomic contig Name=Xb4151_4152.C187
gacttgcgtngcaaacaccccaggtttgagtntagnagatccccctttgtgtgtaataccaatccaatctctggtattgaatctggctacagggattttgggttatatcggtgtgcccaagctctgtatatcacatcccagaccgtgtatatgcagcgatcactgtcttcacagattgaatctcgcgtctattgtaaagaggggaactcctgtgctaatactattcttgagttttggcggtgagctgcacacctattatggcgttatcccacatctaagaggtggatcttaacattggtttatcggcttgggtaatgtggagggtcggagggttgtgattgaaaaacaattgccccctttaaaaagccaaaccttttaagggtttggcattaaaactttaaagaaaggggcgcaggggggtcccacaagaaaaggttttaatttctcacaatttttcccgtttttaatggggggggaaaagggagggagtttgggggggctccttttaaaacatttttttttttttgttttttccccaaaaccccccgggggggtgggaaaaaaagtttttttttaaagttttttttttttatatctaaaaaaaaaaaaaaaaggggggggggggggtgttttttttgaggagagaaaatatatttttttttttttttttttgggggaagtgtgtttgtgttattaaaaaaaaataaaaaataagaggggntngttggtggtgggggtggtgttttttttattctccccccccccccccccc

SEQ ID NO: 14729 - DNA, 1418 bp, Xenorhabdus bovienii
  unsure (1)..(1418): unsure at all n locations
  Genomic contig Name=Xb4151_4152.C188
ttttnnnnnnnnnnnnnnnnnccccccccgtttnccgatacatcagctcgtacccaataaccaaattgctttgcgaaaaatcctctttttttcggggataaccggggagggtttttgggagaatatttataacggggggcatcccgcgggggaaaaagaaaaaaaaatattttttttgtttgtgagggagggggggattacctcacaaaaaaatagttgggtgccccccccccccggctgggaggggggcggcgttttttttttttttttttttttctccccccccccccccattttttattttttcctcacaacacgacaccacacgctcccgggggggggggggtgggtgcctccccccccccccgttctatatttaaataaaaaaagaactaccgcccgcagggggcggccccgcccccccccactaatacaatacctaccataagtttgttataaataaaaagaaaaaaacgaagggaggccntctgataatcaaccgagacgcaggaggagagacgcggagntatattaagcacgcnncacatatttctttctactctcccttctatcataagcagcacaccggcaacacaagcacctctcacccacgccgccccccatctcctgcctcctagattacgccggcgaccgctcaacgcgcgtgcctagctccactcctacccagtatataacaaaacgagcatacataataacgcgttaagacgagaagtatagatgtaagtgctacacagacacacgtagctcctcctcaccacaccacttgtctcgcactggagacaaaacgactcgcagtagtgcatctcgatctattttctcgtcatagaaatgatttaacctacatatgaatcaacctctcgcacactgccactcatgccgactctcactctcgcgctccccacactcgacgcgctcagcggcgcagatcgctctaatagatgactcctgctctcgactctcactcgnctacgcccacgcacatncacgaccggtatctcagcacacaacgacgcatactccgtactccgcacctcgaaccctaatcctcacaacactatcatcgactactagcgctntcggtcagtactatactctcgtcacnagtcaccggaatacgctgcacacgccacacagaagacataacacgcacgatcacncactccctcatctacagcgcgacctagtaacccgcgntacgccgcgtcgtgggcatctgccgtgcaccagccatcacgatcgacgcctgacgcctagtcgtagacagcaacacgacngcttagagagacntatcgacgatgacgacatcagncgtcgacgcgcacaactactaactatacaaccctgctgcactantaccgacgacgtnactactncatnacantncaatctcgctgaag

SEQ ID NO: 14730 - DNA, 717 bp, Xenorhabdus bovienii
  unsure (1)..(717): unsure at all n locations
  Genomic contig Name=Xb4151_4152.C189
ctgaattacgaaatttcgnaaggcttcgggnttacccccaataaattcgttttttggacttagncgcggaatttgccccaggtagtcattgtcccaccactaaaaaaaaataccccgccggggggaaaggcctttctaaattgggcccccttgggtctggtttttgcggcccccttagtatttacttggggnacccatggngcctgtgggatggagcatttattccggtgggagaatccccggcaaccgcggttcaattcccgagggcctttttttgggttttccccgggggggggaaaaaacgtgggggggctttggccaacaaaaatggggagagacggccaaagttggaattaatttggtgggccccccccacccccggaaaaaaacccggtttgttttcaccgggggataacaaaatgtggggggntatttgggaaaatcccctccggggcaaaaaggggggcctttttgggggcntaataggcccccccttttttccccctaaaaaaaaaggggggggggaatttaattttacccccccccccccgggggggggggaaaaaaaaaaaaatcccgtggtattaaaaaaaaccccctctgtgggaaaataaattatcccacccccntttngggtggttgttttttttttttcccccccccccccctaaaaacaaccccccccttttttttttttttcggcggcaaaaaaaaaag

SEQ ID NO: 14731 - DNA, 1122 bp, Xenorhabdus bovienii
  unsure (1)..(1122): unsure at all n locations
  Genomic contig Name=Xb4151_4152.C190
nggccaagccttntggcattggncccntgnnncnagnngnnntnncgnnnnaccnnttnnccnntttaaaagnnnnagaggnggngnnaaaattnnccntccctctcctttccccacacaaacaaaaaaaaaaaaaaaaaaatttcccccccnttttnnnntttnnnttttnntttnnnttgtgggggggggggggnttttttaaaaaattttttaaaaaaaaaaaaggggttnttttgggggggnccccccggggcgnnttttttttaaaaaaaaaaaaaaattttttttttttttggggggggnntttttcccccccgccgcggggnaaaaaaaaaaaaaaaaccccccccccccccaaaaaagggggcccccccccggggggggggttttaaaaattaccccctnntttncactnnaaaaattnttcccaattttttaaaaaaaaataaattttccttttttttgggaaaatgggggttaaaaaggggaaaaatttaatttaaaaaaaaacccgggggagatttaaacccccccntaaaaaggggggnaatattggtgggggagaaaaagggggcgcgcaacaatttttntaaaaaatttttttttttttttaaagggggggtccccgggtttatttttanacccccccaaaaaaaatttttaacctttttccccccccaccccttataaattttttntttaaaaaaaagggtggggttttgggaaaaaggagggaaaaaaacccccccccttttaagggggaaaaaaaaaactttttttttttaaaaagggtgggtaaaaaaaacccccccaaaaacccnttttttttttccccccccaaaaaatattggtgggggggttttcccaccaaatattttttttttttttttctcccgggggggggnattttttatggggggggagaaacaaaccccccttttcccccttnncccccccctnttccccctttttttttttttaaaaaaaaatatggtgggggaaaataaggggtggggtgtttttttttgggaaagagaaacgccccccccctcgggggggggggggggttttttnttttataaaatataaaaaagaggggggcccgccgccccctttttt

SEQ ID NO: 14732 - DNA, 430 bp, Xenorhabdus bovienii
  unsure (1)..(430): unsure at all n locations
  Genomic contig Name=Xb4151_4152.C191
ttttcattcactgtccttttaatgtgttttttcgtgtacggtgtacttctgctgcaaggttcttgtatgggacaatgcaattgccaaaacactgggtgtttttaaacttttgcccattttggggaattttattttttaaaaaccttttacgtttttttttcccccccaaaaaaggggggtttttttttgagggggttttttcaagggggttttttttttttttttaaaaaaaaaaaacccccctgggggggggtttttttcccccccccccccccccggggggggggggaaaaaanncaaaaaaaatttttttttttggggggggggggtttcccccgggcaaaagaggttaaaccccctttttaaaaaagttttttttttttttttgggtgggaatttaatttttaaaaaaaanggcgggggggggggg

SEQ ID NO: 14733 - DNA, 442 bp, Xenorhabdus bovienii
  unsure (1)..(442): unsure at all n locations
  Genomic contig Name=Xb4151_4152.C192
ggggggttttgtttgaaagaaactggtcnataatcagttgnnnnnnnnnnnnnnnnnnnnnnnnnnnnnnnnnnnnnnnnnnnnnnnnnnnnnnnnnnnnnngcggagcttgccaagtctggtgagccgcctttatcttgcgccttttaccacccagatacggacgacaaacaggggttatccggggtcacggcgcagggttttaccctttaaaatgggaccgggtaccccattgaaacccaataaacgggcaaaaaaccttggaaattcggtttggggggggccttttgggcccaattttcaaggttttaaactttccccaataggggaaaactttggggaaacatgggggtttttttaagggggggtcaaaaattttccaaaaaaaaaaacccccccttttttttttttggggggaagaatttttttttaaaaaaacccc

SEQ ID NO: 14734 - DNA, 899 bp, Xenorhabdus bovienii
  unsure (1)..(899): unsure at all n locations
  Genomic contig Name=Xb4151_4152.C193
agcatannnnnnnnnnnnnnnnnnnnnnnnnnnnnnnnnnncgtcggcagaacggttttaagatcgctatgtggccgccgggtccagttagagatacctcgccataactaaaacttttaggatcccttatcaactcaaaacggggaatcggcccaaattcccggggtttttatctttaaccggggggcgggccccagggtgtttaaacccaagggggggggccaaatccccatttcccccccctttttgggggggggggggggggggcgaacaccccccccctaaaaaaaagggccccccacccaaccaaattttttttgtggggccccccgccccctccccgggagggagaattatataaggggggggggggtattttggggggggggagaaaaaaaaaaaaaaacgggggggtgtcacaccaaaaagggggggggggcgcgccccccccccccccgcggggggggggggggggggggcgcccccccacaaaacaaaaaaaaaaaccagccggccggctgtttgtgtgtcggccgcccgcccgccgacaaaaaaaaaaaagagagagggggggggttttttgggggtctctcccccccccccccccccaacaaaaaaaaggaccccgcgggggcggcgcggggcggggtcttgcgctctcccccccgcgaaccctaaacaaaaacacacgaccctatctccggcggcgccgggcggcggggtggcgcggggtgggcgtgcgggagaatggaggaaagggcgcgcggcggccgccgggcggtttcgggtgtcgtgcgccggctcggcgagaacccgacgccccgcgcgcgcacggtccgacgcggcgcagagagggggggggcgcgggaggtgggcgggtggggtgtggccggcgcgca

SEQ ID NO: 14735 - DNA, 839 bp, Xenorhabdus bovienii
  unsure (1)..(839): unsure at all n locations
  Genomic contig Name=Xb4151_4152.C194
ngcattnctaagacgncagccctataggttcgaagattgggncncnctatctanagcctaagccaaagnnnctnncgnnaanacgngnncnccggcccccnaagnttggttnnnntgggggggnnnntaaaatagaagagggggnngggnggnnggtnttttttaaaaaannttataataaaaannnnccccnctcttttttgggggggggggcccccccccccggagaaaaaaannnnnnaaaaaaaaaaaaaaaaaataatatttttttttnnccccccccccgggggggggggggggggggggacaccccccccttcttttttttttttttttttttttnnccccccccccccccccccccgnngnnngnggagaaaaaaaaaaaaaanaaaaaaccccccgcccccccgcggggggggggggggggggnnngngnnnnnnnngnnncgccnccccgccgccgccccgcggggnggnggncttcttcctccncccnnnnnnaaaaagaagaaagaagagaaagaaaaaaanacnnccctccnactccctccccctctttcttttttttttnntnnnnnnnncgncnncccccccccccnccgggcggggnggggnggngngngnttntnnnnttgtgtgtggtttnnnanancccccccccccctcccctcttttntttttntangagggggngggggggggggggggnnnntttttttttttttttttttttttttnnnnnnnncncccccccccccccccccataatatataatnaataatataaatnttntnnnnnnnggnggggggggnngnggggggcggggggggcccaa

SEQ ID NO: 14736 - DNA, 1046 bp, Xenorhabdus bovienii
  unsure (1)..(1046): unsure at all n locations
  Genomic contig Name=Xb4151_4152.C195
aagaattatnattttgtggggtggtacgnaaaataaacacctcntntatgtgttcgngantatngngngnnncnnccttacttaaacttagnnnnccnattgggnnnccttnnnncgnnnnggaannnccggggggnnnccnccgggnnccnnnnccnggaatttggggttttgggggggnnnnattaaggggggggggggggngnnntattataaaaaataattttaaaannncccttttttggggggggggncncccccccgggagaaanannnnnnaaaataatatattatatttttttnnccgccggggcgggggggggcccttttttttttttttttntaaaaaaaaaacccggggggnaaagaacctcttgggggncccccggaaagggttttcttttccccgggggctttttcaaaaaagagaaaaataagggggtttgggcccccaaaattggaaaggggggttttattttctggcgggggccctttggtgtattttgggggncccccaaaatttcccctggggtttaaaattttaacccccggatatttttccaaaaggggaaatattgcccccgggaatttgtcccacaaggtttaaaaaaataaagtttcccaaaagagaaacggtggggcccactttcgaaaaaattttttgggggcaaaaaatagattttttttaaagggaagaaacccccccgggaatattttttttttttttttaaaacacttaaaagggggggtgtggttttttttttgggccgggaaaaaccccaaaaaaaaaaaaaaaattttttaaaaattggggggggggggagaaaaaaaaaaaaaccccccgggtttgttgttttttccccccccttttttttatacaccccccacacaaaaaaaagaggcgcggtggggggggagagaaaaatctcctcttctgaaaaaaaaaaaaaataataaccccccgggcggggggggggttgtttttttttttttttttcaaaaaaaaaaanaaagggggggnttnnnaaaaaaaaaaagcgatttta

SEQ ID NO: 14737 - DNA, 800 bp, Xenorhabdus bovienii
  unsure (1)..(800): unsure at all n locations
  Genomic contig Name=Xb4151_4152.C196
ctgatatcgattcgagctcggtacccctgaatgccgacatatccatactagatcgccgcacgagatgaacaggctattcaggcgactactgctatcagcaaagacatactggcgctagatatttcgacggataccaaactcgggtcgattgtggagtaaatgggcgcgacatctgatatcacctagcgccagcaagaagatgttacacccaaaacgcgttcaaatggtatcaggctggacttagctcacgccgcgctgaagttaggctcgataagaggcaagctgaacgacatgctgcattcactgtaccgggacgcacgctgacgtatgaacatgcctcaatccacgacaataacctctatgcctatctgcgatgtttctatcaaccgcctttcaacgcttgagggtaaggtaaggacccgggcaaaaatttcccccctttgggcctggaaattaaagggggngccccaaatggctctcattgccgccaaaaaaatcccaaaagggggtgaaattggcccccaaaaacccggtccccttttttagacgaataaaaacccccccgggggatcaggaaacactccccccgggaagagggggggaaaaaaaaaaaccccccgggggggggcttttttttttttttataaaaacaagggggggccccccctttttccccccccgggggggggaagtttgtgtgggccccccccccaaaaaaaccgccggggggggggccccccccaggggggggttttttttttttctccccggggcggtgttatatataatatttattaaca

SEQ ID NO: 14738 - DNA, 760 bp, Xenorhabdus bovienii
  unsure (1)..(760): unsure at all n locations
  Genomic contig Name=Xb4151_4152.C197
nnnnnnnnnnnnnnnnnnnnnnnnnnnnnnnnnnncctatanattgttgnccctnagttatnnnngnnnnnnnnnnnnnnnnnnnnccgatacaatcgagtcgtaccatcatgtatggcgagcgacgactcggctctgacttgtgatagcgttttgacgtcagatacagcacaaaatgggtcagggaattcaaaaaagtgtggggaatttaaagggggggttccgcttccggggggtttcccggggggtaaaataaaaaaaccggggccaaaaagaaaatatttccctttttaacaaaacccccccttatttttataaaaaaaagggggggaattttttttaaaaaggaanncaaggggggtttccccccaaaaaccccccaaaaaaaaacccccccaaaaaaaaaaaannngctccggggnnccccctttcccggaaaaataaaaattttttnnnntttttttttcgggggggggggggggggggggggggggggggggggtttttttttttttaaatttttatattnnaaaaaaaaaaaaaaacccccccccccgcggnngncccccccaccctttttttttttttttttttttttttttttttttttttttttttttnnnccntcccncccccnncnnnnnnnnncccnnaaaaaaaaaaaaaaaaaagggggggggggggggggggtgccccccccccctctttttttttttttttttttttttttggggggggggcggccgactaaaaaaaaaaa

SEQ ID NO: 14739 - DNA, 835 bp, Xenorhabdus bovienii
  unsure (1)..(835): unsure at all n locations
  Genomic contig Name=Xb4151_4152.C198
ggggattaacaacccccttggggggggggggggggannnaacgcnnnnnnnnnnnnaaaaaaaaaaaaaaaaaaaaaaaaaaaacccccccccccccccccccnttttttaaaaaaaaaanggatattggggtttttttttgttttttttnnnngccggggggggggggggnnaaaaaaaatttaaaaaaatatgggggggggnggggnngggggggnnngcgcccctactacacgtaggccnaggnctnnncgnnngggaaaccggggggncccccggncccccgaattgggttggggnnaaggagggggntaatnaaattcccttgggcccaggaaaaaataatttgccgggggcccttttttaaagacccggggggnaaaaggaccccctttggggggggcccccccgggggggggggggttccccttttttnccccaaaggggggaaaaacccccagggggggggaggaggggggnaaaatatttttataatatcccggggggggcaccccctatatttcccacaaaaaaaaaggggggggggggtttttaagagaggaggggggtttaaaaaaaaaaagagagggggccccccccccccggaaaaaaaaaaaaaaaaaaaacccccctttggggggggcgcccccctcttttttctccttggggggggggggaaaaagaaagggcccggcgccccccccccaaaaaaaaacccggggggggcgcccccccccgcgggggggttcccacaaaaaaaaaaatatcccccccccgggggggaaggagggnananaaaaanaaaacnccgcccgcggcggggtcgtggggttta

SEQ ID NO: 14740 - DNA, 1148 bp, Xenorhabdus bovienii
  unsure (1)..(1148): unsure at all n locations
  Genomic contig Name=Xb4151_4152.C199
aggggcccccaaaaagggaaaatccgttttagggnnnccctataggnnnccnnntctggnnnnncnngaagnnntnnnnncgnnnnnaccttnnnccttnnngaannnggaggnnnnnttaanncnnccnncnncgnctnnnnnnnaaccnnccgntntnngnnnnanacttnggnnnngannttnggnnggggnnnnctaannnaaaaaccggnnncnnccnnacacncccggnnttnncccaacccccccccctttggggnccgggnttgggnnaaaaaaacccccgcggtttnnccccaagaancctcttggggggggggggggccccccctatatgggggggnatatttatcccccccggcgcctcttttgtggggggngaaaataattgtggggnaaaaaaaagtttggtgggaaacccctttgcggggccccaaacccaggggaaccaaaagaggaaaggggggaaccaccctttcttctcccccgggggggagaaaaaaaaaagggggggcttgggcgccaaattaccccccggggcccccgaaattgtcccccggccctgtggtttaataccaaaatgtggccccttgggcccccaaaaaaaaaccccgggggggaaaacccgggggttctttttttttttttcgggggagaaaatttttttggggggcccccccccatattataatatatttttttacccccccccccggggggtttttttcccccccctgtgtttgtattatattagggggctcttttttttttggggggggcaaccccccccggggggttgataaaacccccccacaaaaaaaaaaccgcccggctttctttttttttattaacccgggttttttttttttttattaaaaaaaaaggagggcgccccccccccccccncnccccccaaaaaaaaaaaaaaacccccctccctctctcaaaaatatataaaagagaggggggggggggggggtgtgttttttttttttttccctcccccacccccccaacacaaaaacaaaaaaaaggtgtttcggnggggggggggggngnnnnnnnnnccccncccccccccccccnnncnagnnaaaaaaaaaaaaaaaaaacaccccccccctccccccctgcgggggggggga

SEQ ID NO: 14741 - DNA, 949 bp, Xenorhabdus bovienii
  unsure (1)..(949): unsure at all n locations
  Genomic contig Name=Xb4151_4152.C200
ggccttttganctctngncctaggaccnctggnnncngaggnttntnncgnnnnncacttnnncttnnngaaangggaaggnnnctaannncnncnnccnccnncccnttaaaggngggnnnnccccncccgggttttnnnnnnaaacctttnnncccgggnnncccggggtttantttncttttttttcttttaaaaaccttttattttattttttanttaaattttnnnnccccccccccccaaaaaaaaacccttttttttttggggggggggggggggnnnnnaaaaaaccggggnnccggaattataacnaccgccggnaatatttccaagccggaaanaattggnaaaatccttcttggaactttttttttcaatttggggggttgggaaccattcccctccaattggaggttggaagtggtggccaacggggttggcaaatcggctttgtccggtggggagggggaaaagggatggtcctggaatttcaaggggaaacgcccctggaaaacgggttgggggccttgcccccttcatggggtgggggtataagggggggggagacccttggccaaagtttggtttcccggggggggggggggggcctttttggggggtaaaagggggcttataaaaaagggggtggaaaaaagggcgccccctgttgccccaaaactgtgggggccgggggaaaaacccttggggcaaaagggggcgcccctttgtgtnaaaaaacggggggggggcccaccaaggggggggaataattccccgcgggttttttttaaaggggggggaaaaaccccggtggggggggggtttttttttccaaaaggggggggggggagaaaaaaaaccccccctccttttttttttaaaaccccccccaaaaaaaacacccgcgggggggggaanntnngggggggggtggtttttttttttt

SEQ ID NO: 14742 - DNA, 951 bp, Xenorhabdus bovienii
  unsure (1)..(951): unsure at all n locations
  Genomic contig Name=Xb4151_4152.C201
cttggtttaccgcccccaggctttggggtaccccgagnccttcgggancncacctagntanacgggcccgnnncagnntgtgctggnaattttcnaggcgggcccgcagncttncgggtctggcttattttttccgggggactgggacctaagnccaatnggggtttcgatggaaacggaacaatttttggggggaaccccccgggccctttgggagaaaacccctgggggggggcccaaaatccggtattttttttttgggggggggggttataatcttttgggggggggccgctttttttttttcgccgcgcttttttttaaaaaaaataccccccccgcccccccgagggggggtttcccccccgattttttttcctccccccctcttttgggggaaaaatttgggggggggggggttgttttccccccccccccccctttgggggggggggggtccccccccgggggggggggggggggggggggcggttttttttttttttttggggggggggggggggccgccccctctctttttttttttttttaaaaacacacccccccccgcggggggggggggggggccccccccccccccccccgggcggggggggntttttttgtnagacccccccaccacccacggaaaataatccttttttttttttttttttttttttttattaggggggggggggggggggggggttttttttattttnnnaannataaaaaagaaaggggngagagggggtggaggcgncncccccccctcttttnnatattnnnaggtggaaggggggggataaangnngncgcgccgccccccccccccctctttctctttttttttaaaagcgtccgcggggcggcggggggggggggggggggacanaaaannnncacaaaccccccccccnnnnnnnnnnnnnnnnnnnnnnnnnnnnn

SEQ ID NO: 14743 - DNA, 867 bp, Xenorhabdus bovienii
  unsure (1)..(867): unsure at all n locations
  Genomic contig Name=Xb4151_4152.C202
atgtctattcaacgccnnaactattnnncgnggannccttncgngntnnaccncncttttntntntnnnnaanatnnagggnggnnnnngaannttaatttntnttnttnttnnncaacaccaaaanaaccnaaaatttttggtntgggnnaaacccccaattnncccaatatgggttnnnnaaaaaaaatatnccccgcggnnatagggtttgggnnaatatgggtttnaaaaaaaaaaaaccaaaccccaaaaaaaaaaatattaaaatttnaaaaaanaaaaccaatgttccaacncctttgggccccaaaccttggnaaaagaggaaatatnaaaaaatttccccattttaattcccattcccttttaaatttggatataatttcttaaggcccttttaaaaaaggatttaccccttttcccctttccccaaaaaaaattttttattgtgggggaaactcttttttttaaatatccctgggggggggggggcacaaaaaacaaaattttnttttttttttccccttaaattttggggaagaaaaaattccttcaaaacaaaggggggttttttttttatccccacaaaccttttttttcccacaaaatttttttaaacaaaaaaaaaaactttttttttttttttttaaccgcccgcggttgggaaaaaaaggggggggaaaaaaaaaaaaaaccccccggggggggaaccccaaattgtgccccccaaaaaaaaaaaaattttttaaaaaatttttnncaaaaagaaaacaccccgggggggggggggtgttttattttttccgggggggggccccccccccccccccccggggggggggggggacaacccaccccccccct

SEQ ID NO: 14744 - DNA, 800 bp, Xenorhabdus bovienii
  unsure (1)..(800): unsure at all n locations
  Genomic contig Name=Xb4151_4152.C203
ggcattagtgcgnaatacgggctcgtttacgccgaaccccggaatttttnttttttgggggnngggggaaaaaacccgcggtttttttntnnccccgggggaaaaggggggggnnnttttttttttttttttnnnnnnnaaaaaaacactttttttttttggggggggggggtttttttttttttttnnnnnnnnnntccccccccccggtgggggggggggggcnggnntttttttgnttttttttttttttttttttgggggggngggnaaaacacacacccccccccccttttttttatttataagggggggggggggggggtttttttttttttttttttnttnnggnggngaaaagaaaacacacccccccccccccccctttttttttttataataaataaaggggggggggggggggggnggggnnnnnnnnnnnncnnnnccccccccctttttttttttttttttttggggggggggggggggggggggggggcangnnnntcnnnnntctnnntntnnnnngtgttggttggttgggtgggggggtagngggggtgaagaaaaaaaaaaaaancgcccccccccccccccccttttctttttttttttttttttngggggggggggggggggggnggncccncnnnnnnncncctnncntctcctcttttgttttgtggtggggggggtggggggggagaggaaagaaaagagaatagaagagtgctaacccccccctcccttctcccctcccccctctcccccccnttaataaaagaaaaaaaaagaaa

SEQ ID NO: 14745 - DNA, 1111 bp, Xenorhabdus bovienii
  unsure (1)..(1111): unsure at all n locations
  Genomic contig Name=Xb4151_4152.C204
ttttgggggcctttnggggggntnnncccccccccttcttnctttnnngttgggcattntnnatgccntncggntncgggggggtggnaagccccngcctacgggggggctggacgggggggctggnncgtgccgggggcaggggccacnggggnncaggtactagctatttggcggccggacggggtnaggtctgttactctgccctggctccggggnacagctgaaactcganatagcgccaaggcaagctgggcnnnngagaannaggccccccctcccccggggagaaaaaaaactttttttttnnngttttaaaaaaaaaannnngncccccccccacaccccnnnnnnncccccccnccaaagaaaanctcntggnngnntnnngcaccccgnnnngggaanccccntgccgngggnnnttgaaacccccaaaactcntnngaantnnnnnanaaccgcggggncncgcccggnccccccggaattgggnnttgggggccccttggggggnnnaagttattatttccccgggggggcctccctttttaggaacacccggggggnagnaaaaggaccccttttgggggggccccccccgcgaaaggaggttccccctcntggggcccggggggggggccccccttattcccgggtttcccacccccttttggnaaaangaagaggggaaaacccggcggggggttttcccggggcccccccccaaacacacacncacaattagggggccccccccaagagagtttgttccccccccgcgcgggccccgcgcgggcccccccctaataatacaaaaaaaacccggccccccggaaaacaggagggggggcgcccccccccggtggggggggggggcgcccccccgggggtgtccccctgtgggcctcttgggtggggggaaagaacccccccccacaagggtgggggccccccaaaaccccccaaaatttcccaaatggggggaaaaacccccgcggggggagaaaaaacacaaaaaagttccccccgccccccccctttgggggcccttttttataagaagaaagaggggcgctcccctcgcgggagaagaacccccccccccgcg

SEQ ID NO: 14746 - DNA, 686 bp, Xenorhabdus bovienii
  unsure (1)..(686): unsure at all n locations
  Genomic contig Name=Xb4151_4152.C205
cacccggcagggagacncccccccccncaccccgggcggggagaggggccctcccggcgccacgccccccgcgccgcgcccgggacccgcggccctaaacattactcttcgccggggggcgcggccccccccccanaaaaaaaaaaaaaaaaacccccctccctttngggngaaggccnnnaataancccggaacccntcctgtttnncccccccaanccnnacccccaccaaaccccccacccccaaannnaaaaaaaacccaaannggaaaaggggtttnncccgnnccnccccncccccaaaaaaaaaaaccccaaaaaattaaangaaaaggggggggnnaaaaaacccccccccgggggnntaaaaatnaaaaannnnaaaaaaaaagggggcccccaaaaaaaaaggggtttgggggggaaaaaccccccccccccaaaaaaaaggggggtttttaaaaaagggggggggggccccccccccccccccggggggggggggtttttaaaaaaaaaaaaaaccccccttttttccccccccccaaaaaanaaaaaaaaaaggggggtttggggggggggnnnaataaaaaaacccccccccaaaaaattttttnaaaaaaaaaagggggggaaaaaacccacccccccccgcgggggggggtnnncccccccccccccacca

SEQ ID NO: 14747 - DNA, 869 bp, Xenorhabdus bovienii
  unsure (1)..(869): unsure at all n locations
  Genomic contig Name=Xb4151_4152.C206
nnnnnnnnnnnnnnnnnnnnnnnnnnnnnnnnnnnnnnnnnnnnnnnnnnnnnnnnnnnnnnnnnnnnngcgagggaaaaaaaagttacaaaaacacccacccccccccccccccccaccccaaaggaannnngnnnnnnnnggccaactgcagccgcaggccactccagaggacccccccggtgggaggaaccccacccggaaccaaggccaaaccggggggggggggaaaacccccggggggggaaacccccccggcccccccgggggaaaaaaaaggggggaaagggggggaagccccccccggggggcgggggcgcggggacacccacaaaaaaaggggggggggcccccccccccccccaaaaaaggggggggggggaaaacacccccccccgggggggggggggcggcccccccccccccccccccccccgaaaaaaaatggggggggggggggggggggaaggaaccccccccccccccccccccaccaanaaaaggggggggggggggggggggggggcccccccccccccccccccccaaaagcggggaaagaaaacccccccccccccccccccttttnnnnntttttgtgggggggccccgccccccccccccccccccccccccccaaaaanannnnnnnnnnnaaaaangggggggggggggggnnnnnnnnnggggcccccccccccccaccccctcccccccccctccgnccnnnncnccccnccgcccccccccccccccccgccggccggggggggggggggagaaaagagaaaaaaaacaaacaccgcntcccccccctccccccccnnccccccccccnnnaagggggnnnaaataaggaaagaaacaaa

SEQ ID NO: 14748 - DNA, 1330 bp, Xenorhabdus bovienii
  unsure (1)..(1330): unsure at all n locations
  Genomic contig Name=Xb4151_4152.C207
gagggggnngnnnnngagggnnnnnnnnngggagtgcccccctgagagaagganntagaagaggggtaagaaaaggttatntggtttgagaaagcggcaaccggggggnnnnggaaaaagcggcccccnntttgnnanganaccccctcgggggnnnnaaannnnngggggggggggccagaccgggnaaaaaaaaaaannnnnnngggggggggnnnnnnnnnnnnnnnnnnnnnnnnnnnnnnngnggngnnnnnnnnnnnnnnnnnnnnnnnnnnnnngggggggnnnnnnnnnnnnggnnnnnnnnnnnggnnnnnnnnnnngggggnnnnnnnnnnnnntgtggggtagangggggnnnnnttttcttttttttttnnnnnnnnnnnnnnnnnnnnnnnaaaaaaaaaannnncccnccnnnnnnnnnnccccccccccccccnnnntttnnaaannnnnnnnnnnnnnnnnnnnnnnnnnnnnnnnnnnnnnnnnnnnnnnnaaaaaatttcacaaaacaaaaaaagggggggggggaacaaaaaaaaaaaaaaattttttttttttgcgcncnncnnncnncnnnncncncnnnccccnnnnnnnnnnncccnnnnnnnnnnncnnnnnnnnnncccccccnnnncccnncccnnnncnnnnnnnnncnnnnnnnaaaaaaaaaaaagcccnncncnncnccnccncccnccnnncnnnnncnnnnnnnnnnnnnnnnnnnnnnnncnnnnncccccnccccncnccnncnnncnnnnnnnnnnnncncnncnnnnncnnnnnnnccnncnnnnnnncnnnnnccnnnnccnnncccnccnccccnccnnnnnnnnncnnnncccncnnnccnncnnncnnnnnnnnnnnnnnnnnnnncncnnnccnnncnnnccncggcnccgcncncggccnnggnnnccnnnccgccncncngggggggcgnncgcgnnggcggcgggcgnngcnngggncgcggggggggnnggcgccgnncggcnctccggcgcccggtgccggctgccgcggggcccnncnggtgcntgggngggnggncgntgcgncgcggncncgcccgtccgngnnnggggngnngncgggnnnngggggcggggcnggggggnggggggttgcggngtggncctngcngcgcngggngncgcgtaaggtggtnntcccccggngntggggncgnnggcttngctnncngngnggcccccactggngcgggtcngnggncggcggggcnncccgcnnntnccngcgcggctnngngnnngcagcgaagaaacgaagaaaagaa

SEQ ID NO: 14749 - DNA, 1125 bp, Xenorhabdus bovienii
  unsure (1)..(1125): unsure at all n locations
  Genomic contig Name=Xb4151_4152.C208
nnnnnnnnnnnnnnnnnnnnnggggnggggnnnnnnnnnnnnnnnnnnnnnnnnnnnnnnnnnnnnnntttttaccaatttctagtcttctttntccttcccttttcttctcttagtttaaaaataatactcactccccaccctcccgacctaaaagcacaaaaatagaagagaaggaaaaaagcaataaacgaaaacacagacacagacaccaggtccatnttttaaacccccccccccaaaaggattttttttccccccacgcttatattttttttttttacaaacaccccccggggnnnnaaaaaaaaaaaaaaaaaaaattttttttttttttttccccgcccccgccggnnnnnnnggaagaaaaaagaaaaannagagaagcnccccccccccccccccccccttttttttttttttctcccccccccccccccgcccgnnggggngggggggnnnnnnnnncnnttttttttttttttttttaaaaaaaaaaaaaaaaaaaaaaaacgccccctcccccccccccgcgggggttgcctttttttttttttaaaaaaaaaaaaaaaatatttttttttttaaaaaaaaaaaaaaaaaaaatattttttttttttttttccccccccccccccccccccgggngcgnanaanaaaaaaaaaaaaanncntttttttattttttttttttttgtttttnnnnggggaggaanaaanacccccccccccccccacccccattttctttttttttttttttttttccttctttcccccccccaccccacaaaaaaaacaaaaaaaaaaaataataaaatttgtgtgnggtttttttntggtnttnttgnngggggggannnnnnnncccccccccccccaccccccccnnncccccccccttttttttttttttttttttttttatataaaaaacaaaaaaaaaaaaaataaaaaaatattgtttgtgttttttttgtttttttgtggggggggagnnnnnnannaaaaaaaaaanaaaaataaataatgataatattgnccatnttaattccatccacccaccaacccacaaggggagtatgagggcgcggaggacataaagggagaaatgtgttattttat

SEQ ID NO: 14750 - DNA, 657 bp, Xenorhabdus bovienii
  unsure (1)..(657): unsure at all n locations
  Genomic contig Name=Xb4151_4152.C209
ctttttgacnaatatncggncttcggtttacccagtacgtnncccatagttggtnacagccgcttcgaggcatggcggtattcagcaacttccggcaatgagcccaggagtacgcactgatatcacacgttcacacacgtgcgttgagctcacgtgtggatacgctacaatgtcgatcttacgactgaactncgggttaaccgccaaaatgttggaataccaaaaggcatattttgggcccgggggttcttggaaaaattgggggaaaagggggtttttgggaaataaaaaaagggggacttcccctgtttgtgccacacaattttttttttttttgggacgcccccttttttttttttgggggggaaaaaaaaaaaataaaaagagagggcgggggggtgtttttattttatataataaaaaaggggggggggaacattttttgtgtgtgggcgcccccccctcattatttaagatggttgggcgcccccccacaccctcccttctataaaaaaaaaaatattgttgtttttttaaaaataacacccccgcttttatttttttaaaaaaaaaaaaaatttgtttgtgtttgtggggggggggnnggnnnnnnagaaaaaaaaaagagaaaggggtttgttttttttttttttctta

SEQ ID NO: 14751 - DNA, 828 bp, Xenorhabdus bovienii
  unsure (1)..(828): unsure at all n locations
  Genomic contig Name=Xb4151_4152.C210
cggagacactcgnnnnnagacccgnnnnnnnnncccttggaaaaaaaaaaacttgcgngcccnnncatgttttttttgtgttttttggcggggggggggcccaattnnnnggttctctnnnnggggaaaaagggggggggggagnnnttttaaaaaacccccccccccccccccctttttaaaatttttngggggggggncccccccccaaaagggggattttggggggnnntttttaaaaaanccccgggggggggccccccccccccccccgcggggnccccccccccnnaaaaaaanaaaatttttatgagggggggtttgttttttttttttttttntnnnnnnnnntnggggggggggggggggccccccccccctcttctttttttttnnnnggggnngnnnggggggggggggggggggtggtttttttttttttttttttnaaaaannnaaaataaaaaaaaaaaaattcttttttnnccncnnnnnnaattttttataaataataattttnnggggggggggggggggggggggnnnntntttttttttttttttggggggggggggggggggggggggggttttttttttttttttttttttttttttngngcgcgcccccccggcgggcggggggngggggggggtcgtgtttttttttttttttnccctccaaaaannnncctttttttttttttttttttgggggggggcgggtgntccnccccccccccnnttattntttttttttctcggggggtggttttttgtttttaanccaaaattttgttgggggggggggggggagaaggaaaaaaa

SEQ ID NO: 14752 - DNA, 964 bp, Xenorhabdus bovienii
  unsure (1)..(964): unsure at all n locations
  Genomic contig Name=Xb4151_4152.C211
ngcnnnnnnnnnnnnnnnnnnnnnnnnnnnnnnnnnnntctntaataananaaattaangnnnggnnnaaaaaaaaaaccccaaaagggnnnnaaaaaaaaaaaaccccttttttccccccaaaaaatttttttttttttnnntttttcccccccggggnnnnaaaaaaacccccccaaaaaaaaaaaaacccccccctttttttttttttttgttggggggggggnnntttttttccccccccccccccccccccctttttttttttttttgtggggggggggttttccttaaaggggctttttnttcttttatttttccggaccccccctttcggaattttccccaccttcccattgggaaaaaagggnaggtaatttaagccaaggggtccggtttttgtttggaaaggggggtggaacttaaaagtttcccttaaaggtaaaaggcggtaaaccggggggaaacccccccaccccttaagcgcccaggggaaataaaaattcccatttgggaatttaaaaaaaaaaagagtttttccccccctaaaatttctggggagggggggggggaaaaaaaaaaaatcctccaccgttggtggggccccccaaattcccgcggggggtgtttaacctccaaaaccccaaaagtggggcgggagaaaacccgtttttttttaacacccccgaaaaaaaaaaaaattcccgaaaaatttttttgtttgtccccccaccaatttttttttcccaaaaaaaaaaaaagggggtgggggggaaaaaaaaaacccccggttttttttttattacccccccccgcaaaaaaagggcgctctctttctttttctccnaaaaaaaaaaaaaaacncccccccgggggggggtgggtgtgttctcccccccgccgggttgttttttttttttttaaaaaganncgccccccccccccccnctccaaaaaaaaaaaa

SEQ ID NO: 14753 - DNA, 849 bp, Xenorhabdus bovienii
  unsure (1)..(849): unsure at all n locations
  Genomic contig Name=Xb4151_4152.C212
cgctctatttaacttntggcctagnnncnctggnncgaggntnncggnnaacttnncttngaanngagnnttancccccctcttttntgttaattaagccctataaaaatttatattanaacacttggggctaaaaaaaaataaaagccaaattaaaatagatttttgggtggggcccaataggcccccccccccaaaagggaccccgccataattcttttgttaaatatggcggggtcccaaaaattcccctggaagtaatttggcgcggggagacccccttttttttttttccccccctttcgccaaaaaaagggggggggggaaaaaaccaccccgtttttttttttttttttgggccccccataaaatttttccccccctttttaaccccccttttgggggccccggggggtgggttcccccccccaacacaaaaaaattattattttttggggggggcccccacacaacttcttgtgggggggccccccccccccccccaccaaggtggggggggggggggtttttttttttttataacaccccccacacaattggggggggagggggtttcttctaaaaacaaaaaaaacacccccccccccaaaaaaaaaaatattttttccccccccccccgcggggtgggggtgcgccccccccccccccccccccanaaaaaaaagaggggggggggggtgggtcccccccccccctcccccccttttggggtgggggggggagagnaaaaaaataatttttttttttttccccccccccccccccccaaaanaaaaancgggggcgggcccccaaacaaaagaaggggggggcggccgccctcctctg

SEQ ID NO: 14754 - DNA, 1043 bp, Xenorhabdus bovienii
  unsure (1)..(1043): unsure at all n locations
  Genomic contig Name=Xb4151_4152.C213
nnnnngactacttttattcttttgtgttggccccctcncggagttnncgtaactcctnaaggaagaaacccgcccctctctttgnccctngttatgncatgttccaaccgngnnnnntggatggagggctgttatgnnctaangcatgtgacgncgcnnncggggggggaataagcctagccttaaatcncccanacatanatncttttttttttttttttggggggggggaggggnntatttatttttnttctggggacaaacataaacctcttanctgngngggtttttttttttttttgncangnngggcagttttttttcctttctttttttttttttttnttttgcganngnngncgagccccattnaggngacncttnnnnnnnnnnngggcggggggggtccccaaaaacacanaaactcacttgnnggccacaaaagccccaaccagggnncccccggaataatttccccggnnaaaaatnttctcttgnggaaaaggngagaaaaatntctaaaaacccccccccccccaaccatataatttatttaaacaactaactttgggntnnngagggncccatcgtgaggcccccaacaaccaaaaaaaccccacaccttnaaagagtgnccccnccctacaataaaaaacattttttttttttttttttccccccgcccccngctgccgggggtntttttttggggaaaaaaaagangccccncnccaaaanaaaaaaaatnttaactggtgggggtttntttttttataataaaaaaacactcccntgggggtttttgggggggccccccccggcccgggaaaaaaaaaattttnnnnnnttcccccccncctcggtgggttaaaaaaaaacccttgggaaaaattttttaataaaaaaaggccccctcttgttgggaaaaaaattttggaaaaaaaaaataaattgtgaaaacccccccccccaagaggggggaccacacccccaaaaaaaaaacctctttgggggnnnnnnaaaaaaaaaaaagcccacccccc

SEQ ID NO: 14755 - DNA, 1124 bp, Xenorhabdus bovienii
  unsure (1)..(1124): unsure at all n locations
  Genomic contig Name=Xb4151_4152.C214
gggcgtttcaatagtgcgctcttggnccctaggnnccctctggnccaagtgctttctggacactactctagagggacgactacgcctccatactggacttctacgtntgggcctcggactgtgaccgncttgggcttccgccaagacaacccaagccccacgctatcgggttgggttccacctactgttgacgccttgggttggccgttggaaggggatcctggccgggggggttctttctggaccttttctttctctctcccaatctaccaccccggactaagtgttaactttttttacggttggttttggcccttgggccgggggnaaactttggttttttaccactggccttttggtttaccccccgttccgtttgggctttagggccgttgaaaaaggccaccttttcaaggaaaaaaccccgcggggaccccgcaaaaaaaaccccgtttntttttttttaacccccccaattttccggtttaaacccgttttttttttcccgtttgggaaaacttttttggggggaatttcccccccccggggggggaccctttttttttttaaaaaaatttttttaaaaaccccgggggggtttcccggggggcccccccccgggcccgggtgttttttttggggttttgttccccccccccccaaaaaaaaaaggcctttttcccccccccccccatatttttggaaatattttgggggggggcccatttttagtgcccccccctccttttgggggggtttataaaaaaaaaaatttttggggggggaaggtttttttttttgggggggggagaaacccccccccccccccctcttttttttttttttggggggggggccccccccccccaacaaaagtttttgggggngggggttttttnngggttttttttttttttttttaaaaaaaaaaacccccccctctttttgtttgtggggagaggagaaaaaaaaaaataaaatattttttttttttcccnccccccccccccccccccgnnnggggggagaaatgaaaagaaggggggggggagagatatattttttttttttncccccccccccccccgcgggccggggggagagagaaaaaaaacataaataca

SEQ ID NO: 14756 - DNA, 1056 bp, Xenorhabdus bovienii
  unsure (1)..(1056): unsure at all n locations
  Genomic contig Name=Xb4151_4152.C215
naagggtnnnnncnnggggtggcccaaagggaaggncangtatttgtgggnagttagactgntgtattcatggattttgtgnnnannanggtttcccttttnnnnnnnnnnntttggggggnnnnnnnnnggagggggcggggggggnnnnanannnnnnggggggggggnggngnnnngnnnngnnnggggnnnnngnnnnngnnnnnngggnnnnnnnnnnngngngngnnnnggnngggnnggggananaanaaatttttttttttnnnnnnnnnnnntttttgggggggggggtttttttttttttttnnnnnnnannnnnnnnnanaagggggttgttttttggtnnanngggggggtcccctcttttgtgggggggggtgtgntnngggtattttgnnnaggnggtgattggaaagggagatgnnggtnnttttttgnngggggggggntggnngangnnnntngggtgggtnnnnngttgtngtgtgggggatttttttnattggnnnnnggtnnnggggtttntgagngggaaggtngnntgtgggtttntntttgggtgttnnggnntgttttgggngttatttggngttnttgtnttngatgtngattttttttngnttgttgttgttttnngttgtgtttttttttgnttttttttggggaaanngggnaattttaatgatgttttgnnnnnnngnnnttggnannnngnnnnagntttgtttgtgtggttgggtgtgtgttgagttgttttggttgtgtattttngtggntgggtggaggggggtggggtgttggggtggtagtggggttgnngagtgtgtgggtggggtgttnggggtttnnngtggtggtggngttggtgnggggggtggggatgtgnggtggttnggggggtggngtggggtagtggagggttgggtgagtgtgggggatgggtgtgtaagnggtgggnngtggtgtgngtttgtgnggttgtgttgttgttgtttatggtttgtgttggattggggttgatatgttgtttttggtgggaaaagtgatgta

SEQ ID NO: 14757 - DNA, 897 bp, Xenorhabdus bovienii
  unsure (1)..(897): unsure at all n locations
  Genomic contig Name=Xb4151_4152.C216
accctttttttcctttgnncctaggnncccctcggncccgaggnttnnttcttttaacttttcctttggaaagggaggngttaaaccccccccccnaaatatnaaaagaattnnccctttttnnnaaaaaattntttnaaaaaattaanaaccccccaagnncccnccttnncggggccccaaaaaataaggnnaaaagggggggtttgggtttttttaattttttaaaccccccgggggnnaaaccccaaaacccccaggnnnaaaaaaaaaaatttaattttaatgggggcgnaccattaaacccggaaatatttttcctttggggagaaaaaaattttttttatatttggggaatggggttaaaaaaacccacccttccccncccaaatttgtgggggatattttttncccccttgggggnaaaaaaccccctttgggggaaaanaaaaatattttaaanaagnttttttgggggggaaatttgaaaccccccgaaaaatgggctccacaaatttttccccccaaaaaaataggggtggggggggcccacctttataatgggaaaaaaaaacccccctctgggggggggaaaaacccccccaaaaataaaaaaattttcccacaaaaaaaaaaacaccccccccccctttttttgaaaaaaaaagagggggggttttttttaacacctttataaaaaaaaaagaggggttttttaaaacccccccaccgggtgttttttccccccaaaaaaattttttcccccccccaaaaaaagcgccccggctttttttttttttaaaaaacacacccccccccccatattttttttttaaaaaaaaaaaaaaaaaaaaccccccccggcggggggggggggggggcccccaaaaaagaggg

SEQ ID NO: 14758 - DNA, 905 bp, Xenorhabdus bovienii
  unsure (1)..(905): unsure at all n locations
  Genomic contig Name=Xb4151_4152.C217
gccatttttcattgcatgncnctgncaggntnctacttctagnaggaatncncnncccaagngnaaacccgnaaatggacagncagnaatgtccggcccccaaagaggggccccacactttccanaacacgcgtttgtggngngtattaataacactctttnnnccacaaacacacaanaaggaggggggggggggncgncgcncactttatatattttntccnccgcgtnntnttcncccacaaaagnaccgcgcgaaaaaaagagattncccccattatttttccccccttttaaaaaaaattaccaaaaaacccggggggggcccggggggcttttttaaaaaaaagacctttttgggaaacccttttttcccaaaagaccccccccaaggggggggggaaaaaaatggggggcgcccttcggggggggtccccccttcccccccctttttgtaaacccccggggcgcaaaaaaaaaaaaaaaaaataaaaatattttttccccccccccccaaaggtttttttttttttgggcctccgcggaagaaaaaaaaaatatttttggcggcgcgggtgggccccccccacaaaanaagaaaagtggtttttttttttgtgttttcaaaaaaaaaaaaaaaaccccgcgcgggtttgtttttttttcccgcgcgcgggggggggtggttaaaaaaagaacacccccctctttttttttttcaaaaaaaaaaaaatatttttgggggggggggggggccctctttcttttttttttgggggggggggnnaannnnnnnaaaaagaggggaggagaaagaggagggggcccccccccccccaacacattatttgtgtgggagaggaaaaaaaaaaaaaaaaaaggagggntttccccactaccccccc

SEQ ID NO: 14759 - DNA, 910 bp, Xenorhabdus bovienii
  unsure (1)..(910): unsure at all n locations
  Genomic contig Name=Xb4151_4152.C218
atnnnnnnnnnnnnnnnnnnnnnnnnnnnnnnnnnnnnnnnnnnattgtggtgtgggctgggactnccctgaanantcaacgcccgtatcaacaantcgctttcttttctggggctgggttggaatgcaaggtttatttggggtttcccccggtttttgggctttggggaagggctctaaccccgggaaaagggggaaaacccacccgccttttttttaatattgggggaaaaaaacccccccttttgtgggaaaaaccaaagagggagtttttttttttgggaaaaaaaaacccccccccggcgggggggtgtttttttcccccccggggagaaaataatctctttctttttctgcacgcggccgagaagaaaaaaaaacacaacccgccccctcccctctcttatataaatataaggggagggggggggggggaagagaaagaaaaacaacttctctctctttgttgtagaggggggagaagaaaagaccccccccccccccccccccccgccgcgcggcgcggggggggggggggtggggttgtgttgttttttttttttttttaaaaaaaaaaaaaaaaanccccccaccccccccccccccgcccgcggagggaaaaaaaaaaaaaaaaatttttttttttttttttttttttttatttatttttatataaaaaaaaaaaaacccccccccgcgcgcccccccccccaccacccaatttttttttttttttttttttttttttttttatataaaaaaaaaaaaaaaaaaanatnnnaannnttnnnnnnnnnncnnccctccccccccgcccccccggggcgggggggggnggggggggggggaaaaaaaaaaaaaaacgccacaaggcgccccggcggggtttttgttttttttttatttaaat

SEQ ID NO: 14760 - DNA, 650 bp, Xenorhabdus bovienii
  unsure (1)..(650): unsure at all n locations
  Genomic contig Name=Xb4151_4152.C219
gagctgatgctgagtcatcagagatctcgcagtatatgccctacagatggtacacctgtacatgcaaaacaaaaaaccgcctccgaaacaagggacttaaaagtttggaaaccgggttgggttgaaccccccccaaagggaatctaaaaacgaaaaaaaaagtccgggaaaatctctcgcgcggttttaaaccccccccccccaaggggggggggttgaaaaaaaaaaaaatttttttttttggggggggttttctttttttttttttttggggggggggnnaaaaaaaaaaaggggggggggggggggggcgccccccccccagaaaaagaggggggggccccccccccctcttaaaaaaaaaaaaaaagggcagaacaaaaaattttttcttttcttaaaaaagacccccccccttttccggggggaggggtaaaaacccagggctcttttttgtgggggggggaggggtttttatttttttggaaagggggtgcnctctttcatattctttttttgggggggaaaaattaaaatttccgcggggggggggggggggggggtggggccccaaaacccccccgattattttggggtgtgagaaaacactacctccacgtgttcctaagaacagagggtgatgtgtctat

SEQ ID NO: 14761 - DNA, 961 bp, Xenorhabdus bovienii
  unsure (1)..(961): unsure at all n locations
  Genomic contig Name=Xb4151_4152.C220
nnnnnnnnnnggggnnnnnnnnnnnnnngggggggnnnnnnggggggcccttctnnnnnnnnncnnnnnnnnnnnntntggnaagggtttggnggggnnnnnnnnnttttnttggaagaagggnnnnnnnngggncttanncnnnnnnnnngnnnttnnnaaaaaaaaagggttctaaaactcctcttcccgggggggggnnnnnnnnnaaagagaggagggttccccccccccccccccttttgaaaaacccgggngagggngnnncccccccggaaaaaannccccccccccccaggggcccccccccagaaaaaatccttttttccccgcnnnncccatncccgagaagaagttaacccccccctncccntaccccgggggccccccccccccccccccccctttttccccaaaaaaaccccccccaaaaatatgnggggggggggtgggggggcccccccacaaaaattttaaaaaaggtggggggggaaaacaccggtaaaacccccccaaaaaaatttttggggcccccccgcgggggaaaaaagagagggggccccccccccgncnccccctcaaaaaaaaaaaaacccacgcgcgggggggtttcccacaaaaaaaaccccccccccccccaaaaaaaacacccccccccccccgcgnncccaaaaaaaaaaaaaaaaaaaaatttttttctcccccccccgcccccccggcgggntntttttttaaaaaaaaaaacaccaccccgggagaattaattaaaaaaacaccccccaaaaatattccccccccaaaggggggaaaaaaaaaaaaacaccccgcggtcgtcccccccccccacacaaaaaaaaaantttttggggggnggggggggggggggnccccccaccaaaaaaaaaaaantttttttttntttntccgggcgggggggaaacaaaaaaaaaaaaaaagggga

SEQ ID NO: 14762 - DNA, 995 bp, Xenorhabdus bovienii
  unsure (1)..(995): unsure at all n locations
  Genomic contig Name=Xb4151_4152.C221
atttttatctaccngannatttncgnagnccttncggntaccnnccangnaattggncgtngncnncttttnntttnngatnaannagncncggnnnttnncattncncancnanntgnangncanncnnccccgtggnttncattgcccccccaaanattgcttcnctgttggaacattagnntcggggccaaaaaatatttccgcgggggcggaatttctaaccaattacaccaagggggggcgggcgcctttccaaagaaaagtgggttgggaaccccccggttttgggctttttattattatattcccgcgcgggtgtgggcgggccgttttttttttgcccctctaaaacgcctctttgtgggggccccccccccccaaaaataaaaggaggggtgtttttttttttttgtgggggcccgcggggtgtgggggaaaaaaacccccacccccccccccccccgcggtggtgtttgggtgggggggaggaggacgctttcttcttttctttcccccacccggggggggggggggggggggggggggggggggggcaacccccccacccccctctccttttttttttaaaaaaaaaaaaaaaaaaaagaggagggggttttgtttttttttcttttcgaccaccggggggggggggggggggggggttttggggaaaatataaatatccttcctctccctcctaataataaaaaaatttaaaaaaaacaccaacatattttttttttttttcccccccccccccccccccccccgcggggggggggagaaaggggggnnnaaaaaaaaaaaaaaaaanaaaaatttttttttttttttttttttttttttttttttttttttttttttgggggcgcgcccgggggggcgggggggcggcgcacacacacaaaaaaaaaaaaaaattaaaaaaatttttttttttttttttttttttttttttttttttgtttcgagaagggaagacgggaaac

SEQ ID NO: 14763 - DNA, 1147 bp, Xenorhabdus bovienii
  unsure (1)..(1147): unsure at all n locations
  Genomic contig Name=Xb4151_4152.C222
gcaggtcccccccacgggtgcncccatgagggaaggnangtttgttattgggnnngtcgaaaagttnatataaagttaanctgttnnnnagagagagcttggcctttnngnnnggnnntttttggggggnnnnnnnnngnaagagggcggggggggggngaaaaaaaanaaanagggggggggnnggaagagnggannnaaaggagaggaganganggnnagnaaaagnggagnnngnnganaggannagggnagggaggaanaaagaangggnttttttttnnnnaangnnnaanaaanggggggggggggggggaaaaaattttttttttttttnnanaanaannnnnanaaaaaaaaaaaaaaaaaaanaannannnnnnaanancacccccccccacannnnnanggaaggnannaaaannnnnnnaannnnnanaannnnannnnnnaaaaaaaaaaaaaaannnnannaaaanannaaannnnnnnnnaggaannaanaaannnnnnaaaaaaaaaannnnnnnaattttttttttattatttnnnaatnntnnnnnntnnntnnnannnnatnnnnnatannaaatantttatttatttttttntattttttntnatatttnnttttnntattttttttttttntttntatatattttnnttttttntaaataanttattttattttttttttttntntatattnttttttttttanaaaaaaaaaaaaaaaaaaaaaaaatattttattttttttnnnnnnnnnnnnnnnnaanaaaaaaagaaaacanannnnnnnannnnaaanannnnataanattttttttttttttttttttttntnnnnnaaaaannnttntnnaatttntttatttattaaatnaatnaaannntttantttttttgtttntttntatangtnnaatatttttttanntntttttttaatttattttttttttataaaatnaattntttttttttttttgnnntattttgatttnnntttaaatttattttaatnatgatattattgaattagaggntnatattatattgttngagttgttttnntttttnttttgtttnatttttngtaagtgggataattttnttttttggtattaaaaatttggatata

SEQ ID NO: 14764 - DNA, 864 bp, Xenorhabdus bovienii
  unsure (1)..(864): unsure at all n locations
  Genomic contig Name=Xb4151_4152.C223
gggggtacctggggggggnnnnntnnnttnaggtntnnnntngggtggggnnntnctnttttnttnnnnnaaggaggtnnnnnnnnnnnnnnnnnnntnnnnnnnnntntnnnnnnttnnnnnnnnnnnnnnangggaccccttaggaaacctttaggnncctaganncctttggnncggggntnncgnnncttccttngaangaggttaccccccccaaaaacgggnccggttggnaaaagttcccttccggcgggaaaggggggccgaaaactttggcccttgggggggacctctttttttttgggcccaccaaaaaacctcttttccttggaaacttgggggtttttttgttttgccccccggggttaaagacaccccccatggggggggggggggttgccccccccccgcccttttaaaaggggttaaaaaacccctttttttttttttttaaaaaaccaaaaaaaaagagggggggggcgcccccccccccccacaatttgttgggtgtgtttacccccacccccccccccgcggggagaaaatagaggggggggggggggggggggagaccaccccctcctttttttgggagggggggggttttttttttttttttttttttaaaaaaaaagggggggggcgccccccccctcccccgcgcgggggtggggttattttttttttttttntttttccctaaaaaaaaaaaaaaaaaagaatggggggggggggggggggggggggcgngnnatatcccctccccccaccaaaaacnngcggggggggttgttttttttttttttttttttttttccccccccccccccgccnctctttgtaaaaaaaaaaaaaaaataa

SEQ ID NO: 14765 - DNA, 1261 bp, Xenorhabdus bovienii
  unsure (1)..(1261): unsure at all n locations
  Genomic contig Name=Xb4151_4152.C224
nnnnnnnnnnnnnnnnnnnnnnnnnnnnnnnnnnnnnnnnnnnnnnnnnnnnnnnnnnnnnggccgggttgggcggcttgggagggctgccagcaggaggtctcctcagggaccaccctggctgcaaatgcgggggaatagcagggtagagagatggggtagattgcggtatgtaagtagagttagcctcctcgtctggnaaatggggatnnnnnnngntnnnnnnnnnnggggccaaactttggccaggcccntgnncagggntcgnnactccntagnnagggatccccccctnaannaagtgnaaataccgncccttccccaccatcccctntggnncggnntgggaatagcgccatttggtaaaccccaagaaccccccggccacagaaatttaaatccgcgnatatcgcagaagccccctcttnatatccacccgcgggggggggaagaagtgagatatttttttcagaggccacccccccggggaaggagggccgcgcggagaaaaaaaaactatattcgcggggcccccctccgccgtgtgtgtttttttgtgtggggggggggggataataaccgggggaccccccccccttttttttcctccaaaaaaaaagaacaccccgccggggggggtttntnnaaaaaataatataaaaaaacaaaaaggggggggcgcgcgcccccccccaaaagaagaaaaagaacctcccccccccccccctcttttgtttttttttggggggggggggggggaaaacaannnnnnaacccccccccccccccagaaggaaggggggtttttcttttctccccccccccgccccccgggggggggggaagacaaccccccccccccccccccccccgcgcgcggggggggggggggggggggnggggggccctttgtnacaaccccccaacctatacnttttttttttgnngngggggaattataaaaaaaaggagagaggggcccccccccgccccccccccccgcgggggtgttttttctttgtttatccaccacacacacaaaaaagaaanngggggggggggggggggggagaaagagaaaaaaaaaaaaaaaaaaaaccccacaaacccccccccccccccccccccccccccccccccccccccnnnnnnnnntttttttttttttttgttgtttttttgtttttttttntncnttnnccaaccccccccccaccaaccaacacaagaagagaagattgttttctcttttcttcttttc

SEQ ID NO: 14766 - DNA, 791 bp, Xenorhabdus bovienii
  unsure (1)..(791): unsure at all n locations
  Genomic contig Name=Xb4151_4152.C225
gacttgcgtgcatgcctcgcagttgactctagnaggatccccatgccgctgacccatgctgggccgagcggaacattactcctactgtgcgacgccacgtaaacggtagccgaacgtcggattgaccatgcaccgatatgactgcacacaccgttctagctgctgagcctgcaacgcaacagaatgcttgcagatgtagcaaaacaaccgtctaccctttgaggggggcttgggcccctttgggcccccccgcgtcattttcaccccggcgggaccgaatttttccccccaccaccttcttttgtgggccccaaaaaaggcttttttgaccccggggggtttccgcggggccccccggggaacacccaaaaaannnggccccccccttttgggaaaacccaccagggggtttttaaagggggcaaaaaattttttccccccccctcgggggggggcccccccggttttcccccccccaaataaaccccggccttttaaaaggggggcgcgccccacaaaaaaacaccaccaacaaaggggttttttataaaaaaaaaagggggggggccccacaagagggagggggcgtgtttttttattatcaccccagccgccccctccccctcataatggaaaggggcgccgggggggggggggggaatctccccccccccccccgccctcttttttttttttgggggggggggggggagagaaaaacaaaaacccccccctccccgccgggggggggaaaagaaaaaaaaaacccacccccccccctgggggggggg

SEQ ID NO: 14767 - DNA, 1045 bp, Xenorhabdus bovienii
  unsure (1)..(1045): unsure at all n locations
  Genomic contig Name=Xb4151_4152.C226
ccctcatgacnaaaaaaccctcttaccccttaggggtaagctgttctttgaccattattttgtttttgaggttggccccttgaaaaaaccccctccccaaaaaaatcccccccccttttttttggggggggcccctttttccccccccccccccgggggcctttgggctttttcccccgaaaaaaaaaagcgccgcggcccccccccggaaaaacactctttgtgtttttttttgtgggcgccccacatatatttttcttggggccgcgccccgcgcggggggggaggaaaaaataaatacccccccgcgcgcggggggggggctttcttctttataattattttttttgtggaggggggggggggggggttgtttttttttttttttcccccccccctctatatataaccctccctcccccccccccccctcaaaaaaaaaaaaaaaaccccccccccccgcgggggagagaaaataaaaaaaaaaaaagccggcgcgcggcgcgccgcatttaaccannttntgttttttttttttgtttntnncttttttncttcttctaaaccaaaacaaaaaaaaaaatttttttatgtttataaataattnaaaggagngggggggggggggnnnnaaaaaaattaacaaaaaaatacaccccccccccccaccccgccgggggggcggggaggagaatataaaatatttattnatttntttttctnncccccgcccnnccccacctggngggagagagagagagcacctcctcccccccccctcttctcgncgcggtgggtggttgattgatatnnaatacgaaatttcttnnnttcgtggggnnaaggncggggcgccacacccnaacagcaganacgttttttnntnctttttttttttcttttcttnaacaaanaaaagaagagagaggcggttgtttcctcctcccctcccccnccctgnnggggggagggggaagagaaaaacaaacaaacccacancccccccctctttcttntggtggggtggggaagagaaacacacccc

SEQ ID NO: 14768 - DNA, 708 bp, Xenorhabdus bovienii
  unsure (1)..(708): unsure at all n locations
  Genomic contig Name=Xb4151_4152.C227
ctttttcgaattcagctcgtcccttacttgtgcagcgatagacctgcgttattcgaggcgcagtctattcattcggcagtgacccacgattgctccgatgtttgaacggacgaccagcctttacggagggcattccctttgaccgggggagccgggggtgacaaaatttgaaataagccccccccccccacttccttattgggggccccccgggcggaaaaaaatttcccccggaaaaacctccacacatttttccctttttaaaggagggggggttttttaaaaccctttttaaaaaaaagaaaaaaaaacccccccgttttttttgttttttaaaaacccccccgcctttaaaaaaaaaaaaaaaaaaaaaaaattttttttttttttttttttctctctttaaaagaagaggagagaaaaataataatttttttttttatatttatgggggggggnaaaaaaaaaagggggggggcccgcccacccccccgcggggggggggggggtttttttttttttttctcccccccccccccctttttttttttttttttcacaaaaataaaaaaaaataaaattncccttttttttgggagaggggggtgggttggtttgtttaaaaaaaaaaacaaccccccccccccctcccccccaaaaaaataaaaaatatatttttngggggatatataaaaaaaaaaaaaaaaa

SEQ ID NO: 14769 - DNA, 897 bp, Xenorhabdus bovienii
  unsure (1)..(897): unsure at all n locations
  Genomic contig Name=Xb4151_4152.C228
nnnnnnnnnnnnnnnnnnnnnnnnnnnnnnnnnnnttaacttnnnnnnnnnnngnngtnnnnnnnnnnnnnnnnngggnngggngnnnnnnnnnttggggggggnnggggaannnnnnnaaaaaagtttcttttttaaaaaaaagaaaactaacacttgggagaccnaaatacccggccccccccggtttacccccccgggcggggggaaaaaaaaaccccgcccccaaaaaaaaaaaaaaaaacccccccccaaaaaaaatttcaaacccccccgggaaaaaaaaaacaacgccccccggaaaaaccacacaaaaaaaaaaaccggggggggaaaaaaaaaaaaaaaaattttgcccccccccccccccccccccaaaaaaaaacctttaaaaagaaaaaaaaacacaggcccgccccccccctttttttcccccccacccacaaacaaaatancccccacaaacccgcgccccccccggttcctccccccccccccgcggggaaaaaagaaaaaaaaaaaaaaaaaaaagagggggggggcccccgcccccccccccccccccggggngnnnaaaaacnccccccccccccccnnaaaaacaaaaaaaaaaaaaaaaagaaaannntnnngggggnnncntcccccccccccccccnccccccccnnnnnnnnngggggggggggggggggggaggaggaagaaaaaaaaacnnaccacccncccccccacaaaaaaaaaaaaanaaaaannnnacnnnnnnnnnnnnnnnnnnnnngnnngnntgggtggttggcggcgttttnnngggggnnngggggnnnnaaagaaaaaaaaaaaaagaagaagaaggannnagnanaaaaatnnacaacccccccaacgaaaaaaaaaaa

SEQ ID NO: 14770 - DNA, 975 bp, Xenorhabdus bovienii
  unsure (1)..(975): unsure at all n locations
  Genomic contig Name=Xb4151_4152.C229
ggcccagccttgcctagccttgcacggtccggctcttttagaggagaaaccccccccggtttcgtccgggacaccaaaatttttatgaaagggnggggggtttccaagcccccctttatttccttttgggaaacaccctatttatcaggggccctcacccacaaaagaaaaaaacaaatttgtcttttttttcgccccgctcccaaaaaaaangggggtgtaagaaaaaaaaaaaagggagaggggcccccttctttgtgggggggggggggggggcgggtaaaaacaacacgggggggttgttttttttttggccccccaaaaaaaaataaacaaaagagggnttaggggggcccccccccccccaataaaaacaaaaaaggggtgtttaaaaaaaggggggggggagagaatttcttttttttttttttggggggggggtaaaaacaccccccccctttggggggagaatttttttttttttgttttttggggggggggggttttataaaaaaaaaatattaataaaaaaacacccccccccccccggggggggaagggggggggccccccccccccctcttttttttttttgtgggggggcgccccccaaaaaaaaaaaaaaaacccccccccccccccgggggggggggggccccggaatataaatttaaaaacnntttttgttttttttttttttttttnnnnnnnnntttnncccccccccgccggggggggggggggggggggaggggggggaggggccnncccctctttttttttttttggggggggggggggggggggggggggggccccccccccccccaccaaaaaaaaaanttttattttctttcttgtttgtttttgttggtnttnnanncgcccnccccccccnnccncccacacaccacaccaccaaacaaataacttttttttttttcttnnnnngggggtggcctgtttgtttttttt

SEQ ID NO: 14771 - DNA, 767 bp, Xenorhabdus bovienii
  unsure (1)..(767): unsure at all n locations
  Genomic contig Name=Xb4151_4152.C230
ctgtattacgnaattncgagccttcggntacccccgtgaaacgggctgatccaccttcatggatggcgcccttttttgttcctgggggagcccgattgggccttttttcccggtttggtggccccttttttgggaaaaggggggcccgaagnttttcggggtattccggggaaaaaagagttttttttggggggttttttaaaaacccctggtgggggggggggaacccctttttttgagagagggggggggggtttttttttccccccgcaaaaaaaaaatattttttttttttttttttaagggggggaaaggaggggtttttttctcccccccgcacagaaaaaatattttttnnncggcccaacacagtgggggggggggggggttttttttttttcccggggggggggaggggagaaggaaaaaaaaaaaaaaccctctctttttttttttttgggtgagcagaagaacaccccccccctccttcttcttttttttttttnataaaaaaaaaaaaaaaaagggggggggggggcgccccccccgccccccgcaaagaagaaaaaganaaaaannnnngggggnnntttttntcttttcttattnaaaaacanccaccccacaccacccaaaanacccccccnncttttttttttttttttttttttttttatnanaggggggggggggggggggggggggggnnnnaanaaaaaaaaaaaaaaaaatnnngnctttttttctcttcccccccctcggcggga

SEQ ID NO: 14772 - DNA, 1022 bp, Xenorhabdus bovienii
  unsure (1)..(1022): unsure at all n locations
  Genomic contig Name=Xb4151_4152.C231
ggcccaagaacttttggactaggncccctggnccgaggttnccggacactactctaggggataaagcccccctcccttctgggccccggaaaaaccgcccccgatcttctacattgggcggacttggaacctactacggtggcttccccaggttttggcaaggggggaaaatcacttggcttaatcttaaaacggaccaacttttttcttggaaaccttaaagnatctanaagnaaaaacttcgtttttttctaccggggttactctaccgactaaaaagaaagagcccttacaaataaatggtggctccttacatttttttttgagacctctacttttttttgaattttgaaaaggggaaagttccttcggggggcattccaattattgtcaaaaaccagccggtaacctttaaacccgcccgtttttgggcccggaaaactttttttaattgggaaaagccattttgacccccggggatatgggaatttgggccgccaaagagttttttgaaattttgcccccctttggtttttcccccgaatatccccacccccccttttttagcaatttttattaaaccccccccgggggaaaaacccctttaaaaactggtgtgtttgcggcccctatttcctaatttttttttagagaaaaacgcgcggggatttaaaaaaggggtttttttttggcccccctttttgttttcttttttcaaaaaaagccggaaaaaaaaaaaaaacacccctgttgggccccctttttttttgggggcccccccaaaaaaaaaaaactttgtgtgtgtttccccacaccccttcttttttctcccccccttttttaaaaaaaaaaaaacacccccccctcttttctctcgcggggggggggacccccccccagtttttttttttttttttttttttttttttttttctggggagagggccccccccccccnaacaaattaaaataattatttttttttttttttgggtggggcccccccaaaacaacaccacctt

SEQ ID NO: 14773 - DNA, 1096 bp, Xenorhabdus bovienii
  unsure (1)..(1096): unsure at all n locations
  Genomic contig Name=Xb4151_4152.C232
ggggaccttttaggtacgnncantntaancgagcgntntcgngtttnacgcgctngncngannctntatntagntccactncgnngntnncagnnctntntnanacnncagntngnnnatactccattncnannatnnatnnatntnntnncannagntncncancgnggnncttnnagncngnncnnangnnncnattnctngnccnaccagnnnacccaaanagntnttntttncnatttnattccccccccaaacctcccctttaaatgggccttttttngaaattaggcccttgggaaacccccagttgaaccaccaaccattaattggggctttacaataaaaaaaaaccctttgggcccaaattaacccaggaccttggggtttttttctcggcgtttttgttcccagggggggttttcacaacaaggggcccacctttaaaattattcttgtgggttttttggggaaaaaacacccggggcgggggggggggaaaaggtttttttggggggggaccacaaattttcccttcctcctcccgaaatttttaccgcttttcaaaaaaacccccttttttttaaaaaaaaactttgttttttttttattagggggggggggggggggggggaaattttttttttttanaaaaccccccccccgggtttttttgggggttttttttttttccctcccccccccccgggtgaaaaaaaaaagaggggccccccccctctttttttttttttttttttttgggggggggggcgccccccccccctcaaattattatatnagggttatgggggggggggggggggggagaaataaaaattttattttttcttgggggggggttttttttttctccccccccttctgtgggggggggggggggagcccgccccccccaaaaaaaaaatttatttttttttttttttttttgggaggggaataaaaaatattataatttttttgggtgtgggggggggggggggggtttttttttttttttttttttttaaaaaaaaaaaaaaagaaaaagaaattttttttttgttttttttttttttccgtccccgacccccccccc

SEQ ID NO: 14774 - DNA, 753 bp, Xenorhabdus bovienii
  unsure (1)..(753): unsure at all n locations
  Genomic contig Name=Xb4151_4152.C233
atttannnnnnnnnnnnnnnnnnnnnntgtgagtatgatatggatggcggttcgtaagcgcctgatggtatgtaatatgccgcttggcagtattatactagtcgctgatccatgatagaacctgcagtgagtnattacctgccattaccagctatatgaaacataggggtctcgacgttattttgcagcactgacattttgattggacggggggattggcggaaaactttaccccgggaaaaaacctttttggcccaggggaatttcccacccccccccgaaaaaaaccccccccgaaacccgaaaaaaaccctccacaaaacgcgggggggggtgttaacaaaaaaaccaatttttttttgggaggggggtttttcccaggggggggagagggcgccctccttccccaaaaaaaaaaacctttttgtggggaaaaaaacaaaaaagggggcgcgggttttaaaaaaaggggggggggcccccccccccccaaagaggggggggggggggaaaacccctctttaaaaaaaaaaaaaatattttgggggggggggggggggcgggaaaaccccccccccggcaaaattttttttttcccccccccgccccccccccaccaaaaaacaaaagtggtttttttttttttttattaaaggggggagggggggtgttttttttttttttttttagaagaagacgcccccccctctgtgggggggggggggggagagaaaaaaaacctccccccccctc

SEQ ID NO: 14775 - DNA, 875 bp, Xenorhabdus bovienii
  unsure (1)..(875): unsure at all n locations
  Genomic contig Name=Xb4151_4152.C234
nnnnnnnnnnnnnnnnnnnnnnnnnnnnccctttataagngaaaanggccccctccccccccgggaagggggaggggtcaacctcttagagaggnttggaaacaccnnnnttttgttgataaaaaaaaaanaaaacccaattnaaagaaannaaaanggggaacttgggggtttcaacccctgttaaagggnaaaatttgaaaaaaaaaacccttaaaaaaaaaaaaaaaaagggggtaaaaaaaaaaaaaaaaaaagctttttttaaaaaaaaaaaaaaaaaagggggggggggaccccccccnttaaaaaaaaaaccccctttttaaaaaaaaaaaaaaaaaaaaaaaaaggggnaaaaaaaaaaaaaaagggggggttttttttggggggggaaaaacaacaaaaaaccctcctttttgtgggggaaaaaaaaaaaaaaaaaaaaaggggggaaaaaaaacctcttattttttttaaaaaaaaaaaaaaaaaaacgcgggaaaaaaaaaaaaaaaataaaatttttttttgggggggggggccttttttttaatgttggggggggaaaaaaaaaaaagccccccttttttttaattttttttaaaaaaaaaaaaaaaaaaaaaaaaaaaaaacccccccccccccccccccccccgcgccggggggggggngggnnnnnnnnnggcaaaannnnccccnaaaaaaaaaaaaaaaaaaaaaaaaggggggagagggggagggagaaaaaaaaaaaaaaaaaaaaatttttttttttttatttctcccnccncgcnngngngngnnngnnnnnnnnnnnnnnnnnaatnaaaaaaaaaaaaaaaaaaacaccggcgcggntgtaaagggtggga

SEQ ID NO: 14776 - DNA, 857 bp, Xenorhabdus bovienii
  unsure (1)..(857): unsure at all n locations
  Genomic contig Name=Xb4151_4152.C235
cnnnnnnnnnnnnnnnnnnnnnnnntcttgattccattattgtgcatccatcacttgcttgtcgcatattacttatctaacataaccatgtcgagtctagcttcgaacaagacattcgacatatatatggtaccgatgcgtgtaccttacctcatctactatctagatagtgatctaaggaatactgctctctatgtctattactagctgtatcttcatgggcttacattgctcctctcttaacagaagatatccaatcgccctgttatatacctgacattactctatgttacatcgcgtactctctaatatccagtgcacatatcctttcttctcgacttgcctcaaagcaccaattnnaaaggctttgggggggcccaaaaaatttttctttctgtcggcgcaaaaaaaaaaaataacccccccccccggaggggggggggttttttttttttttgtnaaaaaaaaaaaaaccccgcccccaaaaattatggccgcccccgccccccccnttttnnnnaaaaaaaatttttttatccccccccccccccccgggggggtgaaagaaaaaaaaaaaaaaataaaaanntnttttttcccccccccccccccggcccccggggctttatttaattaaaaaanannnnnnnnnaaaaaaagaaaaacacccccccccccccctctaatttaaaaaaaaaaaaaaaaaaattgttttgttgggggagagaaaaaaaaaaaaaaaaacccctttttttttttttttttttttgtcctccccccccccccccnctgtctttttttttttttatttgttttattgggaaaagggaaaaaaggacccgcccgggaccgccccc

SEQ ID NO: 14777 - DNA, 855 bp, Xenorhabdus bovienii
  Genomic contig Name=Xb4151_4152.C236
acaactctgatgatggagtaagggggatatgacacataaaaagaaggggttattttctacattgtaatcaatctattacattgattctttcggatgaaatgagaataaacggattgcaaaaagtaggataattgacgggttaacagtttggtactaattgtagacaattttcgtttccctctttcctgccagatagccccgaaacgacccgcattacttgcggtataacgtacagtatggcgaatattccgatgtcctaaatagtcctgaatcaagcgggtgtccacgccattgtccgccagcgcgtagccgcaggaatgtcgtagcatgtgcggattcgcgcaaaccgctaaattggcctgtaaactcgtttgtcggatgattttataaaattgctgacgggacatcggtacccctgtacgtgacaaaaataaccagtcattctgctcactgtttttgtacttctgacgttgggcaagccactggcgtatcagctgaacctcccgcatcaccatcggatgaattgtggaaaaaccatttttcaggcgctgtacacgtagctttttcccctccaaatccgcatcagaaagctttaacccacgcaattcagatactcggaatccatgaatatagcccataaatattatgcctatatttcctcccacctgagggttgttttcccaactctctggaggagctttcaatctccgagggggtttaataattaccctcttgcatgatgtttgccacaatatttgattcctaagcatatcaagatacctaaaaagattcttgcgagtttcccagcctgaacccagggtttacactacggatctctgatacaacaacgcccct

SEQ ID NO: 14778 - DNA, 694 bp, Xenorhabdus bovienii
  unsure (1)..(694): unsure at all n locations
  Genomic contig Name=Xb4151_4152.C237
nnnnnnnnnnnnnnnnnnnnnnnnnnnnnnnnnnaagtttgngnnnnggnngngnnnnnnnnnnnnggnngggggngggttnnnnnnnnntttttgggggntttggngnnnnnttttttncgggtccttttttngnnnnnngcnacttctatttagccnaaaacagactnggtnnccccccaaaaaccatttgtntgtnagtggtggtnttggcaggctgttgcagtactgaaatgcgcgtttggttaccgaaacggattaccgtgtttccaccttaaggcttgggaactcgggttcccgccaaaaaattttttgggattttggggatcagggccaaagggggaaaaatgggcggaaaacggggaaaaaaggagggggggacccccctttaaaaaacgggaagggggaaaaaaaatttttgcccttggccaaagggccccgggaaaaacccccccgggaaaaaaaaaaaccggggcggttttttatccgggggaaaaaaaaaaagggggcccataaaaaaattttttttaaaaaacacccccaaaccaaaaaaaacccttttaaaaaaaaaaaaccccgggtttttaaaaaacaaggggggggggttttttttccccccccctcataaaaaaaaaaaaaaaaaaggggccccccccccccccccccanccnaaaaaaaaaaaanggtggtgggc

SEQ ID NO: 14779 - DNA, 1092 bp, Xenorhabdus bovienii
  unsure (1)..(1092): unsure at all n locations
  Genomic contig Name=Xb4151_4152.C238
ccatttctatacgnanattacgngcccttcggttaccccatntgtntgtcggaactgggcacccgggggttatatttgggctgggcgcaaaagacggggattaacttttgaaagaaaaaaaaatgttgaaccaaacccccaattggggggctttttcttttggggcaaaggttttaaaaaccccgggtttttcccccacgggggggggggaaaaactggggggggcggcgctccaccccttttttgggacaacaacacttttttttttggtggggaagaaagaaatttatactctctcccaaaaccaccccacacaattttttttttttttttttattttatccccccccccccccttttttttttggggtcgccccccccccccctttcttgtttttttttttataattattttctttaaaaaaaaaaaaaaatttttttttctccttccgcgcgggaaaaaaaaaaaaaaataattttttncgcgccccccgccccctctttttttttttttgtgtgggggggggggggggcccccgccccccccccctctattaataaaggagaggaggggggggggggggcggggaaaaccccccccccccacccatttcttttttttttttttattattggggggggggggggtgtgttttgatttccaaacacacacaacaaacaaaaaaaaaaaaaggggggggagggtggtggttttttnttctcccccgccccccgcggggggggggggggggaaagaccccccccacaccccaccacccacctctctttttttcttttaattttgggcggtgggggggggggggggggggggnnttanantaccatnnntttattaaaaataaaaacaanacaatcccccctcccccccgcttgcggccggcggtgtgcgtttttgttttttttttttctgataaacaaaggcgcggctctgcggctgcgtggggagacacaaaacaaggaacgaaatgtgggaagcatcccnggccttttttttctttctcttctccaacaacccanacagaaaaggagagaggttgaagtgagctggcctccccgcccgtcccccaccac

SEQ ID NO: 14780 - DNA, 983 bp, Xenorhabdus bovienii
  unsure (1)..(983): unsure at all n locations
  Genomic contig Name=Xb4151_4152.C239
gactatctttagtggcgnnantaataacanaccctancgtgttnacncncttnctngnctttgncnctngncccattcgnncataaaaatncttgnacccgcccttaacttgtnngggnnatgaaaaaaagggaggtttcatcccacaggaggtcttgaaccgttgaattttttggaaaggttccacaggggaaacatattgggtaaggggggagtggcaattttttcgtttaacctgggccccaaagagccctttttttttgggggaaaaaaaaaaaaaagcccctttttccgcggcccaggggggaaaaaaacttttaaatggtttcccggggttttttttttttatatcccacaggggtttttttgtgggagagggggtctccccggagggttttctttccttttaaataatagtccccccccaaccccttttttttttttttaatggggcgccccccccccccccccacaccaccccctcttcttttttttttttttgtgtggcccccccccctcggggggggggagggagaaaaaaaaaaatatttttatttttttcttttcccccccccccaacacaaaaaaaaaataataattttttttttttttttttggggggggggaaaaaaaaaaaaaaataattttncccccccccccccccgccgnnnnngnnntnttttttttttttttttttactacaccccccccccccgcccggggttttatgggggggagaaaccaaacccccccccccnctttnaggtttcttttttattaggggggtggcggggaaaaaaaaacaaacaccacccacttttttttttttttttttttttaaatatagagggggggggggggagcgaaaaaaacaaaaaaaaatattttttttttttttttnnntannncccacccgcgggcgtttttttctcccgggcgggggcccccccntatttttttttttaaaaagagggagaaaccca

SEQ ID NO: 14781 - DNA, 947 bp, Xenorhabdus bovienii
  unsure (1)..(947): unsure at all n locations
  Genomic contig Name=Xb4151_4152.C240
ccttttatacganatncgnanctcgtgtaccccttacaacttcccctggcgtnnacctgccatgggcaccancccaaatggtgccctttgtgnaaataaaagccggctcgggtcaaattttncttttgggtttcccaacggggggccggtgggttttatagccccaaaggggaataacaaacttggttttaaaaggggttggggtgagaaaaacccttttctccacgccccagtagaggggattatattagtgtgggcccggggaaccccgcgggggggggtggggcccccccccccccgcgggggagggaggggttttttataaaacccccccccccctcctccggggggggggggggggcctcccccccccccccccaaccgggggggttttttttttattttgggggggggggggcgtgttcnnnnttttttttttttataaaaaaaagaaaaaaagggggggtggtgggtgggtcttcctccncncnncccccccccccgggggggggaggagaaaaaaaaaaaaaaattttttttttttttttttgggggtgggggggggggcgcccccccccccccngggggagataaaaaatatttttttcccccccgccggcccccccccccnagaaaaaaaaaaaaaagaaagttttttttttttttttttnaaataaaaaaaaaaaaaaaaaaaaaaccttgttttgtttgtttggttggggggaggaaacaaaaaaaaaaaaaattggttttttttttccacaaaaaaaaaaaaaaaaaaacccgccagaaggcgnggtggggcggcgggggggtgttttttctttttttttttttttgtttttttttttttgggggggggccccccccgccgccccgtgcggagtnngttttaattaattattatctataatataataanttagcaagggggggggggggcgggg

SEQ ID NO: 14782 - DNA, 752 bp, Xenorhabdus bovienii
  unsure (1)..(752): unsure at all n locations
  Genomic contig Name=Xb4151_4152.C241
nnnnnnnnnnnnnnnnnnnnnnnnnnnnnnnnnnnnnnncccaaaaggggggcggggnnnnngnggnnnnnnnnnnnnnnnnnnnnnnggcactgctgctgcagtcgatctaagatccctgcctcatggatcataccnttttggggatggtgagcgctttctctatcgttacctccgctgaaatctctataacggattgagacctaaaggcattttcaaaaaggggaatgggttaaaaaagggattttcccccaatttggggggccaaaggaaaaaaatttttggccaacaaaaaggaaattttcaaaaatttttgaaaaaaaactcccccccccgggggtttttttaaaaaaagggggaaaatttttccccccaaaaataaaaaaaaaattgggccccaaaaaaaaaatttttttgaaaaaaaccccctcttttttttttttttaaaaaaaaaaaaaggggggggggcccaaattagggggggggggggaaaagaccccccccccccccttttttttttttgttgaaaaaaaaaaaaattttttttttttttttttttttttaccaaaaaaaccccccgcttttttttttttttcctccccaacnnaaacccaaaaattgtnnngggtgtgggggngnttttggggggggggggaccggggcccgggcttccttttctttttttttttttttaaaaaaaaaaaaaaaaaaattttttttttttttccttccccccccaaaaaacccccgtg

SEQ ID NO: 14783 - DNA, 920 bp, Xenorhabdus bovienii
  unsure (1)..(920): unsure at all n locations
  Genomic contig Name=Xb4151_4152.C242
cttatacaatcagccgtcccttatagaagtgctttacgctgatgcagtgcacgaatttgccaaactgaaacatcctagngccatttggaaatcccccaacccccctttaaagggggaaaaaccgtttctggggggcccctttttttccacaatttgggaaaaaggcccgggccccccgggtaaaaaaaaaaaaaaaaacccgccgccccccgccgcttgttggaaaaaaaaaaaaggggtgccacacacacaccttttttttgttggccacacaacccccttctctaaaaagaggttttttttttgcccccccccacaaaaaaaaaaaaaaataaaaaaaaaaagaaagagggaggtttttttttttttttataaaaaaaaaagaagaaaagaaattttttttttttttttttgtgaaaaaaaaaaaaaaaaaaaaaaaaccccccctctcttttattttttaaaccaaccaacaaacaacacattattttttttttttcctcgcgggagggagggggggaaggggggagaaaactttcttctcttttcttcttctttcttaaaatataaaataaaaaaaaaaaaaaataggatgttgtgtggtgggggggagaagagaaaaaaaaaaaaagaaatctctcctccttcacaacaccacgggcccgggggggggggggggggggcggttttttcctctttttttaaattnnnaaaaaaaaaaaaaaaaaaaatttttttttttgttttttttttgttgtgaaaaaagaaaaaaaaaaaaaaaatatttggaggggggggggtttgcgcttttttttttttttttttatttaatataaaataaaagagaaaacacattgggagggggagaaaataaaagtgtggggggaggggggcnnnnnnnnnnnnnnnnnnnnnnnnnn

SEQ ID NO: 14784 - DNA, 916 bp, Xenorhabdus bovienii
  unsure (1)..(916): unsure at all n locations
  Genomic contig Name=Xb4151_4152.C243
nnnnnnnnnnnnnnnnnnnnnnnnnnnnnnnnnnnnnnnncccccgcgaaacgagcgattaaacccnnnnnnnnnnnnggcagtatctgagcatctaagatcctgcacagtgtgatggctactgccatatctatctgtcaaagttcaccgacttgaaaagccctgggaaaggactttaaaccgtttaaaaaaggaaaggtttttaaaaaaaaaagggggggggggccaaaaaattggcgggtttttttttcacaaaggggggggaggaaaaaaaaaaatggggtgtccccgccttttttttttttttttaaaacccggttggggcccccccccaaaaaaaaaggggggggaaaaaaaaatttttttttttgaaaaaaaaaaaggggcgaaaaaaaataaaatctcgggggtttttttttttctttctgcggcccgcgcccctttttttttaaaaaaaaaaaaatttttttcggggggggggggggggggtgggggggggagagagttttttttaaaaaaaaaacaaaaaaaaaaaaatggggggggggtggggggagggggggaaaaaaaaaaaaaaaagtgggggggggggtggcccccaaaaaacacccgcccttcttttgtaggggggaaaaaaaaaacccccccccccccccgggggggggggggggggggaaaaaaataaaaaaaaaaaaaaccccccccccccccccattgtggttttttaaaaaaatttttttttttttgggggaganttttgttttttttttctccccgcgggtggggggacacctcctataaaaaaaacccccccgcctcccgccgggaggtgtgttttgtttttttttttttttggggaaaaagaggggggggggagaataatatttgggggggggggcccgtctcctactcccca

SEQ ID NO: 14785 - DNA, 1069 bp, Xenorhabdus bovienii
  unsure (1)..(1069): unsure at all n locations
  Genomic contig Name=Xb4151_4152.C244
ggaaaaagggggnnngnnnnnaaccaccaaaaaaccccccgtcccgnnnnnnnnnnnnnnnnnnnnnnnnnnnnnnnnnnnnnnnnnnnnnnnnnnnnnngnngngnnnnnnnnnngggggnnnngggnnnnnnnnnnnnnngggtggtggntttaaaaaaaaaaannngggtctcacaaactngnctagncccngccngaattcgnaaannctggaaggaaaaaacccccccctcncaaaaccgctttgggggggggggggnnaagtaaagggaggaaagggaacaaaaaaaaccccaaaaaaaaaaaaccccacaggcccccccccctgggggaaaaaaccccgggaaaaaaaaccccggaaaaaaaaaacccgccggggaaaaaaaagaacaccccaaaaaaaacccccaaaaaaaagggggggccccaaaaagagagaaactcttttttttccgcgcacacccccccccccccccaccccccccccccccccccttttttccccaccccctgtttttttgggtgggggttttccccaaaaaaaaaaaaaaaaaaaaacccgcgggcgaaaaaaaaaaaaaaaaacccccctctttaaaaaaaaaaaaaaaaaaccccccccccaccaccccggtttttttttnnaaaaaagggggggaaacccccccccccgcccccgcgggggggaggggggaaaaaaaaaaaaaaaaaaaaatggcccccccacaaaaaaaaaaaaaaaaaaaaaaggcgcccccccccaaaaaaacccaaaaaaattattttttttttttaaaatttcccttttaaannnnnnnnnnngggttttttgggggggggggggggggggcnnnnttttttttgttgtgtggggggggggggggggccccnccccccccaaaaaaaaaaaaaaaaaaaaaaataannttatacccccccccccccnnnncccacacccccccccnnnttttnnnnnnnnnnnnnnttctttttaccaaaaattacattnnnnnnnnnnnnnnncccnnnnngggnggggggagaaagcaaaaaaaaaaacaaacaa

SEQ ID NO: 14786 - DNA, 760 bp, Xenorhabdus bovienii
  unsure (1)..(760): unsure at all n locations
  Genomic contig Name=Xb4151_4152.C245
gttgcgtttcacggcaatgatcgttcatcttaactggttatgccttatctgatgaacgctactgactgacaaaagcatatgccacggtgaatctgctaatcaggctgagcacgaagcatttttcaaaaacaaggcctttttggggaacttggaaaaccgttctttcctgggggagatcccgtgggtttgggccccaaaacctttttggggggaacacgaccccccctttttacccggggggggtttttttagggggggaaaccccccatgggggcgcccatataaaaaggagggggagaccccccccccggcaaaaattttgccccccccctcaaaaaaaaaggggggaaaagagggggggccccccacaaaaaaataattgggggggggggggaaaacaccacaccgccgccccccgcggcggaaaaaataatattctttctataaaccaacataaacgcggggggtgggggggggggggtgtggggggggggggtgtcccccccccccccccccccccccccccccccacaagggggggggggggttttttttaaaaaaaaaaaaaagagccccccccgggggggggtgttgttttataaaaaaaaaaaaaaaaaaaanaaaaaaaaatactctcctcgcctccgcctgtgaggtgttgggncnnnnnnnnnnaaagggaaaaaaaaaaaaaaaaaacacccccccccccccccccgcccgggtgttttttttttttttgttgtctccccacaaaaaa

SEQ ID NO: 14787 - DNA, 1098 bp, Xenorhabdus bovienii
  unsure (1)..(1098): unsure at all n locations
  Genomic contig Name=Xb4151_4152.C246
ggcgctccaggcgacttggactacggcatctggccgacgcttccggaactatctaacggagatcagcccccaacgactcgagtccccgctctcctcggcggggtcgacataaatattatctactgtcttattagaccagacccgtcctctcggttgcgttactgcctagaaccgataaatagttgttgccacacaagcgcgtcctgaggctcctctctcgcacatggatgcgccacacacataccctatacgcaggccgtaaatggcctaacctcgttacttggcattctctaaggacgcgcatgtatccgaaccaacacatttgcgttactctgcatcccccctggtatttttacacacaaggcccaagtttttcccaaacaaaaaacaaaaaaaacaaggggtttttntnaanaaaaaaaaaaaataaataaaaatatttatatttttttatctnntannnccnnccncnccccccccccgccccccccnccccccccctcncccctatctnctctttctttntttttttttttttttntttnnncnnnnnnnnnaaannataaaaataaaaaatnnnccccactctcttctcttcncttttttttcttttnnattttctatttttctttattcttctcnnctncctctccccccctcccctcccnnaaaaaaaaaaaaaaaaaaaaaaaatnattttttttttttttttttttnnnnattttttttttttttttttttttttttnnnnnnggcggnccccgccccccccccnnnnnaaaaannnnnnaaaaaaaaaannaaaaaaataataanncccccccccccccccccttttttttttttnttttttccccnnnnnnnnncnccnnannnnnannnaaaaaaaaaaaaaaaaagaagaagggaagatttataaattttttttttttttggggggagngnggggnntngggnnccnnnnccccccccccccccgcgcgccnnccncccnccctcnccnccctttcttttttctttntnnnnnnnnnnnnnnncnaaaacaacaaccccccccccccccccccnnngggggggggggggggccgagataaaaaa

SEQ ID NO: 14788 - DNA, 683 bp, Xenorhabdus bovienii
  Genomic contig Name=Xb4151_4152.C247
gcatacttgatgcctgcagtcgatttagagatcccgaagcatccgtatagctttgatatgtgcggaaatgaatatcgttttcgtatagtcatgtttacggcgataataaagcacgacccgtatccgttgaatggggaccgtaaacttaggccgccttgaattagggaacacccggaacgggccgattaaaaccgtcctttggtgtaaggcaaaaagcggcaattggggccctgaaaagtttttttcatgggggttaaaaggggggaaaacgttgttttctttccccccaaaatttttttaaaaaaaaaagccccccccaaaaaaaaatttttttgggggggaggggggggcccccaaaccaaaatataaaaaagggggggggggggggttttttttttgggggggcgaggggctttttttttttttaaaaaaacccccttttttaacccccccccgggggggggccccccgccggttgtgtttttttcttcccccccccccggcggggggggcgcccccccccccggccaaaaatatttttttgtaaagaaagaaaaaaagccccctttttttttttttttttttttaatataaaaaaaaaggaaggggcttgttttttgtttttaaaaaaaaaaaaaaaaaacccccccccccccccccctgtttgtggggggggggggcat

SEQ ID NO: 14789 - DNA, 650 bp, Xenorhabdus bovienii
  unsure (1)..(650): unsure at all n locations
  Genomic contig Name=Xb4151_4152.C248
ttgatgcctgaggtcactctgagatccctgctgcttatttgatagtcttgagtagtttatctcagaccaaaaagcacccggggtggctttttgctaaaaaaatgttgggagggcctacttttactggggggaacccacatttctttggggttgggggggtntttctcttttttttttccgggggaaacaggggggcccaccccctttttgtggcccaaaaaaaatttttgttttttaacccaaaaaaaagggtggtttttttttttttataaaaagatttttttgntttttttttttaaaaaaaaaaaaaattttttttttgggagagggaaacccccccccgccctctttttttttgtgggggggggggaggaagaagggtggtttgttgtnaccgccccccaaccccccccccncgnnnnggggnggtgnngggggggngggggggttcctttttttctgcccgnnnggggggnnngggggaaggggggaaaaaaagannccaaggacgagacgtcccganncccggggggccggccgggcccggcccggnttcggnnnatgggagcgcgttgctgttnntnttggcgcctgtttttttgtgggggggnnnnnntgnnncnccccgccccccgggcgcgagggnaaga

SEQ ID NO: 14790 - DNA, 1164 bp, Xenorhabdus bovienii
  unsure (1)..(1164): unsure at all n locations
  Genomic contig Name=Xb4151_4152.C249
gggaggtgagtagagagaaaagattagggaggtgagnagtaaaaagataaagatctttagataanaggaggaggctgcgaggaggcggactgctaggggagaatgcccccttttttacccnaaggccaggaatggaacacaatccggagtgtttttcccgcttattcgaggtttgcggcccaacagagttgtctggagggcctggaaacctccatgggaaaatacatttttccaaccttggggggaacaaacttttgggcaaactccaggaaatggataaanaggggcgcggatatttggggacccaccccgggggggggaaaaaagggccccccttttttctagaaggaacaaaaaaattggctttttaatccttgaggaaaaaccccacctttttttggtggaaaaatttttattttttttttgggaaaaaaaaacgcgttgggggggcggtgtggaccacaacaaaaaaaattttctcttttttgggggggggaaaaaaaaaanactttcttttaccacgggggggggggggggctttcaaaaaaaaaaaacataccccccccccccaatttatttttttttttttgtgggattttttagggaagggggtggccccccccccccaccaggggggggaggggggggtgttgcggcccgcgggcgcgcggagaaaggtaaacccttcatcttccccgcctcctggtcggggagcgagagccaaacccgaagacccacctttcttcccatcggcgcggccaggggccgcggcggcgacgatttgccggtccgtaccaacaaggcgaattaaaagaagggatgggagaggatgaagcctgcgtcgtacctttgtagaggaatgaatcgagacaccggttggcgagacagtgctatgtgataagtgtgnatcgtagtaatgctttcgacagaaacgtccgcggagaccgctcgagggaacatgtttgtgttccctttcgggggggataaagacgtccgggggccggccgggaggggtgagaagatcggcggattgcactgatcgacgaacaacgaaacaacacgctgcaaacgtgtgatgttgtacgcttctctccgcggcggtggtgggcggggagctttggcacgccccggcgaacggctgctgcgcggaaagacgtattcctg

SEQ ID NO: 14791 - DNA, 801 bp, Xenorhabdus bovienii
  unsure (1)..(801): unsure at all n locations
  Genomic contig Name=Xb4151_4152.C250
nnnnnnnnnnnnnnnnnnnnnnnnnnnnnnnnnnnnnnnnnnncctcttnnnnnnnnncnnnnnnnggngggnnnnttggggtggnnnnnnattttttttnnnngcacttgacnaanccactcgttcccattggaaaacttcaaaggcaaaatggagtaattgcccttttggtccgaatgaagggatattcgaatgggcgttgcgttctggtacaaacgtatttttgccaacctgccgaacttctggaacaggagtaattaagcccgttggggctgggggcccaaaaaaaaatatcnnaatatgggttttaaaaagagaaaggggggtcggggccccaacaccccccgggggggggggggggggccccggaaaccccccccctctggctaaaaaaaaaaaaacccccccagtggggaaaaaagagaaaaaaacccccccccaaaaaattttttctcccaaaaaaaaaaaaaattttctcaaaaaaaaaaaaaaacccctcttgttttttttttttttccccaaaaaaaaaaaaaaaaaaaaaaaaaaccctttttttttttaaaaaaaaaaaaaaaaaaaagggccttttttttttcgccgccccccccttttttttttttttttttgggtggggggggggagaaaaaaaaaaaaaanngggganannngggggggggggggggggggggcgccccccctcccccaaaaaagaagaaagaggggggggcttttcttttttttttttttgggggggggggggagaaaacaaattttctttttttttttttataaaaaaaaaa

SEQ ID NO: 14792 - DNA, 524 bp, Xenorhabdus bovienii
  unsure (1)..(524): unsure at all n locations
  Genomic contig Name=Xb4151_4152.C251
tgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatagcgaaagaaggccccggnaccggatccggcccttttcccaaaaagatttggccccacacccctctaaatatgggggggaaataagagggggcggcccccccctcgggtaggggggcggggggagttggtttttttttttttnnctcccccccttttaacacccacacccctatttttttggtgggggggggggggggtgttttttttttttctccccacacccccccccccccccctttttttttgtggggggggggcgggccactcctcttcccttttgtggggggaaagaaacaaaaacaaaattggggngtgttgttgnggggagaggggcgcggcgnncgcgcgcnccggaa

SEQ ID NO: 14793 - DNA, 1009 bp, Xenorhabdus bovienii
  unsure (1)..(1009): unsure at all n locations
  Genomic contig Name=Xb4151_4152.C252
ctgttttatgacgnantntncgngaccttcggttnaccccagttatcttcccccataaaccagtgnatncggccctgnacccttttnctngttnanccaggcattcaacccggagaagccggccattcttnaatttcaaaagccaatggggcaccctcaaatagggggaaaaaacccttggcccctttttacaaaaaaaaaaaaccttaacccttggttggggccttttttataccccctcttgggggccaaaacggtaaaatttcccccccttaacaccgggggggggccatcctttagaggggggggggttttttttttttttttttttgtggggcctttttttttccccccccccctcttttgaggagggggcggttttttttttttttcctgaaaaaaaaaaaacactttttttttaaaaaaacccccccggcggaaaaaaaacccccccccccccccttttttttttaaaaaaaancggcgggggggggggaaaaaaaaaaaaaaccccccccccctcgtcggtggtgttttttaatcccacaacaaaaaaagggggtttttttttatataaaatattccccccccccgcccgaaaaaaaaaaaaaaaaaaaaggggnnttttttttttttttttttttttttccccccccccggtttgggggggaaaaacaaacccctttttgtttttttttcttgccggtggggggggaggagaaaaataaaaatatatatttttggggttggggggggggggtctttttttttcttccccccaatgtttttgggagaaaatcatattttttttttttttgttgtgttgaaaaaaaaaaaaaaccccccccccccctcttttttttttttttttttttttttttttcctcccccccggggggggggggggttggtgtnttttgtttggagcagcccccaagaaaataaattttttttttttttgccctgggcggaccaagaaaaaaaaaacccagttgatggcctttaaaaa

SEQ ID NO: 14794 - DNA, 1018 bp, Xenorhabdus bovienii
  unsure (1)..(1018): unsure at all n locations
  Genomic contig Name=Xb4151_4152.C253
gactaaatctttagtgagcgnnaataataaaaaacgcccctgccggttttnacccccgntnnctattcaccccccgancccattaatggccgccccggnaaagtccaagggnttttggtttggcccggtggaagcccaagaaatctttggaaaaataccaaagccccaaaacacttgggcggaattgtgtttgtttctcttccacaaaaacttggggggggtttatataaaccaccacacataaagttgggggattataacaccccacaaaatttatttttctcctcccttggaaaaccaacacgggttatttgggggcggggtaaaaaaaaaaaaccgggggggggagncccccccgcgcttttttttccccccccccccaaaagaagaaaggggggcgcgcaaacaagggggggaaaccccccccccccccccttttttgttgaaaaaaaaaagaagtttttctccctttattaataacccccccgcggggcggaaatataaacccccccccccccttcttttttttttttttaaaaataaaaaacacaaaccaaaagaaannnnnnnnntaatataaaaaaaaaaaatttattttctctcccccccaccccccccaaaggggggggggggggaatattttttttttttttttttttttttgggggggggggggggggggggggattttttttttttttttttttttttttctctctcccccccaccaaaaaaaaaaaaaaaaaaaaaaagaggaagagggggccgcccgccccccccccccccccccccctcttaaaaaaaaaaaaaaaaaaaatttnnnnnnnnnnnatttatcccccccccccccccccccccccccggggggggaggggggggggggggggggggtgtggttttcctcttctaacaaaaaaaaaaaaaaacccacccaaaaaaaaaaaaaagaaaattttttttttttttttttttttcccccccccccccccccccccccctttctttctttttattataa

SEQ ID NO: 14795 - DNA, 748 bp, Xenorhabdus bovienii
  unsure (1)..(748): unsure at all n locations
  Genomic contig Name=Xb4151_4152.C254
ggtattcagtnannggagnnggtgcggattcggtggcnangtggcagggcagcgaccgactggctggnagggggacctctcagcngccatatcacaccggggctgggcgcggggantcatctnntattacctcactaattgatccaccactaatggattgttcagccgcccttccttaaccaccaaaaatattttaattnccccccagatcgccgttgatcgtggggggtctaattttccggaaatttctaagatgcccggaattcccgggaagggggggcccttccaataatggggcccgacggggggaaaaaaaccacctttcctcttttttgnnggggccccccggggggaaacccccccccgcccgccaaaaagagggggcgggggggggggggggcccccccccccccccccgcggggggggaggagaagaaaaaccccccccccccggggggggggggaaaaaaaaaagagggggggggggggggnnnnnncccaccaaaaaacccaacaaaagggaggggggnnnngcccccccccccccaaaaaaaaaaaaaccaaaaaaaaccccccccccgggggggggggggggaaaacccccccccccccggagggggggggcaaaaagggggggggggcgcccccacaaaaaaaaaaaaaaaaaaaaaaaggggggcggggggggaacaggacaacccccccccccncggggggcacaccaccccccccacgacggggagagggg

SEQ ID NO: 14796 - DNA, 802 bp, Xenorhabdus bovienii
  unsure (1)..(802): unsure at all n locations
  Genomic contig Name=Xb4151_4152.C255
ctgaattcgaaattccgagcctcccngntaaacccccccccccnttttttccccccnnnaaaaaaatttttcccccccnnnnnnnnannnnaannnaaaaaaaaaaaaaggggtgagggggggttttttttattaaaaaaaaaaanaaaanaaaaatttttttnnnttttnttttnntnttttttttttttttaaaaaaaaatttttttttttttgggggggggggggggggccccccccccaccaaatattttttttataaaatattttttttgggggggggcngtttgggggggggccttaaattttttttttaaaatttcccctttttccctggaattttatcccccattttgaattggggaatttttttttccccaagggaattggtaaatccccctggtttttaatttgaaaaccctttccctttttaaataaacccctaagggggaaagtgtttaccccccgnaaagggcccccttttcccccaaaaccccccaaaaaaaaaaagtttttccccccctttatatatttttccccccccaaaaggccccctttttcacccccccctttttcccccctttaacccccggggttaaaaaaattttttttttaaaaaccccccccccccgaaacccccccgaattccttttttttcccccggggccccccccccacccccaaaaaattttttttttcccccccccccgccaaaaggggggaatttttcccccccccccccattttttttttttggcccccccccccccaaaaaaaantnttttttttttctccccccccc

SEQ ID NO: 14797 - DNA, 952 bp, Xenorhabdus bovienii
  unsure (1)..(952): unsure at all n locations
  Genomic contig Name=Xb4151_4152.C256
ggcaaatctnnnnnnnnnnnnnnnnnnnnnnnnnnnnnnnnnnnnnnttgtaaattaaggggnccnaaccnncnccaatggnaaggnnttgnagtncgaagtnacgnaacttggcccttggtngnngttttncaaacccaactttttggnaacgtgnctttncncgnncaccgncttnncttttnncaattnncnccaagnncncccattnaanacactttttttnnntnnnnnnnnnaaaaaaaaaatatattttttttttttgtgggtttggggggggnaaaacccaaaggggggggtttncccggggggtttgggaaaacccccggggccccaattttcccaaatatttttaaaaaaattttaaaaaaaaaaattttaaagggggggcccgggccccccatatattttttnccccctttgggggnnnggggggccccccccccacaaaccaaaaatttttccccttttttttccccttttttttttttcccacaaaaaaacccggcggcccccgcggcgtttttttggggggggaaaaaaaagaggggtgttttttttttttttttccccccaaaaatttttttttaaaaaaaaaacccccctccttggggggttttttggggggcccccccttctgggggggtttttttttaaaaaaaaaataaaaaacccccccccccggggggttttttttttttttttctcccaaaaaaaaaaaaaaaannnaatttttttttttaaaaaaaaaaaaaaagcggcccccgccgcccncgccggggggaggaaaaaaaaaaannnaaaaaaaaaccccccccccccccccccaaacaatatatatattttgggggggggggggggggccccctccttcttcttttttttttnctcctctttttttttttgtcgtgggggggggggggnnaaaaaaaaaaaaaaaccaccccccctc

SEQ ID NO: 14798 - DNA, 955 bp, Xenorhabdus bovienii
  unsure (1)..(955): unsure at all n locations
  Genomic contig Name=Xb4151_4152.C257
actgatacgattcgagctcggtacccttcagtacggcctttgtncagacaacntnncaaaaananaancccccccaaaaaaaanntttttttttttnccccccccccaaaaaaaaaaaagagaggggctttattaattctattttttttttttatttatnaacaatccccctcctttctccacaccccccctcaataatcaaaaaaagggtaggggggtgcgtgggtgcggggacgtagggtaatgatcgccgatgttactgcccccccccaaaaggtttaaaaaaaaaaaaaccggggttnntccctttccctttnttnttgggtntnttncccccaaaccncntttncccggggnnccccttttcccctttccccttttccccccgggtgtggggnccccccctttttaaaacccccaaaagggggaaaaaaaaccaccccccnaaaagggggtgttttttttttatataaggntgttttttttaaaacccccaagggggggcccccaccaaaattttttaaagaggggggcgcccctttttttttataaaaanaaaaaaaaaacccctccttttctcccccccctttttataaatatttttttttttaaagagggttgggggcgcccccttttttttttttttttnttttttttaaaaaaaatttttataaccccccccccaaacaaaaaaaaaaaaattttttttaaaaaaaaaaaaaaaaatgtttggggnggggtttttccccgcggggggccnccctttttgtgtggcccccccgcggggggggggggggcgccccccaacaacaaaaatttttttnntaaaaaaaatttttataaaattttgggtggggggggggngcccccccgcggcccccccccgccaaaaaattttttttttttgagggggggggagaganaaccacccccccccgcgggagaaaaaaaaaaa

SEQ ID NO: 14799 - DNA, 909 bp, Xenorhabdus bovienii
  unsure (1)..(909): unsure at all n locations
  Genomic contig Name=Xb4151_4152.C258
ccttttgccgaattcggcctcggttccccngngtggtccagcgcggcgtgggcgggtgaggctctggcggacggcctagggctcccagcgctggtncctgctagggcgtctgcgcggccccgggctagtggggcgacttattggccgctgtcgggtcggttgtgtcgcagcccaggaaagacttttttttgggggcccnnaaaaaaaaagcactaacggtttttcgccctgcctaggnctaacagattaaaaacggtnnctctagccncttctntnncgnncttcttnaagaggtnnatctggtngggnatataatttggggntggncattattnanaccaatttnnccaaaaccaaatttnaggngaanaggaaaaaggtttggtggccggcctggttattccaccgtncctgggccttcccctggggcccttccaaaanaaaaccaacccccccttgggttccaggttntattttaaaaaaaaaatccccctttttttttaatttgggtaaaaataattttaatgggggggggtttaaggttttttccacagacccaaaggggtttaaaaacctttaagaaatattttttttttttttcccggggttttttttcccccccgggggggggaaacccctttggggggggggggggaaaaaaaccccccggggggggaatattaaaaaaggtggggccccctaatcgcgctgttgggggggcccatttattccctttcccgggggnncgggggggcgccccccaaaaaaataaaacccccccggggaaaaatttttttggggcgggggctttcttacaaaaagggggggagataatttgtgggaaaattcttcttctcccgggggggggaaaaaaaaaaaataattctccccctcccttttttataaaaa

SEQ ID NO: 14800 - DNA, 1434 bp, Xenorhabdus bovienii
  unsure (1)..(1434): unsure at all n locations
  Genomic contig Name=Xb4151_4152.C259
aaaaaaggggganaaaaaaaaaaaaaaaaaaggtctaaatttgctggcctggggggttgatttttaggggtaccccccaaaaaaggggtaacctttttttccctttaaacccccgggggaacggggtttccccccctctggggaatataacttttgggggggtttttttggagcggttttttttttttttgtgggggggggggttttttttttttttttggggggagaaaaatttgggggggggggggggggtttttttttttttttttttcaaggggggggggggggggattttttttttttttttggggggggggggggggaggggaaataaaaanaaaaaggggggggggggggggcccccctttttttttttgtttttttattttaattttaaagaaccgaaaaaaacacagagggtgtttgttcttttttttttttctttttgtcggtgatttttttttttnatttttgtaaagtgntaacgaaggggggggggggcgcgggtaggttttttcttttttttttnttccgccccgggggtggggggggggggggaggagggaagagagnagnggaccgcgaagactgcgccccaccccnaacgtagcaaatatagaaaaaaaatgatttttgtttgtggttggggcggcggcgcagatcgcacgcgcgccgcgcccctctntnncttctttccgagtngtgnagacgggggaggcgcaaacgaaacacgccacacacaaacaccgaagagagcgcaggggggggttggtggtggtggtgtgttgtgttgggtgtggtggtgagtgccctcgcngtctcggtgggcgcgtgtacggaacgtagaaagagaggaggantaagatcgcaggtgattgtgctgattatattcgctccggagtaggctgggcggggcgggnacagaggcggggagcggtggcgcggcggcgtccgtgcgcacatgacatattanaatacgatanagcgaacactcgtataccccatttnttatatcgtgccgtcttcggcggtgggtggggtgtcggagngttgtgtttggggtgagattactgggctggcgttcggcgcgtgcggtacgggttcgtcggctgtcgatgtatgaatgtcgagtgttgagagggatgtcagtggacgtcgtcgagctgcactgtgtgtgtagtaggagacgtcgatggcacgcgcgccggggttcacgctgagcttcgtctgcggttcgcgcgtgggtntcacggagaggtgtggtgcgggcgctcgtcctatcctgcccatttgccgttcgagcactgcccgtatgcggtcgtatggcgcgccgcggcgagtgggagtggcgcgcgggcggccgagngcgacttggntcagatgtgttgcggggcgttcaggtggttggngatgattggnagtgtcggtggcggg

SEQ ID NO: 14801 - DNA, 1076 bp, Xenorhabdus bovienii
  unsure (1)..(1076): unsure at all n locations
  Genomic contig Name=Xb4151_4152.C260
nnnnnnnnnnnnnnnnaaccccnnnnnnnnnnnnnnnnnnnnnnnnnnnnnnnnanagaataaaaaaaaagagntagcccccaggtttctctcgaggggccgtgacaagggttaaggccgggtgtgagggagtaagacgggcgaagaccgcgcagatgacgcccccaagagcggtgcncgttcccattgnnnnttnnnnccagttaatttaccnaaaatttcgngagncnttcgggnttaccccgcnntattgggagcaattgttcccccatatgtcagaacttgtacaaaagttcaggaaaaggggggggaaaaacagtctccgaccttattctcgagcgaataaccgcatgtaagcctgattccgcaagggcagaaattccccagttgagtctaatcgtggccgaaaacgattaagggaagcctggctttggaagtatcttacaaacaatggacaatttgggaattgggggccccgggccggtttggaaaaaaaaacccccggccttttgggggcgagatttgggaaatccccgaaaaggaaaaaggttttaaaaaaccggggacaaaagggggcttgggggaaaaaaaaaacgggggcctcccttttttttgggggggccccaaaaaaacccccccccaatttnttncccccaggtgttttatacaaaagaaagagggggagcgccccccccgcgctttaaatagggggggggcctccaattttggggaaaagaaaccttttttgggtaaaaaaacccaccccggggggggccccccaaaaaaaaagggggggggggtttttttctttccttcctggggggggcccccccccccccaaaaaaaaaaaaactacggcgggttgccngcggggggttttaaaaagaaaaaaaaaaacaacaaccgcgcccgaaaaaaaaaccactatcttgggtggggggagagaaaaaaaaaaaaaacaaaccgggggggtgccggcttttttttttttttttttttgttnngggggggggggatggaggtaggcgncccgcccccccccccccnccnnnnnnnnnnnnnnnnnnnnnnnnnnn

SEQ ID NO: 14802 - DNA, 1444 bp, Xenorhabdus bovienii
  unsure (1)..(1444): unsure at all n locations
  Genomic contig Name=Xb4151_4152.C261
ttaatattttacagttggagcacctaacatcanttccagggggccanctggcctctatttttttctcgtgccctttttaggaaaaaanaanacggccctctaggagctcttgnncctagggcccctcgcccagggtntgcggaactttttaaaggagagtatccccccttgggcaacccaaaaaaaaacagggggcctttgggtttaacaaaaaaccgcgttttccccccaccatttttaatccgggggggcgcggggggaaaccaaataataaagggggggggccgcgcggggtttttcccacaaaaaaaaaatataaccccccccccccccgccggggggggggggggggggggtggggtaaacccccccgccagtttttgggggggggggggggcgaccgctattttttatttttaaacaaggnggaggggtggtgggggggggtggggagaggtcccccccccccccccccccgcggggggtcggggggggcggggtgtgggaggcggggtgtgtgggggtgaaggggaggagtgcgtaggtgagtcggttttgcagtcgttggtgctggcggtcttcgtttcgcacggaagcgccttgcgtggcgggggcatactgcggttgttttgaggggggacgggggcatgtatcgagggcagtgagggaggcggttttttgttttctgtggcccttcgctaccctctcggcgcggtggcttcgcggggcggggtggggggtgggcaggtgtcgacgcatggcgatgggtgtcgggtctggtgggttggtgggggattgccgggttatggtgggctgcttctcgcgctctcgtaggtggtgtgggggtgtggttttggggaggacggcggcgcgcggggggggtgtgggtggtgtgggcggggttgggtgtgtgtggggtggggtgtgggcgcgctcttggtttgtatggggcggtcgggggtatgagttcggctcgtccgaaggtgtatactcttctcgtatcgtggggtaggggtcgttcgtcctctttctctgnttctccctcttcttaacgactgttnnttcgcgcgctgagcggcgcgtgctaggtttatggttagagtgtgggacgcgtgatgcagcagcccgcgcgcggcacggtcgggtgtgagccgcttctccttntgttcttgtgtgggcgtcgtctcctagatatgaagcacaacgcaccagttcattccttagtcgtctactgagttggtagtcacgcgtgcangcgcgcggctagagtgcgtgtcctccagcgcgcgggctcgcgaggagggcggggggatgggngcggggggcaggcgggggcgtgcagtgccaacaatnctatatatctcctaactgtccgtatgtgtnataggatcggtgccggcgtgcactaccgggtcctcaaagacacactcagatatggattagg

SEQ ID NO: 14803 - DNA, 1219 bp, Xenorhabdus bovienii
  unsure (1)..(1219): unsure at all n locations
  Genomic contig Name=Xb4151_4152.C262
ggggagggggagagagaaggaggtgaggggagggaagagggaaagggagggggggggagcgcttgagcttagggcagancctgggcggatncggactgcttangaggcatccnccatnaatncgccccccttattatacacttaccccaaaccctattacgccctgttttttacccagtaattattcataggcctttaaaatgggtttccaggccccataccttccaatttttgggtaaaaaaataaaacgccccgcccttagacccgaatttttaatgggggatttttggggggggggtttttttttggggggagaaaacccctttttttggggggaaaaaaaaaaaaaaacccccccggcggggttttttggttttttttcgccccaatggggggggatataagaagagaaaaaaaaaggggggggagggggtgttttttttttgtgtttcccacaccaccctcttgtttttaaaaaaaaaatatatatgggtgtttgttgggacaaccacagtgggggggtggacaaacccttttattttttgggcttttcaaaaaaaaaagaaaggggggggggcgtggggtgtcgtaccccccccccccccccccacaaaaaaagagggggtgggtggcggggtttttttctggcgggggggggagaaaaaaaaaaaacaaacctcccccccttcgtctgtggggggggggtttaaaagtcgatatatatggcttgtccgcgcgccgtaatggagttcacggggtgaataagggtgtacgagtattgtttttttttagttggaaacgtaggaacaacaaaaacaatatgctatgtgtttgttttggtatggtgtggcggatcgcggtgaaggggcaagagcgaagggtttcggtgtgataagaaggaaaacgtggtgatcggcgaggttttcgcggagcggggaggcggtgggcgggtgccgttgaggagcgctcccggactgttctttcacctcgcgttcgctctacacctgacttgatgccagagagagtggtggggtggtagtgagtagtggtgcggtttggcggtatctgcgtattgtgtagacgagatgggctanagtgatacttgactcagaagtagtagttatgaanaatagcggtattctatttatggcagaaaaggcgaaaggtttatttctgatctgcgcggtaagtaacgtgtgaagtaggatgtatagtaat

SEQ ID NO: 14804 - DNA, 1221 bp, Xenorhabdus bovienii
  unsure (1)..(1221): unsure at all n locations
  Genomic contig Name=Xb4151_4152.C263
agaaaaaagagggaaaannaaaaaaaaagaaaaagaggagaagaggaaggaaggaacatgtatcttgagaggagaacacancaagganagngcaactacagaagagagagccctccaataagggaaggggctctctaggaaactctttgggccttaggggcccctctggccgagggtttccgggatattcctttaaggagggggatatacccccctctgtgtttttattaacccccccccccccccttttgtggagggggagggaaacattttgggcgcaaattttttaaaaaaaagggggggggcccttggggggcgccccataattttttttatttctctccgggcggggggaaaaaaaaattttttcccccccaccccgggaaaacaaggaaaaaaaagggggtgttttttatttattggggagtcccgcgggcggggggggttttttttttaaaagggggggggtttttttttttcccaccccacaaaaaaaaaggggggggggaaaaaaataaaaagcccccccccccccgggggggggggggggggggcggttgtcatcctaatatatattccctccccccgcctgtgttttttattccggggggggggggggggggtgggagagcacccgcgtcttctctttctttttgtcnagagaaaaaaaaaaaaaaaaagacgacccctcccggcgagggggcgggggggggggagaagaaaaaaacacaccccccccccaactcgcggggggggggggttgtgggcgcgggatcggcccctccccccgttaagtatagcggggagggggagtggtgttgttgggggtcgcccccgcgcccccccacccagagaaggagggtgaggggggggtgtgtgttttttgttttttttttactcattcccaacagaaacaaaacagaaaggggaggaggggtggggggttgtcttatttgattttgatggtatagaggattgacggcgngtggtggcgcgcgggcgcccccgctcttcacgcntccgctacattctctaaattttcgttannatgatttatgcagtgtgcggatagaagtggaagcacgaacataaaactttggatctagatagttcgacgagccttactaattacgtgtggttnagcgcgtgttgtgggccggttgttgggtggcgaggtgaggggagtgagtgtgttggagcgtccgcgcccggccgcacccn

SEQ ID NO: 14805 - DNA, 905 bp, Xenorhabdus bovienii
  unsure (1)..(905): unsure at all n locations
  Genomic contig Name=Xb4151_4152.C264
ctctttttgggggaagggtggtttttncccatttttttttgggggggatggaggaatttttggggttcggcttatgccgagaagggagctagattcccgtctcgcagtcagtgcggcgtgacccgatgcaaatctcgcctaccaacgcatgttgtcattggtgactgacggtggtgtagatctccatcgctggggacattgacacctatcaagggcgcgattccatatgctgtgccatgcgggatgagtccgtacggctttgcgataataacaaaacaggaaaacttcgtgctttttgtagnncccgnnnatttaacccggaaccttntccggtttnncccccctttnacccccttaattttggttttncccataggnttaaaacgggtttttggccttaaaataaaaataaattcccggccctttttttaaggcgcccaaaaccggggaaggaagagcgcantaataatattttttttaaaagaaacccccccgggtttttggggggnncnaaaagaggattatttttggggaaaaacgcgaaaagaccttggggcccggggggggaaaaaaaaataatgtgggggggggccccccccctttatttgggcccccccaaaatggggggaaatatntttttttctaatanataatcccccccccccccaaaggggggaaaaaaaaaaacccctttgggggttattcccaagagaaggggngggggtcncccncctccttttgtggggggtattaaaaccccccccccccccacaaaagtggggggatatatattttgggggggggggnngggaaaaaaaaaaaaaaaaaaaagagggggtggggggtgggtttctcccccccccccggggggggggtttttttttttttacaaaaaagcggagcgg

SEQ ID NO: 14806 - DNA, 1068 bp, Xenorhabdus bovienii
  unsure (1)..(1068): unsure at all n locations
  Genomic contig Name=Xb4151_4152.C265
agtatttttgnnnggcgttttctttttttttgaggaaaaacttcccnttttgggggggnnnnnnccccctttttggggaaaaaannnncccccccctttttctcccggggggggggnnnnnnnnnnccccccccggggggggggggagagagaantttttttttttttntnnnnnnnnnnncccccccccgcggggnggnnnnnnnnnnnnnncccaccccaattatatttttnnnnnnnnttttttttttttnnnnnggggngggggaaaaaaaaagagggggggggaaggagaaagaaannnnnntttttaaaacccccccctctcttttttttnnntcttggggnnccccccagaattngggnnnnaaaaacccnnccaaaannccccnccccccccccccccaaaaaaaaaaaaaacgggccctcttggngnnntnttatatttnaaaggcnccgcggnngggggnttttttngaaaggccccgcggnnaaatttggggccctctttggggnnttggggnntatataatnnttttnaacaacacccccacacaataatatnnaaattatttttggggtnnttttcccgcggctcttttgggggttggggaattnaatatgggccccccccccttggggnngttttttttttttaaaccggggnccgccgcccgagagggttgggttntttttnggggcccccccatatatatatattttgtgggccgcgggtntnngnggggggtttttctcctctttttttcacagaaaaaaaaaaaacccccgggggtttttgggggggttgnggttcccccccctttggggggcgcccccatatttggggggggggggaattatctccccccccccaccacaagagggtttttaaaatagggggggagacccgtggttnttttttntttgtgggcccctctgggatatattttgggggngtaaaaaaacacccaaaaaaacgggggggggaagaggatttttttttctcacacaaagaattatcttggggggcgcgcccacaaattttttttttaacaacaaaattataaa

SEQ ID NO: 14807 - DNA, 1060 bp, Xenorhabdus bovienii
  unsure (1)..(1060): unsure at all n locations
  Genomic contig Name=Xb4151_4152.C266
nnnnnnnnaaaannnnnnnnnnnnnnnnnnnnnnnnnnnnnnnnnnnnnnnnnnnnnnnnnnnnnnnngggggggnnnnnnnnnnnnnngnnnnnnggggnggggnnnnnnnnnncttcttggttggccnnccccagagaaacccccacacaaaaggtttcacntttttttaaaagnnnnnnnggggcctgnnagnagctgtngnnncntagnnacnctngntcttagtntnncgnnnatncctcngaaggaggntaccccccccaatnnaaagggnaccacnatnnnaacgnncaaaccncattaaaatgnaaaaaaaggggnaaaattaattaaccccactttaaaaaggggggtgccttttttttttaccaaaagaaaactcttttatnccacttttaaaatatcccacaaaatgggaaaaaaaacaaaatatttaaaaaatggggggggcgggagaaaaaaatattttcaaaaaatacaaaaaaaaaagaacaaggggggggggaataaaaaaaaggggggggggggggggccccccaccccggggggtttttttctaaaagcaaaaaaaaattagttttttttctctggaaaaaaaaagaggggccccccagggggggtggcccccccccccttggggaggccccccctccaaaaaaaaaaaaaaatatttttttttggggcgccccccccccaaaaaaaaaggggggggggggggggggaaaaaaaaaaaaaaaatntcnccccaccccccccgccccccccgcgctgttttttttttctctccccccaccccccccccnnnnnnnnnnggggcccccccccccccccccccccggaaaaaaaaaaaaaaaaacaaaaaaaaaaatgggggggggggggaaaacccccccccccccggtagaaaaatatatatttntnaaaaaaaaaaaaaaaaacaaacccccccccaaaaaccccaagaaaaaaaaaaagaaaaatttatccccccccccaaaaaaaaaaaaatcttccccccccccccacaaaaacaaaaaaaataaaaaaaaaaggggcg

SEQ ID NO: 14808 - DNA, 946 bp, Xenorhabdus bovienii
  unsure (1)..(946): unsure at all n locations
  Genomic contig Name=Xb4151_4152.C267
aaaaaaaaaaaannnnannnngngcnnngnnngagaaagaaagnnnnnnngggnaaangnggngttttttaacggnaaaccccgcatttccctttgagaacaacccctacaaacaaatacgtaagctatacctccctctatgaggaaggaataaaatannaaacaaaaaaaaaaaaanagttttttaaattttttttttttaaaaagaaaananaaaaagggggttttctttcctcccttttaaaaaaaattttggcttttaaaacccttcggccctttttttcccccctattttttttaaaaaaaaaaaaacccccccccttaaaataaaaaaaaagttttttttgcccccccttctttttggnggttttataaaaaaccaacccctctctcccccccaataatnnntgtcttttatttttttttttttttcttgtttttaaaaaaagcaaaaaaaaaaaaaaaaanaaaactctttttcttttttttcccccccccccccccccccaaaaaaaaaaaaaaaaaaacaacaaaccctcctcccctcccttctgtttttttaataataccnccaaaaaaaaaaaaaaaaaaaaaaaagagagggggggagnggngcgnnncnccccctttttttctttttttttttntattttttnnnagggngggggggngcggggncccccccacaaaacaaatatttatattttttttgtnnntnttattttttttttagngcgnnnttttataataataaacaaccnanaccctcccccaccccaccccacccgcgnnnnnnnnggngnnnttccctcgcgccccccggcccaaannnccaaaaaaaaaaaataaataaaanaatattcccttttncttccttttttctccgnnnnngcttttcttattctatttcttttcttnangctcattctatttttacttttttatt

SEQ ID NO: 14809 - DNA, 863 bp, Xenorhabdus bovienii
  unsure (1)..(863): unsure at all n locations
  Genomic contig Name=Xb4151_4152.C268
ggctagctgcatagcttgcatgccctgcaggtgcgacttctagnagcatncccctatggctgaggaaggttatgtnccccactatctacggcggtgngaataacacccaaataccttaggcgaccctaaccaagtcacccaaatcatactcccggcggcgacataatacatttgtgggagggattgctgactggctcgcatatgtagacccttagccaactcgggttggattcttctgcggaagagagcccagaccgaatcgacccgcacgctgtgctgctaactagaggcccaaaaaaaaaacagggggnaaaaaaaaaaccgggccttattttggggcccgggggggggtggaataaaaggccccgggttttctatatgtttaaaccccgggattttttggtccccccccttaaccttgaaatgggaaggcgggggtttatattggggcctctgggcgggaaaggggggaaaccccgatcgcgaattattttttggtaaaaaggggccccggggaaaaaaatttctggggggtttctccccccaattggggggcccccctttaaaaatttccccggggggaaaaaaaaaacaccccgcctttatttttggttggtggggacacacaaaaaaaatatttctttcctctttttttgggggggggggggccccccttttgggggggagaggaaaattatttttccccccccccccccggtgttttttttttttggggtgcggcccccgttttttataaaaaaaaaaaaccccccccccccccggagggggggggaaaaaaaaaaaaagaaggggcggcggggcgggttgttttttaaatttttttattgtaggggggggcggcg

SEQ ID NO: 14810 - DNA, 902 bp, Xenorhabdus bovienii
  unsure (1)..(902): unsure at all n locations
  Genomic contig Name=Xb4151_4152.C269
nnnnnnnnnnnnnnnnnnnnnnnnnnnnnnnnnnnnnnnnnnnnnnnnnnnnnnnnnnnnnnnnnnnnnnnncctcataactcactctccccaccatatctatcacagagcactagacctgatntnnnnannaaannnnnnnnnnnccaggaattacgaaattcgnaagactcgngntacccccgnnntaaactcttgcatgntggctttggtggaataaaaattgggcctggggcctaatggggtaatttccgggcaaaagccttttttggggtcccgaaatttttgggggggaaacgagggccatacaggacgatcaaaggttggccaaaattttcacaaagcccaaggtcttaaacaaattttgaaaaattctccggggggaaaacccccccggccccaaaattgcccaaggggtttcccctcggggggctttttttttttccgaagaattaaatggcgcggaaaaaaattccccccccttttttgggggaagggggggttttttttggaaaaacccccccccgaaaaaaaaaatctttttttttcccgcgcgnttttttggnaatttaataatactccctctttccnnaaaaaaaaaaaaaaaaaaggggggggggggggttattttttttttaaaaaaaaaaacccaaacccccccccttttttttttttttnnttttttttttgtgggggggggtnnnnaaaanaaaaaaaaannnaaagccacacacaaacaaacccaaaaanttatttttttttttttttgttgaagaagaaannnccccccacccccacanaaaaaaaacaaaaaaataaaaannnnctttggggggnccccgccgcgcccacaaaaaaattttttttttttttttttatttaaaaaaaaaaaccaacacccg

SEQ ID NO: 14811 - DNA, 1408 bp, Xenorhabdus bovienii
  unsure (1)..(1408): unsure at all n locations
  Genomic contig Name=Xb4151_4152.C270
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccttgtcttatgcgtgggtagggggggngtnngaggaaggcgcnnngggnnnatgngnaagggttnattggtttatgagacaanaaaaccagacggcctcggggtgggcgtggggngncgnggngnnnnnnnaaagnananaanaaaaaanaaanaaaannanaanaaacaacgccggcgccccccccncnnccccnnnnnnnnnnnnnnanaggagganganananttttntgttntgtttnttntttgtgtggtgnnggggggggggggggggggaaaaagaaaatggggggggggggggggtgtggnccnccgggggggcnggagaaaaaggantagggggggggggggggaggganaannattttggtttttggtgtgggagagaggagaggggagagtagnagagaaggcagancgccccgcttcgttgtccgcggggggggaaagagaggggggcgcgccctcagaataaaaaaacacttncgcnaaaaaagggggggagggaggcccggggggctcacaaggagganaaagagggggggtaaaaaaaaagaagagaggtgggggggcccgcgggggggggggagaggattttgtggggggagaaatttccccagaagaggggagaagagaggggggggggggggaaaacaattctttttttttttggggggngggggggggggggagacccccaaaaaaaggggggggggggggggaaaagaggagggagggggtgggagaaaaaaaaaaaaaaaaaaaatttttttttggggggggggggggggggagcacaaaaatatctcacacaaaagggggggggttgggggggggtgggtntnatagaataaataaagttntttagaaaaaaaagaggaggggggggggcgcgcgccgcgncgnaagaagaaaatatnaaaaaatataggnaaaaaaaaaggagggggggggttggntggtctcncgccccccaacaaaacaaaaaaagaaagaagaggnnntnnnccccgcgggggggggaggagagcagaacaagtgggggggggggggggggggaanaaacnacccacaaaggaggagagggggggggnggggntttagggggggggggcgcgacggctcgtggttttggggnnnnanaagaaaaaagagagagagggggagggggcccggccgccggaggggggggggagggggagnnnnnagaggagatagtatttttngaggggggggggaggggnggagggnnccagagcaagagagagganaagagnagagagggtggggnggaggggaagggagaac

SEQ ID NO: 14812 - DNA, 1745 bp, Xenorhabdus bovienii
  unsure (1)..(1745): unsure at all n locations
  Genomic contig Name=Xb4151_4152.C271
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaggaaaaaannnaatgaataaaataaatgtttatatannncctttctctanctatccccctttcttngttatatttggagggangtcttccctcctctcttnnntnaatcgnnnccccnccccccctgtcgttcnnaagtcctttacatccagtactaagaatgnatcgcacattagtacatacnacaacctacaaattgatagtatataatacataaacataanntatgaggcacacccctcatcccaaataagaatgacagagaagatnnnagagtgntctttgntttgtcgtaagctcacatatctccacacacctctcagaatctttaagagagtgnnntctttttcttctcncatatattattatnnnnnnnnnnnggggccccaaaaaacctttttggnccaattttccncnnccttggnnnccaaaagggnnnttgcgggnnaacctttnctcttaaaggnnnaaaggnnnngaattnnnnncccntntncnttnncttcagnnntntnnatatnnaaccncngncnncgnnttngnntntttnncnnnccnnnnnagnnnnnaannttnanntttnnnncnnccgnnnnntngnncnaccntttnngnnnncngnnnncgnnncctttnggnntnttnttnaannttttnancnnaanncncgnnnnncgngngcacaaanngnnngattnannttttgncncnttnccntngnnaatacngngaattngcnnccgcnaaattttnnnaaggnnnngcnncacatttccncgnncggngaattttgttgtttctccannncnnaaaanngnagttnttatnagtatanttgtctccgacagagaggttaatnattttntggnntttatanattannanatgntgtagggnaaccnccctagttttgaaagggcccaattcttttacaaatcattatatantgtcccaaaggcccacaacctctttntgttttncgccatattttcaaaananagaaacaggcggagagaatannnttttngnntgnagaacacacgccccctntttgttttttttgccaaaccnngggnaaaaccttctctttttctttgcccccagaaggnnnaaatnttatatccaaccntcttttttgtgtttggcaacatattatattttttttgtttggggnaggaaaaccaatntaattcctccccgggggtgtggggaaaaaatttatattttcccccccccccggcgggcgggggagaaaagnaagtaaattatttttttttttattttctctccggggcgggaaaagaagaaaaacacaacaaaaagggggggggggggtttttttatttatatttaaccctatnnncccccctccttctttttttttttttgggnggaggagagaggagganntgttgttgtttggggggagagaagaataattatttttttttttttttttgttttccgcgggggggtttattttttttttttttccttccccgcccccaacaacaaaataatataaatatttatatttntcccctcccccncacaaaaaaaaaaaataaaaag

SEQ ID NO: 14813 - DNA, 829 bp, Xenorhabdus bovienii
  unsure (1)..(829): unsure at all n locations
  Genomic contig Name=Xb4151_4152.C272
ggaatttgggggaaggggggggctacatncccccactttgagggggggggggaaccccccaggcggcaagtagggaagccaggccgcaatgaagaaggcggagagcgagaacataggccgaggaagcaaaggaagcgagggggggggagacccctaggaaaatntttnnggtaaaaagcnccaagacnnnnnnnntaaaaaataaaaannngccccggnggggggaaaaaaccccccnagcgcgggggtttttnnccaacaccnccccaaaaaagggggggggtttgggggnnncccccaaaaaaaaatntttncctttnntagggcggggcccaatnntccntctgggccnctagggccccaaaggncttngaggggagataaaaataaaaggccaatattgggcttaaaaatttaaaaaaaaaaagggggttttnnccccccggggggaaaaaaaaacccaaaaaattttcccccggggggggggggggggccctttttcgggggggggggggccctttaaaaaaaacaaaaaatgggggcaaagggggggttttttaaaaaaaaggcccaaggggaaaaaaaaggggcccttttaaaggggggccccccccccccttttttttttgggggggggggaaaaaaaaaaaaaanntttttccccccaaaaaaaaaaaaacccccaaagggggggtaaaaaaacccggggggggaaaaaaaaaaagagcccggggggggggttttttnnaaaaaaaaacccaaaaaattatccccccgggggggggggaaaaaaaaaaaaggggggggggggcgaaaaaagaaaaaaaaa

SEQ ID NO: 14814 - DNA, 820 bp, Xenorhabdus bovienii
  unsure (1)..(820): unsure at all n locations
  Genomic contig Name=Xb4151_4152.C273
ncctttttcttgcatgacctcgcaggtctgactctagaaggaatcccnncgtanaaaataaaacgccctggtttngannggagagatatagaatttggatccgnttcttggnantncntggagnggagtncaanaagaaatcccanggggannataaggggtggggaaaattacaaatttttcccctgcccaaaaaacgggtgtttaaacactggtgtttttttcggaaagaagagggggaaaaaaaagccccttttttaataaccccccgtttttttttatccccaaccaaagggggggttttctcaccccccaaatttttttttttttaaaccacccctctcccacaataaagggccccccccacaaaaaaaaaccccccccccccctttggacgcttttttaaaaaaatcttttttttttgcggcgccaacaaaaagggggggggttttttaaaaaaaaaccccccccctcctttttttttttttttttgttgggagaaaaaaaaaaaaatttttttttttttcccccccccccccccctttttttttttttttttaaaaaaaagggaaaaaaaaaaaaaacgcgcgccgcccgcaaaaaacccccggctttaaaaaaaagaaaaagaaaaaaaaaaaaaacaccccccccccccccccccccccccccctctccccaaacaaaaaagagggggggggggggggggggggcgggggcccccctcctcttttttttttttttttttttaagaaaaaaaaaaaaaangngggttttttttctttttctnnnnnnnnnnnnnnnnnnnnnnnnnnnnnnn

SEQ ID NO: 14815 - DNA, 556 bp, Xenorhabdus bovienii
  unsure (1)..(556): unsure at all n locations
  Genomic contig Name=Xb4151_4152.C274
nnnnnnnnnnnnnnnnnnnnnnnnnnncgcatatttttggtaaaacgcgtgttgccttttcngctgcatattgcgacataaggcgcatacctgactgaataataagaattcgttggctggtaaaaggggcccattggggccccgcaagggtttggccccatttcccgggcaaaaacccctttttttttaaaggttaaaccccgatctcttttaataaaggggggccccggggttttttaccggctttttttaaaaaaaagtttttaaaaagatttagtttggaaaaaaaaccgcgcccgttttggggcccccaaaaaaaaaaaaaaggggggggggggaacccccccccccgcgtgtttttttttttttgtggggaggaaggaaaggggtgttgttttttttttttttccgcggggggggggggggggggaaaaaaaaaaaaaaaaaaaaaatggggggggggggggggggggggaaaatttaccaacccccccccccccccctttccgtgttttgtggggtggggggtncacaccaaaaaaaaaaaaaaaaaaat

SEQ ID NO: 14816 - DNA, 1772 bp, Xenorhabdus bovienii
  unsure (1)..(1772): unsure at all n locations
  Genomic contig Name=Xb4151_4152.C275
ggggtggaggggggagtgtgggggaanaggggaaatggtaatagggaanggagaagtaaaaaagggcccaaagaactttggccctgggcccttgggcgaggggtcccgcacctcttctaagaaggaaaaccccccaccccaaaggggggaacggggtcccacaggggctttttcaggggggtttttatattggcgccggggaaggagaaaaaataattagggggccccccccaaaggggaccccccccctttgtggggaaaaaaaaaaaaaccccccccccggggggggcgcaaaaaaaagaggggggtgtttttgtttgtggaaaaagaagagccccccccccccccaaaagggggggncccccccccccaccaccgccccccccttctagtggtcgcgcccgccctcttttttttaaaaaaaaaaaaaaaaaaaaaaaaaacccccccacccgcccgccgcgggggccggccatttatttaaaattcgcggggcgcgcgggcgcgcgcgccccccctctcgggtagggacgaggcccgaggggatgagcgaaaaaagccacagcccccgacggggccgcccnncccctcccactcctccttttttgtatgagcgaaaatcccggcgccccccccccccgcccggcggcggggcccgcccgttcccttttccctcctgttccgctaccctccccccccccgccccagcgaacaaaaaaaaccaataaccccacccctctcctcgcgctccagcacggccgcgcggtgacccgcacgaaggtacgagtgccgcgacgtcgcgacggccgcagccacaggcgtgcagggcccccggccgccgtgctagcgcgcgccgcggcagccgncaaccggccccacccgtctagctgccgcgcggaccgcanggaagccgcaggtgtgtcaccgcaccccaggcgtataatgccgctgtatctacgcgcgccgtaagattccgcggccacgacncggacacggattgtctaagacgccattaccgaagaatgtgcgctgcgtgctctccaccgtacacncnagactgacgctacacagaacctgcgcgaaacaagtgangcgaccgcacgcggctcagacngcagaacatgtgcnatgaatagactacccccgcagcgcggtcacgcacgcagntatgtncgggcacgacttcanaatcgtccacgatcccagcacagcgcgccgtagnttacgcgcacgcanccccggtantcacccacntacatgacacggaacgcgcgcgantgtcgcctgtcgcccgcgaccncgcgtgtgctacaccgtatagcagcgacccgtgactcgcagnatatcctccngccacgtatgtcggccgcacgtatcgagacacgtcgatctcccgatcgcancatgtcgctnnagtaatcgtgtagtcttgtctgagatcgccattctccactggnaggccgcatgctanactngacctcatctgcagtatagcacatgctcagcgtcgttaggcgacccgcaccagaccatcgcggngnatctaccncgcgnagcaccgcccaccagcagctcatgtcagcccaccncagcgcagcgtctgntactataatgatgcgcacagtcagtcangcaccgccgcgtctcgtagtacgtancgtcaccgtagctcgngtcantaccaccagtgcccacggtcnctaacggacgntaggagtngtacccngacatacacctntggtgatggagnagcntggagccgtcgactgcgt

SEQ ID NO: 14817 - DNA, 1092 bp, Xenorhabdus bovienii
  unsure (1)..(1092): unsure at all n locations
  Genomic contig Name=Xb4151_4152.C276
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnncccccccccnnnnnnngggggggnnnncncccnccnnnnncnnnnnnnnnnnnnnnnnaaaanannnnnggggcccaagacccttgtccaatggcccntggncaagngnntncgnnaacttccntaagnnaaagnaatcnccncncagnncagntcggntgggctcaagcagaaagtgtgccatagaatcaagnaattggggctgaatgggccaggccgnaaaaaaggaaaacagggggaaaaaattttccgccggggaaaagggcggggccaagaacggntgaaagttcagggggcagggagggaaaaggntacggtcccataaaataatggttgttggggaatttaagccaattggaggggtgggcggtaaatataagcccggatattccaaaagaatttcccccccccgggccccaaaggggcattaaaaaaaaccccgggtcaccccccgggttttttttttaagggcacccccgggggaaaacccccgtggaccaaaataaatttaaggggaaaaaccccccgaaagggggaaaaaaaaatttttcccgggaaacccccccccccaaaagaaatggcccctgttgggggaaaaaaaaaggggggggaaaaaaaaaccccccccctttttttcggggggggaaaaaaaacctttggggggggggtttttttaaaaaaaaaaaaaannnttttttgtgggggggggctccctcccaaaaaaaaaggcccccccccccccctgtttggtaaaaaaaaaaccccctggtgggtgtgtgtaaaaaaaaaaacccacgggggtttttttttttttgggggnncattgaaaaaaaaaaaaaaaacaacaccacccccggaggaaaaaaaaaaaaatatttgagggggggccccccccccccccc

SEQ ID NO: 14818 - DNA, 342 bp, Xenorhabdus bovienii
  Genomic contig Name=Xb4151_4152.C277
cgagcggccgcaagcttcggtctggtcattccgggaatcgtcaacaccttcatcggtctcttcaaggatacgagccttgtctacatcatcggcatgttcgacctgttgggcatcgtccgtcagaacttcgccgacgctaactgggcttctccacagacgcctgctactggtctgatctttgcgggcttcgttttctggattttctgtttcgcaatgtcgcgatactctatattcatggaacgacgcctcgatacgggtcataaacgataagaataaagggaataatggaaatgagtgcacaaagcgccctccctcaatccgagacctcggccaagcttccgc

SEQ ID NO: 14819 - DNA, 697 bp, Xenorhabdus bovienii
  Genomic contig Name=Xb4151_4152.C278
gtttcgagcgggcgcaagcttcggtctatcgctcatccaacagccagcgaccttccggagaaagaagaacgcggggcgttcaccgtcgttgtacgggtagcatagccgttccggcctgcctgctttaccttgtagagcgcaagatcggcccgcgcaaaaacatcgaggtcactcctctcatcacccggttcttcgctcgcaatgccgatgctgaccgtcaagatgagtttccgcccgttgaaaacaagcggcgtatggttgactgcgccgacgatttcacgggcgatttccgtcgcctcatgctcctgcatcccaggcagcagaatcgagaactcatcgcctccaaagcgcgccagcacaccgcggcgattgaggatgtcgaccccgacatcggcgaaatgcacaagcgcctgatcgcccagcgcatggccatatgtgtcgttccaatgcttgaaattgtcgatatcgatcagcatgacggtataggcgaccccgtcttcactgaatgcgagttcggctctcgccagccttttcatgaaatggcggcggttcgggagcccggtgagttcgtcggtctccgcgacccttgccatatcgccgtgcaggcgattcatcgccatgacgatgaaaccaaaattccatatcatgccgctatagatcacgcagaccagcgcatagacctcggccaagctttcgc

SEQ ID NO: 14820 - DNA, 339 bp, Xenorhabdus bovienii
  Genomic contig Name=Xb4151_4152.C279
gcggaagcttggccgaggtctttaaccgtaatgggcgaattctccggagcgtattttgcggcgttgtcgaacagattgaataaagcctgctcaaacaggacggcgtcaaggtggaccatcggcagattgactggaaccgcgacgttgacctgatggcaggcgagtatccgagatgcacgattgagtgcagccccgatcaggtctccaacaaaatgaagcgagagattaggcttcatcgcaccggcttcgatgcgagtcatatcaaggagattggcgatgaagcggttcaagcgttcagattgatccacgacggttgcaacaagaccgaagcttgcggcc

SEQ ID NO: 14821 - DNA, 256 bp, Xenorhabdus bovienii
  Genomic contig Name=Xb4151_4152.C280
tcgagcggccgcaagcttcggtctggcgatttcgttcaggcgtctgagatattctcgtcgatccttcatgccgtcccggataatgtcgacgcagttgtcggtcttgcgacctgccttctggaatccggcgacgcggaaaaggcgcgggaaattctggcccagattcctgcagacaagcagaacgcgcctgccgtccgggcgctggaagcacgtcttgcactggccgaccaggtcaagacctcggccaagcttccgc

SEQ ID NO: 14822 - DNA, 442 bp, Xenorhabdus bovienii
  Genomic contig Name=Xb4151_4152.C281
gcggaagcttggccgaggtcttgatattgatttcgcccgctgttgcggatgacgcggcaaagatgagcccgagaaacacaacccagttcttcatatccaatccacttcacgatctgaaacacataccgattgagatataacaatctccacaaatgtccaaccgcgaccgccgcccgccgctaatcttctccgcaaaatgaaaccggaggcgcttgacgctgaaagaccaaaagagcacaagaaatcatgtctgagattcgatccatctgtgtttattgcggctcgtctacgggcctgaatcccatctatcgcgatgcgggcgttgcgcttggccggtccattgccgaacacggtctgcgccttgtttatggcggcggcacgcgcggcatcatgggcgcggttgcgcaaggcgtgatggaagaccgaagcttgcggccgctcg

SEQ ID NO: 14823 - DNA, 497 bp, Xenorhabdus bovienii
  Genomic contig Name=Xb4151_4152.C282
gcggaagcttggccgaggtcttcctgaatgtccatgccatggtcgatgacactcatgatcgcctccagcgtgatcgtgatgatgcgcgaaccgccggggctgccgatgaccatgaacggcttgccatccttcgacacgattgtggggctcatagaggacagcggcgacttgcgcggttcgatggcattggcttcgccctgtatgagaccatagagattggccacgcccggcttgatggtgaagtcgtccatctcgttgttgagcagaatgccggtgccttcggccaccttggccgtgccgaacgaaccgttcagcgtgtaggtcacggcgacggcattgccgtccttgtccacaatggaataatgcgtggtctcgttggattccttgaattcggctggcttgagcgcctcgctgacaccggcgcgataaggatcgatacggctgcgaatttcagcggcataggccttgctggtaagaccgaagcttgcggccgctcg

SEQ ID NO: 14824 - DNA, 739 bp, Xenorhabdus bovienii
  Genomic contig Name=Xb4151_4152.C283
gcggaagcttggccgaggtcttctcgaagatcatccggcgggtcggatcggcaagcgccctgaaaacatcgttgaatatatcgttctcattcatgccgtcacataagcacgcacttatgtgattcgcaagagaaacttttcgctcgctcaagactggcgggaatgtcaggcaagtttgttcaccggcacccaaccgaaaaatccattgggcgcgctgcaccaagcccatccatgcgtttcttcgataacgtggaggacggtccctttgttgcaggtcagttccatcgccgagtagtcgcgcagagtgatgaccgtatcatccttgaccgtgatgctgttatcgggaatccaccccgcacggccatccgctcccacggcccacagccaccggtagccgtcccagatttcggcctttccggtcagggataccgtctgccctcgtgtgaaggcgatgggatgatcgtatggtgcgacgtgatcttccagcagacgcctgggaaccgccttgtctggcatcgatcaatccgccgaatgaaactgcatggtgaagacattcccgccgataccctctgccagcgagggcgcaaatttcagcggcgtgcatttttcaaccgcgtcgatagcagcgttcacgaatgcctttttcgccttgtcatccccctgaacgttgatcgcactggggcggggcggccccatcaggctgccgttgcgcttgaagaccgaagcttgcggccgctcg

SEQ ID NO: 14825 - DNA, 523 bp, Xenorhabdus bovienii
  Genomic contig Name=Xb4151_4152.C284
tcgagcggccgcaagcttcggtctgctgcaattaagccaattcgaccaaacggcgagaatgccaatctggcaattccacgccccagtgtgatcattgccgcaccggtagcggctatacctattgcacttattactgtggtagccccggacatcttactgatcgcttccgagatattcccggcagcaccgagaatatcgcccgacccgatatccttggcgaaggctttaagatcgagcccgatcttgcggaaattattcgatagcctggccagatcaatcatgcgctgatcgacctgcgtgccgtcaccttcaaatgccttgccaaacaggagatcaccgagatcgttgatcagctggcgagtaccactctcacccccataaccgaaaccgctcatcagacccttgacggccatttcgatcttgtcgatgacgcccactcgcttatccagcgtgtccagcacatcgcctataccaaggctcatatccttgatcgtcggtaaccagacctcggccaagcttccgc

SEQ ID NO: 14826 - DNA, 261 bp, Xenorhabdus bovienii
  Genomic contig Name=Xb4151_4152.C285
ggaagctctggccgaggtcttcttttccgcggcttcggcggcatgttctgccgtaatgcccaaatgcttgtagagatcgttgatctcacccgaagcgccgaagcccttcatgccgatgaagatgccgttttcgcccatgaatcgttgggaggcgggcgagatttcctcttcaatggctaccttcaccggcgcatcgccgatggttgccgtcttgtaggcgtcgctctgctgttcgaaaagaccgaagcttgcggccgctcg

SEQ ID NO: 14827 - DNA, 662 bp, Xenorhabdus bovienii
  Genomic contig Name=Xb4151_4152.C286
gcggaagcttggccgaggtctgggcggcctcgacaaatacggcctcgactatgagagcctgaaggccatcaatccgcgcctgatctattgctcgatcaccggtttcggccatacaggcccttatgcggaacgcgcaggctatgatttcatgatccagggcatgggcggcatcatggatctgaccggtgaaccggaccgggagccgcagaaaatcggtgtggctttcgccgacattttcaccggcctctacagcgtgattgcaattcagtcggcgctcatcatgcgggagcgcaccggcaccggccagcatatcgatatggcgctgttcgactgcatgtcggcagtgcttgccaatcaggcaatgaactatctggcatccggcatatcgccgaagcgcatgggcaatgcgcatcccaacatcgcgccctatcagacgttgcccgtttccgatggctatttcatcatcgcctgcggcaacgacggacagttcggaaaactgacttcactgctcggtatcggtgatatcgctaccgacgagcgcttcgtcagcaattcggcgcgcgtggccaaccgggctgccctgacggcgtttttggaagaaaagacccgagcgtggaagcgcgacgatcttctggccgagaccgaagcttgcggccgctcga

SEQ ID NO: 14828 - DNA, 278 bp, Xenorhabdus bovienii
  Genomic contig Name=Xb4151_4152.C287
gcggccgcaagcttcggtctacacctttatggcgaagccgtcaaattggagcctttccggcgagagggtgaagcatccatgcggcgcattcggtccaggggccgatttccatcccgcttctgttttcatcccgttcagacctcaccggacacttcgcgacggcgccggtccagttcttcgctatagcggcgcaaggtgtgcgcttcactgaggaggccgagcaccttgcgctcctgtgcgttgttcaccacggcaagagacctcggccaagcttccgc

SEQ ID NO: 14829 - DNA, 840 bp, Xenorhabdus bovienii
  unsure (1)..(840): unsure at all n locations
  Genomic contig Name=Xb4151_4152.C288
ttgctagagatagtgcaattccctcgaaattgcaagaaacaataaaattgccacattttataccatgcaaagctttctgagcaacttcatcagctttcatagaaccagaggaggctgcaatgattttggcgagctctggttttctctcggtttctgaaaaagtaacctttcagctagtacttccacttggataacaggaaacataaacttcacacacgatatgctataaacagacatttaacatgctgaaagcataaattttatcttttacaaacccatgaaggcataaattctaaatgaatatttaataatcatggatgaacttatcatgttaagcaataacttccattctctaatctccgtatgtttttaattaggattgatcctgattggaatccatctaacgttcagccctttaagttttattactcccgcacgcccaaaagggcaattgttagttagaggtgagagaatgcttgtgaggtcctgttatagggggagggagctgattctcatgggtatggataattctgaaatggaattgggagcctcgagaatcatctctaacttagcgaactattctgcttttatttaatttctggctttacttttttggtttactaaattacacgatcttttaagttcatttcgctttatatccccttatcatacccaatgaccactgtgtaaatgtacataacattcagtatagtaaaggctttttggatatcagagaaaatgcagtaatttaatctgatcatctgcggcagaaactcatcgttaanatattactagacttaagcataacctttagaatnttatgcgtcataaatnaaacct

SEQ ID NO: 14830 - DNA, 884 bp, Xenorhabdus bovienii
  Genomic contig Name=Xb4151_4152.C289
tcgagcggccgcaagcttcggtcttcaataccatcaacagcgacattctgataatgtcggccgtcatcgttgttgcagtttcgctctacggcctgcgctttattcacgtctttgacgtgctgtctctcgggcgcgaccccgcgatcaatcttggcgtcgatcaccagcgggtcgtgcgcaaggtcctgttcatggtcacagtgctggtttcggtttccaccgcactggtcgggcccattaccttcttcggcttgctggtggccaacctggcctacatgattgcaggttcggcaaagcaccgaattatcctgccagtgggggccctgcttgcagttttctgcctcgtgggcggacagaccattcttgaacgtgtcttctcgttcaactccgcactcagcgtcattatcgagtttctgggcggccttgtcttcatcatccttctcgtcagggggcacgcgcgttgattgaaatcagccaagtcagcaaatcctacaatggcacactggtcgtcgatgatgtgaccctgaaactgccagcgcgcggcataacctcgatcatcggtccgaacggtgcgggaaaatctacgctactctccatggtgagccgtctcctgcctatggacaaagggcgagttaccgtagacgggctcgacgtttcgacgacatcgggtgacgtgctggcaaaacggctgtcgatactgcggcaggagaacgcaatcaattcccgcctgaccgtgcgtgatcttgtaactttcggccgttatccctattccaagggtcgtcccaataatgaggatcgcaaacatgtcgaacaggccatcggctatctcggccttgacgatttaagcgggcgctttctggatgagacctcggccaagcttccgc

SEQ ID NO: 14831 - DNA, 468 bp, Xenorhabdus bovienii
  Genomic contig Name=Xb4151_4152.C290
gcggaagcttggccgaggtctctgtcggtatcatttcgggtgggttgttcgtttgaacggactcgtccagaagttcaaaggcgcgttcgaccattgcctgaacattttgccggaccatcacaaccgggaagtggagaacttcgatgaaggggtcccagtcgaaacatccgatggagcactcccggacctcgtcaaccggcagcgtcttgagaaaactgacgacgccctcaaaagggctcgtcgagttgacgaacagtgcctctggcaatccattcaattttttataaatatcgcggatgattctcgcggcggcatcgggaccataaccattcgtgattatggcgtcggagtgaacggggaagttcagcgcagccagttcatctttatacccgcgcacacgtgcgcgggtgttgtggtcactatccacgccaccgatgaagtagaagaccgaagcttgcggccgctcga

SEQ ID NO: 14832 - DNA, 723 bp, Xenorhabdus bovienii
  Genomic contig Name=Xb4151_4152.C291
cgagcggccgcaagcttcggtctctcgataaagcgggcgatcatctgcgggctttctgtcggcggtttaattgcgcaaggcgtttttgccgcgcgacccgatctagtgacagggcttgttctgtccaacactgcccacaagattggcactgccgatatgtgggatgcgcgtattgtcgctattcgggaaaacggactcgcaagcattctcgacgcgacaatgccgcgctggttcacccctgcctatcggcgtcccgataatccttcctatcgtgcgtattgcaacatgttcgttcggcaaccgctcgaaggctatgcggccacttgcgctgctctccgggatgccgacttaacgcaagtagccaaaaagatttcggtgccgacattgtgtctggtcggcgagcaggacggttccacaccgcccgacattgtgcgcgaattggcacacctcgttcctcaagcagattttgcagagattgccgactgcggccatatcccctgcgtcgaacagcccgatgcctacgtctcgctgttacgcaactttattacaaacagattctagcatggagaataaccatggctgacaatgccgtgccgtcagaacgttacaagatcggcatgaatgtgcgccgttcggttctgggcgatacgcatgttgatcgtgcttcaaacagcgcgaccgaccttgatgcaccatttcaagagacctcggccaagcttccgc

SEQ ID NO: 14833 - DNA, 245 bp, Xenorhabdus bovienii
  Genomic contig Name=Xb4151_4152.C292
gcggaagcttggccgaggtctgggaagcgagcagcagcgcgcagcagaagccgaccgctctgcggggaacatgcagcatggccttgttgacggcgcgcagcagccagttggacgggtagggctgcgagaccggacgggccgtaagatcgaacttctgcgcaacgatgtcgggtctggaacagatacagacaagttgtgcgccggggcaattgcgtttcaagagaccgaagcttgcggccgctcga

SEQ ID NO: 14834 - DNA, 371 bp, Xenorhabdus bovienii
  Genomic contig Name=Xb4151_4152.C293
agcggaagcttggccgaggtctgcctgttcagtaattcgggcggcaacaggagttcgacgatgacgtatgtcgtgaccgataattgcattcgctgcaaatatacggactgcgtcgaggtctgcccggtcgattgcttctacgaaggcgaaaacatgctcgtcatcaatcccgatgagtgcatcgactgcggcgtatgtgaaccggaatgccctgccgaggcgatcagccccgacaccgagccgggcctcgacaagtggctggaactgaatacggaatatgcggcaaaatggcccaatattaccgcgaagaaggacgcccttcccgaagccaaggagatggatggcgtagaccgaagcttgcggccgctcga

SEQ ID NO: 14835 - DNA, 417 bp, Xenorhabdus bovienii
  Genomic contig Name=Xb4151_4152.C294
gcggaagcttggccgaggtctttgccggaccgatgcgcaggacgaagcgggcggcatcgtccgccgcgtggatttccagacgaccgggaatgacgaccttgcggttcgaataaggtttggtttcaacgagcatggttcaatccttatccgttcagtttctttccttcggggtcatagaagaccatgcccgatacagtggcctcatgcacgctgccatccggcatcggcatataaagcgtttcacccatgcgagccttgccgcccgacaccaacgccatggcgatggaccgcccgagcgtctcgctccaataggacgaggtgacatggccaagcatggtcatcggcaacggctgttttgggtcggcgacaatctgcgcgccttcttccagcaccagaccgaagcttgcggccgctcga

SEQ ID NO: 14836 - DNA, 951 bp, Xenorhabdus bovienii
  unsure (1)..(951): unsure at all n locations
  Genomic contig Name=Xb4151_4152.C295
tgtgtatgggatgataagctgacgcgcagaacaatccggttgcggcggggcgcatggctcttaagaaccactgcttgtgactgataaaagatgaatatctcgaatatagtcatgccctacactatcccacactctgcaggtgtgaatgcataatgctgatataagcggtgtcacgatccgagccagtaggtattataaatatgattgtccatagggtgatggatgcaatgaggtttataacaattatgattgtaatgctctatattatgaagacgcaaatcgttgtctgaactggcgcattgatgatagtgacaccacttcttgcgggcgatgaatctatcgagactgacgtcaccagcttatgatgtacaaatgtcactaatgtggttagacatgatgtgtcgaacataaatatgctgctcgccgtattattatctggcaactactgatactcttctttacgaagggctaggagatgggccacaaaatgggagcacgcccttctgtaatgatacttagtgctatcactgactaggaaatgtgttgcaataacgtgcccttctggcggggcttcgggggtgcgaatttncttgcggctaatgggggcctctgggtctggattggtgctccttctcggcttccgctgggtgccgccgcccgctgtggggcccggacgggcgtggggttggcccccccccccctcgttcttcttcgtctttctccgcccccgggggttgtcgtgctcccntttgttgcgctcgtgtcgccgccgcggcgcgtggcggtcggtttcgttcggcgggcccgccggcgtctggagctgctctcggcgccgcgttggttgggtgttcgggcgtgttgtcccgccgttttgttggcccggccgtggctgatggcccgcttggtttttgtgagggcttcgccgcgccaagacgagtcgcaacgcggaga

SEQ ID NO: 14837 - DNA, 850 bp, Xenorhabdus bovienii
  Genomic contig Name=Xb4151_4152.C296
ggccgcaagcttcggtcttgcaaccatggacggtccgggagtgcgctccgaatgaagaccttttccgccacgggcgctttcaggacgagattttcgtccgcttctccgacttctcgccgcaatgctggctatgatggaaggagagatagtacgcgaatcccgcaaggcgctatcgagcgggcaccggtcgagtgacgatgcagtggcacagaggcagacagcaaacaggctctctacaggcaatgtggtctggcgccgccgccggaacgacgtttccctccaatcctttgcacttgcatccggcaatttcctatggtctgtcatgatgcgcatgttcagacgttttcagccggtttccatcgttctgtttgtcattcttctggcgtttctcgtcggcttcgttgcgttcggtgaaaaggtcaccagcatgcagcctccggccattgatgagcctgccgatgcgatcatcgttttgaccggtggccagtccagaattcaggctgcggtcaatcttctgaaagacaagcgcggaaagcggcttctgatcagcggcgttcatccatcgaccaacgaaaaggtgctgcagcgcgcgacacatgccgaccagagcctgttcgactgctgcgtcgatctcgaccggtcggcgctcaacaccatcggcaatgcagcggaaagtgaacgctggattcgtacaaacaattatcgccgggtgatcctggtcaccaataattatcatattccgcgcagcacgctggagagtgtcctatctcagtgaaggagtgtggaattcattccctatccggtggtgaacggggaacgtcgcgaacacagacctcggccaagcttccgc

SEQ ID NO: 14838 - DNA, 275 bp, Xenorhabdus bovienii
  Genomic contig Name=Xb4151_4152.C297
cgagcggccgcaagcttcggtctacggggcttcttcattgctttatacgcggcaattgcatctttcaatcgagcatgggcctccagcaactctctgcgagtaaaaacatttgatgtcatgcatttctccttttgcctgtttcggtttctatggtctgccccctgaaaagtggtcctccctgaagtaggctattgagccgtaggaggacgttggaatgccccagaagaagcacaaacccgaagagatcgtcgcgaagacctcggccaagcttccgc

SEQ ID NO: 14839 - DNA, 395 bp, Xenorhabdus bovienii
  Genomic contig Name=Xb4151_4152.C298
cgagcggccgcaagcttcggtctcaatgtcgacgcgacccggatgagccaggcctttaccgggggtggatatgtgcaggcgattgtgacgagcgaggtgaacgaatttctcaatcgctatcgcggcagcgcacaaacacccgtcgaactcaatctgagggcgagattcaatcaggatttgaacaagggttggttcggggcgatcaacaatgtgatttcgtcggtgacgatgctgtctatcattctgacgggcgcagcccttattcgagagcgcgaacacggaaccatagagcatctgctggtgatgccggtaacgcccgtcgaaatcatggtcagcaaaatatggtctatggggctggtcgtgctgattgcttcagacctcggccaagcttccgc

SEQ ID NO: 14840 - DNA, 194 bp, Xenorhabdus bovienii
  Genomic contig Name=Xb4151_4152.C299
tcgagcggccgcaagcttcggtctggaactatgagccggtcaccttcaccaaggcgattgccaacggcaagatcgatctgaaaaccgatagtgaggctgaaatcagcctgccggtcgattggggtcgttaccgtctggaagtcgaaactgccgacgcctcaggcccggctacgagacctcggccaagcttccgc

SEQ ID NO: 14841 - DNA, 179 bp, Xenorhabdus bovienii
  Genomic contig Name=Xb4151_4152.C300
gcggaagcttggccgaggtctgcgccaggtcgatgttctgctgtcgcaaggaaaatcggttggcgaggcggttcgcacgatcggcgtgacgcagttcacgtattaccgctggcgcaaggagttcggcggcctgaagggtgaccaggtgaagcggctgaaggagaccgaagcttgcggcc

SEQ ID NO: 14842 - DNA, 276 bp, Xenorhabdus bovienii
  unsure (1)..(276): unsure at all n locations
  Genomic contig Name=Xb4151_4152.C301
tttttaaaaattgtttttggggggggcgggtcccccgcgtgtttttttttttttctccccgggggagggggggtcctctaaaaaaaacacccccccccccagggttggcgtgtggtggggggtattattttaaaaaaaaaatcttttttttttttcttccccgggtggggcgggggggggggggnntntaaaaaaaaaacaaaggagaggggggggggggttggggggggggnttccccccacccaccaaaacaccttcctccttttttttatttt

SEQ ID NO: 14843 - DNA, 199 bp, Xenorhabdus bovienii
  Genomic contig Name=Xb4151_4152.C302
tcgagcggccgcaagcttcggtctacctgtactacgattacatgtgtcgtgactttttcaagtttttgtctgagcaaccaaaacagtctgaatacgcggctcttggcagtaggcagcgcgtacgggtcaaaaagagattcgagaaaaaagccaaaaaggcgtatgaactctgcctaaaagacctcggccaagcttccgc

SEQ ID NO: 14844 - DNA, 743 bp, Xenorhabdus bovienii
  Genomic contig Name=Xb4151_4152.C303
tcgagcggccgcaagcttcggtctgtcctgtccactttgatcggcctaccgctgggcgtcgcgctgattgttaccggcccgggccagtttcttgaacgaccggctttcaaccgcatagcaggcgcgatcgtcaatctggttcgatccacgccgtgcatcatcctgatggtggcgatcattcccctgacgcgcctgattgccggaaccacggttggcacctatgcggccatcgttcctctgacagtggcaatcgtacccttatacgcgcgactggcggaaacggcgatgcgtgaagtagaccaaagcctgatcgaggctgcggaaagcatgggtgcgacgcctatccagatcatcttcaaggtgctgctcccagaggcactgccagggattattgccgggcaaacggttacccttgtcagccttgtcggatactcggcgatggcaggaacggtcggcggcggtggcctgggcgatctcgggattcgtttcggatatcaacgcttcatgccggaagtcatgatagccgttgtcatcattctggttgcaatcgtgcaatccattcagattactggcgattatgccgctcgccttgtcaattaccgcgtggcccgcagccgtcgctcgcgctaagaattttcaggaggtttccatgaccatacataccacgccgatcaacctgcctttgctttttctgtcccgtttcaacggaaagtgcggaggagcgcggcagacctcggccaggc

SEQ ID NO: 14845 - DNA, 639 bp, Xenorhabdus bovienii
  Genomic contig Name=Xb4151_4152.C304
gcggaagcttggccgaggtctctggaagaggcctaggcttttttcagaaactcggtccgcaacaccaatcccttgacctgcttggtgctgcaatcgacttccgccgggtttccggtaaggcgaatgcccttgaccagcgttccccgcttcaatgtggtggaggttcccttcaccttcaggtccttgatgagcgtgacggaatcgccgtcattcaattgggtgccattgctgtcgcggacgattacatctgtcatggtggtttcctgtctggtgtctgatctggctcgtccgtagcacccttgccgatgttataccagaacgcggcttattgcaggcctcgcgaaaccgctccggctcctgccgtggcacgcatcttgcccgaaaaccggttcccacttttcaggatgcgctctatatctggttgcaaagcaagccaagcgggagcgtttcatgatcggtcatgcacttgtggttatcgacgtccagaatgatttctgccccggcggttcgctggcggtcgatcgcggcgatgaaatcattccgaccgtcaaccggctgattgaggaaagcgaaaacgtcatcctcacgcaggactggcaccccgccaaccattcaagaccgaagcttgcggccgctcga

SEQ ID NO: 14846 - DNA, 224 bp, Xenorhabdus bovienii
  Genomic contig Name=Xb4151_4152.C305
gcggaagcttggccgaggtcttcttcttggcctgcccttcgagcagacggttataggcgatcatgatcaccagattggcgaccagaacgatgatggcgatggcggcgccgagcggccagttcagttcgatcaggaactcgtcatagacgacggttgccgccatcttgagacgacgcccgccaaggaggcccggaatggcaaaggagaccgaagcttgcggccgc

SEQ ID NO: 14847 - DNA, 217 bp, Xenorhabdus bovienii
  Genomic contig Name=Xb4151_4152.C306
cgagcggccgcaagcttcggtctccgacgccgctcacgaggccactttgccgacaaatggcacctcgatgagatggtggtgacgatcaagggaaagaaatactggctgtggcgcgctgtcgataccaacggttacgtcctcgatgccctgctgcaaagccgaaggaacaaggcggccgctatgcgtttgatgcgcaagacctcggccaagcttccgc

SEQ ID NO: 14848 - DNA, 477 bp, Xenorhabdus bovienii
  Genomic contig Name=Xb4151_4152.C307
tcgagcggccgcaagcttcggtctgcgttcaacggcgcaaaggccgttttggacgccattgccaagggcgcgtcggccaagcgtgtcggcttgaagcctgaaggccgtcagccggtccgcgctggcgccgatctttttgatgaatccggtcgccagattggcaccgttacttccggtgggtttggcccatcagcaggtttcccggtcgctatgggttatgtagaggcaagcctcgctacccccggcacacgtgtcttcgctgacgttcgcggcaacaaggtgcccgttgacgtttcagcacttccctttactccgcatcgctatcgcaaaggatgatttccatggccaatatcctgttcaccgaagatcacgagtggatcagcgtcgaaaacggcgttgccactgtcggcattacgatccacgcacaggaacaactgggtgacctcgttttcgtcgagacctcggccaagcttccgc

SEQ ID NO: 14849 - DNA, 260 bp, Xenorhabdus bovienii
  unsure (1)..(260): unsure at all n locations
  Genomic contig Name=Xb4151_4152.C308
gggggggtgggtgggaacacaaaaaaaaaaaaagtttttttcctttttgttttgttttaaaaaaaaacaaagcgggcgcgccccccccctcccaaaaaaaaaaaaaaaaatttttttttttttttttttggtggggggtggggnnggggggggccnnnntnnnncccccccccttttttttttttcttccctcccttgggcaaaaaaaaaaaaaaatattttttnnggggggggtgggggtgggggggccggccaccaaa

SEQ ID NO: 14850 - DNA, 885 bp, Xenorhabdus bovienii
  Genomic contig Name=Xb4151_4152.C309
ctttggagatattacccgcgcggtatgtttcccatacctgatgagctctatccgtatgcacactgtagggatgggcgtcgacacacaattcatcggtccgggctgaggatggagagacaaacactactttggcctagaagcggatgctagctaccagatggtgctgctagttcaaaaaagcgaggcaggtgtggtggatatacaacacatgtttaccacatgatacggacatagctgcgtaatctggacaggcgatatcgccagacaatgaccttaagacccgatatcccatagagactgatacaatctgatacgcccatgggactggctgacagacgcctctaccatgacatgagactatgatgcgcccgaaccgaaggctctcgatcgccacacgacacggggcacatgaagactgagcgccatccatgctgccgtctgtggctgccgacagactacgagcctgttggagtgcattcatccagcccggcagtatagaccacattagagacgggacagggaggacttcactctaggcttgcccaaccggactttgcatgatagccgccctggcccggatcagaaaaaagaatgggccaactgaggacctgaatccggcccatttccacgggtcctggagcggccgcaattcacctaaccctgggtgccccctttttaccccttcttacgcacaaaagggggaactgcgcccggccgaaaacgggggaattacattttcaagggcccccgctgttaccccccccgaaaggaataggttcccctgcaaaaggggggaaaaaattttggcggttgcgcccatttagactccggggcccgctaaacggaaaattgccccccccagccccctgtagaaaaggcaacccc

SEQ ID NO: 14851 - DNA, 632 bp, Xenorhabdus bovienii
  Genomic contig Name=Xb4151_4152.C310
accatgacccaagcatgcatgcatgcctgcaggtcgacgtgtattcaccactgcggtgcatgcctccctgtacaagttccgtcgacacgtgagcaccgtgctgacctccaaatatcgttaagctggagcctggtcgactctagaggatcctccagtacccgagcatgcatgcatgcctgcaggtcgacgtgtattcaccactgcggtgcatgcctccctggacaagttccgtcgacacgtgagcaccgtgctgacctccaaatatcgttaagctggagcctggtcgacgtgtattcaccactgcggtgcatgcctccctgtacaagttccgtcgacacgtgagcaccgtgctgacctccaaatatcgttaagctggagcctggtcgactctagaggatcctccagtacccgagcatgcatgcatgcctgcaggtcgacgtgtattcaccactgcggtgcatgcctccctgaacaagttccgtcgacacgtgagcaccgtgctgacctccaaatatcgttaagctggagcctggtcgacgtgtattcaccactgcggtggcatgcctccctgtacaagttccgtcgacacgtgagcaccgtgctgacctccaaatatcgttaagctggagcct

SEQ ID NO: 14852 - DNA, 1753 bp, Xenorhabdus bovienii
  unsure (1)..(1753): unsure at all n locations
  Genomic contig Name=Xb4151_4152.C311
gcacagcatctactgctagtactacatcgcagcctgcacagcagcctagagtacactactcacgctagctcgctggacacctagtgcaggcctctgaggcacactagctactagcagtacatcggacctgtctacgatgaggtcatacatctagagagtctagaattgcagnctcagaccacacctccactagccgatactagaatggnctcctacctgcagatacatagctggcgnactgggtatgcacgagacatgcattgagccatacttcaagagtctcaatccttcagtagacatgccacgcggactacagacagctatggctagagcttctagaactagtcaggtagctctagctcgccagtgagagaagtcgagtatgaaagtagatgagctagccactagatatagcgaatctcacgctagaggagcatgacgatgcaacgcacgacgtttatccatcttttatgtctangcttcaggtgacttcagtgttctagagcttctcctcatgagcacttcaacacgaacctctactgccgtgaacacnacttgcgcaaggtgatnactgctacctatactgcacctcatgcggcccggacgcatgactctcttccgcggagtcatgggtctcatggagtgtatcttgtgccactgagagttcacatnggttgacttaagctacgcggagctactgncnacacaggcgacccaactngcactcnagcantcgatagccatacgagaagagatgcgttatgtggctacatgctctcntnagcggatgcaacatcgagcgctcgcacgcgatagaagtgctacgcgtctgtcttcactgactaagaagagcgtatccagatagacatcaatcgctantggccgtagtgcgtgcacaccgcgtgacangagagcgtctctgttatctcacacatagnanctcatctcattgagacgcgcgccnaccgnagtcgacaacgccgacatgtcatccgacgcntncactctctcncgcngcacgacacagctgcancccgacacactagtcntcgctaacctctcnacncgatcantcttcgtcacggctcncgcgcgccgcgagtcctcgacgcggcgtcccagcgntagtgtctgcgggatgacnagatacctctagctgccgncatgnggatcactacatagntactacatgcacacagtatnagtagtctgtgatgatggcgatcacaaactagctatagcnaccntgnagcgntcangagacggnagaccacacctcnatgcgcagcgcacatctccgcctctcntaccagcagcttantggacgacgaagcctantactcgacgaactacgagcgccgtagtagtngcaagtgtgtactctcgcgtntgacctgctcacgcagagctactacggtacgtnctgtctcgcggtgtagattcagtngacagctcatatatactnctacgccgangagacatggtgatgaagtatatatagntntagtactaagttnggcatactctcatataggtgtccgtacatgtatgtactgaactcatcatgtactacactactacaatgtgctactatataccncatacatatctctctcgatatatctcattgatgtcacactggcatcatctgaggcaaagactcgagtcgacgtcgctatcgctcgatccncggacgtcncgacctctagccgaagnataccatntcagcgtcgtanaccactgcagcacntct

SEQ ID NO: 14853 - DNA, 1333 bp, Xenorhabdus bovienii
  unsure (1)..(1333): unsure at all n locations
  Genomic contig Name=Xb4151_4152.C312
tcatagagactagcagagcgtgcattagctgcacacatctgatntcgcatggatagacatagtgtctcacatgtgnctcttatagtgcgcgaactcatctatctgactgtctcatgngcgaacgcacatgactngngtcnctagctctctacgcagtgaagtcttgctcggaatgatcatgactgcgcagagagancgtctcgatcagaggtcgatcaagcncgagtcacgtggacatagtggaccttgctgtagataatgctccatnaagcnctctgttctngcctagctactctctcagagttgatggactatgtgctgctagtcacgtggtgcactcagttcaggcgactagctatgcactcactaggctagtacttagcggagtggagtgcagtcatgtctnggcgtagctctagtgncatnctactgacngcatgctgacgtagtnagagtatggnagtagcctatnagagatgcacgactnatctcgcgagcactagagcagactactataggcagccgacttgccaggctacgnactaactctaggaggcctcctngtnctatcatggtctatgctagcattagactgagtagcaagtngcgaatgcnaagaagggctagctncatnatngcgacaggnctncttnatagncgaagtactagtactagccagcgagacctctagtgcagagagtctagcttgctagtaatgagcattgtctcctcagtcctttctagaatagtaggatcnaggccaccctaagtccatgctagtggaggatagctctcttagcccgcagatctagtcactgatttatatatatagtgctactatgacatcatcatgaacggccaagtggagcccagctagtctctgtggtacttatagtcaggaacatgggaagaagcagggattaatgctctgtctatgtctggtgaaaggtaatatagcttagttgcggcaagggaacatatcaaaccccctgccttagacacatggcttccagcctctggccacagaggaagcacgaggaccagaatgcaggaccttcagagcgaggaggagacccttcggcaagaagaagacaaccagagaggagggaactcggcccgggtggcagatcataggtggccgggccgcaaataaaattactttttcggaagaggggattctctggccaaggtctcagggtcggatgcttgtcctcctcatttttctccctgcagggttttgggagtgagaccagggattgggagtttggtctctatcttgcgacctaagngataggtattttgccccaggagcgagggcttggcgatcggcggg

SEQ ID NO: 14854 - DNA, 576 bp, Xenorhabdus bovienii
  unsure (1)..(576): unsure at all n locations
  Genomic contig Name=Xb4151_4152.C313
aaggaggaaagggaaggggataaggggaaggggaggagaaagaaaaggagcggggagggggggaggacggagggagagggggagggagagaggagggaggtttttttagagcctttgggaacctgggaaccctggggcaggggtttccgggcacaatctctaaagagaggaaaaaaaccccccctgggggggtccaaaccgggagaattggggataagggggggtttaattcccccaaaaaaaaccccccggggggggggggggggggaaaaaaaaaaaaaaaaaataaaaaaaaaaaagaaggggggggggggcgggggggggtaaaaaaaaaaaaaaaaaaaaagagggggggggggggggggggggggggtgtgnntttttttttttaataagtatgaagaaagaacaaaaaaaaaaaaaaagacaagaattattcccaaaaaaaataaataaaaaaaaaataaaaaccnaaaacccgcggggggggggggggagagggcttcacacaaaaaaaaaacaaagaagaaaagcacagttgcggaggngaataagaaaaaaaaaaaaaaagagggg

SEQ ID NO: 14855 - DNA, 892 bp, Xenorhabdus bovienii
  unsure (1)..(892): unsure at all n locations
  Genomic contig Name=Xb4151_4152.C314
aaattaaaacccccaaagggccctttaaccccaggaccacccgaaattttttcccatttcaaaaaaaaaacccaagtgggttggcccctaattcccttaaaccccccacccccctttttcccccccaaagtgggggaaccccacatttttttccaaaacccccccaaccccccccaaccccgggggggttttcccccccaaagtttccccccccccaaacaccaccagggcccccaaaacacccaccccccccaaaaggtgggggccccccccccaacaacccttcccaggccaaaaaaaaaaacccccccccccccccccccgggttcccccccccccaaaaaaaacccccccccgagcccccccccggggtggccccctaaaaaaaaaacacccccccccccccgggaaaaaaaaaaaaccaccgcgaaaaaaaaaaaaccgcccccacaaccccccccgccgcggggggtggggggaaaaaaccccccccccccccgttttttttttaaaaaaaaaaaaaaaaaaacccccccccccccccccgaacaaaaaaaaaaaaaaaaaaaaaaaaacgcccccccccccccccccccacacaatatattttttcccccccccccccccccccccaccccccccttccccccccaacaaaaaaaaaaaaaaaccggttccccccccccccccccccaccccccaacaaaaagaggggggtgtccatcctctttcccaaccacccgggagaacaacaaccccccccccccccccccctactccctccacaagacgcaagacacccccccccccccccccccaccccctccaccaacacaccccccccccncaaaaccacccccccaaacatgcggtggggaggacacaccccaca

SEQ ID NO: 14856 - DNA, 932 bp, Xenorhabdus bovienii
  Genomic contig Name=Xb4151_4152.C315
taccttctggaggctccccttagagctgccgacggctgctgggtctggcctcatatattgagtagtctccaagcgcataggaaatgactttctcttacttcctctcactttcagaagaatccggaacatgccgagcccagtaatctgcagagacattccgattagcctagttcatctgaggatgccagctctactgcaacaactcagcctatcagcccaggcatcatgcagtaatatctctcgagtcattagatatacctaggcaggatagatcaagactctgcttcttctatctctgaatatagatatgagatgccggcatgaagattcatctactcagctaggcatgcagtatacgaggataggataggcgctcgaaatacgatactcggcctctgatggtgcggttcataccatagatctatgagtcagcaaccacatgaatattgattattctgcgatgcccagtaattccctgctgctccagcatccaactgagttctcatcgggtgcagctgaggacgcgcgccatcatgccaagagcccacttccactgctctgacgagtcctaagctacccctgagcagagaaatggcgcctgactaggggcgacctaatatttccacatggagcgcccttctcggggaaactgtatcgcggcggctggttccgacaattgacagtaagtcatcgagagggacggccgtttcggaaggcaaagccagttatctccccgcctggtggtcgggaccctaggatcctgagagcagaaggaggcattggcatataataatcgaatgagatatccggtcggatcggatggcatggtacaatgggggtcgtgtgggcggcgcttcaggactgccgcctagcctggtggtttttctgtgggattccggggcacggccgagtggagtgccagggggtggggg

SEQ ID NO: 14857 - DNA, 1829 bp, Xenorhabdus bovienii
  unsure (1)..(1829): unsure at all n locations
  Genomic contig Name=Xb4151_4152.C316
ccacagacctctcgtgttccatgtcgcggggcgggctactcacgaggtgaggcaccgcccctccacgtcagggctatggtcaccatatagtgtgcttacgcgccttgtcatgctatgccagagagtctgttactatatcatagtgaacgaccngactttatgcatcatgnactncagttgacactgccgtatccacgctatgatgccgcgacgactagccatacgtactctatgagctcctgacctgctatagactgacgcattcgctctagcagagatccactatatatgcatgtatcacttcagtgaatgcagcacatcagcagtcacactgcggcggtagccagcagacaacggatgcatctctagtagccgacgacactgagtagtggatcactgactctggctagaggcggccgcatagatgtcagagaagccactcaagaacgatacacaatnagccagcacatgtagtacagaagagccagacgcgctcttactaaaccccactagcaacgaggctgtagtatggagagctcatggtgtgttatttatctaacgagcacacataactccacgaaccaaggctgtgtcggggtttcactagctcattcaggtgacgttgggacgcgctggttgacaagcaccgacctcgctggtcactcatagcagtcgctccgttagccgcagtcggtcgccgcgagcattgacgngtcgtccgctgagcaccagactggctcctgtctctgtccgcagataccagagcgagtcatgacgtccacacgacttgactatagaccaantctatagcactgtgacaccactattcntccacgcgccgccgctgactccatcgagcgtataataccgacagggacaaancggtgccacaccacgtccccaccagcgtcagattgccacacacatttgttgataagcgcgcgccggcgagtcagaagcaacctcgatgggagaaagacatcgcacggtcaacccctaaagcaacagactacgactatatacaagatgcaatgaaacgcgatctctgttcacgctgacgaacncccgatcttaccgccagttacttatactgctggcggatcagttgantattgngtcgtgacggngngactaggagagggtggatgagctcgctagagatagcgcgcgcgcgcagagagttagcgaaccagcgagcactgagcgtctactacagacctttacatatgccgacaaccgcgtcagacgacctcttcgcgtcacctgataacgtcagtcnacagagtagntgcgagatagaccgagcacgcgacnagnacagatcgctcaagcgacgcgcganatctgcgcgacgcaccntnctgcgcatcgccacggacgtcagcgcatcgcaattacccgcctagcatantagncctcatcacacatacactacgtcacactataccatcgcgnaaccgtagtgntaaaatgacgaacagctggcagaaactaagactaaagataggtcggacgacacaatcagcatagaacttaacnccnagcgctacagcagatcactaatatacagacagcacgggcaagacaactntcgaacgangtcagttcnagtaacgcgatcagtcagtagagcacatcgatgtagnagcgcgcacacagatacgccagtcgtatntatctcgccaacgacgcacaggatgaaacggtcataagcacagcnacgttcacattataatcagtatctctctctatatcactactcacgttngcntcttatacaacgcactantagaaccacgacgaggacanacacgtacggacgagcagag

SEQ ID NO: 14858 - DNA, 870 bp, Xenorhabdus bovienii
  Genomic contig Name=Xb4151_4152.C317
atataaacagactgaataaaggcgccgcgaaccgggagatacccaagatcacgtttacagggtgaacgtgcgttctcatacaacaattgactgaaggagcgggggggggacatcataaacattaatttactgctatggatacgtactcacccataatgcggaccagcgtgagacgcttgtaccgataaaatgctggaacccttgtagtactgacatgactgaccatcaacgggctgctcaaacgtagataccgcaatgggggcgggatgatgatttgtttgctaaagggaaacatcagatttaggcttttaatatgtggcggatgagcatactcgaggaacattagaacgcctatacacagtcatatcctatacagtacatgaatcttctctgagttaacctcactataaatctggatatctgcgaccgacaatcaagatcttatgttggacggtctgatatgaaccaacaaactgagcaaggggggtgtttatgctatacaggatgatctgacttatgtaactacctgagctatcgcttgacagacccatgcgcgatacttgtcgatatgataatgaacatctagagtgggtcacaaggaactggatggagcccagtgcagactgagacagtaatggcatggtactgaggccataggagtgacttaaatgagctatagaacagctggcgataaaggccatgttggaaggatctacgatctgagccctactacgcggattaggcatgcagtctagcgtgtgagactatcactaaacgtgaaactgatgaatactagtccaagaccgacatcgttatagctggtcggtgcacacatactgttgggctggacgattgaggacacagtataca

SEQ ID NO: 14859 - DNA, 866 bp, Xenorhabdus bovienii
  Genomic contig Name=Xb4151_4152.C318
tatgaacatgatcaaacatccgtgtggaaagagcccaattacagattgtgtggaattgagcctggggtacatgaatcacggctggacagctgttgagcggggtatgctgggagcaggccattacaacgccttgcatctggggatgctacaggactttcttatcattagcccgccaacttaatgcgtaacggggttaagggctggaataccgttatagactctatgcgggggggggatgcatatcgactaaaatctaacgagcggttaccgcgtttcaaaatccacctgacgttcgctatctatcggaaatccaaccgtaagtttacaaccgtggtgcaattcattctccggcgatacccaaaaccatactctaacaatggacatgaactttataccctaattaccagtattcaaaaagggctctcgcggcttactgcccctaaatacttactcattacacctactggatcatgccttccgatgtgcgctatcactgctcactcaacacatatcagaatgtgcagccttataacaatctcagtctgaaccgactctgctttaaaaacactattcagcatgaaaaacagcatcatccgtatctgaatatatactttccgggaaggagatagtttgctcacttaactatatcggtagcgaccatagtgtaactcacttctgattacgctagtatctaatacgcatatgctagccataaactatccccatctttttggggagaaacaaccctactaatgactaaccttttttctaattaaccccttgttggctacataacattcccttactgccaaaaccgcttataagaaagctgggcgtgcgttctgaaattttagggtattaagggg

SEQ ID NO: 14860 - DNA, 839 bp, Xenorhabdus bovienii
  Genomic contig Name=Xb4151_4152.C319
attatcatattcaataccctaattacacgttggataagcgaaatggatggggatgcgctaatcgctacctgagtagggcagaagaaagccgagcttgagtataaagatgtacgtatgtcatcggcaaggttacggattagatctgctcaactgctgcaaatgtacacttgattggtctgagctggtaagcgaaatgactccaaacaaattagaacagcagctaaaacagtaagtgtgacatgttgatgtcatgcccaacaaaacagatctacgacaaccactgccgtgatgatcacattatattaatgttaagctatattgcaccagacacatcgtaacgctaaagagcatacagcgcgtatctatcactgacaccagccgtctttgagatacaaataaactacatagagtatgtttaattcaagacaattactttattcttggtgcaatactaatgaataaacagcctctgtatcagcatcacggttaattacggttataagcttatcatgacaacgtttacaggccggtaacacatacttcttccaacagatctgattataaatggcgactatctctagctcatcaagtgaggttttacgatgaccatgttatacttattctggagaagataacctctacttagagttatctatcagccatcagtaatcctcagattggagctgctattgtgtacactttggatacaatgctgacgacttgttgggcattgatttcagctataaaagcactatatgcctaatgcactttggatccttaatcgtaccgtatgtacgtccacggagccccgataacatcggtctatgaggataaagttg

SEQ ID NO: 14861 - DNA, 126 bp, Xenorhabdus bovienii
  Genomic contig Name=Xb4151_4152.C320
tcgagcggccgcaagcttcggtctctcatccgaaggacaaacatcgtgagcaaaatcgtctctcccaatgcaccggtggctctgaaagtcgaaaacctgcgcaagagacctcggccaagcttccgc

SEQ ID NO: 14862 - DNA, 444 bp, Xenorhabdus bovienii
  Genomic contig Name=Xb4151_4152.C321
gcggaagcttggccgaggtctttgtcaaagttcgatggagaattgccgtgtgctctgcgagcgtagaaccgcgtgccgaattgctttacgccgttgtcgatcgccatcgcctggctggaaattcttcgccagagccacatcatcaggcacaggaccagcccccacgccactatgacatcggacaggaaatgagcgccgaagataaccctgttgaaggaaacgaagaacaggatcggaactgcgaccacagttccgacggatcgccattgcaagggaacgaagacgataagcgacagggttgcggcggctaccgcggcctcgcccgagggaaaggagcaactgtgcctgcaagcggccgcatattgccatacgggcgtaaaatcggcgggttccaccgaattcgacgatttcgcgcggacgagaccgaagcttgcggccgctcga

SEQ ID NO: 14863 - DNA, 651 bp, Xenorhabdus bovienii
  unsure (1)..(651): unsure at all n locations
  Genomic contig Name=Xb4151_4152.C322
cgagcgggccgcaagcttcggtctctggcgtccggtgccggtcgtgtttctcgctgaacgcgaggagtgggctcaggtcgtgcgtgccatggaaatcggcgctcgcggcttatattcccacctcggtcgatataaaagtctgtgtcgaggccattgatcgttgccaccgccggcggcatgtnatgtgccccgcttccattggtttttcaagacccgggcccgcccgatattcgacaaccaacgtttttgggaggaacttgttacccggcccccaaaaatcgagggttggccattccaatcccgatatcgggaagggtaaaaaaaaaaaaaaattccgctttttaaaaaaccttgggcacaaattttctccgtttaaaccccaaatttctcacccacacttggggggggcggttttttaagggggggccccacgcccttttgggcccacaaatgtttggggggggaaaaataatgggggggagaaaataaagtgggttttctcttctgggtggggggaaaatatttttttttttttctcctcaccccccaanaatccccccaccaccaaaaaacataaaaaaataaagcggggggggggggggnnnagttaaatatttttatagaagagggggggggggcgggggggtggga

SEQ ID NO: 14864 - DNA, 1017 bp, Xenorhabdus bovienii
  Genomic contig Name=Xb4151_4152.C323
gcggaagcttggccgaggtcttcgtgacaatctcttctgccttatgtcttttcgctgccatttcaatgtccttctacggctcataagccatacttcatgaaggatcacttttcagggggcagaccactgggaccagtttcaaaaacagattcttgtccataaagacgactacgccggtattttcatccaaggggcaattatcgattggaatgttgatttatatcaacgtccccagcacatggcggccgcgttcgcaaagagggattacctggtaatatatcagacccacaattgggggaaggatgatgtccaagggttcagacaggttcgtaagaatgtctggcttacaaattatgacgtggccaaagagatttctggcgcggtcgtgtcagtttattccacgggatatattggtggaggttgtgaagcgttcttatggcaagaacgttctcgtctatgaatacatcgatcacatcgatcctaagattagtgggtggtcaagataatatagatcgcttgattgaggtgaagaattttgcgttttccggcggtgtagattacatcgtttgcgtcctccgcactactctatgatgaggcagttaaagcagttggtcatgataaagtaattatggcgcagaatggtgtggatacaaagcattaccgcgacacaaaacacgatgatttgaactgcctccgatctacaaagagtttagaaacaaataaagaacgtggttggggtactttggtgccttggcgccttggctttggattgaagaagttaacaagttaattgccctcgaggtccgacataggttttattttcattgggccggattactacggttgccgagctcaattaatttgagtgcggagaaggttctttgtccgggtgccatcgattagaagggtctttcccgcttttgctcgagagtttgacatgtgcttcattccgtttgaagccgggagatgtcgcaaagaccacctcaccgttgaagaccgaaagcttgcggccgctcg

SEQ ID NO: 14865 - DNA, 1261 bp, Xenorhabdus bovienii
  Genomic contig Name=Xb4151_4152.C324
tcgagcggccgcaagcttcggtctagacgcgcctgacagggaggtggatgcagagattgtatttgaacttctcgcaagtcctgtcgggcagcacaaggaagatggcgccccgactggttatatcgatcttaccgatcaaccgtcatggaaccttggcctgcgctttccgggcaaagacaaggcttggttcgctgccactcgaaagcagatcaagggcgaaacccttctgatcgagcgagacaatgcttacgttctgatgaacagcattcgcgtccccgaactcaccgcctctgtagacgccgctatcgcgctggctgagaggttattccccggcacggaatacgaattcaccaatctgtacaacatcgtccgcgtgacaatcgagatgaacggcgagtacggcggctttcacggcgagcatgtcaattcgctgccgattgcgatctgcatcgccctcttgcgcgcaaaggaggccagcaagccatgagcaacattcttatcatcagccttatcggcttgttcactagcggcgtggcatccggcatgtcattgtccgctgtcatttacctgagcctaaatgcaaagaaggccagcaatgccgagtaaggaacacgaagcgctttcgagaaggtggcgcgggatttggctaccttaaatgaaggcaccgagggtacgtgggaaaactatcacgcggacgcgcagaaagcgtgttctaccatcctcgccgctctacaggagccaacgcggccaatgtctgaaattggacaaccttatattcgggttggctatgatgcgtgggacgtgtggcgcgccatgctcgccgcctccgcacttggggagcagagcgatggctaaggccgaactgaacgaatatgaccgcaaaatgcttggcattctcaacggagatttgcccaatgaaacgtggggcgcgtggtggacgccgtgcctcgaatttctgtccggtcttggactttgcaccaagggaccaaatttccagatcacggctgagggtcggcatgcacttggggagcagagcgaatgacgatgtttatcgcaggagttttattcgcaggacttataagaatttcgtttggccgcattgttctaagggagatgggccagtggaaattccagttcagaagatttgatgaggaagatcagcgcgtaaaagacgcatgggaagaaggcttctctatcggtcgccaagccctgaaaggcggtggggaaggaggcatccagaagacctcggccaggcttccgc

SEQ ID NO: 14866 - DNA, 393 bp, Xenorhabdus bovienii
  Genomic contig Name=Xb4151_4152.C325
gcggaagcttggccgaggtctctgactgaggggcatatcgctagcaaggcgaccaacccgttgcattacaattaccggcgattgtgcgaggcgctaagcgacgcatggccgacggttgtgaaagccgcgccgccacttccggactttggcgataacctcttccacgaaggggcgacggtattcatgggcggcaagtcctacgttctcggaaagtaccatcctgaaatcaaagcgtgggatctgcgccacggcggcgagaacgaaatcactctgcgcgcagatatcctgcgcagaaacatcactggcatcaagtttaaggaagcatcatgacccctcaagaacgcctcgtacaggccatcaacgacgccacagaccgaagcttgcggccgctcg

SEQ ID NO: 14867 - DNA, 223 bp, Xenorhabdus bovienii
  Genomic contig Name=Xb4151_4152.C326
gcggaagcttggccgaggtctgaatttgacgggcgaccctatgtgcaggagcgctggttgaaggctgatttcgcgctcatcaaggctcatcttggcgataagcacggcaatctgacctatcgtatggcggcgcgcaatttcaatccgctcatgtgcatggctgcagcgagaaccattgtgcaggtgtcggaaattgttcagaccgaagcttgcggccgctcga

SEQ ID NO: 14868 - DNA, 639 bp, Xenorhabdus bovienii
  Genomic contig Name=Xb4151_4152.C327
tcgagcggccgcaagcttcggtcttattagcatgattgcggtaaacatcaaaactgaggtcgaggcagggcattttcgacaggacatttctgctgaattttttgctacatgcttggttgggattgttgtgcaatttgtccgtcatcccattccggcctcagatatacagtcaaacgcagagttgattgcatcggtgctttttcaaggaatgcaaaacgacacaaagtcatttagaaatggcaactaaagacaaataatagcgccatcgaaggagcatctatgttttatatatggccgtaaaagtgacaaaatttcgtttacgatgaagttagcatcagtcttaatacatggattaatattattggcacagtggcctgaccccatagggtggtccggtttcaatcttagttcatgttcggccttggggctattgcctgggcagatgacggtgctgctccgcttgctggcgcaggccagatgatggcctcgggtgccggtggcttgtatccaagcgacgagtgtagcctctcggtgttgtagtaccgccgccaggcttcgatgatgatcttggcctcggcgaggctgtagaagatctcaccgtcgagcagttcgtcgcggagacctcggccaagcttccgc

SEQ ID NO: 14869 - DNA, 156 bp, Xenorhabdus bovienii
  Genomic contig Name=Xb4151_4152.C328
cgagcggccgcaagcttcggtctgatatgcggatcgttgtggctctgggaggtaatgcgcttttaaaacgcggtgagccgatgaccgccgaagttcagcgcgccaatgtacggaaagccgcaaaggcgctggctaagacctcggccaagctggcgc

SEQ ID NO: 14870 - DNA, 128 bp, Xenorhabdus bovienii
  Genomic contig Name=Xb4151_4152.C329
gcggaagcttggccgaggtctgaaggatctggactccttggctgtccggcttgagaggtttttggacgcaaggacgggttaatagtcgaagcaccgctttgtcggagaccgaagcttgcggccgctcg

SEQ ID NO: 14871 - DNA, 287 bp, Xenorhabdus bovienii
  Genomic contig Name=Xb4151_4152.C330
cgagcggccgcaagcttcggtctacggggcctaatctttcgataaaaatcgaagatatgcaatgagtgcaaggctttgatggcaaagccctgacgaattatcctattgcccggcctgatgcaattgtcaggccatacaggcaatcagtgcgtccagggcatcgtccggtcaaaccggaaattgtcagaataggaaaccttgcggcgcttcggctcgttcggctcgaaaacgcggtaggcgatgccattgcgcttcgcataatcgacagacctcggccaagcttccgc

SEQ ID NO: 14872 - DNA, 264 bp, Xenorhabdus bovienii
  Genomic contig Name=Xb4151_4152.C331
gcggaagcttggccgaggtctgggcgcggacgattatctgaccaaaccaatcgattttgacctgctcgaaaccaagattactcgcaagatggaacttgtcgaacgtagtaagaacactcctgcttcggccgattctgatagtgttgtttcgccacccacgaatgagacgaaggcaaaactgacaaaacgagaactccaggttcttagcgagtttgccaaaggtcatacgaacggccaggtagaccgaagcttgcggccgctcga

SEQ ID NO: 14873 - DNA, 673 bp, Xenorhabdus bovienii
  Genomic contig Name=Xb4151_4152.C332
ggaagcttggccgaggtcttgaaattgtcgatatagacgccttcctgctcgatattgaccgcaagcggcgacatggatcccggcgcgatgccgccaatatccgcgtgatgtccgcggcttgcgacccaaaaccggatttcacgattgttatcgtcgaagaccggcgtgcagacggtgaggtcgggaaggtgagtgccgccattatatggggcgttgatgaggaatacatcaccgggcttgatgtcactgttttcgcgaatagcggtggcaaccgatgcgtccatggagcccaggtgcaccggcatatgaggggcatttgcaacgagattgcctgcagcatcgaaaacagcgcaggagaagtcgagacgctccttgatattgaccgaataggcagtgttctgaagcgtcacgcccatctgttcggcgatggacatgaagagattgttgaaaatctcaagcatgacgggatcggcttcaagtgccgatggccgtacgtgcgggaagcgcctttgatacgtgtcagcaccacgtggtcatgggtggtcagacggcgcctgccaagccggtcttcgatgacgatttgtctgggttctttctcgagaagtggtcgccgggcccggtaaacagttcttggccaaggaccgaaagcttgcgggccgcctcaaggccgatg

SEQ ID NO: 14874 - DNA, 919 bp, Xenorhabdus bovienii
  Genomic contig Name=Xb4151_4152.C333
gcggaagcttggccgaggtctaacgcaaagtgcacggcctcctgtcggggcatatttcgacaccgatgtcaccatggttgagatagaatctggcgacgttatgcatatgcgtgacgaatcctttgaaaatttgctcaacgaaatcaattccaaggttgcgcaatcgcgaatgtccaccactttggcttggattttgggcggcgttgggttcgtggcaggtcttgcgctcgggggagggactgcgcttttgttcagcctattggcactccctggatgggcgataggtaagtggcttgattcataccgacgtaccacggtgctttattatgatctcgaaggggaggcggagcggggctataggcgtctaactgagggatttgattctctttgtggttgcgccgccaaatggcacatcgaggctggcggcgcagtgcaagggcttaccgcttggaaacgaaacgcaggtgcgagccatctcgttaacaggaaagcgaccgcactcttatataaactgccttcaattattaacagcaacataactccgcctgcgcttcatgtcggtaggcaggttatgtacttcatgcccgatgtcgttctggttcaagatagaaatcgattcggttccgtacagtatgctgatctgaatttgcgatggcagccttcaaggtttatcgaaaccgaacgtgtaccgagcgatacaacggttgtcggccatacttagaagtatcccaataaaaatggtggaccagaccgtcgctttaaagacaacagacaaattccgatctgcctttatgaatccgttcacttcaagagcaacagtggtatcaacgaactagtcgagttttcaaaaacaggtctcattgagcagtttgccgacggctgtatctgttggcggagaccgaggcttgcggccgctcga

SEQ ID NO: 14875 - DNA, 231 bp, Xenorhabdus bovienii
  Genomic contig Name=Xb4151_4152.C334
gcggaagcttggccgaggtcttttcgctcatgcttcaagcgcgccggcacgcttcttgacggcagaaggcttcacccccagcaatttgagaagatcatcgccacggcgcacatagcgcagcgaacgacgggtcaaaatgcgcccgtcctgcggtgccgtgagcgtaatgtcgccttccggttcacccggtttcgtaaccaccgtgacgagaccgaagcttgcggccgctcg

SEQ ID NO: 14876 - DNA, 296 bp, Xenorhabdus bovienii
  Genomic contig Name=Xb4151_4152.C335
tcgagcggccgcaagcttcggtcttcctgtttggctgcaagagccgccaagaactcctcgccggtcatccggtgggtgtcgttggcaaaatcgtaattcgcaggcttgttatcgatgaagatttcttcggcaaaatgaaaacgttccggctcggcaaaagcctgcatcgaaacgaccgtcattccatcatggacaccgcgccagaacagcgacgaaccgcacttcgagcagaagcggcgttcgccccattccgaagacgaataggtcgagagggcagacctcggccaagcttccgc

SEQ ID NO: 14877 - DNA, 158 bp, Xenorhabdus bovienii
  Genomic contig Name=Xb4151_4152.C336
tcgagcggccgcaagcttcggtctaacgtttacggcgcttcctgaatgtcggtgatgaagcgcgtgctgtcgaccacatcatagatgatgaggaccttcatgcccttgttgatcgcgctgtaatcgaactcgccaggcagacctcggccaagcttccg

SEQ ID NO: 14878 - DNA, 416 bp, Xenorhabdus bovienii
  Genomic contig Name=Xb4151_4152.C337
gcggaagcttggccgaggtctccgggtcccgtactcgatatgcttgatgccattggcaggtctgataacgcagagtggtggcttgaatcggcaattgccgacggagaacggttgatgggcttcggtcatcgggtctatcgcgtgcgcgacccgcgtgccgacgccctgaaaggcgccttgaagcgtatagaatcccttgggcatgagcgtggaaaacaccgggttgagttggcggaggcggtggaaaaggcagccatagcaattctcaggcgccacaagccggatcgggctctcgaaaccaatgtcgagttctataccgcccttttgcttgagcaactgggtttccctcgcgaggcattcacctgcgtctttgcaatgggcagaaccatggggtggatagaccgaagcttgcggcc

SEQ ID NO: 14879 - DNA, 335 bp, Xenorhabdus bovienii
  Genomic contig Name=Xb4151_4152.C338
gcggaagcttggccgaggtctgaaggacccgcgcgtccgtcaggccatttcgctggccattgaccgtgatttcatcgccgatcaggtctggcagggcacgatgctgcccggctattcgatggttcctccccatatcgccaattatgttgaggatgcgccaaggctgaaatattccgacgatatgctcgagcgtgaagacaaggccaaggaactgttgaaggaagcaggcgtcgaaccgaatacgctctcggtcgaactgcgttataacacctcggaaaacaacaagaacaccatggctgccatcgccgaccagaccgaagcttgcggccgctcga

SEQ ID NO: 14880 - DNA, 588 bp, Xenorhabdus bovienii
  Genomic contig Name=Xb4151_4152.C339
gcggaagcttggccgaggtctttcgcaaggacgaaaatggcgtctatttcttcgttgatcgtctgaaagacatcatccgacggcggggcgaaaatatctcttccttcgctttggaagccgaagtgcttttccacgacagcgtcaaagagtgcgcggctatcgcggtgccaagcgaattgagcgaggatgaagttcttatcgccgtaacccctgtcgaaggccaccaaatcaatgctggagaactgctggagtttctaacaggccgcctgccccgctttatggtgcctcgctatgtacgaattctggattctttgccgaagacgtcaagcggtaaaatccagaaacatatcctacgcagccaaggcattaccggagatacaatcgatcgcgatttcaacgccaagcgcgcaagctgatctctcaaaatcgacagacctgaaacaaacttcgtcatcaacaccacgccatctatcgtgcaacaaaccggcgggctggcgaaaatggttgatattacagagcgtttgctgggcaagagcgtcgttatcgtcaccgacaagggagcgcaagaccgaagcttgcggccgctcg

SEQ ID NO: 14881 - DNA, 190 bp, Xenorhabdus bovienii
  Genomic contig Name=Xb4151_4152.C340
cgagcggccgcaagcttcggtctcgtcggcgccggtgctctccgcaaaggccttgatgccttgcgccactgtctccggtccaccgaccacgcggcatgacagcatctggcgcacaagcgcctgtgctgccggatcaagccgttccatatagccttcgacgggtgccggaagacctcggccaagcttccgc

SEQ ID NO: 14882 - DNA, 312 bp, Xenorhabdus bovienii
  Genomic contig Name=Xb4151_4152.C341
gcggaagcttggccgaggtctgagaaggccagaataactggtattctgacggcgttcctccttgcggcatctgcgctcgttgcagccgtggccgcctacatcggtgcggtccatggcggtcgacatcgcgacgaaggccgtatctggggtggcttagcctatcgcaggtaataacgaccttaagcaataagggcttcggaagaatccggagccccatttttagatcagtcggcttaatatccagcaggtgctcgcgctgcaaatcgcagcgaaatccgtaagttcgctagaccgaagcttgcggccgctcga

SEQ ID NO: 14883 - DNA, 258 bp, Xenorhabdus bovienii
  Genomic contig Name=Xb4151_4152.C342
tcgagcggccgcaagcttcggtctcggtcgtgaaggcatgccaatccgtgtcgacaagatcgaggatatcgggcgttaccgcatcgtgcgcgcgggcttcgaggggcagaaactggcagtggtggtcggcgaggatgaggatatacccgcagacccccgtgtgaccttcgatccgaaggctatcggcatattcgcggattcctggcgtgtggggatggagggctgaccatggagaaaagacctcggccaagcttccgc

SEQ ID NO: 14884 - DNA, 406 bp, Xenorhabdus bovienii
  Genomic contig Name=Xb4151_4152.C343
cgagcggccgcaagcttcggtcttgtaacgggcctgatcgatgcggaagatcacatcgccacggtggaccgcttcattatcatgaacgagcacttcgccaaccagtccagaaacatccggcgcaacacgcacaacaatccggcacgagtcttgccgtcggcgcgtccaagggcgcggtcttcatgttaatagttcccacaaatgccaagccaaagaaaggccccgccagtcgtgaccgtgacgaggggttacaaaacacacgggcctgaagggtgcaaaagaagacctcgggccaaggccttccggcttaaagccgaggtgtccaggcaacacttggcggggccggttacttagttgctagcccgaaccctcggggtaacccaaactactgggcggtaattgcatt

SEQ ID NO: 14885 - DNA, 326 bp, Xenorhabdus bovienii
  Genomic contig Name=Xb4151_4152.C344
tcgagcggccgcaagcttcggtctgactgagaacgatttcgaacgtctgatgaacttccggaacgccaaccgggacaagcagatattcatccagcagaagagactgacactcgatcagctcgaagaacggattcggtatttcgtttcgaagaaaggcaaagggctggctgtcattgaccacatgggcctgatcgatcgcaataagtcggaaacgaggctcgcaaactgggaatttggcgaaatcgtaaccggaaaattgaagcagattgcgagagatgtcgacattccgatcatcggctgtgcccagacctcggccaagcttccgc

SEQ ID NO: 14886 - DNA, 554 bp, Xenorhabdus bovienii
  Genomic contig Name=Xb4151_4152.C345
cgagcggccgcaagcttcggtctggcggactttgagttctggcgaaaaaccgaagaccggcttatgcgcctgcgtgatgtgcagactccggtaaacttcattgtccattctttgcgtgaggtgaacacgcggatcaaggaagggcgatatttcttcactgacatccgcaaagaaggtattgtactttacgaacttgatcctgagccgctcgcccaacccggtattctcaatccggaagacgcccatcgtattgctaaggaatatttcgacgaccggctgccgcatgctagtaaattcgctaagggagccgcgttttattgtcaggagggagatttcaaagaggctgccttcttgctccatcaagcgatagaacaggcatattccacctttctattggtaacaacaaattactcgccgtcttcgcacaacctgaaattcctgcgtcggctctctgaagggcaacgcagtgaactggccaaggcatggccgcaagatcaacagcgttacaaagcgtggttcaatatcgtcaatgaagacctcggccaagcttccgc

SEQ ID NO: 14887 - DNA, 899 bp, Xenorhabdus bovienii
  Genomic contig Name=Xb4151_4152.C346
acacctttggtgtgcatgaaaccgccaggttttggactactagggaggattcccccctgcgtgagataaaatgccacgaggcctccctttaacgggcggacaaaatgagtatgcggtatactcgataatgcagcacatacgccgacgatatagagatgctctgctagtggctgtacaaaacgtctgttgtacaagcttgatgactcttttatgaggagagctgcactcagaacgatatgcatcaacagcgtgggctctcttctatagacaaccttgtgcacgagaccgggtggcagagtagcacacacgcccctgtacgcagtttgacactgctgcctatacgggaccacggcaaagcctctaccctatcatgtctgcagcaatggagtatgaagactagctccagagtgattaaagactaagatttaaagcatcgaatcatcattactgactgttattagacgactatctattgtataatgtgcaggcacttgcagcccgtgaacctacgctttgtcagtgatatgcccattgaacagcagtctttccctgctctgcataacgataagactatagcgcttcctaacaatactgttaataacatttgtcaagccgccaatatagatttacgtattgtaacaacagaattaggacatcattacagacagccactccacctgagatgcccatcagatgaattagtacctcagacagcaccgatctactgatgatccgttttggatggttactgcaaatcttacagcggaatacaccccgatgcacagggacactaaaataagttagcaatgacttagccatcttaagattatcctaagcggcatgaatttatttcagaaaaaaactgcaaggccaatttctgaaaaaaagttggcaatatt

SEQ ID NO: 14888 - DNA, 1474 bp, Xenorhabdus bovienii
  unsure (1)..(1474): unsure at all n locations
  Genomic contig Name=Xb4151_4152.C347
ggggggggggggggggggcgccgggggagggacaataataatgtgtggctcctcctctgggaggtgcttacttattaggaaggactcctccctgtcatgtgagctatatggatagagtctagtgcactgtaggagacattgactgaactgactgccaaggaatgtcctagttggactgctcaatcttgacttgatactgctctaggtactgcctatgtactaggctctatgaatgtgaacatacctccatatgagtagaatgtctactatgctcgtagcctgagctatacgnataagcaagacatgggggcttgcatcgcagtgtctgaccaggagaatgactcataagatctactgcagctaggatgatatatgtgagacgactcaggcgcctagcagactcgaatgtaggccagaggagcatatcatacccacatagtccccactgctagctggaagtgctaggggcactattatactgagctagctccgctcggagaggggctcacatctatatcttgtagtaaagagaggncctgccacaatagcctagtagctcagctgcattcagagtaaacaatcttgtaaggggcaatatgcctttgnactactcttccttgatcgcgccctagccactaatgnaggcaagagatcttagtaggattcagtcaatgccacgaggatgacttcgctatcagtcctgtactgaggactagactatggcaatggatngccctagaggactaggcatcatatgaggcactttcgagaagcgtactctcggagagagctaagatccctagagagagatcagacgggagggccctcataaactaggtagtagtcctttaatagctcccaacctcatatgcaggaaggccactgcggatatggaaatgtctcggccttatgaggagagctcagagtagacgcagagcaccctgaagtagcgcccctataataaactgatgggcgaatgtcaagatgtacctcgtaaggagctctaaggatataattacgngctntcacggatgacgtagagaggacgcttgtatattcttatagaggatcaataatactccgagnagatatgctcactaatacttgtatgactaccatttagagntctctaacgctgcgatagcagtctcaagtagagatcagagcattagacatacgcagcctcgagagccctccatgagcgagtcgggactaccctatatagagggcgatcgtctcaagcctagcaggtaggagaccatgagagagccaacaacatgacgcggaggctctgaagagccttatcgagccatctaagcgatctcgaaataaatacctgcgaggtgagacgtaacagaatgacgtgcgnagatataccgcatagcgtctcctacttagcgcggagagactacgaggcgtattctgttctctatgtccacgagagtcaatagtacgatgagttcgacaatcagcg

SEQ ID NO: 14889 - DNA, 527 bp, Xenorhabdus bovienii
  Genomic contig Name=Xb4151_4152.C348
aaaaaaaaggggccaatttttcttccattgtgggtaattttggggccttttggttcccgccctttcctgggggttttttttttggggccctccccttttttttcccaagggggcccaaaaaacccccccccccaataattttaacccccgggggggcttaaaatggtttgggcccccccccggggtcccccgggttctccggaattaccccaccttttctggggtggaaattttccggggaccccttttccccccggaaaaatttttaaaaaattaacccccctttaaaggggatttccccaaaacctgggggggtaatttttcccgaaattttaaacccccaaaaaagggggaagaaaatttccctccctcggggggggttttaaaattttttttaaacccccccccccccattggggggacccccccccccccccccttttggggggggtgttttccccaaaaaaaaaaaaaggggggggggaaaaaaaaaaaaaaaaaacaaaagcgcgggggtttttttaaaa

SEQ ID NO: 14890 - DNA, 1159 bp, Xenorhabdus bovienii
  unsure (1)..(1159): unsure at all n locations
  Genomic contig Name=Xb4151_4152.C349
ggggggggggggggggccgggggaaaggacactttttgactggcctgcggggcaacttctagaggagcccctctgacgaatccctaatgttagaatgagcactggagcatgctcagatgccggatcaattggcgctcattcgctcagtgccggcagcctggatagcccgggaggtcacccctagataaggtaccgctcatgccgatatcgcgggtctcccggactgctgggctgtcaggagatgtattatctcgcagcagtgtgactgatcgccattgagagcaaatagtgacgcaagggatatctccagagagttccacagccagaagcgagggagatttatctctgtgctctttgtcggaagaggatcactccgtagcttgatgagagatgctcctctatggccagcctacattgtatcagaaaaagatcgtctagggctaatatatttgaactcgatactctgcgcccctctgcttacgttcacagcgacggatagagagagcatggctatggcacagtagttgctaggcatatagactagcctaggaaattcatgcctggagacaggcttcggtcatctagtacgatggggccctctagatgagctaatgctctgagcctgcagatagaggccttaggatatagtcggagccatgagtgcctcgacatataggatttcagtccgggagctggatgatcggttcataaacatcagagaactcagcctcctcatttcctcattcaaaagggaggcatattagtatctcaaagaatcccagtcagactgcagtccaagatcagagagggaccttgcttactcgcaggttcttaatgcgagggcattggggcgcattcccagctctctgagagcccgtcacagaaggcgtgtcactaagctaggtcgatcggagggcgcctacaataccctctagtctgcgggccatatgagttgcaacaaccccctcctcgatagagtggtctattgagtgacttaaggccccatgacctacaaacgctatggagagggcaccaccatccccctaggccgaaggttggagaaagtagaagtggcaacagtgacccactctccgtcctctacaggaacccaggacgatccctcttcactgcgcgagnaatgcagccaccataacaggtg

SEQ ID NO: 14891 - DNA, 870 bp, Xenorhabdus bovienii
  unsure (1)..(870): unsure at all n locations
  Genomic contig Name=Xb4151_4152.C350
aggatccccctggtgttaaacatgctcagtttcgcttaatgtccgaagaagctcacgctgcgcgaagccgacttgctacgatccggcatatgtgtagtcgtctttccgtgcctgtccatcttagtctttctaacgaatatgtatcacttttctgctaccctccgcgtagtctcaccagtctgagcagaaacaatttcattaccgccagtctcgcaatgcaataaggtcacagagtcatattaaaactgcttactctcccagatctgggaagcgctcttcgccatcatgagtacagccatgtagatcgaagaaattttgcatggacatttaaagctaggagtgatgagctccgtatgtagactagcgtacttcgtttgatgaatagcatgatatatgtagtccggcactgcagcaacatgatcactacactactgacagctgctatgcggccattagaataaagcggcactactgcaccgcagcatagctangctggatgcgagactgcatgagcttcttcaagcagagttatctgaacatgacatgttcgcccagatccgcgtgatagatgtgcaggtgtctaaacatgaagttccgtcgcagtgcagctcagatcacgccacttatgccgccgcatcctcagaaagatagaagccggaagacacgcgaccgattacggggctgctggaggtcatcataagggattagctgtcgcactctgaccgctggtcagagcacccgcaggggtgccatcaccagcacctaatgattacagggctaaacagcagaacgttagcgcagcccgtataatgcgatactaaagccgcctagtgacttacttattctcaccaaagccaaagacgggacaaa

SEQ ID NO: 14892 - DNA, 257 bp, Xenorhabdus bovienii
  unsure (1)..(257): unsure at all n locations
  Genomic contig Name=Xb4151_4152.C351
tttccccaaaaaagaggggggggtttttttttttttttttttttttccccccggcgggttttttttttcccccccccacaaaaaaagagagaaaaaaaaccgcccgcgctttttatttttttgttggntttnnttttgtccggccgcgttgtttttgagagagaagaaaaaacaaaaaaccccccctttttttgttgtgtgtgggggcgcctttttattattatacgcggcgcggggtgagaaaataataatatttt

SEQ ID NO: 14893 - DNA, 1062 bp, Xenorhabdus bovienii
  unsure (1)..(1062): unsure at all n locations
  Genomic contig Name=Xb4151_4152.C352
acttagtgccaagagcacattgcctatagagtatggcctctcgtgaatgattgggagatgccgaaggaagctgctgccgggtctagccaaggcggcctggtgtatctaaaatataccttcagatgtagagagcattttgacgagccaaacaatgagtggctgaattgtattgaagcgactagtgacgagttgcttggtgcttataaaagggccgaagatgatgccatgactgtagccttcggagagcgaggcaggagaaggctaaacagtgtttttgatgttattggttccgtctacccggattatagctatcccttgcgaaaacaaggaaagaaaaggaaagttcccactttggacatctgagttgggccgaacggtgagaagaaaggttttaacgcgcgcgcctaaatgcgtgtgaagcagggtgcgggtgtgatggtggggggaggggcttgttgggcgatgggtgggtgggggggtggtgttggtgcgggagaggggaggagggtgggagggagtgagtagaggggtgtgggttgttggtgtggtgtgtgggtgtgtattggttggaggtttgggttggggtcgctctgggtgaggtcggcggtttgagccgtagcgctgccagccggcccgttggcggggcgcgcgtgtctctgtctcgggcgcggggtccggtgggcggcgggggggcggcggggtcgggctgcctactgtgtgggtcgcgttgttgtgcggtgggcgggaagtaacgaagtcgtaaacgaggaagatgcccgagtacgagacgagagcggagcgataacagagaaaaacgggcggatatctttcacacttgtgatgcaaggccgcgcgtcgtggcggtttggggggaggacacacgggggtgtgcggttgtctaggatgggttgtgtggttggaggtcgtttgtgcggtgcggatagggctgtcattgctggtgcgggtgcgaggtgggggccgtggcgcngcacgcggagggggcaagcgggagaatacggtcgaagagcgaaggggaccaatagaagtacaagcaggagaacc

SEQ ID NO: 14894 - DNA, 1204 bp, Xenorhabdus bovienii
  unsure (1)..(1204): unsure at all n locations
  Genomic contig Name=Xb4151_4152.C353
aggggactattttggagtgctggggtcattctagggacccccccagtgctacggcttgaagggagatgtccattagaccatgaagaacagtgagttacgcttatatacataaacagcatttctgccagtaacaggcgatgcaggcgtgcccagccacatgatcaggctttggaacatgctccgccatctgtgcagcagacgatgcatacagttaatgaaccctatacgatggcatcacctgaagatgaaactgtgcatcccactgagacgtaaaatggtcatagcagcaaatggttggcaggagaccaacgctaagtatccctcgccccagtaatgcaatggagagatgaccttccatagagcagtgcatgtgttatgcactggacgatgagcagagcagacagtagaccatctagcaatcatcacacatcctagacagtcaagcagatctccgatggcaggcctagatgctacgttgggactcggaaggcactgtccacactgctgtgattgctacttagatacttagtcagatagctcagtgagatcggggcctaggtctgcgcctaggagatgtccaatccccaggagggcgctggtgaagagccacatatctttgccgctccgcagagagacacaggggctagcgagggcagtcagcatcgagagagtataactgcaggcatcccagtaagagtcgccatttttcaacgcaaggcaatccacgctcgggcctaacaaataactgcctctataagattgntggctcaggcaacttaaggataataatggttattcgtgtcgcagctcagaatgtccagcatatattgagagtggcgccccgtaaattggtcacagaccagaggcgagtggagagtaatctagtttcagagtattacgactcggtgtacctcatggtagtaggggtgattcgacacaggccttcgtagagagcgtagcgccttttagagactaggatatataacacggcggcccccgagagggcaagaaagattattatactattgttccaccntccgttctgcggattgtttatagacaatgtctccgccatgnccgggccgcggagtacttatcaancacaaggctctctgctcctggcgacgcagattagtggtctatgcgcacccatgaaacgcagaaagaaactctttctggtgtatattctgaccgcgcctcggcc

SEQ ID NO: 14895 - DNA, 900 bp, Xenorhabdus bovienii
  unsure (1)..(900): unsure at all n locations
  Genomic contig Name=Xb4151_4152.C354
tacaagtccctcggcccgtggggcataatagcaagtgcccggcgctatactgcctcggtgtaaaacagtggagacataacagagcattctgatcgggactgccctgccaatactgacaaggtactacatgattatgctggcgcagttgggagaatagcatgtctttgacacagagcgttagggcagggaaacagcgttcagaaagttgacttgccatttctatataattaaacgtgccaaaatggccctggcgccgcatcctgataaactggtccaaagcaacataatgtatctttggaacactcagtacatgctctaggataacactgctaagtgccgaaatgatccgcgaaccattagatgctgaatcggaattactgaacagcttagcgtacatgcgctgaaacacagagcctgttatagataaaaaggccccgggggttgggcttagaagagaaaccggaatatttttttcgcggcgggcttttttctcctcggccggctgatgggagaggagatgtttttttagggggggaagaagggacnagagtgcccagggggacttttgtgaggagtgagggaaggggtgatacaatggtgatggggtgtggacaggagagctgtgtagcatcggggcgcagattagatacagacgttgcatttagggtggagtctaaacatgtgtaacgggagtaagnccgtggagtagtgagacgaaagagagactgcggaccgccgtattagaagcgtagccggccgcgcggaaagtagcatgaagaattgatgtcggagatggtgagtattcagtaaataacggattgatgtctggtgacctagtccgcatgaggagtnctctntacgcttagcttagagtaaagatagagcatcaatacgngacgg

SEQ ID NO: 14896 - DNA, 349 bp, Xenorhabdus bovienii
  Genomic contig Name=Xb4151_4152.C355
gggaaagaggttttttgggggggccaaaaaaaaaaaacacccccccgggggggggggtaaaaaaaaaaagggggggggggcccccccccccctttgggggggggaaaaaaaaaaaccccccctccttttttgggggggggggaaaaaaaaaaaaaagaagggggggggtttaaaaaaaaaaaaaatttttttttttaaaaaaaaaaaaaaaaagaggggggggggggggggcccccccccccccccaaaaaaaaaaaaaaaatggggttgtgtttaaaaaaaaaaaaaaaaaaaaagagggggggggggcggtgtttttcttttatttttttaaagtaaagaaaaaaga

SEQ ID NO: 14897 - DNA, 707 bp, Xenorhabdus bovienii
  Genomic contig Name=Xb4151_4152.C356
ctgcaataggcaaaagttgttgggctaaatcttcaaatggtgaaaaaaataacatagacaaaacctctcaatgaatgaaaattaaaggacaactatccatgttgacaggccttaaccatctgacactagcaacctcaaatcttgagcataatctcaatttctatataaacctgttagagtctactccccatgtccgctggtgagggagaatcaatttatcttctcgccactgacgaacatcaacttggagcccgtccatgttggttcccttgctcgttgtttttacattgccggtcgtatgggttccgcactgtataattttcacgatcctctggcaaaacaccgtgaatataatgactctgcctatacgctcgatcatttttataccaagatattgaaaatagaatctggctttcaaacggaaacgggtagacaaatggctcgtgaaaggacagaacgcatggaacactttcttgaggcttttttgaatgaaattcaggtcacataagcaaattgagatgagtgaatcaatattaatgactaacagttataattagcgagattttcataagtaagagaacttgtagtgacagaaatatatagtgatgaatactggatgcggcgggcaatggagctggcaatgcaggcacaatctcaggacgaaattcccgtcggggctgtgctggttgccaataataaaattattg

SEQ ID NO: 14898 - DNA, 508 bp, Xenorhabdus bovienii
  Genomic contig Name=Xb4151_4152.C357
ggggggggttttggaaaatattaaaaaccggggggttccccaggggaaaaaaagggggtttttttctccccccccttttttgaaaacaccccccccccccccccttttttttattaaaaaaaaaaaatttttttttttttctttctcccgcgcggggaaatttttttttttttttcccaaaagagagagaggggcccccccccccccccccctctctcctcatattaaaaaaaaaaaaaaaaaattttttttttccccccccccccccccccccgggagaaaaaaaaaaaccccccccccccccccccttttaaatattggggggggccccccccccacctattatttttttttttttttttaaaaaaaaaaaaaacatccccccccttaattataaaaaacccaccccccccccccccaaacaaaaaaaaattttttttgttatgtaagaaaaaaaaaaaattttttttttttctttttttcccccccccccctaattttataaaaa

SEQ ID NO: 14899 - DNA, 325 bp, Xenorhabdus bovienii
  unsure (1)..(325): unsure at all n locations
  Genomic contig Name=Xb4151_4152.C358
gaaaaaaacccccccccccacaaaaatcccccccaaaaaaacaccacccccccgtgggttttttttcccccccccccccccccccctttttttaaaaaaaaaaagggggcccccccccccccccccccncntaanaaaaaaagnngggaaagaaaaccccccccctctaaaacccacccccccccccccccttaaaaaccaaccccccccccccccatcctaaaaaataaaaaaaaccaaacccccccccccggtctgggggggggggccccccccccacacaccctatatattaaaaaaaaaaaaaangtgtggggggggggga

SEQ ID NO: 14900 - DNA, 880 bp, Xenorhabdus bovienii
  Genomic contig Name=Xb4151_4152.C359
gagtggcactcccctctgtgctcgtcagtgagtagtgacatgccgacatgcagatgatactcagcagctagcgagctattctcctgcatgatatgcccactagcaggatggaccctgatgcgagtagtcctagaggagtatcgctatcatagcacttactagtgctgcgctcagtttcagacgcgtagtgggtctatagtgtcatacgagatgggatgctgactagctgacatggaattgattcgagtagggctcctttgaccgctgcagtagctctccgagatgaggggcgaatcactctatttgtcaatagttcaggatatgacgaggcagatattggctccagcacgatgtaccattcgtcaaagacctagcaactgatggcataggcatggagctccatggaccctgggaagagggcccatgaagcctctttacgctatactctattaggcgagagggaggggttggctagggagatttatgatgagcccactacccataaaagagcactcagaatgaagagcccgaaatacgccgcggagagactcagtgcttctagcagggtgggacgactgatcctacgaggagtctgggcacaagcctttcttcgagaggcggggagcattaccggaagggggggagcgcgacttatgcggtgggcgagaggagcgcacaaatatgctagggaggcacaagggctctgtccgcgggtggggccggggggtggcatcgagtttctgatattcttctcctgtattgcgaggaacgcttcgcaaggactgtgtgcaaatggctccggtgcgtctgagggtgcgtccgcgtaggcactgcttcctcgatcattgtaccgtaacaactacagcaacagtatcagatt

SEQ ID NO: 14901 - DNA, 262 bp, Xenorhabdus bovienii
  Genomic contig Name=Xb4151_4152.C360
gcggaagcttggccgaggtcttctgcgtcaagcgcagatcggtgcgggctccactggccttcccttcaacttcttcctcattgccggagcactctacctgctgatttcgtcggtttccggcgggcttctgcaattggccgagcgccacttctcgcgcggcgtcaggagggcaaaatgaaccttgaattctattctgatgcattcttccagatgctgggcggcgtgccgctgaccctgaagaccgaagcttgcggccgctcga

SEQ ID NO: 14902 - DNA, 860 bp, Xenorhabdus bovienii
  Genomic contig Name=Xb4151_4152.C361
cttttgagagatagtacgatgaggttgcactacaaagcgtgtataggctgaggatcgtgctctaagtgatgcgatcttccccgacataaggataataagaatatagtgatgcaagcactggcatcaaaaccggtgtgacagatgaggttgaccagattcgttatgcggtctgatgctgaaaatactaaaaacacgagtctatattgggtaatcgctgaagttccagttatagctattgctaatgtacttcttcatatgatcaaaaacccatcatttctcgaagatatacacagccatgataatacatcacccgcaaggggattattgatgacgagatcaatgtctgcgctttttattgtaatcaagcaaaagaggggcccgccaatatgtggccgaatcgactcacgacggtcgccattgtaaatgcagcatctactatccatgactttaacgtggggtgttcggggttggcgccgtcttcccggggtggtggacgtgggggcgaggttggctgggtggtggtggcgcgaaaggggggtggggcccgggcgcggtgggttggggtgtggggtggggagggtggcgaacagcggccctacactgtctaagtcgaccgcgagatttatttcccgccccccccccttttgttcttttttcttccccccttttatttccccccccgtctcacccttcacttttgcggccgagagggtggggcgttcctgcggggcccccggtgtggtgtaggagtaagaccgtcgtgttgttgtaccgggcgctggccagagatttgtgcccgcggtatctggcgctcctattttgtatttggtgtttgccgagggcctaattagcacagcaag

SEQ ID NO: 14903 - DNA, 207 bp, Xenorhabdus bovienii
  Genomic contig Name=Xb4151_4152.C362
ggccgcaagcttcggtctggaagatcggccttgctctcctgctcaagaaaacaggctcgcaaagcccggagaagcgcttccggcagatgatccgccacctggcgcagcatgaccacctgcccgactaccatgtcgagttcgacgatgcgaacgacatggtgatcttcaaaaatcgcggcacgatgaagacctcggccaagcttccgc

SEQ ID NO: 14904 - DNA, 635 bp, Xenorhabdus bovienii
  Genomic contig Name=Xb4151_4152.C363
tcgagcggccgcaagcttcggtctgcgtcgtcaacggtcgatgacgacatgaagcactttacttcatcatagccgaccagaaggctaggaatggcaaggctcgatgcctccacaatgacccggcccatgccagcaacaatgtcatacttcggcatatgagtttgaatatcgtctatccagccgagtaaacgtatacgtccttgacgggacgcctgacccgaaatcgctttcaggagattgggtatttctggcccttcgccagcaatatctagttcccaattcggcagactgtcgagcatgtcgagcagagcataaagaccttttgtcttgtcggcatccaaccggccagcccagatcattcggtggccctttggtgcaacactgacattggtacgctttgctgtatttggttgaatgtcgggccaaaaaccaaactttgtgctgaagatttcacctagttcatgtgacacggcgatcacatggctattggaaataactctaggccacagcgcgctggcgttgtctcccggagcgccgtcaaccgatcccggaccatgaatggtgcaaatcagcggaatatttcttccagtctgcgattattgctccgacgataaagacctcggccaagcttccgc

SEQ ID NO: 14905 - DNA, 774 bp, Xenorhabdus bovienii
  Genomic contig Name=Xb4151_4152.C364
tcgagcggccgcaagcttcggtcttgttcatgttcatgaatccgtcgaacaggccattgcagcgtttccggatcgtgaagccatcatcaaaaaccttgccgatgcggcgaaaagtctgaaaacagtccagaccagcgcacctgatggttttctcctgctgcatggccacagactggagcgcaagcggcaggaaatcgatgctgccctgatggaagcggcttcgctgttcgagcgtgcttatctggaacagccggtattggcgtcgggggatgagacaaggctcgtcatcgagcatggttccggagcggcagaaatcgcaataatggctgaacctgtcctgcctgaaacctgttctatcgcctgcgagcagcaaacctcggaacgaaaggttttcaccgtctcgctcatggaagacgtggcaccttccccgcttttcgagcctgcatggcggtcgcttggcggtaacgggcaagcctttgtccggctaagggcgcagtttgacgaccatctggcggagtgcggcttcgatctcgaagagccattcgctattgttccccccgcttcactgaagttcgatccgcctgccgtcattatatccggaggggaagaacatttgccggtcaggcttgttgtcgacggcagggctgaccggattgctttcacaccgcaaaacggctggaatataagcctgaacggtcaaagcgccgtgctgcatgggccttccgttccgaaaccgggcctgacaaacctccaagacctcggccaagcttccgc

SEQ ID NO: 14906 - DNA, 192 bp, Xenorhabdus bovienii
  Genomic contig Name=Xb4151_4152.C365
cgagcggccgcaagcttcggtcttgaaggcatgcgcgagcgcgacggcaatataagccaggtcagcgccacgctgcgtatgcgtaccggcgccgatcgctggaaggctttcctccgtccggccaagcgcgtgaaggaaggcgaccgcatccgtttcggccattccggatcgagacctcggccaagcttccgc

SEQ ID NO: 14907 - DNA, 417 bp, Xenorhabdus bovienii
  Genomic contig Name=Xb4151_4152.C366
gcggccgcaagcttcggtctcaacccgtccggccaaattcccatgctggtgaccgacgagggggaagcgctcttcgatagtccggtgatctgcgagtatttgaacgattttgccaaaggcaagctgatcggtcgcggtgacgaacgctggcgtaacctgcgcgatcaggcgctgggtgactccatgtgcgacgctgcactacaattacgctacgagatcggcctgcgacccagtgaactgcaatggcagcaatggcggaatgcatgggcatcgaaaatcatcgatactctgacgtggctcgaaacgcggcccgagcatctcagtggacgtcatgatataggcgctatttcgatcttcgtgccccttgcttttatcgacaatcgtattccagaattgagacctcggccaagcttccgc

SEQ ID NO: 14908 - DNA, 565 bp, Xenorhabdus bovienii
  Genomic contig Name=Xb4151_4152.C367
tcgagcggccgcaagcttcggtctgacatggagcaggcttgtaaacgggaccaatgatccggatcagatcatcaggaaccgcacgcgccaaagcgagcaccatttcccaatcaaaccagttaccaacggtaccgagatagccgaatatagtacgatctccgttgcgcgggcccaaggaaggcgaaatatcggcatctaatccattgaagaccaagcgaacatgatcatgcttgctactccacttttcgtaaaggagtgtactcgaagtccaaacctcgtcggtgagtgaaacaatatcctcttcacaccgcaccatcgctcctcgcgagaagccctggtaaaatgcggggaaatcatccatcgcgtcatacagagatttacattgcgggagcgccgtcagaaccttgttttgcaaaaaccgaaggcttgccgattgcgagcatacaattgccctcctcagcaaactcgattgcctgtctcaacacctttcgccaaagtaaaagtagttaaccatcccagatcctggaaagcggctcgacaggcaagacctcggccaagcttccgc

SEQ ID NO: 14909 - DNA, 128 bp, Xenorhabdus bovienii
  Genomic contig Name=Xb4151_4152.C368
cgagcggccgcaagcttcggtctggccgcgccgcacccggtgcaaggaaggcaatctcgccttcttctacgatcactatggctatgagcgctatgatttcgtgtcgcagacctcggccaagcttccgc

SEQ ID NO: 14910 - DNA, 301 bp, Xenorhabdus bovienii
  Genomic contig Name=Xb4151_4152.C369
gcggaagcttggccgaggtctatgccttcaaatgacaaaataccggtaacaatgagtattgaaggggcaccccaagagatggcaatattggagtgaggctcattttgaattatcagaatgaccatgcctgaaaagattgccaataagcctactgctttgggaaatgtgccgccagacaggatatattttccgataacaataccagcagcgaattctaacaagtgcgggttcatataataatcgaaaaatgcatgtcctgttaccggtccgagagcaccaaaagaccgaagcttgcggccgc

SEQ ID NO: 14911 - DNA, 233 bp, Xenorhabdus bovienii
  Genomic contig Name=Xb4151_4152.C370
gcggaagcttggccgaggtcttacagcccccgtgaagaacgttttcaacaccaaagcatgtcgcgctttatcctattcaagtgacatgcttcaaactccagttttcacgcatgtcgttatcccaaaaccggttcccacttccgggagacatgctccaggaccactggccatcacataaagcgaaaccgtcgatttgcgtcccgcttcaaagaccgaagcttgcggccgctcga

SEQ ID NO: 14912 - DNA, 214 bp, Xenorhabdus bovienii
  Genomic contig Name=Xb4151_4152.C371
gcggaagcttggccgaggtctgttcctgtgggatatgtctttctgcttgccatcaacgacaaggacaaacagattgaaacactgcagcagatcatggcgaccatacaggatgctgatgcactcgaccggctgaaagcggcgcgcacgctggaagacgttcaaaccgcgctgcaatgaagcgtctcccgagagaccgaagcttgcggccgctcga

SEQ ID NO: 14913 - DNA, 230 bp, Xenorhabdus bovienii
  Genomic contig Name=Xb4151_4152.C372
tcgagcggccgcaagcttcggtctctcgcaatagccgttttcccatggactgcccggcatgatgtaggcggttttggcaccgactgctgcgatccactcccggagtgctttggcgatgaactccgggccattgtccgaacgaatatgggtggggatgccgcgcaagatgaagaggtcggaaagcacgtcgataacatcgactgccttcagacctcggccaagcttccgct

SEQ ID NO: 14914 - DNA, 268 bp, Xenorhabdus bovienii
  Genomic contig Name=Xb4151_4152.C373
gcggaagcttggccgaggtctgaccacccggcagatccttataggtcgccgaaatgcggcgctcgatcagcatttgcgccgtttccatcggacgggaatagccgaaacgcggcaaggtggtgcgataggcgcgcaccagaaagattgcttcgatcagatcgccacgcgactggcgcacggcaagggctgacagttcacggtcatagagcgagccttccgccatgacgcgatcgaccgccagcgccagaccgaagcttgcggccgctcg

SEQ ID NO: 14915 - DNA, 548 bp, Xenorhabdus bovienii
  Genomic contig Name=Xb4151_4152.C374
tcgagcgggcgcaagccttcggtctctctaagccatgacggtatatgcaattccgcgatgtcacaagacacccataccgtcaactccgccgtcgatagcgaggctggctcggcgattgacggcgaaagacggcggaaagaaaagtgtttattttgagtgcgttatagagggagataggcggctattggcggcgtctgggtaggcgcgaattattcccactcaatcgtacccggcggctttgacgtcacgtcgtagacgacgcggttgatgccccgcacttcgttgattatgcgggttgccgcattgccaaggaagttcatgtcgtagtgatagaaatcagcgggtcatgccgtctacggaagtcacagcgcgcagcgcgcagacgaattcataggtacggccatcgcccatcacgccgacagtctgaaccggcagcagaaccgcgaaagcctgccagatggcatcgtagaggccaggccttgcggatttcgtccagatagatcgcatccgcttcacgcagaatttccagacctcggccaagcttccgc

SEQ ID NO: 14916 - DNA, 331 bp, Xenorhabdus bovienii
  Genomic contig Name=Xb4151_4152.C375
gcggaagcttggccgaggtctggcaatgcagccctgatcctgatcgcgggatgcgtgctgattgcaatgctccattatggcagcgcggtctttgcgccggtcgttttcgcgctgttcatcatcatgctcgtctggcccattcagcgggcactttcattgatcatgccgcgatatgttgcattggcgatcacttttcttctggtcgtctgtcttctgctcggttttggatggctgatcgcctggacagtcgggcaggtgggacgccggatagtgatcgacgcagtgcgataccagttgctctatgaacagaccgaagcttgcggccgctcga

SEQ ID NO: 14917 - DNA, 1106 bp, Xenorhabdus bovienii
  unsure (1)..(1106): unsure at all n locations
  Genomic contig Name=Xb4151_4152.C376
ggcctatctcattcctggggttgtaccctagagggctccctttaatagttgtagagaccagcaattgctaagcactcatgctcactaatacgccctacctggcgacagcaaccagagctgaagtgcatagatggtaagaatatgctacccggcggtcattgatgctgaacataatattgtgagtgtagcttgccgacagtcggcctgaacaaccccggccgctgaccgccaatagccccaatgcaatcagggcagtggtaagacgatggataccacaccctgccacaggaatggctactcgcgagcagacatgaggttgcctcacagtccagccaacgacctaggccgcgacacaccaggacatacgccactcgcaacgagactgcgtagcgaatagtctaccgccctgcttgttgcttgacatccgcaggctctcaccccctccaattgtgggaccatggagcaccgaacatataacctccgcgcaagcaccccctgcacgcgtccttccagagggccgttttttcttccgttcccacctcactggtctggcagcgggaaacgcccccccttcccacgcaaatacttcccaccgaaacacccctaccgtaaaaaaaaaaatcaccgccgtattattcgacggaaaatacatcagcacaacttcacattatgcgatctcccataataaaaacacacccgccagaccaccacacgaaatttcctgttcactagacccaccgcctattctcccctctgtttgtcgccctggaacaatatacattaaccacgctcgaacaccccaaacctatatttatttgaagacgagcggagaccgcataaaccctcgcgtcagcgcccaatttaggcactaccgcgcggcacacgtctctacttatcccccacattcttggttcgcacgcccaccatcgcgcgctatccccactatattattattggccccacctgtattagcatctattattgcgccgcggaaancgcggtattctcagtcccgcgggaataaagctcgatggctctcgtctcacacgttatacagagcgataatgggtgntacattagaccactaccctacgacctcacaccca

SEQ ID NO: 14918 - DNA, 239 bp, Xenorhabdus bovienii
  Genomic contig Name=Xb4151_4152.C377
tcgagcggccgcaagcttcggtatttggcaataccctcagcatcccgatcatcatttttgtgggctttgatatccgggcgaacatattccggtgacatcagccggacctggtcccctcgttccgtaaacaagcggcccagatagtagacctcggccaagctttcggtaagccgaagtccagcacacggcgggccgttacaggttcagccggcctcgggtcccaggtgtgcggtaatcat

SEQ ID NO: 14919 - DNA, 276 bp, Xenorhabdus bovienii
  Genomic contig Name=Xb4151_4152.C378
cgagcggccgcaagcttcggtctgattccactgccaggcaggcatttcgtgctggttaattgagccaagaacgactaaattagatggggtattcggcgcttacgcctcgatagaatatatagccgctgctccgttgatttcagcgctgttccactcttttcggtcgaccacccgaacgcttcaacgacaatggcaggaaacaatcgatctcatcggcgctgaacgtcaagtcttccatcttttgcagtcgcttctgagacctcggccaagcttcgc

SEQ ID NO: 14920 - DNA, 403 bp, Xenorhabdus bovienii
  Genomic contig Name=Xb4151_4152.C379
tcgagcggccgcaagcttcggtcttctacgaaaccgtttaaagccgatttcgacttattcagtcactggtggtttacacccacgactcagcgagcccattgggaaatggcattctcgccacgcggataatacaagccaactatctttcccggagtgcttcccgcgctctgttgaaaggcttgatgagggtaatccataacagtcttgctgccggtatgaatgtcaacggtagcgaccatgccggggacgattggaaaacgctcgccagttttgttgaaaagtgcgtctgtttcggtctttatgaagacacgatagtagaactcttccggtttgacctcgtcctgaattgtatccggtgaaatactgacgacctttcccttcaagacctcggccaagcttccgc

SEQ ID NO: 14921 - DNA, 233 bp, Xenorhabdus bovienii
  Genomic contig Name=Xb4151_4152.C380
tccgggggcgcgcgcaaaataatacccggcggcgccccccccttgaagaggcggggggggggaaaacaccccttttcccccccgagaggtgtttgtggggggggtttttacccccccccccccaggggggtccccgggcgcgccccttaaaaaaaaaaaatccccccccccccccggggggggggggtggttttttttttttcccccccccaaccgcgggggggggggggttc

SEQ ID NO: 14922 - DNA, 907 bp, Xenorhabdus bovienii
  Genomic contig Name=Xb4151_4152.C381
tgtacattcagctcggacccttcccttccttagttgactgatcattatctctttctcgagtatcgctagcttttattcaagatctgcaataaatgattatagtgaagattgtcttttttggatatacagaaagcctcatttagatcttcataaattatactcgttctcccatagcgtagagcgttgatcctacatcagtgattggctagttcccgataatgaccctgcccacggcctagtatgtgttcacccgacactgacgacgtgcaaccagacctcgtcacgacactggcacgagtggttgtcctgaactgggcaacttcctgcacgtgctatccagtgacggccaatcgtctccgaaatttgatccactgcctcttacatctttttcttccaccactcgaggtatcatcatgtgttgccgacaccaccattctcactaggcgaattgctgtgagatgtccaaccttagctgcgctgcccaacgatgacgacgaactggcaggagacatctctcaccgcgggtgcaactctgaagtgatcctcacgatgacgtacccactcaccggggtccgtcatagtatctcctgtcgagcccttatgtaccgcatgaactgtcatccctggtctatcatactgcccagtccctgcctccgcacctcaaactaaaccctctggattgcgctctctgaccagggagacttgctattcatcaggtgcaatgcgtgcatgccaggcttcttccagatcctccaggtcacgggctcgatcatccgatcccgacctctaccaggccggtccccccttaaaaaaccggcctctgcacgggcgctcatatttctggccaccaacaacccagagcgacagccaacccaccaataccctacaagctgacccttgccccgcc

SEQ ID NO: 14923 - DNA, 679 bp, Xenorhabdus bovienii
  Genomic contig Name=Xb4151_4152.C382
gcggaagcttggccgaggtctaccctgctatgccgttggcacgacaacaggtccaccagagatacgtccatcccggtcctctcgtactagggacagatcctgtcaatattcctacacccacggcagatagggaccgaactgtctcacgacgttctgaacccaactcacgtaccgctttaaatggcgaacagccatacccttgggacctgctccagccccaggatgcgatgagtcgacatcgaggtgccaaacaaccccgtcgatatggactcttgggggtcatcagcctgttatccccggcgtaccttttatccgttgagcgatggcccttccacgcgggaccaccggatcactatgaccgactttcgtctctgctcgacttgtcagtcttgcagtcaggcaggcttatgccattgcactcgacgaacgatttccgaccgttctgagcctaccatcgcgcgcctccgttactctttaggaggcgaccgccccagtcaaactacccaccatacacggtcctggacccggataacgggccgcagttagacatccatataggcaagggtggtatttcaaggatgactccacaatggctggcgccactgcttcaaagtctaccacctatcctacacatgccgacacgaatgccagtgtaaagaccgaagcttgcggccgctcg

SEQ ID NO: 14924 - DNA, 919 bp, Xenorhabdus bovienii
  Genomic contig Name=Xb4151_4152.C383
ggggggggaggttgtttggggggacattatgggatagggcccgttccccctggatgaggattgcctttctaaacaggtaggcctaccctgattgcaaaagatgatcagctagttagcctgcctaatcacagaccccaacataagagggttcatccaggaaggtaaaccataaaccctgcagtactgccagcctgactgattatatgctctcatgggatgagattgagccgcactgcccaagccactgtctgatggcgctggggaagagctgacggccacttcgaggctgccggtcacctcccagtctgctatatgactgtgatcgttctcggggagcgagatagccctgcatccgcctgtcctatatctatctgatcgctttggtggatatgaggcaggcagctaatagatgcccacgcagacggcatggcattagtcggcggccagatccagaatgggtaaagtacagctgcgagacaccctatatccactggagcggctctctctataacggactgagggtatggagacacagcaaaagatagtggctaagtagtgggaggctagacttatatcacgaggcaataatggccatgcgcacatctgacggcccgagtgatcctactagcacctatcttggagataccaagcatgcttctgttattactgctggtcactttgggctatggcccaagtgttctcagagcccctggattgcccagagggatgtagcaattgtctttgtgatagtgaatattagcttactaaagagcggaatgattaactcagttctatatgaggagttctgggttctctaagctagggccatgtttatgttgctccagaagctcccaccggtatgggagtagatctaaggcctaggccgcagctgtgtttaagtttttgcgtagacatttag

SEQ ID NO: 14925 - DNA, 650 bp, Xenorhabdus bovienii
  unsure (1)..(650): unsure at all n locations
  Genomic contig Name=Xb4151_4152.C384
ttttttttcttccccccccccccccgcgcgccccccgcgggggggaggaaaaaaaaaaaaaaaaaaaaaaaagatttgttttttttttttttaaaaaaaaaaaaactattttttttttttttttttttttttagaggggggggggaaaaaattaaccctttttttatatttgggggggggggggggtgttttttttttatttaaaaaaaagggggggggggggggggggggggggggggggggaagatctcccccccccccccccccccttttttttttgttgtgggggagaaaaaaaaaaaaaaattttttttttttttttggggggcgggggggggggggggcccccccaaanctttttttaaaaaaaaaaaaggtgtgtctctaaaatttttttccagaaaaaataaaacccttggttttattaacccccccccaggtttttttttgaaaaatttaaaaactttttcgtaaaagggggttcctttttcccagggaaattcttgtggttaaaccggattggggcttaaaacccgtggttgatttaaaccgtcagccctgggacatgtggagcgggaacgtttggtcttccgtgacaatcttcgtaatactagggatctctagagtcgactgcagggcatgcagcttgc

SEQ ID NO: 14926 - DNA, 666 bp, Xenorhabdus bovienii
  unsure (1)..(666): unsure at all n locations
  Genomic contig Name=Xb4151_4152.C385
tcgagcggccgcaagcttcggtcttctggatgaggcggcccgggaagaagcgcttccggganaatccatattagacagattgccgaactcgaactcaatataacggctatcgagaacagcatcacggacctgaaagccggctagagcatttcctgcatcaccggaaatgctctatcgacgattatagcgggaccacccgataccctttgcacgcagcaattcgattaccccatccgcgcccggcagatgcagcgcgccaacggcaataaaggcatttcccttgtcgatgatcgggacggcgcgatcaagccatgacgtgattgcgggtccgaaattgaagatattttagaaacaaatcattggtcctcgtcggaaaggttggtcgggaacatctttccgaagcgccgggcagtgagcgtcccgacctcgccctgaggtaaagtgctgtcattgtctccagggcgtcctcggtcccggtcaccagtagtcgaggggtagccacaaggctgcggacgttgaaatcgaagcggccatccgggctcgtcgccaggaagacctcggccaagcttccgctaagccgatgtccaggcacacttggcgggccggttacttagttgcattccggaagtctcgggtaacccaaagctcttggcggttatatacatt

SEQ ID NO: 14927 - DNA, 896 bp, Xenorhabdus bovienii
  Genomic contig Name=Xb4151_4152.C386
ttagtgttgacattatgctaaggcgatcttctgccgtaaacggaagaagtggttcatattgaagttcgtagtccatcagaagtttatacagcaaaaaatggggcgcatcgccttatgaacagcaactttgacatcatattaataagtgcatatatcagtagatcacctaatagctacaaatataaaacaaaaacgggtcgtcgctcaaaacgcgcaaatttagctagccaacggctatactgcgatgctgaggtactcactagctgaaaaactaagccacagccagatatacacctcagacattgtgaaccgcggcttcatgctgatcacgtcacgagccctgaaggtaccctcttaacactggcaacttcactgatggcaccaactctgatcgtgcctgctagcgccggcatcagcagcctctaagctattctcaagttgagtcgaatctagagcacgcacaatagagaagcgcgctgatgagcactattagctttatcgtgtactcagacctggtaagatctgtgcaattgacctgacagagccctaaataaattcgcataacttccgcgctggatagcaacggaatcatacacaccaccaacactacatagtacatgacccctgaactcttcacgctgggcttgtataaaattgaatgacgacgagaatacccataggggtatgcaggcacttagggctactactgtcggttaccggaatacggggtaaaggcaggttctattgaagaacggtcccgttcccaaagaaggggcgaaacccatgttggtccgggccggccccctaatggggaaacaggcagaagcgccattggtccccttattgggactgaaacaaaacgatttttccactccccgcgagacacccaaacagga

SEQ ID NO: 14928 - DNA, 1663 bp, Xenorhabdus bovienii
  Genomic contig Name=Xb4151_4152.C387
tttaatcgttaccggtttttcttatagtccaatggcttatatggatcgagttcctgagtcgttttccatgtaatagttgccaagacgatgataatcagaataggcacagtccagacgacaagctcaattttatttgagtgtgcccagtttggacggtaagtagcagatttattggcttcccggtaacgtagagcaaaaatgattgccattacgatagccggaataacaacgatcagcatcaggccaaacgcctgtcagtatcagcgttttttgctcaacgccgatcgcccctttgggattcatcaataccatatcacaaccgcttagcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgtgtctatattatttttggaccatttgatcatatacaagatgtgtatccaccttacttatattttaccaaaatcattaggggattacagaccgagctgaattcgaataa

SEQ ID NO: 14929 - DNA, 1606 bp, Xenorhabdus bovienii
  Genomic contig Name=Xb4151_4152.C388
gtaagcaatatgcagcgcagtagtaagtgaatgaatccccagttacatagataacaatgtgactgggtgccaatgaagccgtaatttgaaagatgaagggaatcattctacttccgagatctgttcctgtctgcctccagatatccctccatccagccatttgtcagataagatttcgttgtgatctgacatggtgtataggctccatattacgttccgtcatttccccatataaaaacgcaaccatgagtaagagaacacctcagaccactatgtaaaaactggagtgttcttatataaatgaagtgttcaatacaaaaacacactcgaaggtgtaattattcaaggatggaatatgaagaagaatgaatgtcacttgataaaaaatgaccctgtcataaaaaaataattatcatattgtttttattataaaaaatagaaaaccaccatccatgactgtcgaaaaaacatccacatcttgataataccctaaaatgcgagtaagccattatttttaagattctgaaagattatttagtggaaaaaatgataataaatgatatttataataagaattagaaaaatttccgataataatctattaaaatgcaaaaatatctttaactaacttaaataaatagaattttgttaaaaaacaaaacattttatatcaaactgtccagtttagatttataatctatatgatgaatgtttggtggagtttaatttcggatatgtcaatttaaaagaatattaattctgattaacttggttttacttggatgccaataagtaacgatttttagctatcaatactattgcaaagagattaaataggtgaataacaaaaaaaattcatggattataattgcttaagcggaatgagttgtaatatgtaacgaaatttgacttaggataagttatataggattatgtttacagtttgatatattttgtccagtttctagcctgaagaaaggtcttaatagaaccaatatatatacaataatacgcatttaaatatgtattaattttattttactaattttcagtatttaaaaactttatttactttacattcaatacgttaataaatttaaaattacataaatctcataagaaaaaagttaggaagcaggttagttatccctcgagtaaggagagtaaaaatgcggtttaacccggtggtagatgaggaagttgcaaaatgcagggtgacatcaaaacaaagaatacaacccgtgtcatagaagccccccttatcttggtaagggcactgtttttacaacacgttaataaaaaaggtcatgtcattaaaaaaaccaagtgaatgtcagaaaaacaaaacggcggatcaggtgtaacaataggcgcaactggtgaggaaaaagccaaaccattttgaagcgccaggaaaatgatccttgataacgccataacttactgatttaaattgaaaggataagatatggtagacgctaatacattagtcggaaaacgtatttgtaccaaaaggaagagctgggtattaccgcaacggcattggcaaaaacaattggcattagccagcagcagctttctctgtatgaaagaaggacgatcttga

SEQ ID NO: 14930 - DNA, 3152 bp, Xenorhabdus bovienii
  Genomic contig Name=Xb4151_4152.C389
aaaaattggaagttgcaaaagtaggtgtaagttcttcatttttaaagggtacgcccctacaggattcgaaccctgtgccctacggcttagagggcccgttgctctatccaaatggagctaaagggcgcatacgagatgagaacccgttaatgcgttgatgagcacgggattatacgtgcatactgggttgagtcaatgggctttttgttcatatgctcattttatgattatcaataaaactgacagatgattcatgttctgacaaaatagcgcctattcctatactcgatgatggaatcttaaatacatgtcagcaaaaattattgatgggaaaacgattgcgcagacaatcagaagcgaagttgcagaaaaagtcaggcaacgaatcgccgctggaagacgtgctccaggtcttgccgttgttttagtcggagaaaatccggcctcccaaatttatgtcgcgagcaaacgccgtgcctgtgaggaagtcggttttacttcccgctcttacgacttgccagacatcaccagcgaagccgaattactttccctaattgataacttgaacgaagatccggagatcgacggcattttagttcaacttcccctacctgccggcattgataatgtcaaagtactggaacgcattcatcctgataaagatgtggatggtttccacccttacaatattggccgcctgtgccagcgtgctccaaagctgcgcccctgcactcctcgcgggatcgtgacgctgcttgagcgctgcaatatcaatacctacgggctgcatgcggtcatcattggggcttccaatatcgttgggcgtccaatgagccttgaactgctgttggctggctgtactacgacggtgacgcatcgttttaccaaaaacttacgccagcatgttgaacaagctgatttactggtcgtagcggtcggtaaaccgaatttcattcccggcgaatggattaaacccggcgctattgtgattgatgtcggcatcaatcgtctggaaaatggtaaagtcattggcgatgtggatttcgatagtgcatccgaacgcgccagttggatttctcctgttccgggcggagttggcccgatgaccgtcgcgacattgattcaaaataccttgcaggcttgcgaggaatatcatgatgtagaaaaaaccaaaggatactgatggaaattttttgtttagatggacacccttatgtagagctgtgcgatctactgaaacttcaagggtggtgtgaaagtggtgcagcggcaaaagcgatgattgcagaaggtttggttaaagttgatgaccaagttgaaacccgcaagcgctgcaaaattatcgcgggtaaagcagtggcctttaacggcgaatcggtgcgcgttgaagcataattccatgatattgcatcaccgttaatgacctgccgaaaaactgtaccttaaatattttatacatccaaggtacagtttttatttataaaaaatattaggggctgttgactccgatttcctaatattcattattattcatggcaagatcaacgatttgttcttttatcccggtatgacaggcgcgataagaataatatacatccaagtcaatgaatttataagaaaaataagaataaaccaccaagaattttgcaatatatagctatttatttagtcaactttacaaaagttgaacgcatctatatcatgacccgattcaaaaacttgtggtttaacggcttaaaatgcgcatgagaaatggaggagactgtttttcatgtattaaatcacattcccatacggattagcgattttgggtgcattaaaaggacttacacatccgcaagcgggtcgcaggcatgataagaataacgcgtacagtagcgcatgaaagcgctcaaagtgagtatctattacgtcactatgatgccctacactctgcgttagttcagcatctaccgataaatttttctacattatttgctaaacctgccaaaagcagtgatggtgccattgaatggtacagtgatttacaaggccaacctgtcccttttgctcagttatctgcgatagaacgcgataagatccagacgcaaattgcccgtcaattggcggtattagctcgcctgcgtgaacagctcagtgaaaaagagggtgtggataacgaattactgacgttactgggaaaaatcagccagtttcctgctgaggaacacatttggagtgtggataaccaacccgttatcctttgggagccgatgaacgaatctgcatctcaaaatattgcaggaaatcccgattttgtcgcatctcagccagaacagaaacgaaagccgcgctggttatggtggttgctgttgttattgttcattttattattgctgtggctgctgcgaggctgcctgccacgcaatcacactcatattgcgataaaacaacctaatccccctgtggcagtaaaacctccgcaggtaaaaccagtagaacagccaataaagcaaccaatagaacaacccgcgccaacagtgccggaggtaaaacctgaagccgtggtgctctccccgcctgcggatgtcagaaaactatgtccgtcccagcgaaagcggaatcaggctccagaggttgtggtggttaatgagatggtccccaccaccctgtgagcggtatgctggcagggtgtttctttcaggagaagaccatcatgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccga

SEQ ID NO: 14931 - DNA, 6898 bp, Xenorhabdus bovienii
  unsure (1)..(6898): unsure at all n locations
  Genomic contig Name=Xb4151_4152.C390
acgcagggaaaaaattgacaacaacggcctgcgaaaaggtatttttccccttgtcataaggccagtagccaccctatttttggaaaaaatttaaggcgctcctttctgtgggttggtgtaccataatattattttccaatgcattgaattgtaaaatgttatattataacatctcaatgattctgcaagactcttttagcatgtccattatgatcaccctaaaaaacattacggtcgaatttggtagccgcaaggtattaaacaatatcactttcagtcttagacaaggcaagatcctaacgttaatcggcccaaatggtgcgggcaaatcaacactggttcgcgttgttctgggcttgattcaaccaacttctggaactatcgaacacagtcatccactgaaaatcggttacgtcccacaaaaaatcagccttgatcctaccctgcccttaacggttaaacgtttcatgatgctaaggccaaatgttaaatcagcagacatcatgcccgtattaaagcgtgtcaatgctgaacatttattacagcaacccatgcagaaattgtcaggaggagaaacccaacgggttttactcgccagagccttgctcaatcatcctcagcttctggtgcttgatgaaccaacacaaggtgtcgatgtgaatggccaactggcgctttacgatttgatcaatcaaatcagaacagaacttaattgcgccgtgtttatggtatcccatgatttgcacttggtgatggcgaaaacagatgaggttttatgccttaatcaacacatttgctgttctggcacacctgaagtggtgtctatgcatccagaattcatcgcaatgtttggccgccatggtgcagagcaactggcggtctaccgccatcaccacaatcatcaacatgatctgagaggaaaaattattttgaaaaacggtggggagccacgtcgatgattgagttattacttccaggctggctggctggcatnttattgaccatcgccgcagggccgctcggctcttttgttgtttggcggagaatgtcttattttggtgatactctggcacacgcttcattgctcggcgtggcattcggttttttactagacgttaatccgttttatgccgttattgctgttacgttgatattggcaatgattttagtctggctggaaaaacgcccacaattagcggtcgatactctgctgggtattatggcgcacagtgcgctatctctgggattggtagtcgtcagctttatgaccaatatccgagtcgatatgatggcatatttatttggtgatctgctgtctgtcacttatgaagatctctggctgattgcagcgggtgttgccattgttgctgggttgctgacatggcaatggcgtgctttgctgtcgatgacggtcagtcaggatttagcatttgttgatggcatcaaaatccagcgcttacgtgtgcttttaatgctggttacagctttgaccattggattggcgatgaaatttgtcggggcattgatcatcacttctctattaattatcccggcggccactgcccgtcgattttcccgtacaccagagcacatggcagtttttgctattgctgttggtatgcttgctgtcacgggaggattaactttatcggcattttataatacccccgccggaccttctgttgtgctctgctcggcagcattgtttgcattaagtttgacgtgtaaggcgaaaaactgataatccagattagcaatataaaaattgaaaatatgataatgattttttataccatataaatacaaggggttatgatctcaatgattgtcagatacccctttaaaatccgttacgcgcaggactcatcgttccgaagtactggatctgatttgtcggcgaaatggcgatgaatttcgccttatccgtcgatgatttgctgaagaaaaacgcttctgcctttggctgactaacttgtctgtagaggaatttacgggcaatgacatcatagatttatcgttgccgctggcaggtagagcgactgttcaaagagttaacatcacacacaaactggcaaggatttgcgactaggaaaaagacattaaccacaggactgtttactggctatgaccaataatagaaactcttctccaaagggcatggtcggaaacctgtttttgagtactatcaatgggttaaaggggaggattgtccccttgatgaaaaggctattgtgggcagataaaatagttgctagatccagcagctgacaagaattatcccggctcagcgcccctttttcttacgcccagactgggtaaagcgcttacgggaagccgagttgccgtctgatttttcggcgtttttcggctcgttaaagcccgtttttttagctgtaacgtgcttagtctgcgcttttttcgccgatttttcttcggacgatgagttttcaatcagcttaaataactcgatcagttcgtcgtcggtcaaatctcgccactcgccctgtggcagtcctttcaagttgacgttcatgatgcgcgtacgctcaagcctagtaacttcatagccaaagtgtttacacatgcggcgaatctggcggttaagcccctgcaccagcgtgatacgaaacacaaaagaagcttctttctgcactttacattttttggtcaccgttcccagcatcggcacacctgcgctcatgccctgaataaactcatcggtcaccggtttgttaactgttaccacgtactctttttcgtgattatttccggcacgaagaatcttattgaccagatcgccgtgattagtcagaaaaatcagtccctgggaatccttatccagacgcccgatcggaaagacacgcttgctgtggttaacgaaatcactgatgttatcccgctcactatcttccatcgtagtgatgatgccaacgggcttattcagcgcaataagcactaggtcttcttcatcacgcggctcgataagctgaccgttaactttcactatatctccggcaaatacctgatcgccaacagcagctcgcttaccgttaataaaaacattcccctgttcgatgtaacgatcggcatcgcgacgagaacagatgccgctctcgctaatgtatttgttaagacgaatagatgggttgatcagcatgatttctccgtaaaaagcagactataccttacccgagttacgttgcgaagcttgatcggggtgaattgtgcggggcggctctatcgtattaacagagaaagtctgtgtaaaagtgaggttgatgaataattacaccggaagttgataaaaacgtcatttttaccggctggctatacctcacttttgacaatttctctgatacagaaaggatgatatttgatcgtgatttcaccatcagtaacagccaaagtcgggtttggcaaccgttcattttttcctttcggatgactttccttcatccgaaaattatctggtaaaggttgaggtaataactttttagcttcacaaataagttgctctggtggtacagacagcaccagttcgacatgttcccaaccttggtggacatagtgtttttggctgggataaggcaattccacgcaatcaattttccagtcaagtagtactattggctggttcagatcaaataagcagatcggacggccattaatgatactttcagatattaactgaccacattgcagaaagcccttacgccaacgatcagctattttactttcattacaacgcagggaaatatggtctgctgaatattgttcgaagtgtaagccaagatgcccttcaaattgcttaagtttttgctcaaatccggctaaatcagccactaaatcctgtaactcagaaatttttgaaaaatgagacatttcttccccattaaataaaccgtaaaaattgcgttccattaatgtgatataaatcacaaattgtctatttttgccgaaatatcactcagtaagcgactcattgaagttggcataacgacgaatcacctgaaagacagactaaaaacaaaaagtaacaccaccagaggtggctgatggtagcatgcaggaccccgaatatggtataaaccccattattttctcataacccacacgcttaaaagtattgcatttccaaaatgcgtaagctttcgtgcgtaacttaaggtaacacagtgaatatacaggttattctttcagaaaaaatcagcaatgcgctgattgaagctggcgctccaaccgacagtgaagctcacgtccgtcaatctgcaaaagcacaatttggtgactatcaagcgaatggtgtgatggcagctgctaaaaaggtgggaatgcctcctcgacaattggcagaaaaagtcatcagccaactggatctgcaaggaattgccagcaaaattgaaattgcaggcccgggttttatcaatatttttcttgataaagcgtggattgcagcaaatatagaaactgccctgaaagatgaaaagctcggtatcacccctgtggaaccgcaaaccatcgttatcgattattctgctcccaatgtcgccaaacagatgcatgttgggcacctgcgttcaaccatcattggtgatgctgcggcacgtacccttgaatttcttgggcataaagtcattcgagccaaccacgttggtgattggggaacccagttcgggatgctaatcgcctatctggaaaagatccagaacgaagatgccaatgacatggcattagcagatttagaagctttctatcgcgaagcaaagaaacattacgatgaagatgaagagtttgctatccgcgctcgtaactacgtcgtcaaactgcaaggcggtgatgaatattgccgtgaaatgtggcgtaagctggtagatatcaccatgtcccagaatcagcaaacttataaccgcctgaatgtcacattgacagaaaaagacgttatgggtgaaagcctgtataacgatatgctaccgggtatcgttgcagatctgaaacaacgtgggatcgccgttaagagtgatggtgcgacagtggtttaccttgatgaattcaagaataaagaaggcgaacccatgggcgttatcatccagaaaaaagatggtggctatctttacaccacgacggatatagcctgtgccaaataccgtcatgaaaccctgaatgccagccgtgtgctttactacaccgactcacgtcagcaccagcacctgatgcaagcttgggcaattatacggaaaacgggttatattccagcatctatgttactcgaacaccacatgttcggcatgatgctgggcaaagatggtaaaccattcaaaacccgtgccggtggtacagtaagactgtccgacttgctggatgaagcgattgagcgtgcagataccctcattcgtgagaaaaacccagatatgccagaagatgaactgaaaaaaatcgtggaagcggtagggattggcgcggtgaaatatgcagatctttccaagagccgtactacagactatgttttcgactgggataatatgctggcctttgaaggcaacacggcaccttatatgcaatatgcctatacacgtgtgtcatctatctttaaacgtgcagatatcgatgaaaacaacctgacactgccggtgatgctgaatgaagaacgcgagcaggcattggcaacccgcctgttgcagtttgaagaaacgatcactactgtcgcccgtgaaggtacgccacatgttatgtgtgcatacctgtacgatctcgccggtctgttttctggtttctatgagcactgccctatcctgaatgccgatagcgaagagctgcgccagagccgcctgaagttagctctgctgacagcgaaaactttgaagcaaggtctggatactctgggtatccagactgtagaacggatgtaataaccctccacaaagctgaaaactggcgtgatattattttattacgctggttttttccttttttcacctctgttagcgttttatcatctaccatataaataatatttaactggaattacagtttatatttaattatggagatatataaaaacagaggcgattattatagagaaatacttggctattatattattccaacttattatagctgtattaattttaaaatagaatatcattgagtttaattattaataaccaattttacggttgtaagttattataaacaataacaagagattcgcaaaaaacttattaatttattttttataatatataatttattattttaattaaaatttacaatataaaactattaagataataatttaaaaacatattaaacaataaattacaaacaataagaaaaataaaaatctatggtccccaccttttttgcaacactgatttttgattgatgttggcttgcttaaatctatccggcgtcactatgggcagggatgcccgcgcctcgatgagttccgcacctgataagcctaaaaaaccgcacggcttcagagagccattttttatgtcaggattccatcaggtcgataagccgttcatgtcatcaataatcagtcttcgcaaaaccagattgggaactgctttaattaacgattaacctgcccagtcagactggcgtcgtcgttacctttcgaacacagtttgccgtgttgtgattgcccaggctatccgggctaatttgttggccagcgcacaggccacaacatttgagtgttttcgctcaagctgagcctttacccattcagccagccttcctgactgataatcgattctctggataaagactctggcgcactggacaagtaaccgtcgcagatttttgtctccgcgtttacttatccctaaaagcgtatttttgccacccgtgctgtactggcgtggtaccagacggttgaagcagcaaatcc

SEQ ID NO: 14932 - DNA, 4482 bp, Xenorhabdus bovienii
  Genomic contig Name=Xb4151_4152.C391
aagggagcagactgtaaatctgccgtcacagacttcgaaggttcgaatccttcccccaccaccattaaccagttttttttcttgagtgttctgctctagttactacttccagagaagatacttgagatacaataaacagctgattaaagtcaggtagccgagttcacgcgggcatcgtataatggctattacctcagccttccaagctgatgatgcgggttcgattcccgctgcccgctccaagatgtgctgatatagctcagttggtagagcacacccttggtaagggtgaggtcggcagttcgaatctgcctatcagcaccacttcccccgttcttgcctcctgatttttcttcctgtaaatatctaacaagcgactgcttggttgatgtggtgaaaccaccgattccgtgttttagaggaacaatctaatgtctaaagaaaagtttgaacgtaaaaaaccgcacgttaacgttggtactatcggccacgttgaccacggtaaaactaccctgactgcagcaatcactactgttctggcgaaaacttacggcggtagcgctcgtgcattcgatcagatcgataatgcaccagaagaaaaagcgcgtggtatcaccatttctacttctcacgtagaatacgataccccaactcgccactatgcgcacgttgactgcccaggccacgccgactatgttaaaaacatgatcacgggtgctgctcagatggatggcgcagttctggttgttgctgcaactgatggcccaatgccacagactcgtgagcacatcctgctgggtcgtcaggtaggcgttccatacatcatcgtgttcctgaacaaatgtgacatggttgatgatgaagagctgctggaactggttgaaatggaagtccgtgagctgctgtctcagtacgatttcccaggcgatgatacgccaatcatccgtggttctgctctgaaagcgctggaaggtgaagcagagtgggaagcgaaaatcatcgaactggcagatgcactggattcctacatcccagagccagagcgtgacattgacaagccattcctgctgccaatcgaagacgtattctccatctctggccgtggtactgtagttactggtcgtgttgagcgtggtatcgttaaagtgggtgacgaagtttcaatcgttggtatcacagatacggtgaaaacaacttgtactggcgttgaaatgttccgcaaattgctggacgaaggccgtgctggtgagaacgtaggtgttctgctgcgtggtactaagcgtgacgaaatccaacgtggtcaggtactggctaaaccaggttcaatccagccgcacactcaattcgaatcagaagtttatattctgagcaaagatgaaggtggccgtcatactccattcttcaaaggttaccgtcctcagttctacttccgtacaactgatgtaaccggaactatcgaactgccagaaggcgttgagatggtaatgccaggtgacaacatcaacatgatcgttaccctgattgctccaatcgcaatggacgaaggtctgcgtttcgcaatccgtgaaggtggccgtactgtaggtgctggtgttgttgctaaagtgattgcttagcttttgattattaaaaaattatgaaaaaagagaagctatagcttctctttcaaattttgaaccaccggaaacggtggttaatgagatggtccccaccaccctgtgagcggtatgctggcagggtgtttctttcaggagaagaccatcatgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtgataaaaagactttcaaccgtcttggcagagaacgaacttcctccctatctggcacagttgctgatgcgcttacatgcccattatctttatcttgtcgaacagctcaccgagcttgagacggcactggagcaggagctgagacgtgatgaaacaggacagcgtcttcagacaataccgggcgtgggtccgataactgccagcgtcttatcatcgcagctgggcgatggtaagcagtatggctgtagccgggattttgctgcttcaaccggtctggtaccacgccagtacagcacgggtggcaaaaatacgcttttagggataagtaaacgcggagacaaaaatctgcgacggttacttgtccagtgcgccagagtctttatccagagaatcgattatcagtcaggaaggctggctgaatgggtaaaggctcagcttgagcgaaaacactcaaatgttgtggcctgtgcgctggccaacaaattagcccggatagcctgggcaatcacaacacggcaaactgtgttcgaaaggtaacgacgacgccagtctgactggcaggttaatcgttaattaaagcagttcccaatctggttttgcgaagactgattattgatgacatgaacggcttatcgacctgatggaatcctgacataaaaaatggctctctgaagccgtgcggttttttaggcttatcaggtgcggaactcatcgaggcgcgggcatccctgcccatagtgacgccggatagatttaagcaagccaacatcaatcaaaaatcagtgttgcaaaaaaggtggggaccatagatttttaggcttatcaggtgcggaactcatcgaggcgcgggcatccctgcccatagtgacgccggatagatttaagcaagccaacatcaatcaaaaatcagtgttgcaaaaaaggtggggaccatagatttttaaaggagcatcaggcgcggaactcattgaggcgcgggcatccttgcccatattgacgccggatagatttaagcaagcccatcataaatcaaaatcagtgttgcaaaaaagagggtgaccatagatttttcttgtgaatcggcggcgcgttggcgatgatgataaaagcgggttgttgaaaccccgattttttggcaaaactgcgggacagtcagtggggattttttctgctgttcaaagatgtccagtcactcagcttgagtaaatttggattggcgcatgagtttttttccatcatcagaataggtgaaactattttaatcagtgaatttatcttggctagatggggttccccgtacgcttacagatgttcacacttaatatccaccaacaaattttttcgggttcttaaatttgatcgtatcgccggagtaagaaaacagaaaaacccctgagataaatctcaggggttttcgaaataaggtggcggtgcggacgggactcgaacccgcgacccccggcgtgacaggccggtattctaaccaactgaactaccgcaccaccgaatttcttttatccatttgactggaacttcagtagacttctgcttatgagtcatactggctaaatagatgtctggcagtgccctactctcacatggggagaccccacactaccatcggcgctacggcgtttcactgctgagttcggcatgggatcaggtgggaccaccgcgctatggccgccagacaaattctgtgttcaatcccgaacaagctgctgtttttcatttgaaactgcgtctctctctctcaccaaaacaccttcggtgttgtcaggttaagcctcacggttcattagtactggttagctcaacgtatcgctacgcttacacacccagcctatccacgtcctcgtcttgaacgttccttcagtatcctcaagggacaagggaagactcatctcaaggcaagtttcccgcttagatgctttcagcggttatctcttccgcacttagctaccgggcagtgccattggcatgacaacccgaacaccagtggtgcgtccactccggtcctctcgtactaggagcagcccctttcaatcttccaacgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtacctttta

SEQ ID NO: 14933 - DNA, 3644 bp, Xenorhabdus bovienii
  unsure (1)..(3644): unsure at all n locations
  Genomic contig Name=Xb4151_4152.C392
tgatacgattcgagctcggtaccctgtgtctctccgccagagccttcattgccatatccacaattttttctttctacccggtttatgaccgttgtaacgatagttgagttgaaaggttctttggcagcctttgggggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccagcctttgcaatagtagcgagggaagccagccttacctgttccgtgtttgcgtacaggttctgcttggtcgcaatatcgacaagtcacttctatcgtaacagtcatgatgatatcccattaaaaagttcaggaatatcaaattaacgctttgaagtcatgaccctatttttgagtgctaataatgtaatattaaaaaactcatcattttaccgtgatgagtttttattaatgatatttatggagaataatacatattttgaactatttactatgtatgttcatttttgcaaaagattcacatcctacctgatatccgttatcgcaggattttttaaaccattcttttgcttttccatcgtctttttgtactccctcacctacataatacataatacccaaaatagcctgagaacctgcgctatcttgtgccgccgctttttcaagccattctttcgcttttatatagtcttgaggtattccttcagcataataatacataacgcccaatgaaacttgagaattcatatctccctgtaaagcggctttttcataccaatcttttgctttgatatagtcctgcttgactcctttcccttcagaatacattgtacctaattcatactgagctcctatatgcccactattggccaatgcatgtattatttcaatatgagttttttcatccacctgtgttgttttaacattaaaatgttcactcccgttactctctgaataacaagcagtagtgatgcttaacaaaaatacagcaaataatgtttgggatttttttttcataatcattcttattattaaaaatgcaaatcgtggttcagttaggtcatgatactcaaaaaggcgattttttggtaggcattaatgtattgagtttcaagtaataaaaagtaatttagaaaaattatgggattgtacgggattaattaacgtattgataattaatgataaaacttggattcgcataataagtgcaatttctaagaaaggcggtcagttgctatagtaggcatctttcttgccaaaggaaaatgcgctatggcctataaacaactgaccgaaacagaaagatatcagattttcagcctgaaagaagccggtttttcacaacgggagatttcaaagtcactcaatcgaaacccatcaacgattagccgggaattgagacgaaatcgggaggcaaagaaatatacgcctgaacaagctcagcttaaggccgtagcgcgccgacagtgtgctacaaaagcagtaaaagtgaaaccagagatagaaatgtggatcaaacagttaatttggcaagatttaagtcctgaacaaacagtcggttatctcaaaagggaaaatataatatctttgcatcatgaaacagtttatcgattgatttataaggataaacttaatgatggtaatttatggcaacatcttaggattgcgaaaaaaccgtatcgtaaacgctatggaagttatgagcgcagaggaaaaattaaaaacagagtcagtattgataagcgccccaaacttgttgataaaaagcagcgtattggtgattgggaaggagatactatcgtgggtaaaaatcataaaagtgcattattgacattagttgaacgaaaatcgttatttactattataattaaacttgaaaataaaacagcagaaggggtcgcaaaagcggcaacaagacatttatcactgataaaacataaaattaaaacaatgacctttgataacggcctcgaatttgccgaacacgaactgatcagtaaaaatttagagacaaaaatttattttgctcacccgtattccccctgggaaagagggataaatgagaacacgaatggattaatcagagattacttcccaaaaggaactgattttaataaggtgtcagagcgggagattaaccttgtggcaaaccgattaaataatcgtcctcgtaaaacacgagattacaaaacaccgaatgagttatttaaaggaataccctctcatttacttcgtccattacggtgttgcgcttaatatgtgaatccaagaaacatatcaattccgtaactcggcgaaaacccatgtatttatatagagagtaaaaaataaaggtgatttaacatgaaaattttcgtaatttcgcttgtgtttattaagaaataaaaaagtaacaccacaaaaaatttctatctcatgagtttctcggtgaaattatcgcgacaaataataaataacttgcttagattcacatagtaagcgcaacaccgtaatggacgaagtaaatgagagggtattcctttaaataactcattcggtgttttgtaatctcgtgttttacgaggacgattatttaatcggtttgccacaaggttaatctcccgctctgacaccttattaannnnnnnnnnnnnnnnnnnnnnnnnnnnnnnnnnnnnnnnnnnnnnnnnnnnnnnnnnnnnttnngacagngataccccggagtttcccgggggaaccgcctccgggtgcatccgcctcttcccggcgggcggtacagaataatggccggcgctgaccgcccctgacaacggggcgcccccgcaagccgcggtcgccgggtgcggctcctcccccagtaccacatggagcgaatgcccccccgcgcaggggcaccccagcgcccgacgggccggttttccgacaaatccgcgagtcccggcactcccgcgttctggtgatcgtgtttt

SEQ ID NO: 14934 - DNA, 2719 bp, Xenorhabdus bovienii
  Genomic contig Name=Xb4151_4152.C393
tctttaacaatttaatcagacaatctgtgtgggcactcacaagacagtatcgacagcatcgcaagatgccgaaaactttaaagtcttaaagagtgactaaaacagttaattcattacgaactaacagtaacaattctttgagcatcagacttttaattgaagagtttgatcatggctcagattgaacgctggcggcaggcctaacacatgcaagtcgagcggcagcggggggaagcttgcttccctgccggcgagcggcggacgggtgagtaatgtctggggatctgcccgatggagggggataaccactggaaacggtggctaataccgcataacctctttggagcaaagtgggggaccttcgggcctcacgccatcggatgaacccagatgggattagctagtaggtggggtaatggctcacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcaacagcgtaaacagcgttgttgattgacgttacccgcagaagaagcaccggctaactccgtgccagcagccgcggtaatacggagggtgcaagcgttaatcggaattactgggcgtaaagcgcacgcaggcggtcaattaagttagatgtgaaatccccgggctcaacctgggaacggcatctaaaactggttgactagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatcctcagaatctgccagagatggcggagtgccttcgggacctgagagacaggtgctgcatggctgtcgtcagctcgtgttgtgaaatgttgggttaagtcccgcaacgagcgcaacccttatcctttgttgccagcacgtgatggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctccttacctgaatgatagtgattgtgcagtgtccacacagattgtctgatgaaagaaaatgagcaggaatgcccgcgaagaagacttgagtccccttcgtctagaggcctaggacaccgccctttcacggcggtaacaggggttcgaatcccctaggggacgccatcctgttcaggcactgtgtgaaaggcagggtcaccgaattattggtaaacggactgcaaagtcggtttaccaataacgctctttaataatctggaacaagctgaaaatttgaaacaatcagtgccgtcatggacgggactggtgagtctctcaaaacgcacacccgaagacaccttcgggttgtgaggttaagcgactaagcgtacacggtggatgcctaggcagtcagaggcgatgaagggcgtgctaatctgcgataagcgccggtaaggtgatatgaaccgcaataaccggcgatacccgaatggggaaacccagtgcaatccgttgcactatcctggcctgaattcatagggtccggaggcgaaccgggggaactgaaacatctcagtaccccgaggaaaagaaatcaaccgagattcccccagtagcggcgagcgaacggggaacagcccagaaccaacatcagcatcagcgtcaggagaacggtctggaaaggccggcagtaaagggtgatagccccgtatctgaagacactggtggtgtgagttcgacgagtagggcgggacacgtggtatcctgtctgaacatggggggaccatcctccaaggctaaatactcctgactgaccgatagtgaaccagtaccgtgagggaaaggcgaaaagaaccccggcgaggggagtgaaatagaacctgaaaccgtgtacgtacaagcagtgggagccttgatttatcagggtgactgcgtaccttttgtataatgggtcagcgacttatattctgtagcaaggttaaccgtttaggggagccgcagggaaaccgagtcttaactgggcgttaagttgcagggtatagacccgaa

SEQ ID NO: 14935 - DNA, 7108 bp, Xenorhabdus bovienii
  Genomic contig Name=Xb4151_4152.C394
taatcatgaatattcgtcaactggcattaaccccgaaactgggctttcgcaccaaaacggtaaccgtgactgagtgggataacgccaccgtcaccctgcgtgaaccgtcagctggggcatggatccgctggaatgaagtgacctcgccaacagacaaagaaggaacactctccacggcagaaaaggtgctgcgcaatacccgtgccgatgtcgtgctgtttatcgatgtgctgtgcgatgaacacggtgaaccggtctttactccggacgatatggaggccgtgatggatatctacgcccccgtgcattcccgcctgttacatcaggcactcagtctggtgaccaccggtgatgaagccgaaaaaaagtccgatctccattaaccggctttatgctgacgctggccctgcgcctcggtaaaaccctgtccgaattgcagggcgggttaagtgccagcgaactgatgctgtggctggcctacgaccgcgaaaaccccctcagcgaccgtcggggtgacattcaggccgcgcaaattgcctccgcggtttatcagtcacagggtgtcaaagtcgggctgagcgaggcgctgctgcaatggggcaatcccgatgaggaaagcggcgacgacttcgaaaacttctttgctaatctcacataggtgacactgtggcaaaactgcgtgaactgattatcaaaatctcggccaattccagctcgtatcaggcggaaatcgcccgggctgcccggctgggagaaaattaccaccgggtgatggaaaatggcaaccggggtgcggcggcggcggcgcgtggcagccgtgccgccctgcgtgacctgaacagccagctggtttcagtgaaagactctgccgtcgggatggcgggcgcgtttgccggcatcttcgccaccagtaaactgattgaaaccgccgacaaatggacaaacctcaattcccgcttgaaactggcgacggcgtccagtatcgatttagccaatagccagcggttattgatggagatgagtcaaaaaaccggaacatcattcgaggccaatgccacggtctttgcccgtgcggctgccccgatgcgggcactccaatatgcctcacaagacattgttaatatgacggaagcgctatcgacggggttgagaatatcaggcgcgaatgcttcagaatccagttcggtattggttcagttctcgcaagcgatgtcgtccggtgtcctgcggggtgaagaatttaacgcgatggcggagaacggcagtcgaatcattcaggcactggctgacggtatgggcgtcgccagaacccaattaaaaggcatggcgaacgacggcctgttgacgatggataaagtcattcccgctttactgagccaactggagaaactgaaagcagaaggcctttcaatgggggcgacggttgaaaaatccctgatgcgcgtacaaaacgccttcatggaatggatcggtggggcgaatgaagccacgggtactacccgcgttctcgccggggtactggatgacctgtctaaaaatattaacgacgtcgctgcggcgggcgcagtggcagtcggtctgttcggggcgcgggcgctgggtaacagggtatcagcgattggggcatcaacctctgcgctgatccagaattcccgcgccgaaattaataacgcggatcaagcttaccgtaactctcaggttcaggttgcctcagcgagagccagcgcttatcaggcacaacaaaacgttatcgccgcgcgttcacgcctgcttcagacgacaaacacacagaccttcgccgccgcagaagcgagactgaaccggacactggtcgcagaagcggcagcgcaggccagagtgacgcaaagcatcaatgcaagagccgccgcacaagcgcgactcaatgcggtcacctcgctcggttcaagaatgggcggtgcgctgctcggcgctgtcggtggactgccggggatactgattatggccgccggtgcagcctacctgctgtaccaaaaccaaaagcaggccaaagaagaagcccgggcgcacgcgaaagaggcgacaaaaatcaaggaagaactgagcaagatggatcctgttcaactcagggacaccaagaatcagttaaaagaagatcttgccgtggctaaagaggatgtggaaaagttcaggaaggagatgaataaaaaccaaatcagcctcaatcttttcatgaaggataaaagcaacggtaaaaatactgacatcaagatcaccgagttcagcactaaactttcagaaagccgttcggcgtatgaagctgccctgaaaacggtcggtgaaatcacgtctgccctcacgagtctgggtgaccaacagacaatcaatggggagaaagagaaaaggttcatcacagcgattaacgaaatgcgcaaaaccggcaatgtgacgctggcgctgcaaaatcaaaagctggaactcacggtcgagctactggaacggatcaaaaactcaagcattgatgtatcaggtattcacattcccgtaccggtagtgaaattcgagccaaacgacaaaataaagtcgttactgaaagaccaggaaagggaaattgatctttctaaaagaaagggattagataaagtcaggcgtgaggcgtattacaaagccgttgatggggggttgaatccggatgataggcaacaaaagccctatgtgaatcaggtcattaataacgcggctcaggtataccaaaatgccgaagccctacggaagcaggacgaagccgcccgaaaagctcaaagcgaggcagaaagtgccacacggaaagccgccaaaaccgcagaagattacacgaataaagtggccgaactgaatacgcaactggccaccgaagcgatccgctataaagagggcaatgctgccgccgagctattcgccaattctcaaaataacgtcagtaagtttactcaggaacagaacaaccacctgaaccagcttaacaagcgactggaggaaactaagcagcgttatcaggacttacaggctgctatcgaagcggatccattccgtaatgttgctaaaagaacccaagaagcgacagagcaactggagcggcagaagaacaatggtcaaattgagtcacccgccgaatacacctatcgaaaaggggatatctggaaagacgaggttagaggcaatgcggacgccagacagcagtatgccgtttccgccagagataacttacggggcgaagttgacccaatacaggatctggaaaaccaacttgaacgcaaaaaggcgctttatcagtcctatgctgacgcaactgttatcagtgaacagcgtaagaatgaactgattgcggccgccgaaacggaaaacaacacgaaacgcattgaagcggcgaaacagttatttgctgcccaaagtacctatcacgcaatcgcagtcaacctgtttgatactgtcagcgaacgcatgggcaacatgattacggggctgctaaccggaactaaatcgctcaaagaaggcatttctgaaatgttcgcttcaatggcacagagcgtcgttcagagtttaatgaaaattgctgcgaataaggcatttgaaatgctggcctcttcattcggtggcggtgcggggggggcgttcaacggcttcatgtctacgttcgtcaagaatgccaaaggcggtgtttataattctcccagtctgagtagctacagcggtcagatagtcaatagtccgacattgtttgcatttgcgaaaggggcgggactgatgggtgaagcggggccggaagccatcatgccgctgacccgtagtgccgatggctctctgggtgtacgtgctatttccccaaagggcttgggtgatcaagggggcaccaatatcaatgtctacatcacggacgggaaaactgaaagttcatcatcgaaaggcgataatgacgccttcgggcgtcgttttgctcaggccgtcgctcaggtctactacgctgaacgtgacagggatttgcggcagggtggtgcaatcaacaaagcgataagggcgaaataatggaaatattcacatggctgccgcgcgtgaatgccagttccaatgttgaatttgcgatccgaaaagcgaaattcggtgacggttatgaacaggtctctggtgcggggattaaccccaagtcgatgagatggacattggattttgtcggtaatgaaaaacacattactgagattatcgcctttcttgaccggcatgaagggcataagtcatttatctggacgcccccgctggcgagcaaggggctgtttcggtgcgagagctataagtatcaggccattgattacaaaacctatgccctgtcaactgaattcattgaggcgcacgcgccatagaggacaatcatgtttactgctgacgtacaaaagctggacgccggaaataccgtccggctctacgagattgacgggacaaaattcggtgccgatgtgcttcgttttcatgcgtatggtatgcctgtgacgcccgaagaaattgacaccgccgaggagacaggcagtcagccgcagccgaagtccctttggtggcaggggcaggaatataaaccgtggcctgttcagatagagggactggacatgtccacggatggacaggctgcccgccctcgcttatctgttgcgaatattgagggaacggtcaccgcgctatgtctgcaatttgatgacatggtacaagcgaaagtcgctatccatgatacatttgttcattatctggatgcgaaaaatttcccgcagggtaaccctaccgctgatccgcaacaagagcggcagctcatgttttacatcaacagaaaaacatctgaaaccgataagactgtggtttttgaattagccagcccggcgtcactggatggcctgattattcccacccggcaaattcacggcgtatgcacatggtgtgcccgtggctggtaccggacagggaaaggttgcgactacgccggaacaaactattttgatattgacaacaacccgaccgatgatccgagcaaagaccgatgccccggcaccgtcattgcgtgtaagttgcgttacggtgaagataatgagctatcatttggtgggtttccggcctcgtcccttatcaggagatagccatgaatgataagacattaacggccatatttgaacatactaaacaaatgtatcccaatgaatgttgtggggtaattgcccagaaaagccgcgtagaaaaatactttccctgcaaaaatttagcccctaatcccgccgaacaattccagctagatcccggtgattatttagccgcatcaatctggggaactattaccggtattgttcatagtcacccggacgcaactactatgcccagtgatttagatgaggcacaatgtgattttactgaattgccgtggcacattgtgagctacccagagggtgatttcaggacaatctatccgcgcggtgaattgccgctactcggtcgcccgtttgtgttgggtgtctatgattgctatggtctcattatgagctattaccgccaacaatgcggtattgaactgaatgactatcgggttaattatcattggtgggagcaaggtgaaaacctttacatagagaattttgagaatgccggttttgttgaagtcacaggcgacccgcagacgggcgatgtaatcattatgcaggttcaagcggatgtgcccaatcatgccggtgttttgttagagggtaatttattactccatcacctctacggacagttaagtcagaaagtgccgtatggggggtattggaaagacaggacaataaagatagtacgatatcatttattattataaattaagcgctataagataactcaattacctttacgctggatttgcgttgttttcaatgaaaatatgcagtgaattacttagaggaattatcatgaaaacaaaatttatttctttaatttttttgatgttgatgagtggatgcgtagggattacaagcaaggacataagaagcgtcagacatgaagtttttttttcagataaaagccctgatgattttaaatattgcttaattgataatttagatcatttaagaggcgatcgaatgctaatagaaccagttttaaattccaagtcggtggaaatattgattggagcgctacaattatcaaatatgagatattaccatagggtaatcatatcggataatggaggaaaaactagggtatcgatacagagcttagatgaccattatcgtccactaacaaaaaatgaactgagagaaatggctaaaaattgtttatagccaaggatgaattgaaaataacatagttttttaacccgcgtcggcgggtttttttatttatgaggtcattatggcttatatatgtccccctcttcggacaatacgcctacacggcgtccttgctaccaagttcggcgcgacatttgactatgccgtcagagatgccccccatgctatccgggctatgagtaggctggttgcaggttttgaggcattcatgatccatgctcaccagcagggttttactttttcggtcattgtgggtggcagaagttaccacaaagacgaactggacatgaccaagggtaatggtggtatccatatactgcctgtcatcaccggcagtaaacgcggtggattgtttcaaacgattttaggggtagcgctgattgcggttgcatggtggaatccattgggctgggctgcctcgaccgcattgtttgtcggggcgtcaggggcatcaatggcaatgggcggcgtttctcaaatgctggcacctcagccgccgaggttggggatgcgggaatcccccgacaataaacccagttatgctttcggtggtgcagtcaataccatcgcacaagggaaccctgtgcctcttctgtatggttcgcgcgagataggcggggcgattatctcagcgggtgtttacaccgaagaccagtatcagactgagcaaatagaaaaccaacgcaaacacagccgctaaatgcggttaatgagatggtccccaccaccctgtgagcggatgcctgccagggtgttctttcaggagaagacatcatgcaaacgttacgctttatgta

SEQ ID NO: 14936 - DNA, 4447 bp, Xenorhabdus bovienii
  Genomic contig Name=Xb4151_4152.C395
caagaaacagattcaccaaatcttctttaaaaaatcattcatactactggctcttttttaaaaaaagtaagaaataggctagaaaaacaaacaagaaaattgttcaatttttttacaattttgtatttcctatcaaaaaaatcactaaaatcataaaaaaatctacgcctgtagtagcgcaaccgatatgatgagatttattttttgtcggatacgggtgttcacaacaacctgtccaacctgcatagacaggcagatgttggcttatgaataagaaagaatcttttttgacgactccatatttacaatttgatcgtgagcattgggcaacattacgtgactcagtgcctttgacactcacagcagaagagattgctgctttaaaggggattaatgaagagatttcaatagaagaagtggttcagatctatcttccattgtcacgtctactcaatttttacattagttccaatttgcggcggcaagccgtccttgaacaatttttagggactggtgggcaaaaaataccttacatcattggcatagcaggtagtgttgctgttggaaagagcacaaccgcgcgtttattacaagcattgttaagccgctggcccgaacatcgccgcgttaaactagtaacgacagacggttttttgcactctaataatgtgttgaatgaacgtggcttaatgaaaaaaaagggtttccctgaatcctacgatatgcgcaacctagtgaaattcgttgctgatataaaatcaggcaccgaaaaagttacagcgccagtatactctcaccttagctacgatattgtccccaatgaacaactgatcatcgagcgtccagatattttgatccttgaaggactaaacgtgctgcaaagtggtatggattatccacatgaaccacatcatgtgtttgtgtctgattttgtcgatttttctatttatgtcgatgcgtcagaagaattgctcgaacagtggtatatcaaccgttttcttaagttccggcaaggggctttttctgatccagactcttatttccacaattattctaagttaactaccgaagcagcgataaaagttgcatcaaatatttggctcgaaattaatggcttaaacttacaacaaaatattttaccaactagagagcgcgctagcctaattatgactaaaggagcgaatcacgctattgaaagtgtcaggttgagaaaataaagcagtagccggaactatttccggctttgcattcaacaacctctgagggaaatttcaccaccaatatatggcgtaataacaccatttatatcaagcagcaacgctccttgctgatcaattccacgggccgttccataaatttcctgatttccaataaccagctttactgaacgattcataaaattatctaattttgaccaccggaaaagaaatggagataatccttcgttttcaaattgaattaacgcttttttaagctcaagaataatttcagaaattaatttattgcgttcaaccactattcccgcttgctgtagattagtccactgctggttaatcaatttttgctgttcactactcattgaaatattcatacctattccgataacaatctgagccgcatcacccgtttttcctatcaattcaactaatattcctgccagctttttatcatccaaatagagatcattcggccatttcacttttactctttcagcaccctggcggttaagcacttccgcaatgacgatcccaacgaccagacttaatcctattgctgcggcaggcccttgctccaagcgccaatacatggataaatataaatttctaccaaaagcagaaatccactgcctgccacggcgtccccttccggcatactgatattcggcgacacaagcgtcacctgaatcgagttctgacaatttctccagcaaatactgattagtagaatcgataacaggtataacttcgagacgatcatttggcaggtaacctgcaataagctctttatccagcagatccattgatgctgggaaacgataacccttacccgggatagttaaaatttctacgccccattcacgaatggtctgaatatgcttatttattcccgcacgactcattcctaattcttgaccaagttgctgcccggaatgaacttcgccatctgataacactttaattaattttaatggaatactaatatctttcatgaaatacattccactgcatctatctcaccctcactaccaatgaaacgtacttcaggctctaagaaaatattaaatttttctgctacttttttgcgtacataagtcgccaaagcagtaatatcctgacccgttgcattacctttattgattaacaccagtgcctgtttcatatgtatcgcagcgtcaccaatacaataacctttcaagtgacattgatctatcagccaacctgccgctatctttacattatgttcattatggtgatattggggacactctggataatcaaatttgatcttttgcgccaattcaataagtacaattggatttttaaaaaaactgccagcattcccgataataacaggatcgggtaacttactctgacgcatttcacaaacagcattgaatatgcgttctggtgttacgctttcacttgagaactgtgttaagccaccataagttaatattggcttccaaaccttactcaactgcaaaccaactgctgttatagcataaccatctttatattgatgtttaaagatactatctctataagcaaattggcattcatttgccataagatgaatcagtttgccagttttcaactctattagatcgacatattcacagacatgtttaaattcaattccatatgcaccaatattttgaattggtgctgaccctacacttcctggaatcaacgctaaattttctaagccatagatctgttgatggagaaggcgaacgatcagctgatgccagttttcaccagcgccaacatggatatgccatgctgtatccgattcttgtatatcaacaccaagaatacggttcaatatcacagtacctttaaaattttcggtaaaaagaacattactccccccaccaagtaataaaatgggatgctctttttcctccgcttcttgccatgcggacaacagtgatgcaactgaagttacagtagaaatatgatcagcacaggctgaaataccaaacgtgttgaactcttttaattggatagattgacaggcagacatttacttcaagctcgataagtaatttatctgtagtctatcagactctacatttgaaagataaatcagtaattactggatatgataataaaaaactaagaaacgcaaaaggccactcaaatgagtggccttttgactgggtattaaagcttggcagttccctactctcacatggggagaccccacactaccatcggcgctacggcgtttcactactgagttcggcatggggtcaggtgggaccgccgcgctattgctgccaagcaaattctgttttacttgccgaacatattatttatttatggtgctgatacccagattcgaactggggacctcacccttaccaagggtgtgctctaccaactgagccatatcagcatgagctattttcggtcactataaatgtgattccgaatgctgaaataaaaattgttgtcatatggacaacaattataaatagatgtctggcagtgccctactctcacatggggagaccccacactaccatcggcgctacggcgtttcactgctgagttcggcatgggatcaggtgggaccaccgcgctatggccgccagacaaattctgtgttcaatcccgaacaagctgctgtttttcatttgaaactgcgtctctctctcaccaaaacaccttcggtgttgtcaggttaagcctcacggttcattagtactggttagctcaacgtatcgctacgcttacacacccagcctatccacgtcctcgtcttgaacgttccttcagtatcctcaagggacaagggaagactcatctcaaggcaagtttcccgcttagatgctttcagcggttatctcttccgcacttagctaccgggcagtgccattggcatgacaacccgaacaccagtggtgcgtccactccggtcctctcgtactaggagcagcccctttcaatcttccaacgcccacggcagatagggaccgaactgtctcacgacgttctaaacccagctcgcgtaccactttaaacggcgaacagccgtacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcga

SEQ ID NO: 14937 - DNA, 9144 bp, Xenorhabdus bovienii
  Genomic contig Name=Xb4151_4152.C396
tcgagctcggtaccctgacgatgaaaaagagtaaaccggttttttgctgacatgcgcgacaaaaaggacagttattacgaagagaacaagcgggcgttatccgccattttttatttggcgaatattccgcgtgcacgccacgaaagtgagcttgaacattttaccccagaggaaaaacaggctctgatcaaagcaatgaatcatattaaagttgttgtcagtcagtttcctaagtacttgaagttatctaagtaatcacattttttgaacacgttttttgtacaaatggcatgagtacgtcaggcactcgcacatcctgaatatggtggaattgatgaatagtggttttatcactacggaacataacggtgattatcctattgccaaaggcaggcagtctggcctgtttcagccaagcataccgcagggtgtgtcaatggctgaacgtttattatgggatgtcaacgcggaagatcaccaatggcgccaccaatatatcgggcagatgccggattttctggcgaagtacttcagccgccgttatgttggcatctttaaccattcaggccgccgtgatgcgaacgcctttctgagaagaacagttggacaaaatgtcttgccacggttgcagttggttaaggcaagatattcattcactcatcatatatcgggactaacaccttttccttttattgagcaattggaaaaggtggtgacatgcgatcgcaaacagcttttgaagctcgctcatgaaatatctgtttttattgcgagcaactatgagcactattccttgcagtcttctcaacaatatcaagccgcgcctgtggacagtgaaagtaaattgttcccccgtgtcgctaagttataccaattactggcgaagctgactttacaatgtggcacaaatcctccttattggcagcgttttaatcatgggcgtaaagtaccatctgttgatcaactttgtgcaggtatgttgcggatgatgtctgcccgctggtggtattttcggttaaaacgtctacgtgatatccagtctgaacatatggcaattgcggttgggcaagtacaaaaagccgcatcgccttatgtttcgaaccatgctttgcgtgaatggttggaacagaaacgccgtaaccgtgagtttttcaaacattttgatttggaaaatgagaacggagaacggatttcgctggcggaaacggtggttcatagtaatgcgaatcccgcaatccgacgttgtgaattgatggtcagaatgcgtggtttcgaagatgtcgccgacaaaatgggatgtgttggtgaattttataccatcacggcgccggcaaaataccatgcggttcagcatcagggcgggtttgtcagacagtggaatggtgcgacgcctcgcgatactcaacgctacctgtgtggtatatgggcaaaatcccgtgccgcaatcgcccgtgccggcattaatttatttggtttccgagtggtggaaccgcaccatgacggcactcctcattggcatattctgctgtttatgttgccggagcatcagcggcgggtcagggcgatccttgagcattacgcttgccaggaagagaaagctgaattgcagagcgatgatgccaaaaaagcgcgttttgattacagaatcatagatcctgataaagggagtgcgacaggctatatcgctaagtatatatccaaaaatattgatggttatgcgctggaagatgaaaaagatcatcaaaccggcgcacctttgcgcgatatggcgaaatcggtgactgcatgggcgagtcgctggcgcattcgccaatttcagcaaattgggggagcgcctgtttctgtttggcgggaactacgccgtctcggggaagtgcgtttaatggataacaaagtcaatgcggttttgcaggcagccgatgaaggcaattgggccgcttatattcaggcacagggcgggccgtgggttgcgcgctgtgatttgactattcgtttgtcttataaacatatcccgtttggcagcccttatggggaagatgtttacaccatacaaggggtgacatcaccatttttgtcatgtgtggaatttatctgcacacgtattcatcaatggactcttgtaccgaaatcagaagctgctccgacatcaggacagattgtctataaaagaaacactgaatggccctcttggagttctgtcaataactgtacggatggacaagtggatagggcaatgaaggggtatgtaaattacaggattgatgaggatgataaattaatcaatatggcaaatatttctgcaaaaacagcacgtaataggtattaattatcaaatttagtcactagaaaaggtaaaaacttctttaatttttcacacattacgtgtactgtatatgcatacagttttatatggaggcgggtatatcagtggactctcttatggaatcattggtagcgcaacgtattaattttattgccagaatggcaacaagttgcgaatgcaatcatgcggaagacaaagagctggcgttggtctggatagctgaactatctgcgcctcatgaaaaccgacttaacgtccatagaaatgacttagaaaacaatttattgttcgagaaagcattaaaaaattcaggttcaacagacgaataaattttgcaggtgaaaatgatgaaagtggagatacttttcgataaacgagctaatgtttctgaatcagtgatgtctgcacttgaaagtgaactaaaaaaaagaattttaccgcagtatcccgatacgcattttagaattgcagtcagcagcagtagctccgtaagagtgacaggaaccaaagacagtagtaagcatgaccagatgatggaacttattcaaaacgtctgggaagatgatagctggttgccagattaaacccgacagggtattgatattcttcaatggatgacaagttataatggattatgtagcacgggggcaggaaataatttcttgcccccgtgctatttagtatgtatttacaacacgcgtcgatgttcatttgtactattttcccaacaatgccacttcattgaggtatttctctgattattcgatcataactctccgatttacttactatttcctacaaaggaaaggagagtgtatgcaagttattgcacaacaaaatgagacagttgatgccctgtgctggcgtcattatggccgaacgctggggatgacggaacgtgtgctgttggccaaccctggtctggctgattttggcgcggtattgcctcatggaacgaaagttgaaatgccgggattcatgcccacgaccactaagccgattatccagctctgggattaaggggtatgcatggataaatacagtcacgcaacttatgcctgcgccagtattactgccattttttctggcctttctttatatgagtggagttttcttctcggggtattcgccagcatttccctcggtattctgacttatcagctcaaccgtcgggagcagatgaaacgtaccttgattctgaaaaatatcctgaaaaacatcctggaaaacctggatattgagtctgcgtcgaaatcagccaagatagtcagcgagttgatacatcacgcaccaagagagctgtgatatgcaggatatcaaaaccaggttcagccgagtgatcattggccttattattggtggtgctagctcttctgtcattctttctcaatttttggatgagaaagaaggcaaccgactgtctgcctatcgagatggcggcggcatctggacaatatgtcgcggcgtgacgcgcattgatggcaaagcggtatataaaggaatgaagctagcgcctgaacaatgtgatgttttgaaccgaatcgaagccgacagggcgattgattgggtgaaaaagaatgtgcgcgttccgctgactgacccgcaaattgccggtattgccagtttctgtccgtataacatcggccccggaaaatgcttttcctccactttttatcgcaaactcaacgccggcgataaaaaaggtgcgtgtgcagagatcaaacgctgggtctatgatggtgggcgtgactgccgaaaaactcaagggcagccgaatggctgttatggtcaggttctgcggcgtgatcaagaagctgaactggtgtgttgggggctggataaatgaagaaagtatctttacttgtcagcgtcagcctcgttattgggggatgttttggctggtggggacaccgttcactgtttctcagtgaattgactgatttgaaacagcaacatgctactcaaatcgttgctatcaatcagaaggcgcattcggagacgttagccacaatccaacagatgaaggatgcgcagaacagagttgcgcaattggacgaatactattcaggaaaattaacccatgttaccgaagagaatgctgccttacgtgctgacattgccgctggttatcgtcgggtgcaaatcgccgccgccaaccttgctacctgtcagctcacccaaaaccgagataccagctcccgcagcgtgggcgatgaaacccaagtcgaactcactacaaaagctggacgtgctatttacgatatccgagccggaatcatcagcgatcaggccaaattagattacctgcaacagtatgtacttgaagtcgttcgtcaatgtaaaccgtaaatattatccttcacttaagtatcgttcagcagaccccaaaagccttttttcacgttggaagaaggcttttattttattgattttacgtgttttttgaacggggtttgtatgacatttcctacaaaccccgtttaatgtctacccggttttttcatggcattcttacgtcatgaacacacaactcactgaactgctgcgcttaatgcgcaacctgatccgaaccggcgtcatcacccaagtggacaccacaaagggtatgtgccgggttgcaacaggcaaccttgaaaccaactggctgaactggttgacatccagggcgggaaactcccgcacttggtgggcgcccagtgtcggtgagcaggttttattactgtccataggcggagaactgaccaccgcctttgtattgcctgcgattttttcagatgagtttccggcgccatcaacatcatcagaagcgacgcatatccagtttcctgatggtgcagtgatggaatatgaaccgcaatcaggcgcattgactgtgatcggcatcaaaaccgcgacagtgactgcttcggattccgtccatattaccgcaccggaaatcacctgtgtcgccagtaccagaatcacactggatacaccggaagtcatctgtacacagctaatgagcacggggaatttgatcgtgcgcaatggcggcaaaatgacgggcaatattgaacacaccggcggcacattcagttccaacggcgtggtcgtggattcccataaacacaccggcgtcaggtcaggcggtgacacatcaggaggccccgtatgatgtatctgggaatgaatcggcaaacgggccgagaactgacagatctggctcacgtccggcaatccgtcagtgatattttattaacttccgtgggtagccgcatcgcacgccgtacttacggttcgttgctgccagaactaatcgattggccacagaacccggcgctccggcttcaggtcatggcggccagctataccgccatcagccgttgggagccacgtgtgatgcttatgtcaatcacaatggagacccggcagaacggtgaaatggtggtggatattgcgggaacttatcatcaatccgccaaagaattttcactttctattccggtgagccattcccggtgaggtaagtcatgccaacaatcgatttaagccagttgccaccaccggatgtggtggaaccactagattatgaacaactgctggaagagcgcaaagaaggattgatctcgctctatccagaagaacagcaggatgcgattgcacgaactctgcaactggaatcagaacctttggtcaaattgctggaagagaacgtttatcgcgaattgctcttgcgtcaacgtgtcaacgaagccgcccgtgcggtgatggtggcctattcgacaggcagagatctggatcaattgggtgtgaacaataacgtagtccgaatggttttgagccctgcggataactccaccgtaccaccgacaccggcggtaatggaatctgacaacgactaccgtgttcgcatcccgcaggcttttgaaggtttgagtgtggctgggccagttggctcctatgaattccatgcccgcagtgcggacggtcgggttgctgatgcttcggctatcagcccgtcaccagccaatgtcaccgtgactattatgtcccgtgaagataaaggcgtggcatcgaaagagctgctggataaagtcgaaaaagcgctgaacgacgaaaacgtgcgtccggtggcggatcgcctgaaagtccaatcggcgagtattgtggaatatgaaattgatgcggtgctgtatatcttcccgacaccggaatcagaaccgatccgcaaagcggctgagcagaaactgaaatactacgttgaagcacaacatcgcttggggcgtgacattcgcttgtcggcaatttatgccgcattgcatgtggaaggcatccagcgtgtggagctgaaagccccgctgaaagatgtggtgctggataaaactcaggtgtcttactgcaccaaaaccacactgatgatgggaggttcagatgaatgatcgccttctgccgatgggctcaacccagctagaacttgctgcggccaaagcctgtgccgagttgcagaagattaaagtgccgctgcgtgaactgtggaacccagacacctgtccggcaacgttgttgccctatctggcatgggcgtggtcagtggatcgctgggacgaacactggtctgagagcatcaaaagagaagtgatcaaaagctcgctattcctgcataaacataaaggaacgattggtgcaattcggcgggtcgttgaaccgctggggtatctcattcgcgtaaaggagtggtggcagaccaatgatgtaccaggcaccttccggctggatattggtgtactggaaaacggcatcacccatgaaatgttcgaagaactggaaaaactgatttctgatgctaagccagtcagccgtcatttgattgggttagacattaatctggatacgcgcggtgagtattactactcagcagccagttacagcggtgatgagctgacggtttacccctatttcgcagaacaagtaacggtatccggctcagacgttgtgggtatgggcatacatattattgatgacatgaggattagaccatgagtaccaaatattttgcgctgctgacgcagctaggcgcagataagttggcgaatgctgcggcattgggtacaaaaattgaaatcacccatatggccgttggtgatggtggtggcagcctgccgacaccagatactaagcaaaccaaactgattaatgaaaagcgtcgtgccgcgatcaatacgttgagcatcgatcccaaaaacactaaccagatcatctctgaacaggttatccctgaaagtgaaggtggctggtggatccgtgaaatcggtctgtttgacaaagatggcattctgattgccgtcgggaactgcgcggaaagctacaaaccacaattacaggaaggttccggtcgtacccagaccatccgcatgattttgattgtcagtagtaccgagtcggtgaccttgaaagttgacccgtctgtggttctggcaactcgcgaatatgttgatgactccattcagaagcattcaaacagccgtaatcatcctgacgcgacgctgaaagagaagggatttgtgatcctgagcagcgcggtggacaacaacagcgaaacccatgcggcaacaccgaaagcggtgaaagcggcgtatgattttgctaatgcggcgaataataatgccaacggtcgcgtgccatctggtcgcaaggtgaatgggaaagcattgtcggaagatatccatcttaaggcttctgatgtagatgcatataacaaaactgaaaccgatgcacgggtgaatgatgccaaagcacaggcgaaagctgcgaatgataatgccgatggccgcgttccagcggggcgtaaggttaatggtaaagctctgaatgcggatattgcgctgaattctggggatgtgggtgcatattccaaaggcgaaacagatactcgggttgatgaagcgaaagcgttggctaatactgcaaaccagaatgcggctaatgcaaataataatgcgaatactcgtctggaaaaaaaccagaatggcgcggatattccgaacaagccgaagtttgtagaaaacctcggtttggcggaaaccaaaaatcaggcccaggacgcagtgcccaattcaaggaaggtgaatgggaagacattgacgggggatgtgaccctgagtgcggaggatgttcagggagagccccgttttaaccagacgatagatctaacgggtttgagtagtgatcggtattatccggtatggtggaaattcccgtttaatgagcgtggagctaattcatggctgacaatacaccgtaattacgccgagaatcgggagaataaaaatccatttgggaaagatgtaactcatttagcagggctagaggtacaaatagaaggaagcgatacactctggggaggagatgctcagtacctgaatataaaacggatcaatcaacgttatcgtaataccgtcaaaaagattcagtatggcatgatgagtattgcaaggtctgttgatggtaagtaccctctatactatgattggaaatctggcgatatcacagaatgccgtgtatatagtggatgttatttacgaggaggattaacctatcatgttactagtaatttcaataacttagattattcccgtaaagaagatgaagtagaaatatggcatggcgtaagtgattctgataagcgggagattaaatggacggttaaatcttatgctattgatgatcctttattaggaaaagattatgatgatacagtaacggcttacggatctgatattacagatatgctatattctgtaggaatagttgtatggtttgctcaaaataaaatccaaatattt

SEQ ID NO: 14938 - DNA, 10904 bp, Xenorhabdus bovienii
  Genomic contig Name=Xb4151_4152.C397
tctcaagaacttacacctactttgcaactacaatttttcccgactgggacggatttgggacgagatttccaaaaagctcatcaatttgacgcgcgtgttcagtcaaatgattaggtgctaaatgagcatatcgccttaccatttcaatggattcccatccgcccatctcttgcaaaattgacagtggaacgtctgactgaaccaaccagctagcccacgtatgcctcagatcatgaaatcggaaatcttctattccagctcgctttaatgcggaattccatgccgtgttatcatcaacacgcatctttctgatattaggcattactattccatcgggattagttgatggtttagtatggacgaacacccacttattatgatttcctatctgggcacgtaacaccctgcaagcggtttcgtttagggctacccctatagccctagccgatttactttggtctgggtgtatccatgctacttgtctctgcatatcaatttgagaccattcaagattgataatgtttgaacgccttaatcccgttgccagtgcgaacttgacgattgactgtaaaggttcggggcattcatcaattaatctttgggcttcgtgaggctctaaccatctgacacgtttatctctgacggctggaaccttgatcacgggtgctttctctaaccatttccaatctcgttcagccgcccttagcagagacttcatcaatgataagtgttttgctttggtcgctaccgagacggaaacttctgtatatgcagggacttcttttccttttttctgggctgctgtaacacgactttcccatcgctgcttagatttgcggtttctcattttgctgattgccgtataaatcctggcttcggtgatatcctttagtcttactccttcgaaatattccaaccagaacgccatacggcctttatcatcatccagtgatttcttatcagctttttcctcgatccatcgcaagcatgcctcatcaaaggtcacatcagggaaatcacccaacctttctatgcgccataattcggcctttcttcggtcgtgcaactcctgagcttgctttttgtccgttgtcccaagagactccttaattcttttgccgcttggcgtcgtgtagttcccataccacgtatttcctctacggaagattgacattgtttatctcctttctctgtcgcatctaccgagctcacaatcacagtttggatcggattgttgattgctgcaatacatgcggcgcgtgtaaataaataaggtgagtttggcttggtggggttcttcttggtgtaggctattttacctatctgacaccatagggataatgtgtccacatcaatccctatgagcgctgctgctttttttctggataaggttatgctttctatctcattattatcagtgatgagtctcattgcttcatctccttatcaatcatatctacgtagtatcgcagccacatcacaggcaagaatttgctcttttgatgtggcgacatagcggtttcaaatcggggtaggtgtttggtgagtattgttgctgtttgctgggctgttcgttttttgtgctgcttaagttctttcaggcgctcccttgccacctgtcgtcttccgttctcgaattcgttagtcatggatggttacggtgatatctcccgtttctattccctgaaatccagagttttctaaaataaccttggcgtcattctgaattaatgattggtattcaaattccggagagagataatcgccaccaatatactcctgaacctctttgttattcatctcgatagttactttcatgctattttcctcaaatgttcgttaccgatatcgaatagataatctttatctaccgtggttattgttttgcgtggggtaataaacggcctccaaattaaaagcatggagccttttgtattggaatttttctttctctgttccactggcacaaattgaattcgaccacccgttattaatctgacctcatcaaccgtttgcattgccaatttaaaccagcctactgaggtatcattggggacgagcatcacaatagactggcattgcttcctgcattcaatggctgctttctctacccacggcgtaatcttggaatagggtggattacagaatatagagccgtaactttcccaatcacactccagtgcattatctcgttccgtgagatagtggctgcacagggtattttgagcatcagcggcggcatctagtttgaatttaaattctaaattgagtgctgtaaataaaggaagtggagtttgccagaggtcgcgtagttcttttggagtgttacttcctccgaaatcagttttcatcttctaaactctcaatggcatcccaaacatcagagcctctgatatcctcaaatgcctgaatagccatctcaaaaactgattgttcttgcgggtgaggagatttccaatattcaaaaccatcccgatgctgatatcccataatattataaaatttacctgccaatttaattgcagcattgactaattcacggtcggtcatcacatcatcattcttgtttgtcatttctccgcctatcccgctcataatcctccccgcactcccggctacagaatgcaccgtgtgttgctggctcagtctcacactatcggcacatcccgttgatactggttagtggtggtggtcggttctggagcgcatgggatatattcagcccatttaaatcgttagctgtgtcgataatatccatgatggttctctatttgttggggtggcggtagagggggaatatttcgtcagcaatatcaggatgcgattcattgtattctctccattcgaatacgcgttccggtagatctgttaaatccagaatccgttgtatacctgtattacgcgcccacgccacaggctccatattttcatattcagataatttcgattgcagtttgataattccatcaactaatgcacatgttgttgagccatttatatcagctaatttatgccagtccgcatcatcctgatggtacgcattaataataatctcataatcagcgagacgttttaataattccaataattctttaccttctaattcagtaaatctaatattttcaaaattagtcaattgtttttttattcggttttgtaaccgctcaatcatatctttgctcattattatctccttcaagtttctctattatataaaaatcattagcgccacattttggacaaacagaaattaaccatgttggaaattcagggtctggaactttaattcgatcattttcataatgaatatgtttacatttgcgtttagcgcattctattttgtcatttctcatttctcatttctcatttctcatttctgattctcctttaataaacagtaatgtattgcccgcagtcgttgcagcaatattcgttaatataacgtccatcctccccccaatcattagagccacatctacagtgcagaattcggatatgtttctcaggaatggttattggagcaaatttctcaactgacatttcattatcaaaatgatagccattgatttttattttatttatatttccgtttctggttgcataataaaaatatacgtcgctagtggttttcattgtagttgattggtatacatctgaattagtcataacatcattgttcatttttcgctatcctctaaaaatcagggttcctgctgccagatcacgttttactatttgtctcaataccctgtctcgccgagattgagtcattttaaaacgacgccgatggggtttatttcgggtgtttttccaatattttctatatcgtgcgtagtgcgaatcataaacgcgtttcaataactcactggctgttgtcagttttttcatttaaactccctgcatatattggttgcccgttggcacatctcggcactgaaccagccgaaatgacatttcctgaaactaattcccagcctccatgccagccatcgataggcctccgtgcgttcaaaattccctctctttcgcatatcctcaaattcctgtttaccgctccgcctcgctctccgtgtcggttcatcagccagatatcccaatggaatattggtttctgggtgcatccccacgcgcgcatcgcatgaccagcagacatagagccacggccaacgactacgaacctccccaaacacctccatgtgatgggctattgtgacgtgaccgcagcaatagcggcatttggtggggatggggagcgggtcattgactcgccgaattgctctggggtttgagttccatggggtgaactgcatgttgtgtcctcccgaattttggttgtaacactcctcccgccactgaggtagcgttagttaatgggtggggttaaaataggtctagctgaaatatttcgcaggattcggagcaggaaccggtatcaaatcgctgggctgcaatcatatcctgatagatgttttggtaatcgacatccgaatacattttggcgataccatccaatgacatgtggcctcggtacataatttcacgatcggtttttctatgaccatctctcacataagagggggttatgcacgtatgttcaaataccagctttaatcccggctcatcttgacaggccagccctaatttttggctactcttcttgatgcagaatacacagttgccaagatactctgggatcgacaaatcaaacggctgatctttccaccaatccagaatgtctcgtttgtcaaaatccgagatatcagccagataactcaccccctctttgcgggttaatctccgtggctcatcggctcgaatgcctatccatgtttgataattaccccgcccgaaatggtcattgcagtaatctctgaatggccgcaatttcaggcggtcagtgcagaatgcgccaccgatatagggtgtgccatattttttaaccatatctgtaaatggcttcaatgctggcatccgtgtttggatatctttcggttcccaaactgtataaccattcgatacacccaactgaggattgatatcagcctgcaatactatcagcgggatatcccagaatttcacgacttctctgacaaatcggtaggtcatgggatgctccgcccccgtatccataaacacatagcggacatcctcaccttgtttgcggcgctgttccatcagatagacgagatacgccgatgtcctgccgccagagaatgagacgacattgatcatgatttatgacctgttttagttaatgggtgaattagatgtttctatttggattgccgaatggcgctagaatggaatgtcgtcgtcaaaatccattggtggaggttctggttgcaattgctgtcccttcggttgctgtggcgctccccatccgtgagattgttgcggtactcctgaatactgctgctggggctgctgtccttgctgacttccctgtctattacttagcatctgcatggttccgccaatatttaccgtcacctctgttgtgtatctgtcctgtccctgttgatcctgccatttgcgagtctgtaaagaaccttcgatataaacctgagagcctttgcgaaggtattcaccggcgacttctgccagcttgccgaatatcaccactcggtgccattcggttttctctctcatctcacccgattgtttatcgcgccactgttccgatgttgccagagtaatattggcaactgcgccgccattcggcatatagcgaacttccggatcctgtcccagattacccactaaaataactttatttacgccgcggctagccatcgtttcccctccattgatcaccgaatttaaatcccacttcgtttagggcgtcgtccattttttctataaattccggtatcaattcatcgaattgctgcatgaatttctcatctctatctactgtgacataataaattccctctcgcgtcatgcgtgggtcatagttggcgaaataccatgaatcttttccagtgacccacatggagtactgaatttgagccatgtaatccgatttaatggcttcaaatccccctaagcgaaatctcataaaaacagcggtagtaaacgggcacttcaactcaaggccgaggccatcgctacacaggccatcgggtgagcatgctgtcctgagcgaatcatccttgaacaaaataggggcttccattacatcgacaccagacacaaattcaaatgttgcccgcgctgattcttcgtattccttgccccatgccagtgactttgcatttacttcaactacattccctgtgcagatctcacccagtaacgtgtagaaatatgtcgccttggtatctgtccattttttgccgtcttttgatttcgataacacctttccagcatccgaggctgtaataactcccagcctcaacttgtgccagtcaaacgatccttgttcaacatttcttaaatcaatccctgctctggtgaggactgactcatagctgaccattgttttttaccttcttggaaagaaaatcttcggctttattagcctccagttctgatagatcgtatggtgaatttatttctcgattaaagattttcgagcacaacggcagtaaatcatcatcccatgttttatccatcccaataagcatggcgttaatgcgttccattgttttagcgcttactccattcgaaggtgttgatgagcttattctcccatctatatcttcatccgctgtcgcaatccctaatgcacctgttaatgtgtagcggcgtaaatacgtgatggcagatgctgattgctgaatgctattttttccacctgattgatctggggtagacatcatttcacatgattcataatgccctgatttatggctaactatgcatttaacggtaattactccgctttccattttttgttcaaatcgataagacaatccaaatttttgcaaaaatggctttatctgctctgagatatcatccaatgatgcatatttatatttagccttgcctgctccaaaatcagcttgtttcaattttttaatggtcggcagtgcgctttgaaatgctgccatagcatccaaaaattcctttcttgcctgtcccgcttcccatttggtttgtagctccagtaatcgctctaacttatcaatatcggcatttgatgatacagccatctcaataagccgcattggagctgctgctgcattccctgtgggttccgcgacatggtaatcctgttcacgagtaacaacctcttgcatgctcatatcctctgctcctccactgtccgacatacatcaaacagccattcgtggtatttatccatcagttcagaacgtttatcacccgttctttctaatagagaattaaccctatcggatagagtgttgtccggtaaattaccaagacggtcatttgccagtttatccagatcggtttccagtgcctctttgtacgcggcggcttcttcctcttgttcccattgctcatcctgagcgccataggggttgcgttcgtatctcacgcgaccctccgttgcgcttttttcagttcttccatgaagctacccatcaaatccctatcaatgagataatccgttaactcattcatcgaccactgccctgagttcatgcgttcttccattgtgcaatccattccctttactccatcaggaaattcaatgatattgactccgtttcgataatgtcggctactgaccgatggtgcgaatatttgcatgatgacctccgtaatatttcatgagtaatttcatgccgcgagtccatgcggcagagcgattttcacgtacagcgagacatccccacgattgagcgcgggttagatttcgtttgttcatgattgattatctggtgataagtagagtgaatatgacggcgagaatggtgagtgagtaataatagaaactatcgggaatcattttgccgtgctttcatcattgcatccgctatatgataggactcgacggccagatattcataatccggtgcgttttgaccgccaccaaatttcgaaccatcgtaacgccggatacctgcgcccatagcccgagctgcgaaataatccctcaatgttatctcatccggtttattcttttgtggggctatttcgccagataaccctaatgaatcaaccaaatttttaacgttatttaatccacctgcggtgaccgtgcctttatattggattttgttttttgttggatagtaaataacttttccttgttttgtttgtaccgttatagttccacagatatcaatggtatgattaatacctagtgcattgagctgcccagatgattcagaaacgagttcctgttttttatcactcagcatcatcattcttctgtcggtggttctgggagtggttgccagtgggtaatacctatgctgagataccatttagtccagagctgattaccgttttcatcgacaccagcgccaatatctctgaaacagtcttcaatatgaaccatatccatacttccattcgagaaatacactattacactgtcgtctcgtatttcaggcaacctctcactacatttaatccaatccataatttctcctatattcaggtaataaaaaacctcgcattggcgaggctggtatttattcattatcttctaatgttacttcaatatcttcggattcatcttcatctgaataaaactcatcgtattcaaaaccatttgcaaacaaaattttttctattgcccgctcgcgtgcataaatggataaatcagaatcttctatttcacaaattttcgcgtattctgattctggtatttcaaagcattggttatattgtcgcgtgatgcgtgcttctactcgaatttcaactttctcactcattgttattctcctattattaactcaccacagcccactcgtaaatgagctggagttagtcaactgagagccatccacttacggtagaatttacgctgttgccaagctaatctattcaatgcacgacgactagcagaacgtggctcatgatccatagcccattgacgaaaatctagataatttcttttacattcaattacgtaccgaatatcagactgacggtcacgtttcattgatgcccgaatttcgttaataaattcaatattcatactcacctcgctgttactgttgttgattgacgatatttttttcgtcgggagttaactcatcccaatttttgatgacaaatagcttgtcgagaaagtcgcagcgttcatctccagaccaataatcaaaaaccagtttctgacaaaataacccagtatccatcgcatcctgtgcattagcgaaatacataaatccgcccgctaattcatttgatacccgcgaaacttgagttgccgttctgtacataataaccacccgatttgatttcacgattttcatatcaccccctagcagtaacgccgcctgactccagtatccgattgccagctctttgcttggttgagtaaagagctacgtcactcatgcagcaagatccgctgttgttgtcgtccttgatatctttcttcaacccaatcatcagttgcgtcagtacgtcaatttcgtctactggtttgataattgagtcgataatttcttccactgagcggctttgaaggttttgtgctgcctgtttctttgccaagaaagcagctctacgctcataacgacgagttgcgtagtcactccgtataacggttactgttgtcatatcgcctccgtaaataagttttggtggtgtagtgacaggtgctgatctcctgcatggggttacaacggctcaatatcctgaactggctgtaactcactggaataacgcatcagtctgcgtattcactacaccccaaaacctactcagtggggttgattcaagaatgcctgaatctgttccggtaatgttaaagagcgaatttccttttagttttggcttcctgccgttgataaatatatattgaaccaaaagtacgaaatagacaagtaccaaaagtacaaattattttaaatatatagtacttttggcataactaattgttagataaggaaataaatttttgagattattttaatttgtgattggggtcactaatcgaccaaagggaggatataaacaggcacaaaaaagccctcgcggggagggctgtatatagatgtttaagctgccagtcgtgacacccacgtctctcttttagtaaatggtaagatatgactggtttcattaaacaataatgataattgttgaatttgatcacctatcgaatcgttatcaacaacaacatatctattattcaagtctgaattggagtttttaagatcaattagtttgccaagcaaggaataggcactgttccaactaccgttttttttcacgctggatgtgaagatatacttaggtgttggtgtgttaatcgtcactggtataactatttgatgcccactcatacccataactgaacctcgtaaagaaataatatcttttagttcagtatgatataaaaagtttataacttgaccttcaaatttttctgcttgcactggttggtgccaatcttgtgataaagtggatgctatgattccagctctaataacgccagaagttacggagccaacagtatcttctgtcgcccaaccaataatctcacctctttcattcaattcagagccttggttctttaggaaggctctgatttcttcgattcttttttttgtaagtgagattcctctggcttccatgttcattaaagtatcacacctgtcacttactaaatacttaccatttatctctttgacaaaggcaccaacatgctcgccatcatcacaatatgtgaaggggctaattattctcagtagctcagagccaattgggtggcattcgaaccctagatttgatatcacagttgagcacatcat

SEQ ID NO: 14939 - DNA, 10740 bp, Xenorhabdus bovienii
  Genomic contig Name=Xb4151_4152.C398
actttttttccgtttggatgcttagcatgcagaatgtttagtttaacggctaagaggctattttatcaacagcataattccttaagtctcgttaaaatttatgaaaatgattattcaccgctataacctcatgaacgatgctttttcaacagataggaaataaaaagacgtgagagaataaaaataaggtagtaacgaagcgtgaatcacttcaatttggagagaggggaagcaaagtagcgcccaagtcttaaaaaagagtggacgccattcttgaattaaaaagttgtaggctgagatttctctgcctgaatccgttgataaatttcttcacggtgaacagaaacttccttgggcgcattcacaccaatgcgaacttggttgcctttaactcccagtactgtgactgttacctcatcgcctatcatgagcgtttcaccaactcgacgagtcagaataagcattctttgctccttgaaaatttaaaagagtcgggtctctaggtttccccgctattatccatcaaacaccgtgaaaacgtaaagcaatgatatctacttaaagtataagcagttttgaacacattcctatatctataggatagctaaaatataagtatgcgcccaacatttcaacaatttcacaacaaaaaaacatccggcaccataaaaaacactttcatggtgccgtggctgtcacggcaataccaactataaccgcaatgttacccactcttctacactagctaatgcggaaggaagagctgctacatcagttccgccagcctgtgccagatcaggacgtcctcctcctttacctccaacttgctgggcaacaaaagagattaaatcgcctgcttttattctagcagtcaaatccttcgttataccaacaattagggtgactttatcaccagtcacagtagaaagcacaataattgctgatcccagttggtttttcagttcatcaaccatcgttctgagcatttttggttcagtatcacccaattgtgttaccagtaggcgaactccctgaatctctttagtttgattcgccaaagaggagctttcctgagctgcttgctgagacttcaagtgttgcaactctttttccaactgttttgttctatccagtgtcgttttcactttctcattcaggctacttatatcgcttttcacaagatgagcaatatcttgcagtaaatccgtctgctgataaacagaattcagtgcagtttgccccgtgatagcttctatacgacgaatccctgcagctgtacctgattcactggaaatacgaaataacccaatatcaccagtacggctagcatgagttccaccacataactcagtagaaaaatctcccatgctcaatacacgtacctgttcatcatacttctcaccaaacagtgccatggcacctttggtttttgcttcttccaattccattaattctgtaacaattgataaatttttgcggatttcttcattcaccagattttctacctgacggatctgttctaacttcattgcttcaaaatgagagaagtcaaaacgcagatatttatcatttactaaagaacccttctgagaaacatgttcccccagaatctgacgtaatgccgcatgtagcaaatgagttgcggagtgattcaaacgaatcgaatctcggcgtaccctattaatctcagcattaattgtattattaacgttcaaagtgccatttatcaatttaccaatgtgaccaattgcctgaccgtatttttgtgtatcagtaacctcaaatatcccgttaccattggacagattacctgtatcaccaacctgtccaccagactcagcatagaacgctgtcttatcaagtataacgatcgcttcttcacctgcatgaatctgatcaatcgcttcaccatgacggaaaatcgccatcaccgtcgcttgctgtgagttatgttcgtaaccagaaaaatcactgcgaccgtcaactttgatctgttcgttataatctgtgccaaaaccactggattcacgtgctcggcgacgttggttttccatcgcaacatcaaaaccgacttcatcaactttgatattacgctcacggcaaacatccgccgtcagatcaactgggaaaccataggtatcatagaggcgaaaagcagtttcgccatcaagggtatccccagacaatttttccagttcttcatccagcaattgcagaccgcgttccagcgtacgggcaaattgctcttcctcagttttcaatacctgttcaaccaatgactgctgacgttttagctcatcgcctgccgagcccatgattttgatcagtggagcaaccagtttatagaagaaggtttcttttgcacccagcatgttgccatggcgaactgcacgacgaatgatacggcgcaacacataaccacggttctcattcgacgggacaaccccatcacaaaccaagaaggcacatgagcggatatggtctgcaataacacgcagagatttgttggtaagatcggttgcgccagtcacttctgccacagaagcaattagatcgcagaataagtcgatatcgtagttggaattgacgtgctgtaacactgcggtgagacgttccaaacccattccggtatcaacggaaggttttggtaatggctccattgtgccatccacgtggcgattaaactgcataaaaacgatgttccagatttcaatatacctgtcaccgtcttcttctgggctgcctggaggcccaccccaaatatgctcaccgtggtcataaaaaatttctgtacaaggaccacaaggaccggtatctcccatttgccagaagttatctgatgcataaggagcgcctttgttatcaccgattcgaataattctttctgctggaataccaacttctttgtgccagatatcataggcttcatcgtctgtctcatagacagtaacccacagtttttcttttggcagattgaaccactctttgcctgtcagcagttcccatgcgtatttaatcgcatcttgtttaaaataatcgccaaaactgaaattacccaacatttcgaagaaagtatggtgacgggctgtataaccaacattttctaaatcgttatgcttaccgccagcacgaacacaacgctgagccgttgttgctcgagaataaggccttttatccaacccaagaaaaacatctttaaactgattcattcctgcgttagtgaacaacaaggttggatcattatttggcaccagtgaactacttggtactatctggtgccctttagtgtgaaaaaagtcaagaaacgcctgacggatctcagcggtgcttttgctcataattgtcccgaaatcaagctgaaaaaacagattcatgtatggttgaagtggtatatagcgtatccaccatttcaactcacgaataaattaaaatagggttaagatagaatgtcttccataagaagtaaaatcccatataaattcatccgcttttcagcattgtaattcgtctggatattttctgaaagtctgtttgtcaagccagtttcagtatccctatatcaatgatgttgattactcctataaaaacaaaaaccacatcccgacaggatgtggttcttcaaaaggcagtttgtcacgacagagtaaaagagtgattaaaactcttcatttttcacttcttcaccgttgtcttcataatcagcttcataatcagagactgcactattgaatccacctgcattatttaacagtaattcacgcagttttttatccagctcagcagagatttctgggtgctctttcaggtaaatagtagcattagctttaccctgcccgatcttatccccgttatagctgtaccatgcacctgctttttcgaccattttgtgtttaacgcccaagtcgaccaattcgccaaaggtgttaatgccttcaccatacaaaatctggaattcagcttgtttgaatggtgccgcaattttgttcttgactactttcacacgagtctcactgccaacaacttcatcgccattttttacggaaccagtgcggcggatatccaaacggacagatgcatagaatttcagtgcgttaccacccgttgtggtttctgggttaccaaacatcacgccaattttcatacggatctggttgataaagattagcagagtattcgagtttttcaggttacctgccaacttacgcattgcctgactcatcatacgagcagccaatcccatatgggaatcgccgatctcaccttcgatttccgctttcggggttaatgcagcaacggagtcaacaacgatgacgtcaactgccccagagcgtgacaaggcatcacagatttccagtgcctgttcaccggtatcaggctgggagcacagcagattatcaatatctacgcccaactttttggcataaaccggatcaagggcatgttcggcatcaataaaagcacaggttttgccttcacgctgggcagaagcaataacttgcagtgtcaatgttgttttaccggaagattcaggcccgtatatttcaacaatacgacccattggcaaaccacccgcacctaaagctatatccagtgagagggagccagtagagatagtttcaacatccattgagcggttttcgcccagacgcatgatagaacctttaccaaattgtttttcaatttgacccagcgccgctgctagtgctttttgtttgttttcatcgttagccatgtttactccttcgtaagcaatgaaggggctgccccactgctgataaaccgtttctgataccaaagtgctggaattaattatactgtataatcatacagcatcaagctaattttttatgatttcttccagcagtgtttttaaagaaaaaataacggcctgaagccgtactgcattgcgctcacccgtaaaatgctggcgatatgtcacggtatgtacatcctcacgattacggtaggcaaacccaaaacagacccgttccccgtcggttttttcttcactaccaccacccggacctgcgatgccactgacagaaacagcaaaatctgctctggccgcttttaatgcccctactgccatttctttaacgacctgttcactcaccgcaccaaactgcatcagagatgcctgtgatacacccagcatttcatttttagaatcattgccataggtcacgaaaccacggttaaaataggccgaacttcccgcaatatctgtgatcactttagcaatccagccccctgtgcaggattctgcacaggttaaggataatttcttccgctggagcttctttccaatttcaatactaagctgattcaggattttttcatccataacaagccttcaattctataagaaattaatttttccgaagcagatcccaaatccatactcccccaattgtcagtgagaacaagataccaaaaccaataccgacggtaacgaccgatgcgcccagcatgatggaaattagatacagacccaacatcaccagcatcgcgctgttttcaccaaaattctgcacagcgacagcattacctgcgcccatctcatgttttccatgctcctgcaataaggcattcaatggaacgacaaagaagccgccaaatacaccaaggacagttaggagcaaataggaagaccacattgattgctgaacagcaaaaacaatcaccataatgccgatcagaatacctgcgggcatacaacggcgaactgttttcaaggtgataaaccgtgcagccaacccggctcccacaataatgccaacggcaaccattgcgttcatcagcgtaggtgtcgtattaccctctatccccaacacgacgggaacccacgctactaacaggaagcgcagagttaccccggcaccccagaacagactggttcctactagcgaaaatcgcgtttcctgattacgccaaagcgcagaacagacaaccataaaatccaccagcatttttttgggattccatcccttaccctggcgcgcagcagcaagccgggggatatagaaattagctactacagccgcaccatacatcaaagcacaaagacctaatgccagtgccaaactgatatcagacaggaaaccgccagccacagaaccaatcaaaatggctgcaattgtcgaagcttccatcacaccattggctttgaccagacgaccaccatcggttaattcacccaatattccgtatttagcgggggaataggcagcggcgccaatccccacaagggtgtatccgaggaaaggattcatatcgatacagatactgatggcaccaagtaatttgatgccattggcgaaaagcataacccagcctttcgaaaaccgatcagcaatttgtcctacgaaaggggcaagcacaatataggtcagcacgaaaacaatctgcagggctggcagactccatccagggtaagcttcagccttcaattgagctaaaatggcaaagaacagcgcattgtcagcaaaagcagtgagaaattgagacagtaatactgctttcattcccttatttaacagtggttgtgtgtctacagttccattcatttccttactcctgttctgccatttttcttaatgtgacaaaatccggttttccactgccaagcaatggtaactgcttcacataacgaatatcgcgtggaaccgccagttcaggcattcccatttctcgggcaacccccgacatcgcatttctattcaaattagcatcggttgtaaagagtaccagcgcttcacctttgctaagatcactcttagctgtagctgcatgcaatgcgtcaggagagactcgcgatgcaatttgttctacggcttcgagagaaaccatttcgcctgccaattttgcaaaacgcttcactcgccctttgattgtacaaaaacctctgtcatcaatagaaacaatatcacctgtatcataccagccgatctgagtattgccttcggcatcttctgcggttggtagttccagatgttcaggtgcctcaacacgcagatatcctttcatgacattcggcccacgcaattgtaaacgaccgccgccctcaataccctgtacaggaagaaggcgagcttccattcccggtaagatccgtccgacagttcccattttagctgccatgggtacattaattgccacaacaggagcacactctgtcacaccgtagccttccagaatgcgaatgccgaatttatctagccaaacacgtttagtgttttctgacagtttttctgccccagcaaccacatagcgcaagcgggcaaaatcataaggatgggcaaaacgggcataattacccaagaacgttgaagtcccaaacaaaacggtacaattacgatcatagaccagttcaggcacgacacgatagtgcaatgggcttggatagaggaatacgcggctacctgtcatcaacggggtaaataaaccaactgtcagcccaaaagcatgaaacagcggtaaagaggacataaaacgatcctgaggagtaaaatcagcaatcgttttaatttgctcaacattcgccaataagctggcatgactgtgcacaacacctttcggtgcaccttcagagccagaggtaaacaggatcagagcatcatcatcaggcttctgggaaggcgtaatggccttagcaggaaaaatcaggtgccataatatccaaagcttatcttcccgcgtaatcgtatctttcagatcttcaagatatacccaattggcttccgtcacctgttctggcaggtgggttaattgccctttttgcaaaaattgacgagatgtcacgatggttttgattgtcgctgctttcatggcatttttaataccactcgttcccgcagtgtagttcagcaaagcaggcactcgttctttcagcgaagcaccatatatggcagcggccatcactgtagcattaggtaataaaagtccaacccgttcatttttttgagtaaactgttctaaaatccggctgacgcccagtatttttttcagcaatgcgtgataactatcttccttaaaagttacgtcttcaatacagggtttaaaacggccaaaacgtttttgtgcagcaaggtaagcgctaaataacgggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccataaaggctatttctatcccggccctgatttattcaacaaagccacactaatagtgataatacctacttattcagaaaatttttctgcttgattaataggagtcactctcacctgtttgatgacattaccgtgtaccgatagaatttcaaaattatatttattaatctgcacctgagcgttcaattcgggaatttcacccaactcttctagaatcatgccgttcattgttcttggtccatctgcaggcaatgcccagccgaagactttgtttaattcgcggatattagctgtaccatcaactagaacagtaccatcactctgtggcattacttcttctgctaaagtaggggacatagaagtagtaaaatcaccgacaatttcttccaaaatatcttcgacagtaacaagcccctgaatatcgccatattcgtcaacgattaagccagctttttgcttgttgcgttggaaattaatcaactgagtgttcagcgggatgctgacaggaataaagtagatcttatctgcggctttaatcagatttcttttcgtaaacgcttttttctccatcatgaggcgataggcttcacgtacacgcagcatgccaatggcatcatcgagagaatcgcggtaaagcacaattctaccatgtggtgaatgagttagttgtcgcatcactgacttccagtcatcattaatgtcaatgccgacaatctcattacggggcaccatgatatcggcaacagtcactttctcaagatctaatattgaaataagcatatcttgattacggcgtgagagattggtgtttgactcattcacaattgtgcgcaattcatctttgctgacagcatcactgcgaatgtcaaaggtctttatgcctagacagcgcatcagcagtaaactgattttattaaatgcccacacaaggggaagcatgattttttccagtgggcgcagtaggaaactgctaggaaatgccactttttctggataaagtgcagcgatagttttgggcattacttcagcaaaaactagaatcacaaaagtcagtatgccagtggcgatggcaacacctgcatcttgataaagacgcatccccacaatagtggcaagtgaagaggccagaatattgatgaggttattaccgataaggataagactaatcagcctgtcaggacgacgcagtagtgattctaccctccgtgcaggacggctaccttgttttgccagatggcgtaatcgataacggtttatggtcatcatgctagtttctgaggcagaaaaataggcagaaatgatgaccatgatgacaagaataatgattaatgtgcttgttgaaacattctccaaagcaaaattcctttctaatatttatacagattggctacagtgatcccttgaccgttaataaaccataatttcctgtaatagcctgccgccaaaaaaggcgagtgtcagaataaacgcgccaatcagattgaaccaaatgacacgtttaccgcgccatccttcatgatagtgaccccagagtaagataacgtagacaaaccatgcaatgatagataaaacggatttgtgaatattctctttaccgaaaatattatccatgtacatgattcctgtacataacgtcaatgtgagtaaaatgacaccgacttgggtaatgtgaaacattttgcgttcaatggtcattagagggggcatgccagaagaaaaagagaattttttctttttaagcagatgatccaaccagcccagttgtagtgcatatagtgcagcgataagtaaggtggcatacccaaggagtgctaatccaatatgaatgaataactcgatagggtaccgagctgaa

SEQ ID NO: 14940 - DNA, 13336 bp, Xenorhabdus bovienii
  Genomic contig Name=Xb4151_4152.C399
ggcttacatccttgccagccctgcaggttcgaactctaagaagaagcccctttcttctgcgatagctgcaataatggcgtttttggttgggtaatagtgaaacagattacctgggctcatgcctgctgccttgcagatttctgctgtggatgttgcatgaaatcctttctctataaaacaggagatggcagcatcaatgatttgtttgcgtttagcgcgctgtttttctgtctgttttgacaaaacatattcctccaaaagatcggatataaaaaattagattaattactctatctaatgttcggatgttattatacagactaaatgtttattcttcttatttaatcgtcagaaatagttttataagtattacacacataaagttgcttaaatattattaatgtccggctgttaatttgcacaaaaacatgccggacataaaataatctgtcagtgataatcgatatcgtctttcgttactgaggtcaattttttaaggtatggagtaataaagtttttaaaatcatccatataactgtaaataactggtacaaacagtaaactaagtaaagttgaactgagtagtcccccaataaccgagattgccatcggcgcccggaaactggcatccgcgccgctggtaatgaccagcgggatcatgccggcaatcatggcaatcgttgtcattataataggtctgacacgctctctgcctgcctgaataatggcttcatttcgtggcataccggtgcgggatttttcgagaataaattcaaccaataatattgagttttttgagactatgcccatcaacattaatatgccgataataacgggcagatcaatggcggcgccataaataagtaatgcgataatcgcaccaccgatagcaaatggcagagcaattaaaattgtcattggctgtaaaaaatctttgaacagaataatcagaatagccagtaccatcatgatactgagtgttatggtcgtcgtgaaacgatcaaacatttcattcatatattcaacttcaccatactcgactctttttacctctggcggcaattttttcattgtgggcaattcattaatttgtatatatgctgttccgaccgcaataccattaagatctgcatcaatactggctttccgctgtctggcaatccgttctattttgtcagggcctgaggcaaaagagatatttgccaccgattttaccggaacattgacgcccgatatgctatttacgtacagatcatttaatacggtcaggttatccctgtcttctttggataataagacgcggatcggaacttgcctgtctggtaagttaaacttagcgactctggaattgatttcacctattgttgccgttctgattactgagccaatcgcatcggttgttactccagctctggctgctgtatcaatattaggcgttatgataatttcccgtcttggcaagggttgcaagagcttgatattcttcaatccctctaactgcatcatctctttacgtaactgctctattgtctgagacagaatttctgggttttcactggccagaacaatcgaaatatctcggctgccactactattgccaaagttatatcgaatatctggaatctcatttaagataggaatcaatgattgctcaaattctttttgtgaccaatcacgttcacccgtcggtactaaatttataataatgttactcctattctggctaatctcaccagaggagccatcaacgccggcaacagagaaaatatcgataatttctgggcggccttgcagtttcttaataatcttctgcaacgtttcatcactttgtgctgcttgggtgccggggggggcttctacttctattgtggtgatactaatatccgctttaggcataaaacccgagggtaacagtgctaccagagctaatgatcccaaaaggaagacgatggctagcaacgacgctgttttgcggaattttaatgttttttcaaggatagtaagatatttctttatccatttgggtgtctctgttttatccgttttcggatgttttttaggctgtaggagataggcggacatcagcggagttaccaatctggcgaccagtaatgatgataatactgctgctgatacggtaatgccgaagggaacaaaatatttaccgataaaaccaccaataaaactgacaggcaggaaaacagcgacaatggtaatagtaatcgcgactattgcaaatccgattgcatctgacgctttgatggcggcaatataaggtctttcacctctttcaatatatttctctatattctctatttcgacgattgcatcatcaactaaaatacctatcaccaatgttaatgccaataaagtgatactgttcagggtgtaaccaaataaatgcaggataaaaaatgccggtagtatagataatggcagtgcaatggctgcaatcaatgtcgctcgccagcttttgagaaagaaaaacaccacaataacagttagtattgcaccttctattaatgtctgcatggtcgaattataacttgccaccgtatattttacatttgatgaaacaagtttaatactgacatccggatactcttctccagccatttgtaatgcccgtacaacccctttttctacctctgtatcacttgaacctttagcacggaatacggcgaaacccacaacaatttcattatttaagcgggcaatggtgatggtttctttatgtgaatctctaatcgtggcaatatcgcctaattttatccaattatcgtttgctaaaggaagttttaattggtgtaaataatctatttcattttttgcacctaaaatacgaatggtatgatcttgtcctgcgacaaccatttttccgccaggaatattaacgttattttgaagtaataactggttaatatccgcaacactgatcttcaaggcagccatctttatcggatcaggttcaatcaaaatttccttatttgtgccacccagcctcgttattttttgaacgccgggcaccattaataactttttacttaatttgtcatcaacaaaccaagataaatcggtcaaattcttatcttttgactgaaccgcgtaattcaggatcgcgctgccctctacatcaatacggctgattagcggttcatctattgattgaggtaattccgaacgaatctgtgtaatttgctcccggatatcatttgtcgcaacattcggatcaatttttatatcaaactcgataatcgtgatggatacgccatccgttattgttgagttaatatgccgaatgcccggcaatccagaaaccgcgcgttctatgggttgtgtaaccgcattttccaattcggaaggtgatgagccactttgtgtgacagtcacagtcacaaccggaaaattaataacggggtttgcattgataggcaattttaaaaaggaaaataacccagcgatagtgagtgccagaaaaataacaatcgtgggaataggttttctgatggcccattcggataactgatatttcatcttattttccctgtggcataatggcaacagtatccatttcttgtaagaatggagatgcagaaacaatgattttatcttttggcgataagccagactttatctcaatccagttatcaaaaatgcgccctgtattaatttcttttttctctacggcattgtttttaccgacaacatagacactgggtttatttttatttcccatattgacagcactataaggaatagcattgactttttctggtttaagctgaaataaagcatggccgaaatcccccagtttgacatcggcggggacattttcgagcgcaattcttatttttcctatttgggtaacgggattaattttcggcgagatatatctcactttgccggttattttgctgccggaagtgagagaaatagccgcaggtattcctgtgtttatttgttttaaagcagaaatataggcttcagccgagaattcgtgctggttattttcgatcaatttaaacagttgactgctatcggttatcatacctgccatcgcagttcgttcactgataacgccttctctgggtgcaaatatggttgtttttgcccgctgggttttttccccttctaattgtgcctgtaactgccggtattctgcttttgccgcatttaaggcggatgaggatgaatttgcctgcattttgtatttgtcaaattcactggcagaaatgacccctgtatttaccagtggttttacacgcttaagttcagactgtgcctgattactcatcgcttcattctgttttatcaaagccagcgctttttccagttccgctttggcttgtttgactttttcatcctgaaccagtgtttctaatgtagctaacacttcaccttttttgacatagtcaccttcttcaaccagcacttctgtgatgatatgctgaggaagtgccgggcttatcacaatctcattttttgctacgattgctcccagtattttgatagagggagtgaactgtacagcctgcatggttgtggttgagacatgcatctgctcttggggggactgggcatttgcagtggaaatgaacagggaaaaacaaacgccaagaagagatagaagatttcttgccattcctcgtccttacagtgatcacttaggttagtgttgatattttagatagattagtctatctaaaaaattcgtgcaaccgtgttctgtgtgaaagataggcgagggcagagggtaattattgtttcaggaaactggtgtgtaacattcgaatttatcgatggtgatgtgcacatcgttaactatgggaattatcactaataaaaaatgaagcccctatttgttgagtatgcaactttcagggcttgttccacctttattaattaatagattttaaaatataaataaagtcctagtttttaatgcgacaaataacagagtaatcaccaccaccatgattaccggcgttacctgcacttccttctttaccacttattatatctacaactgttatattaatatctatatttggattccacaaactagatgaccatatgtttaaaccaaatccgttgagagaattaataggccacccattagtgtcgtaaagagtccgattttgataagcattatgtatatccattaattgatctctagtgggtaactctcctaatttattgcagtaatctttcactataatccactgcgccattccccaaatttcgcggtttcttgtcagcttagattcaccatttaactcagcatttaattgaggccgcgagtattttattccgttaagtgtaatgtaatcttccatatgcccccaataattggccttcggcgtatccggactggtgagtacggtaaaaataacatcccatgttttggttaacgtctggttggcttcgccattcacctctaccgacagggtggttcttgtgccaataccgttagggtcagtgacattgataaccagataacctttttcgtcagtatggccgcggtaagtatcctctttacccgccagtacaccttctttcgcctccaggtttactgtgaccgtgtcagctttcttttgacgattaatcgccgtcatcttaattgtcacaggtatacccccaacggcttgacctccgttctcagttttgaccgtgagcgtaatggttttatctctttcaaccttaaccgccatcgtgccatccgcatccttctcaggtttatccggcgttatcgtgaagtcactcgccacgcctttcaccgtaccatccttgttgccttctaaattattgccttcagcagcttcctgccgtgtatctctgttatatgacttgccacgcgccagtttcgaacgggcttgtatcgcaacttggatgactcggccactgtcttccggtttcaaacggtatcccgggatggtattggtgttatttggcgggacaatatgatccttgtcatcactattaaattgttccaccagaaactcgggggacttattgtaatcagggtctccttcgggatatttgataccccataaaaagagggagttatcttggtcatgtccgcctttagcctcaaatttatacgttgcagtcagttcctcatcaaccgctaacttaccgtggattttcagatctgcaatgccggggccccgggaggggtcaataatctgccctatcgtattaccgccctgaagttcattaccttcattctgaccgctgttcttcaaaatatcagttcctggtttgcttctgccatttttgggcgtcaaaacaatttccacaaatttatcaatatcgtcgtcactcagcttataagattcgatctggcccccttgaccatcgacagtgcctgtagcgccctgtttactgatgtcttccggcgtgccgcctattgttgcgacccgcctccaggtgtaggtagttttatcttccacataaccgttattgggctcaaactcataagtggctttcagggttgaatttacagatcggtacccgtgcaagactacattcttaatggaaggaatggcattagggtcaagaatggtgcccggttttgcccctttgggcgtggtttggttgatgttggtgtccgtcataccaatatctaccgttttggcttcaccgacttcgttgtttccgttaacgggcttaacggtaatcgccaccgttttccctgcatccgcttgctccagcgttctggtcaccttgcctgttttgtcctgagcattcttgccgttgtccggtacgggctggtaatcggctgccggagtccccttgtcatgccaggcaaactgggagaggtcggtggcgtcaccgccattaccgttaaaggtatattcggccgtaagcggctgattgatttccaaatcaccactcaggacaatcttgtcgataccgggtttggcatccggatctgccacaccgcctttgccattcccgcccgtaaggccctggttggctgccgggtcggttatatccgtggtcaccggcgctttggcccgcaggttcgccccgttagccgccagtatggacacttccagtaccttaccggcatcgctgcgcgcaataacatacttcactttttcattatccgccgcgccggcggttacccggccttcgccgtttttctgcgtcagtaccggctctttcaccccggcggcatccgccagtgccatcacttgtttcgcggtagtgcctttatctccccagacatagaacgaacggtcagtggtattaccgcctttgtcctcaaactgatagcgggcatacagggtttcattgatatgtaaaatgccattcagttgcagattgttcacggccggcgctttgttttcattaaactcaattaccgtctccttcttcatctccgtgccatccacggtggtggtcagcgtccagtggccggttttctggccggcggtgacgacgacttcatacaccccgtccgacacttctttaacatcaccgatttgtggatcttggccttctcccggtaattgacccgccgcattgaccctgatgctgtcttttgcccctgtaacgggtttgccctgtttatctttcagcaccacccgtaaggttttggtggagacgccatctgcggccagcgtgttactgccatccgccagttcaatggtggagccctgggtatccagcacatcggccagtgattgcccgaaggtgagggtggccgggcgtttgagcggtttaccgaacacctctggcgtgagggtccattggccttttttcgcgcctgccgtgacagggattgcataggtgccgctgcccggcgggatttccttcgctgttccggtggtcggcatttgcccctgaccgtacagctcatggttatccgggatcagattgatgctgttttccgccccggtgatcgggttgccatccttgtctttcaggttcagcttaatcaccgtggtatccccttcattcggcagttcccctttttcggggataaactccgatttatccgggtcaatcagctccgctttcgaagaaccgaaggtgatttctgttggggtatccagaggcttgccgtctatccgggtggtgattttccactggccggttttgtcgcccgctttcactttgaccttataaataccgctgttttccggctcttcccagactttatcaatcgtcggtttgttttggccgtcacccgacagcttatcgccattgtcttcaaatgtgatactgtccttcgcgttaagaatgggcttgccggatttgtccttaagatggagcgtcatgacggtactgtcttcattgttggccgcgaggatattcgtcgccggcgtaaacgttgagccgccggtatcgacaatgtccgtcagcgactggccaaaggtaatgatggccggtttcagcgttctgccttccaccgccggggtgattttccatgtcccttttttctgacctgccgtcaccttggccttataaataccgctgcccggcggatcttctcttaccgcgcccagtgagggagcagggttctggccgtacagttcatttttatcatcggtcagggtgattttatccgccgctcccgtgatcgggttgccgtccttgtctttcaggttcaggacgaggtctgtactgtcgccttcctgattcaggttgccattttccggcttaaactcggtgcgatcggtatctatcatctccgccaatgaagagccaaagtcaataacagtcggtgtcagctcatgaccatcgatcgtgggcgtgattttccatttaccgtgcttggtgccggcagtcgcggtgatttcatagatgccgctgccttccggaacttccctgacttccgtacccagctcaggatctttaccgtcgccggtcagtgtcgttttatcgtcggttaatttgaggttacccgccacgccgctgacaggcttgccgtctttgtcggtcagtttcaggcggataaccgtttgggttttaccgtccgccaccatcgatttctccgcgggttcaaagccggaaccgtcgggattgacggcagaagaaaccacctgtatcagcgtttccatccgctcagaggcattgccctgagtgtcataagcgatgccggacagggtgtaggtgttgttacccttgtcatggaacggcggcagggtcagcaggtaacgggtgcccccgcgaaccggcgccgctgccagattttctgcccgtgccggtgcatttacgctgtcgagtttgccgcctcccgccaccagaccggcggtatcccagacaatctctttcaggccatgctgggcactgacattgacattcagcgggatcaccgcgccgccgcgtccgttaatccggttttccatcatcaggcggatcagatttttcttccggtattccagtacaatctgattattacgctccaccaaatcataacgtccgccttgcagattgcgtttaaaggccacggcatccggatcaacctgttttgaccacggtgtaccgatttcataattcagccccagattaaacagggtttcaccgccgccggaggtactctgccggcgatccagacccagcgttaccagcgggatcggggtataactggcgcccagggtaaaggcggccggatctttctgccggcgctcttcactcagcaaaccgacttcatcaccaaagtactgttcataaattaacttgccgcccagctgtggataggaaggcacataaccttcggcacgcaggtcaaaaccactggccggccgttcttcgtagtctttcagtttcttgccgtctttccagccgctggcacggaaatagccgttcgccccgaatttcataaaatcacgggcgtattcagcgccgaggccaaagcgggtatggtcacgggttatgtcgtggtcaaggaaagcgttatagcccaacatcccggtatcaaagaagtgacgctgacccagcccgaagttggcggtggtgcggctgtcaatatggcgcaggccgaactgggtaaaggccatctgtttttcggtgtcatagagcggcaacaacatgtcgaactgactgccgtctaagcgcccgcggtcatccacattggcctgtaacttgaccgtgccgtagtgttgcagccagttttgcacggtctgattggcttcactcattgccataccgcgtaactgatttttggcactgtccagcacatgaccgcctttcagcatgcctgccgcgcgggaagcggtactggccagccagcgttcggtattattttcagtatggcttaccggagattcggcggcggcggcttgtgtcagactttcagccagtaaatgaccggacggagatttgggcacgtcaatttcatctcctgcgcccagagccgtaaagggtttgtggaaggtacgaagctggttgagttttttcaattccgtcacggtcaggccatgacgcttggcgacggatttaatactttcgcccgcggccagtcggtaagattcagtctgtaatgtctgtggccgggtcgcctgtgaatgcctgggggttttgtcggcggcgacggcgggcgtgaaaacgccggccaccggaaaggcaacctgggcaaagatattcacccaagcgacctgcctgagccgttgttgtgttgtccactgcttgcgttgttttttaagcatcttcaatcaaccttcagaatcaacattatcctcaccagacgggggttaacccgctgatggcttcgactcatcctggagtgctgctgctatccccataatgagttgacaattagtaccaaactgtcaactcacttaagcaggcttattttaaccgtagttaattttttccttccctgcaaaaattacgctaatttattgataataaaccctaaataaatcccccgtctgagagtactcctccccgcgttgttcacgtctttttttactgatcttcctagttatttttctaattctgtactttgttcaaattcgaaagccgtatcctccaaaatgttcactttagcgggtttgtttttctgcaatttcctcattttcagataaaaaccccttagttgacagtttggtactaattgtcaactgttttcgttttcctttcccgtcccataccgtctcgaagcgacccgcattactcgcggtgtagcgcacggtatgacggatgtttctgtgccctaaatagtcctgaatcagccgggtgtctacgccattgtctgccagtgcataaccgcaggcgtgcctgagcatgtgcggattcgcgcaaatcgacaattttgcctttaaactggtctggcggatgattttatacacttgctgacgtgacatccgctggccgctacgggacaggaataaccagtctgagacttcgctgttggcctgtggtgtccctggcagataattcgggcgtccctttagccactgacgtagcagctgaatctcacgggagaccattggatgaatggtggaaaagccatttttcaggcgctgtacgcgcaggctgcggctgtccaaatccacatctgacagctttagactgaggagttcagacacccgaaacccatgaataaaccccataaacatcatgcagatattgcgtgccgcatgagcatgtttgcctgattcagtcagcaacatttcaatttcagattgcgtcaggtacttacgttttaacatggcattcgccccatagcgtgattaatcagacaataattaaatgtaacattgatcagtgttgctgattatttacggagtgcaatgtcagcccgcagaaaaactcccactatggtgattttttgtcggtatacagggaaatatggggaaatagatctttgaattcgcggaaaaaatgagggtggatggttgcactggttttcagtaacccggcaaatctataatttatttttaataatcgaatttatcaataatagtggtaagggcgactctatgaaactggatcttcgtactgatcgttttagtgggtacggtataactcttgagcaactacgagcctttgtgtatgttactaggtgtttggtcctaacatttgatggattaggatttatctctaaaatagccttttaaattaaataattaattcgttcagcttatttcacacggaatgactattttgttttaatatgaaaaacactcctggaaaatttaaactagaaagaagaaggtgaaatcagtaacgggtgttaattttaaatcgattgggtatataaattatggatgacaatatttttcgagccttctgattaaggcgctggccttaatcagaaaatagatacggatattatgatgcaaaaatttttcgtattatgtaggtaaaagaatccatactatcaagccacttaaaattcggctctaccaactctctccctatcgcacccccggcagttatcattagccaggatgccgtctgttctgcattaatctgtttatcaatttcccctgtttcaatacctttacggattaatagtgctaaacgttcccggatttttttttcattttcgataaatattttattaattgtagggttacggctagcttcagcgataatttcgatgctgagacgtgcataatcgggttggttatacaggtggattaggcttatcatcatcttttctatggttgccataaccgagttttcatcatcatcggtatgcaagattttgtcatagtcatgactgtcttcttctgcgatagctgcaataatggcgtttttggttgggtaatagtgaaacagattacctgggctcatgcctgctgccttgcagatttctgctgtggatgttgcatgaaatcctttctctataaaacaggagatggcagcatcaatgatttgtttgcgtttagcgcgctgtttttctgtctgttttgacaaaacatattcctccaaaagatcggatataaaaaattagattaattactctatctaatgttcggatgttattatacagactaaatgtttattcttcttatttaatcgtcagaaatagttttataagtattacacacataaagttgcttaaatattattaatgtccggctgttaatttgcacaaaaacatgccggacataaaataatctgtcagtgataatcgatatcgtctttcgttactgaggtcaattttttaaggtatggagtaataaagtttttaaaatcatccatataactgtaaaatactggtacaaacagtaaactaagtaaaggtgaactgagtagtcccccaataaccgagaatgccaatccggcgccggaaactggcattcgccccgctggtatgaccaacggatcatgccggcaatagggaaatcgtgtcattaaataaggctgaaac

SEQ ID NO: 14941 - DNA, 12087 bp, Xenorhabdus bovienii
  Genomic contig Name=Xb4151_4152.C400
ggtatcccgttgcttgtgttttacaaggccataaagggctggctgttgctatcgtcaatccccgacaaaggccggtgatttgctaaaggcaatggggtaacttagcccaaaccgaataaaatagatgctcaggtgctggcacagttagcctggttttatctcaacgaacagaccgggataaaatagtcaggatattgccctctgctcagcaacgagtcttgcaagccatgatcgcacgtcgtcgccaattggtcgtactttccatctcagaacgccaaaggttggggaattgccatccagacattcgagaaagcatcactttaatgatcagctttatacaggaacagcttaaggtcattgaatctgccttgtctaaacacattaaaacctatcatcgttccaaactcgatttattatctacagtaaaaggcgttgggcctgccacaatagccactttgatcgctgatgtaccggagttgggtaagttaacacgccgggaaattagtgccttgattggtgttgcaccgtttaatcgagattctggatttttccgggggaaacgaacaatctttggaggaagagcaatggtgcgtcgaatgctatatatggccacgttaacggcaattagatttaaccccgttctctgcgctttctacaagagattgaccgaagcaggcaagccaaacaaagtcgccatcgttgcgtgtatgcgtaaattactggtcattctcaatgcaatgataaaaacaaatagaccgtgggacgaatcattccacacggtgtaaagtgaaagacagttgctcattaaccaccatttggtagctgtcatcatcaaagaatattcttcctgtatattctttttctattttttttcaatatatcgtttcatgcaacacattgatgaatatggctggggtaccaggattcgaacctgggatgccggaatcagaatccggtgccttaccgcttggcgataccccaattgaattgttaatggtggctacgacgggattcgaacctgtgaccccagcattatgagtgctgtgctctaaccagctgagctacgtagccatttacgatgtataatgatcaaatcgtaaagtttgtaacagtattcattatgatggctggggtacctggattcgaaccagggcatgccaggatcaaaacctggtgccttaccgcttggcgataccccacctgaatatcatcacttgttttcaataatatggctggggtacctggattcgaaccagggcatgccaggatcaaaacctggtgccttaccgcttggcgataccccacctgaaaacaacacactaaaacttaaactgttatttgaaataacattttaagtacaacccaatgaaagaaatggtgcgggaggcgagacttgaactcgcacaccttgcggcgccagaacctaaatctggtgcgtctaccaatttcgccactcccgcaaagatggtggctacgacgggaatcgaacctgtgaccccagcattatgagtgctgtgctctaaccagctgagctacgtagccatcttttttcgctttgccttcatcggcggtgcggggcgaattatgcgtatatcagaccgatgcgtcaactgcttttttaaagaattatgcacaaaaatgtttgtttgtttggcttgtaatcgctttgccgattttatcggcaaaggaggttaaaattatccgccaagaagatgttgcagcagtacaccgtttagcatcgcacgtttcgtcaaggcgaatgcaccaatcgcagaacagtgatttagctcagaaactaccaccggaagatcctcacggaatgcttttaacacctgcgtattgatgcaactttgaatcgcggggagtaaaacctgttccgcttcggtaatatcaccggcaatgacgattttctgaggattaaataagttaatcgcaatcgagatccctttgccaagatagtgccctacttgtctgataacttctactgccagtggatcaccttcattggctgcgaggcagatcgcatggatattgcaattattcaaggctagctggcttggaaaaccctgtcgtaattgatgttgaactctggtttctatcgctgaattggatacgatcgtttccagacagccaaaattaccgcaatggcagcgttcgccaagtggctcgatctggatgtggcctatttcacccagattgccacgtttgttgcgcagaatattcttattgatgatgactcctgctcccgtgccacgatgaatacgtaccagaagtgaatcttcataattgcgggttgccccgaagtaatgttcagccagtgcaaggctgcgaatatcatgaccaacaaagcaagagatattgaaatgattgttgaggtttttgaccagtggccagttatctaccttgatgtgaggcatatagcgaatgacaccgtcatcgggatcaaccaggccaggcagaatgactgaaatcgcgatcagttcacggagccgccgctgatttttctcgatgaaatcttcaatggcggagataatccggttttcgacttcctgttgcgtattctctggaactgaatagtgctgttccactagcgtcttaccgctcatattaaatagcgccaccgtggcgtcatggcggccaagcctgactccgatggtatggaagtggtgagtttcggtgatgattgagatcgcgcgccgccctccggtggaagcctgctgttcgacttcttttatcaagccccgttctagtaactgacgagtaatcttggttacgctggcgggagcaagctggctttcttctgcaatctggatgcgggatattggcccatgttggtctatcagccgatagaccacggcgccattaagctgtttgaccagatcaatattaccgatttgcttctgtgcattatgattactcatcaggcgatatactcacgatagttcgatttcatttccattaacgatggttttgcagatgttgaaatcatgagtaaatgcagtcagattcgcgaccttaccgggttcaatcgtaccgaggcgtttatcaacaccgattgctcgggctggataaagcgtcaccatcctcaatgtttcatccaaagcaataccaacatattcaacactattcttgacgctctcaatcatcgtgattgatgaaccgctcagtgtgccattctcatcaacacataagccatttcgatagtatattgttttattggcaaaggtaaattgttctagtgtattggttttcgggtcaaggccagcagggacgatggcatccgtcactaagattaatttgtcggtttttaatcgcttggagttgcggatattcggccatgaaacatgcattccgtcacagataatgccggcatagacctcggaagagtcatagatggcactgattagccctggctggcggccggaaatggcgggcatggcgttatataagtgggtggaaaaagagataccatgctggaaaccgtgacgagcctcttcataggttgcgttggaatggccagcagaaacaataatgccggcttcggtcaactgatgaatatacttactttccactatttcaggagcgagtgtgattttagtgatcacatcggcattaatgcacagatagttgaccatttcggaggttggcttgcgtatataggctggattgtgagtccctttttttatgggattaatataaggcccttccagatgcagccccagcgcctgattaggatgctttgtcagataggaacgcatcacttcgattgccgttatcatcaattcatcgggactggtgatcaacgtcggcaggaaactggtacaaccgtagcgctgattggttttctgcatgatattcagcgtatcttccgtaagatcttccagtcgctcattaaattggacgccaccacagccattgacttgtaggtcaataaaccctggagagaggtttgcgccctgcaaatcgtgtttttcaatatgttctggtaattcatttaccgggcaaacgtgctgaatcaaatcgtctgcaatgataaccgcgtggttatcaagcctctcgtacccggtatagataacgcagttagttaaagcgtacattctggcctcctgaataaatactaactagcgaattcactgagaatatccgcctctaactggcgaaaatatttcactgtcttcactttcaattccattgttgcgggttcatcacagacaataatcgatttaggatgcatttgtaggcagcttactgtccacatatggttgatattgccttctattgcagcttgcagggccagtgctttgttcattcctgttgccagaatcatgacttcttcggcatccatcaaagttcctacaccgaccgttaatgcatatttcggaacctgttccacatcattattgaaaaaacgggagtttgcggttcgcgtttcaatggttaacgttttgatacgagtgcgtgaagagagggaagacgcgggttcattaaacgcaatatgaccatcattaccaaccccgcccataaacaggtggattttcccgtaggacttgatcttattttcgtaacgcaggcattcagcatcaatatctgctgcattaccgttgagcagattgatgttttcttttggaatatcaatatgactaaagaagctttggtacatgaacgtatggtagctctggggatgatcttcaggaataccgacgtactcatccatattaaatgtcactacatgcctgaaactgacttttcccgcctgatacagagcaataagttctctataggtggtcagtggcgtactgccagtgggtaggccaagcacgaaaggatgctctgcggtcggattgaatttattgattttgctaacaatatagtgagcagaccaacgtccgacatcgcttgcatttgttagggggatcagcctcatgattacctcttaaatcatttgttattaattatgggggcgactggatagccgtagggcaaaagcacctatcatacctgttctgtcgacgggtttgacccattcaatacctcgaagatatttttaatcataaaataagttttgtgtgccagctagataattgattaaaaatttatcaaatgtggtgacgtttatcacatatcagaaggatttaatttgcgatacaaaataatctttttagactaaaaaatgttttaacaagaaatacataagtgatgtcatcagatcatgaattaacaaaaagactccattaacggagcttcaagggggcaagagtgaacattctaagctacttacaacgtattggtcgggcattgatggtgcctgtggcgacattgccggcagcggcaatattggtagggatagggtactggatcgatccgacgggttggggcgctgataatgcgctggcagcactgcttatcacatccggtaatgccatccttaacaatatggggatgttgttcgcaattgggttagcctatggcatgtcgaaggataaagatggcgctgctgcactggcaggtttaatcgggtttatcgtcgtcataaacctgtgtgctcccgcgtctatcgccatgattaaaagtataccgattgatgaagtaccaaaggcattcgggaagatcaataaccagaaccagtttgtcgggattttggttggggtactttctgctgaactgtacaaccgctacagtagcgtcgagttaccacaggcgttgtcattctttagtggtcgccgtttagtacctatcttaaactctttcctgatgattctggtttcttttatcctgatgttcatttggccagtggtttatgactggctggtggcattcggtgaaagtatcactaatcttgggtcaacaggtgcgggtatttacgcattctttaaccgtctgttgattcctgttggtctgcatcatgcgttaaactcggtattctggtttgacgttgccggcatcaatgatattcctaacttcctcggtggtcagaaatcgattgaggctggtacggccattgcgggtatcaccgggcgttatcaggcaggtttcttccccattatgatgtttggattaccgggagccgcattggcgatttaccactgtgcacgtcctgaaaacaaagctaaagttgctggtatcatgatagcgggcgctattgcggctttcttcacgggggtgactgagccacttgaattctctttcatgtttgtcgcacctgtgctttatgttttgcacgccattttaacgggaatttctgtttatatcgcggccacaatggagtggattgcaggtttcggctttagtgccggattcgtcgatatgttgctctcctcgcgcaacccgctggcggttaagtggtacatgctgatcccacaaggtttggtattcttctgcctttactatgttgtattccgtttcaccatcaaaaaattcaacctgatgacaccggggcgtgagttatcagccacggatgaaaccgatggttatgatgttgatacggcaaaacaaggaaggaatggggtaaataacattcaggaagaagcacgtcagtacattgccgcagtggggggatccgataatttgacagggattgattcctgtatcagccgtttacgtttatccgtcaaagactcaggattggtcaataatagactgaccagacatcttggtgcctcgggaattatccgtctgaataaacagaacgcccaaatcatagttggaacccgcgcagagttgattgccagtgccatgaaagaagtattggcaaaaggcccggtagcggcaatcatagaaactcaatactctgagtctgatgttcagacaaaggaagatagccagcaaacaggcattccaatcttgactttaatcgctcctgttacaggggaattggtcaaactggaagatgtccctgatgaagccttttccagcaagttggtaggggatggcattgctattaagccgacgtcggatactgttttttctcctattgccgggactgttgtgaaaattttcgatacaaatcatgcagtatgtattgcggcagataatggtgttgaagtcattgttcatataggtattgataccgtcactcttaatggcagagggtttgagcgtttgattgaagaaggggtgacagttaaagccggtgaaccgttgttgaaactggatcttgagtacttgaatgctcatgctaaatcgatgatcagcccggttattatcagcaatatcgatgattattctggcgtcattataatcgctaaagactctgttattgccagagaatcaaatttatttcaggtgatataatgaatttagggtaatcatatcgcttaagtttcaagaatcactcggatttgtatttgatatttttttgtgtgagcgaatatggattaagccgtcactaacatcttccttttcaaaagtgaggtattcagtgatggcttatcttttttaaagcctcagctgaacatccaacatttgtacgctacggcattatgagagccttgtctgttattactttatatataccctttatcttctgcattgtagttttgttggctgtattccttcatcccagccaaaccgttatctatgctcccggggattcgttcccttaccgtcgcgttgcaactcgaaatccattgagtataaaaatgataaataaaaatttaaatatattattgtgattatttattttgttttttatttaataattcattaattgatttttgttattctttctattaataataatttattatgaatataattttgaaatttatttatttggttaacattaatgtgtgatttgcatcaactttttttaaaaaaagtatttttttatttgaatttcacattgcttgctgtagtttattttaatgcgtttatgtttgattcttgttgcttatatttttctatatttaattctatttcagtatatattattacatttagtttatatctaataattaggtaggaggaattatgtctgaatttctttctgaagaaaaaatggagcagtatttaaaaagctgggatgataacggttatatagttatagaatcagcggttagtagagagcaaacacagaaaacagtcgatgctatattctattttttggaaatggataaaaatgatcccgttaatttttataacaccgatatccgttctcgctcaggaattgatgaaatggggcgtattcctttttatcatcatcagaccttgtgggataatcggcaaagtcaaataatttattctgtatatgaaaaaatttttggtataaaagaactattggtgagtattgatagggtcaatatgaatccacctgttaatgatgattggaaatacgaaggttttattcattgggatattgatgtttcaaaacgtccgttagagagtaaaatacaaggcttattgagcctaactgacgatgatggtaattctggtggatttcaatgtgtaccggggtttcataaagtaatttatgaatggctgtcaaaacaaccagaagggtataatagccgattccctgatacgacaggaatgaaaattgtatctatcccattgaaagctggggattatgttatatttcatggcgcgctgcctggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctgaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccctaattttttccatatatttccaccatattgtgatactgatcctgaccttttaatttcccccagaagataaccacttttatgattttgataaatgagtttttctaaaaacggttttaagcattcaggtattggtcgaatgattttctcacctgatttgctattttcttttggaaccgtccataacatagaatcaaaatcccattctgataatttagataatctaacttcttgcgagcgacaaccaaatacaattaaaactctcaaaaaattactatagtaaggtaaattcacatttgtatttagagactgccacagttgtccgagctcattatctttcaaatatctttggcctttattttgcttttttccaacatcaagaatagttaaatcatccagtgcattacttattgcataccttcttactcgacagaatttgatggcttgcctacatagctggaatataattccagatgtcataggggctgcctgtttaattctatcaaaacattggagccaataatgggtttcacaatcggataatgccatatttccaatataaggatatatgtgtttctgcaattgagaaatgtgtttatcaatatttaccctgttatcttttccgtagttttcaatccagtattcaatagctttttttactgtgactggatttagtgattcctgcattgttaagttaaattggagctttggatctttacccgatacgagccaattacggcacttggttcgtatttctcgagcctgcttgagactcatatcaggatagcgcccaatggtaagtcggtttaattttttaccatcaagtcgatatgtaaaaacccagctaataccaccaactttggacaccttagcgctcaggcttgctccatcagcaaaaaattcgatcttgtcattttttcttccatgtaagatcttaagttttttgtcactgagtttgtttagttcggcagtcatgattactcaaaatatttatacaaatgtttatacacagtctgacgcaagagtggaaaaacgtcaataagcactagaacaatacacagcataacatcataatatatttttgatttataatatatttataaaataacagcaaaacacaggaacataaaataattttatgaaaaagaaactcacaacagaacaacttgcagatgccaaacgtttgaagcgcatatttgtgttaaggcaaaagcagctcggtatctcttctcaagatgcattcgcggacgaatttggcatgactcaaagcgccgtttcacactatcttaatggtgtaaacgcccttaatttggagagagcggccgatttcgccaataaattgggcgttagcattgcagatttcagtccatcattagatcaacaggcaaggaaactcctgaaagcggtctatggtgatgatcctacttttgccacccatcagcatcctcaaaaacaatatccactgctgaactgggcaaatgcaggtaattggtgtgaagaacctgcaccgctatatcctgaaaacgatattgaacaatggcatgaaacttctattgaatgttcaccccatgctttctggctagaagtcaaaggtgattcaatggcatcatcgaatgaattaaacatacagcaaggtatgatcattttgattgaccctgatgttaagcctatggctaataacttggtggtggcaaaacttgagggagaaaaagagctgacttttaagcaattaattaccgaagggtacgatgcctatttaaaacctctaaatcctcaatacaatatgatacctctcaatgaaaaagtgcatattgttggtgttgtcatagaggccaagatagctaagttgccctaacagtggcaataagttatagggatgggggtgtttataaacaaggtgatcgccattttattatatccaacgcacctctgagcaggcttaatatgcaggcaaacattgttccgtcttaaccgtttgttaattcagattgagtacataggcataaaaatctatggtccccaccttttttgcaacactgatttttgattgatgttggcttgcttaaatctatccggcgtcactatgggcagggatgcccgcgcctcgatgagttccgcacctgataagcctaaaaaaccgcacggcttcagagagccattttttatgtcaggattccatcaggtcgataagccgttcatgtcatcaataatcagtcttcgcaaaaccagattgggaactgctttaattaacgattaacctgccagtcagactggcgtcgtcgttacctttcgaacacagtttgccgtgttgtgattgcccaggctatccgggctaatttgttggccagcgcacaggccacaacatttgagtgttttcgctcaagctgagcctttacccattcagccagccttcctgactgataatcgattctctggataaagactctggcgcactggacaagtaaccgtcgcagatttttgtctccgcgtttacttatccctaaaagcgtatttttgccacccgtgctgtactggcgtggtaccagaccggttgaagcagcaaaatcccggctacagccatactgcttaccatcgcccagctgcgatgataagacgctggcagttatcggacccacgcccggtatgtctgaagacgctgtcctgtttcatcacgtctcagctcctgctccagtggggtaccgagctcgaatcgtatca

SEQ ID NO: 14942 - DNA, 16201 bp, Xenorhabdus bovienii
  Genomic contig Name=Xb4151_4152.C401
tctagtagaagtctatcaatacaatgagcccgattctgggctgggaaccattgcaaaacactatcttggtttgaaagggcaattattgaccgggttcagtatgctgtttctgatgtatgccttaacatccgcttatattagtggcgcgggtgaattactaaccagtagcattaatgaatggacaggttcttcattctcattatcaacgggcgtgattttattcactttaattgccggagccgttgtctgcattggaaccagttccgtagattttatcaaccggatctttttcagcgccaaactgatctttctgatactgatgcttggcctgatgatgccccacattcaccatgtcaatttgttatccctgcccgttgaacaaggccttgtgttatctgcgattcctgtcattttcacctcatttggcttccatggcagcgtacccagcatcgtacgatatatgaaaggagatatccgtaaattacgctggatatttatcatcggtagtgccattccattagcagcttatattttctggcaattgggtactttgggcagcattgctcctacctcatttatgggaatattagccgaaaaatctggtctggatggtttattgagcgccattcgtcatgttgtagcctctccccagacagaattatctgtccggatgtttgctaatctggcactcgtgacatcctttttaggcgttgccttaggcttatttgattttctggctgatctgttcaaacgtcaggataatatagcaggaaggtttcagacagggttgctgacgtttgtccccccattgatttttgcgttgttttatcccaaagggtttatcatggctttaggctatgcagctgctgcactgtcaattttagcgctgttactgccgagtattctggtattcaaagttcgtcagcagcataagcgccaatatcgggtctttggcggaactcccgcattagttgtggttttcctctgtggtatcattctcattgccattcagattggcattgtcgctggaatactacctgaggtagggtaattcataaaattatccgcattgatgaacgatgcggataatctcgattatactttccatctttcaagttactgctttattggctgcaaattgaaatctactcagtataggtttattagaagctgaagccggccccaatataaaaaccttctgaaactttattgttacggttaccatttttgccttgcagatcaataacacgataacctgcatccacagtcagcggcttaaataaagtataacggatcccccctgttgcctctgtataagaatcaacgcctgatgtcagccctgatggtgctccataagcttcaccatatagtgacaaggaaggtaacaccgcccagctaaggccggcacccgcagctaacgcaacaccatcttttccttcttttggcgacagataaagcactttaccaccaacgcttgccgttattgggcctacaggcagagcgaaagcggtgcctaaactaccaatttgaccgttatgatcactgcgagtccagtttccattcaaagataatcccgcacttttatcacctagccccacagatgtacttgtgtaatgctttccagcctgtacattcatggaaattgcatttgccacgccagacacaaaaaacaaactggccatgctgacagcaatgaaacttttcatacttctctcttcccaaggggtgaataccaatactatctgagatattttactgaaatccaagtaacaccatagatagtgtacataagtaaatatctcaatttatcaaaatatgtatacccctgcatctttatacatcatcaggtttataaattactttagatataacccatttttccagcacccattgcttgacctgctggcgtgaaatttttatcccaccatttttcaattgtacaggcagcagataacaaaccacagggcgttgaaatgctgcgagcttatcagtaagccagtcagcaagtgtttccgtaagtgcaggatgttgggtttcaatcactacaacgggtcgatgtccaaattcactatcaggaataggtacaacaaaattttgcagaatctgaggatgttggttaataatccgctctatatcttcaggctgaatcccctctcccccactgaaaaattgattgtcgaggcgccctaaaatacgcaattcgccctgttcaaatattcctctgtcacgggtcgaaaaccagccatcggtatctgccagtggattcaattttccatcaagccaataccccagagcgatgctgtcagcgcggatctgaatatcctcatccaccaagcgaatatctttgcccggtagtggatttcccacgcctgataaactatctgcccgttttgcacagaccgttgacgccatttctgtcagcccatagccacaccagcaatgaataccaagttgttcggcctgttgagtcaattccgttggtatcatggctccacccaagagcactgcttttaaagtgagtgcatgttcaaacgattgttcaagcaaacgccagagttgggttggtacaagtgacgcatgggtacaaccagataatgcacgatccaatggattcagatctcgcaacaccaattccgcacctttcagcagccaacgccaaagaatgccctgaccggaaacatgaaacaacgggagcgaaaacagccaactgtcatttggctgaaaatccatgcaggagagaagcccctgcgcactggcaaggtgagccccaatagagtgaaccgctgccttgggcaatccagaagtacccgaagtcaaaatcatactggcagggcgatggatatcccacggcacccattgctctggtatcacagataattcaggttgccaatcaagtttaatcgcctgaatagcagatgaagggggatcggtaaaatcgatgacaaatgtcatgttcagatgaggaagcaattctgccaacaaaggctcagggagttgcggattcagtggcaatactcttgcaccacattgcaatgcactgagataacacagcaggagatcggcactgttttttcctctcaggatcacactgctactttcccacagcccctgttggtgaaaatgggcagcgatggcgttgattttttccgctagttgtcgccaggataacgtctcttcatgcagcctgacagcctgcttctctgggtagagcatcgcccaatgatgccacggccattgcgtccattccgctaatgacattcattgctccatacggtgtccagatcatctagcaccacacaaggaatgggactttctggccagccacggataagttgtgactgaatcagatccagcgtatccagcccgggaagggtatcgggtgtcagccaatgtgcgagacgggcgagctgtgtcaaaccaaaactggtttcgatgctggaactgattactgcttccaaccctgcctgatgagcgtctgcaactaactgacgacagcggacaatactgccaaccagcatcggtttgatgacaatggccgcaacgccttcctgtgcttctaccgtgaaacccgcttcacgcacgctttcatcccatgcaatggcaattcctgtatcacgggcaaatgccagggattcttcacaggttttgcaaggttcttcaagaaaagcaattcgttgccggtaatcgggattgacatattttgcgaagtcatcggcttttatgcgtgtccaactgcgattcgcatctagccgcaactggagatcaggcacggcttccagcaggacatccaccaccataccatcccgcaccgcttcatacagcccgactttcactttagcaatcttttgcccagtcatatttcccagacgcaaaatcacgtcatcaggatctcccgtacataatggtgctttgcgataatcagcctcttcgggtaattcaccctgtagttcagcgagggcacaactgataccaaacgccacggaaggcggttcactctcttcgggttctaccgttaatccctgttcgttttgacaccactgttgcagccatgtcacggcagcatttttggcctgttccagagtttcatgactgaattcgggtagcggggagatttccccccaaccgtgccgttcattttcctgcaagtgcaccagaaagccatcacgggttttaaggcgttgataacgcaaaataatacctgcctccatgggcaggctgaatgaatataaggtcgctttccgcattatggattacgcttgaatctactgaaatcaggggggcgtttttcgttgaacgcattgcgtccttcctgcccttcttcggtcatatagaacaacatggtggcattccccgccagctcctgcaaacccgactgcccatcgcaatccgcattcagtgcagctttcaggcaacgcaatgccattgggctgttttccagcatttcacgacaccagcgcacggcctctttttccaaatccgcataaggcacaaccgtgttaaccagccccatatccaacgcttgccgggcatcatattgacgacagaggaaccagatttcacgggcttttttctgcccaacgatacgcgccatataagatgcgccccatccgccgtcaaatgaccctactttcgggcccgtctgaccaaaaatcgcgttatctgctgcaatggtcagatcacacatcaaatgcaacacatgcccgccaccaatggaataacccgctaccatagcaacaaccggtttcggacaggttcgaatttgacgctgaaaatccagcacattcaaatgatgcatgccgttatcatcttgataaccaccataatcgccacggatcttttgatcaccccctgcacaaaatgccttttcccccattcccgtcaggataatcgtaccaacttcatcatcgtaacgggcatctgccagcgcctgaatcatctcttttactgtcaggggacggaacgcattacgcacctgcgggcgattgatagtaatcttggcaatgccatctacagatttatggtagagaatatcgttaaacccttgggagcaatcttgccattcaatgggcgcgtacaatttttcttcattgggataaagcattgctgaatctccttaaccaaaaagtgataaaaaatggttcacttcggcggcaaacgccgcaggattgccattatgggcgttatgcccaacctgtgggatggtttttaacggcaatgtatattgcttcgcaatattctgaaatttctcatcattttccccacataagtaggcaaaatgtgtggttatgtgttgcagagcaggaaccagccacggttgatgccccagtgaagtactttccaacatatcggcaatccggcttcccctgttttggctacggcaatggataagttgctcacgctgctccgatgataaatcggcaaaaacgggctgttgataccaatcggcaagaaccgtctccattgattcctcacgaaaacgccgcacccaacactgatcatgctgcaatctcgcatcacgctcctgttgagaaaacagcccgggatttccgccttccaccagcacgccccgtaacccttcatgtttgccgtaagtcgcatggtacatagcaatacggccacccagtgagtagccaatcagccaatagtcatggatctgatgtttgaataaggtttcattcaggagatcgttcatctcagcgaatccccctgccacagtaatatcggtcgagtgaccgtggccgggcaggtcaatgaccagcgaggcatactgactacaagcattcaccaagggtagccattcatcaccacatcccaacaagccatgcagccaaaccaaccatgttcccggcttatccgaatgaaatacctgactggcgagtttcacaatgcagccacctgtttccgtaactcttgcaagcatctcacgccttcgctgtctgtgacttttaattcaatcagtgtcgttgttttttgttcccacgcctgtttaacacgttgttttaattcagaccaactttggggcgtcacataattcagaccaaacatagccgcagcgtgatcaaaattgacatgctgcggcatacagtaaaaacgctgacgcgtttcttctggtgtaggcagtaatgaaaaaatctgaccgccattgttattgacgacaatcaatatcatcggtgcggaaagatcacgcagcaaagtcaggctgtttaagtcatagagtgctgaaagatcgccgataattgccagcgtcggtttgttcgttgccctttgtactcctgcggctgttgcgatcagcccatcaataccacttgcaccacgattgctgtaaaccggataacctgcggggagctgccccaatgcatcaatcagacggacaatcaaactattaccgacaaacaactgcccctgttctggcagtaatcgatgcagttgatacgccactgccgcctcaccaaattttccatctaatctggcgttgacacattcaagtgcttgctctgaccatgaagtcaattcatctgcccaaccaaaagaagtagactcttgcgtggagtcagcagaatgttcccgaagccaatcagccacataacaagtaaatttccgtccttggtgattagctgggtcaagcctgccgacaatcggatcaacaatccagaattcttccggctgacattcagcctgccattgcaacagtctttttccagtcaggctggagccgaattgaatcaccaattgcgcctgtgccagaatttcctgaacacggggatgattcagccataagtcagcacaaggcaacggttgcccagtttgggacagcacatcactgatcagtggccagcccatttttcttgaccactgtgcaacgagcgggccttcttctgcattcatccggccagtcagtacaacgccccgcttgttctgccacaaaccccaatcccgcactgtagatgtaacataagtttctgactgcctaagccacggttgattaccctgccaccattctcccaatgtttgttgccaatcttgatacgcgatcacatcattgccatacaaaggttcagcaaacgggcaattaatatgcaggctcccttgttttaagttcgacatgccattatcaacgacagagaccagccaactggcagaaatttctgtggtcggccgcggcagtgaaagcgcctgagtgggatgggaggcaaaaataccgatctggcgaatagcctgattcgcaccacaatcaattaattccggtggcctgtcggcagtgagaaataccagctgctcacctgtcagaccggcttcaatcaaggagggatagaggttggcaaccgcagttcctgacgtcacgataacggcaaccggttctttactcgccttcgccagacccagcgccaaataccctaatccccgctcatcaaaatgagtatggcagatcagtttagcgttccctgcggctgataatgtcaatggcgtggatcgggaaccaggggcaatacaaacatgacgcaatccatgccgggtcagtgcttccaatagaagttccgcccaacggcggttaagtacgctgtttgacatatcgatgcccgagaacttcctttcaaatcaaaaaataaggttcaaaaaaatagagcacattatataaggctttctttatcgtaatacccgtaaaaacgatttctttatcttagttcaataaattgtcatttaattagcaatatttcccctgcaaactgggagcacataaggtcaatcgccaataaaatcgggcgttttcggccaaaaaaaagagaagggatgaataagaaagggtaaagcccagccataaaaggagattatggctggtaatacggacttaattataaatgatggatacctttgcggtggcgttggcttgacctgcggtgatcatattttctatctgtatatagtgagctttgaaaggaaccgagtaaattcccatcgggctggtgccaacctttaaaacagaatttatcattaccggttgatcctgatacagaatctgaagaccaattcctccggccgtagagttactccctctctgatcaagcgctaaaatacggttgtcatttgacactgtatttccctcaaattttagcgtaataggaatattgtcgtcacaatccagatcaatactgaaatcttgtgctcccgcagtgcgcggattacctgacaattcccacatcccgattgatcccatagggacaataatattctctttagccaaaatacagctttcagttgtgaccagtgcatcatgaatatgataagtatgcacaatagtagaacctacataagcttgaatcatcccatttttaatcgggccagtccctgttttggggtttgtcttaatcagttctatattagaaccatacatccgtatgcctatcccagacacgcctgaatcataagtatcatcatttctgctactggttggtgtatagccaataaatttccatgatattttctctggtttatcgcaatgaatccccaatatatcttgtgggtttgaaataaccggatgtcgataaatcacagctccaggcatatcgtttctggaaataaacaccttcggttgaaacacggcagataaatcctgttgtttcctttcatctttaatccggcaacttccctcactgccataaacatcagcagctaaactcaccagcaggataaatattgccagtaaaaatcgataattttgacggaaaatcagcataagcctgatcctgatacggtgttattcacaattcaccttcattgtattaatgccagatagaggatggcctgataatgtttgcttttccggcaaggtataattggctagacacgttttggtattctgagagccccatttaacctgtaactttccacgggtcggcattcccgtgaaataggcttgcccttcactactgacaattgtgctgctgggcttgtcgagatcatgctgtttctccaacgtagcaatggcaccaaaaggcactgactgaccttggtatgaaagaaacatcaataccctgctgccaattcgtgtctgaaaattagccagagtaagcgcaccttttgtcggaacaacaaattgcgtattgatatcaatatcaacatcatcagcaaaagaatgaggatcaagtgcgacccggttttttcggtaactgctggcataaggtacaacggcgtagccgttcccgtcagtagtaacgcccgtattattggctaccttgacgccttttgcgccttcggctcgaaccaataccgccgtttcgcccagttcctgggagaaagtcagaccgtaagggtgtgcaataattcccccactgacaccgtaattcatctgcctgccgtggtgttgatagttataaccggcattgagccgaccataggctcccttatacccggcataaatatttccactgacgccatccccttgattggtataactctgttgcaggctgtagtgcaggttattatcctccagtaccgtaccattcaggctgacctgttgcgaagcggggctgtttttacctgaagtcaggctgtaactggcccaactatttttcagccagcggtcgagaggcacatgaacactgaatgagaataattggtcatgattgccagagtcgggagtgcggctataggtataattcaagccgtaattgataccacggtgactcatgttataacccgcaccgagaccacgttcatgactactctgcccccagtaatcctgctggaatgccgtgacatacaatccgccgaaatcccccaatatttgattaacttgcacttgtagtttgcttttcttattgatacggccaaacaaccgatggttgctattgaggttatcagcatgattggcatcatcgaaatcgtaaaaacctttagtcgaatagcgataccctgccacagttaaattcgttcctgtcagtgaaagcgctttcaaatactgtagtcggtaagcctgcccttgggattttttgtctgatggcaattgggtattagcatgggtagcatcaaaagaaagcgagccgacattgcccaaatcgattcctgaacctaacaccatagattgataatcacgggataacatgacaccaccatatgcggtgagattattgtgaagcccgtagatcaaagtaccttgaaagaaataaggtttgcgactgcggctgtagggtgagcgataatgtcccattgtcagcgaatatttcaggctatctttcctcagcataatgggtgcagcagaaaacggttgtataaaacgacgttcccggccatccgcttctttgataatgatttctaaattcccactggtggtggttggataaagatcggttaatacaaatggcccctgtgcaacataggtctgataaatcacatagccattctgcttgattgtgacctgagcatgactttgagcaatcccgcttacaaccggtgcaaaacctttcatactgtccggcagcatattttcgtcagaagcaagctgaatcccgcgaaattctatcccatcaaaaagataagaaggcgtgaaactatcaccgacgatcaactgtcctttgagagcatgaatatcacgttgaagataagatttaatactccgccaatttttgtgctggctggtataagtggaataatttcgcaaacgccatgcctgccaattaacgccggtttgcagatttaaataattgttctgattggttctccgattatcctgccagtttgttgacccactataatggtagttaaccaataaagccgtcattccctgatcccatgactcaggcgaaatataacctctcacctgatgattcagcgcaatttgaggaatgctgatatccagccgttgtcgattaaaatcaaacttcgtgctggctgaaggaatatactcgctgatattagtaatcacctcttctgacggtaaattcatcaacaccggaaaagcattgattttcacccctaaatcctgcaatttttgcacagtgagttttggccgcagttcaccatcatttaaaataaattcaacattacccgtatcaatactttctttattcaaataggtatcgacccaatatttaccaggaggttgcgtggaagtattaaaaatagaaagatcaatatcatcaggaaaattatctcctattctcagcgcatggatgttgaaattattttcagcataagatttaaaatgataagaaaaactccctatcataataaatatagacagccataatcgataatacttgccttcgcataatctcttggcaatattatgctttatattttttgacatattcaatattctgacaatctaatgaaaattaataaatagcctaaagacctgcgaattcttcctgtgtgactccaccgtaatcattgattgctttccagctgacacttttcgcatttttgacaggcaatggccaatttgcttggctgaaggggttaaccattcccgccccttcgacttcttttccgtccacttttagatgtgaaaaagaaataaaataaggtgtcgaattctctgcaattaatacaccattttctttcctgaacttgatacgcttataagcctcccccgaattttcttccagttgtgtagggcggtaaaatagttttaatcgcgagttaacaacaatctgtaactgattgacatctgcatttgattttacagtttcaggaatagatgtcacattcagccagaatatagactccctatccattggcaatccatcactcactttaataatccgcaaaatattttcgttatttgcgggtaacttaaataaaggaggtgtcacgataaatggagtttttgttttctcattttcatcctgaatccagctctgaataaggtaaacagattctttctctaagttattgacagatacagaaacctctttcttatcacttaagtaaacaacacgagttcctccaataaccacaccacccgccattgcaaaatgactactgaaaaaatataaaaacatcattatcaacaaacgatgacactgcacagtcgtttctccaatcaatcatgattaatgtatttaattaaataaggcatccctgccttatatttaagtgtggaataccgtgatttattagttatacactacagtaaaacgcgctaccgcattagccgaacctgcggaaacattgtcactcgtcgctacgtatttagcaataaatggcaactctgctgcccctttttcaattgcatatgatttagaatctttatataaaccaaccagattgtctgagttatcttcataaataccgatagcaacgcccttggcatttttgctgtctgttgtcagagctaaaagtttgcctttgctttcatgagaagaaccatcaaatttaacaagcgcatttttaatttcggttgggcattcagttaatttaatactgaattttgttgctgccgcaactttattttcaccagaaaattctttaacactaactttacccatattcaccgtttgatttgcagaagcggcatcaatttcacacgttttatccgttatttcacctttaaagttaaccgtaccaatagttgcatttgcagttgtagcaaataaagaagatacaaataaagaagaaataatcagcttgaatttcattaaattaaacctcattaatcaatacacaaaaacaattcccccgactgatacaatacgatagggaagttagttcattaacttaatagatactcatgcagcatgtagagtacctataatcattatcttttatccagtcaccctcttacgtggccagttcaagggtttgtttggcaaatcacagataagacaagacaatagtagccttaatgtcatatagatcaacataataaatcgataaatattaatatttagaatattacaccaaaatattgagaaatatttactgaatgtcattatatatagatgaaattaatgaatataattctaaatatttaaatatttaaacataatatataattatcaaactaatgattatcatcacttactaaatattaacgatagttttcttatcattataaaatgatcagtttagttatatttgcaataagttaccgggtcatgactccaaagggttgtaataatgtttttcaatatatgcgccaatgagttttttgtggatttccattgaacgtgagtaacaaatggttctttttgccaaccttttgatatgaattcgcagactgagattatgccactctatacgttgggtaaaaattttgcctaccagatattttttccggcataacttccccagttatcggtcgtgatgaaacgaatattaaaaggcaccaataagttgagcaattttcggcaggttgcatccgttcgggggccaaagacatgggcgatgacttgtttccttttcgtatcaaaagcataccaaagccaatgacgttactttttattgcctataaaagaccactgctcatccaattcacagataagtgtgacatcgtcataagcgatctatcgcgatgttacttgttttggcgagagttttttaatgtccgcatcaccgtattgataccgagacctaatacacggcctgtgtctctcacgccagagccattcattgccatatccacaattttttctttcatatccggtttatggccgttgtaacgatagttgagttgaaaggttctttggcaacctttgcaatagtagcgagggaagccggccttacctgttccgtgtttgcgtacaggttctgcttggtcgcaatatcgacaagtcacttctatcgtaacagtcatgatgatatcccattaaaaagtacaagaatatcaaattaacgctttgaagtcatgaccgaaacagtatcgttagttatattatcgatgtgtgatttgcatgattgatatgaacccgcagaaagttgcgggttagaattttagttatttttttatttcttcgagaggagaatagcgtgactctatttttacattaacaaggaattcacgagaattatcaccgtaattacctggggagtcaaagaacacaaatattaactccccatcctcaggaaccgttttatgaagcacaccattccctattccgtaggttttattaccgattttagcaatgagtgtgtcgtgtagcgtcggttttttaggtaaagtaccctgaggtgctgcccagtagttgtctggatggccatacttcacccatcccttagcaacaatagatataacatctcccgccttgaggataagccctgtgggttggcctttttcaagtttagcaggaacagctccagaccaatcgtacatagtattacctccaatcattatgttttgaaagcgactttatcagtttatgaaggcgggctacttctccgcctgtgaacatccataaaataggttcatcaatactggagagaacttctgattaggatggcatggaatggctgtttggaaattaataaaatccatatccccctgataaaactatgagtttaaaggggacaatcctcccctttaacttaactcattgatattgcttatttctgccagagagccagaattccggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatgaataacgggggaattcgtgacaccgctcggatcctaaaagtcgccaccgccaccgtcatgaaaacattaaaaacctcagaccccgaaacgtaacgacacttccccttgcggaatgtggcatccagattgtctgtgaaatcgacgagcaatggtcgtttgtcggcaataagaaaaaccaacgctggctttggtatgcttgggaaccccgcctgaagcgaatagtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttactcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaatacctaatctaatcatttaatacatgaccaattccttggggtctggagcagggatggggttttaagtaaagtaaaaacagctgtatacatgggtttttataacgataatatgtggagggagttagcgacaggggaatattcagagcacgtccctgtatataatagaaatttcagagaatggcaaaagaaacacaataaaggaggggattttattgttttttcagatgttttatggatttctccgctgccaaaggatagagtgatttatttatgattgtaaaaaaaacagcaaagtatattttatattttatgctgatcatacttttcttatggtggttaatgagatggtccccaccaccctgtgagcggtatgctggcagggtgtttctttcaggagaagaccatcatgcaaaacgttacgcttattggtattgatctcggcaaacattctttccacgttcactgtcaggacaaatcaggaaaggccctgctgcgtaaaaaatttacccgcgccagactgatggagtttttagcgggatcgccatcagcgactgttgtaatggaagcctgcgccggtgctcactttatggctcgccggatcgctgcttttggtcacgaagcgaagctgatttctccacaatttgttcgtccttttgtaaagagcaacaagaacgattttgtggatgctgaagccatatgcgaagctgcatctcgtccctccatgcgatttgtgcaaccacgaacagaggcgcaacaagctatgcgcgccctgcatcgggtcagagaatcactggtcagagacagggttaaaaccactaatcagatgcacgcttttttactggaatttggcatcagtatgccgatcggaaccgccgtataaaaa

SEQ ID NO: 14943 - DNA, 15211 bp, Xenorhabdus bovienii
  unsure (1)..(15211): unsure at all n locations
  Genomic contig Name=Xb4151_4152.C402
gatacaattcgagctcggtaccctggctttgttagactaaaaaatgtaaaaagaagtggtttttccacctcttttttacttctggtatacctttttatatcacctcatgaaaatttcacatgagagttgtctatataaagacgactatctatgaaaatcgaccaatcaaacaatcaaacaatcaaacaatcaaacaatcaaacaatcaaacaatcaaacaatcaaacaatcaaacaatcaaacaatcaaacaatctcattgttttgcaattatgtggtcgttttccagatctaaagtaaccaattttccgggaattagtttgcctgaaaggatcttctgagccaaagggttttcgatctcttgctggatggctcgttttaatggccgagcaccatatacaggatcaaaaccagcatcactcagtttctctaatgctgtcgatgtcatcgtaacctgatagccacgctcttccaaccgatggtataaacgttgtaattggatattcgcaatggatgtcagatgttcttttcctaatggatggaacacgacgacttcatccacacggttaataaattcaggtctgaaatgatgaccaactacttccatcaccatatctttcattcccgtataatccagtgcaccaaaacgttcctgaattatatctgaacctagattagaggtcataattataacagtattgcgaaaatcaaccgttcttccctgtccatccgtcagacgaccatcatccaatacctgtaacagaatgttgaagacatcaggatgagctttttctatctcatccagtaaaatcactgaataagggcgacgacgcaccgcttctgtcagataccccccctcttcatatccaacatatccaggaggagcccccaccagtcttgaaacagtatgtttttccataaattccgacatgtctaggcgcaccatcgcatcatcactgtcgaataggaaattggccaacgctttgcacaattcggttttacctacccccgtcggccccaaaaacataaaagaaccaatcggacgatttggatcggataatcccgcacggctacgacgaattgcattagatacagcctcaacagcctcattttgcccgatgacacgtttatgtaattcatgctccatgctcagaagtttatctttttcactctccaacattctggatacaggaatccccgtccagcgagcaagaatttcggcaatttcggcatcagttactttgttacgcagcagtttcatatgatggctttctgccgttgctgccgttgctgccgttgccaaacgtttttccaattctggaatttttccgtactggatttcagacatcttcgctagatcaccactacgacgggctttttctaattcaaggcgcgtattctctaattctgctttaatgttctgagtgccagtcagctctgctttttcggctttccactcttcttccagctcagaatattcgcgttctttctccaccagctccatattcaacatttcgagtcgttttttactgccatcgtccgattcttttttcagtgcctgctgttcaagctttaactgaataacccgacgctccaaacgatccagtgcttctggtttagaatccatttgcatacgcaaacttgctcctgcttcatcaattagatcgatggctttgtctggcaacatacgatctgaaatatagcgatgagacaaagtcgcagcagcaacaattgctggatcagtaatttgtacatggtgatgcaattcatagcgttctttaagcccacgcaggatagcaatggtatcttcaacagttggctccgccacatacactttctggaaacgacgttccaaagcagcatctttttcaatgtactgacgatattcatccagtgtcgtcgcaccaacacagtgtagttcaccccgagccaaggcgggtttaagcatgttaccggcatccattgcgccatcagccttacctgctcctaccaccgtatgcaattcatcaatgaacagaatgactgagccttcctgtttggcgagatcgttcaaaacacctttcaaacgttcttcaaattcaccacggtatttcgcacccgccactagcgctcccatatcaagggacagaacgcgtttgtttttcagcccctctggaacttcagcattaataatacgctgcgccagaccttcaactatggcggttttcccaacacccggttcaccaataagaacagggttatttttagttctacgctgtaatacctgaattgtccggcgaatttcttcatcgcgcccaatcacgggatctaatttgccctgttcggcacgttcagttagatcgattgtgtatttttttagtgcctgacgctgatcttcagcaccttgatcactcactttctcaccaccacgcatctgttctattgccttagcgattttatctttggttgttcccacagctttaagtatgtcacttaatgttccacgttcttctattgccgccagaacaaagagttcagaagaaataaaattgtcacctgctttttgcgcaagtttgtcacacaagtttaaataacgccccagctcattggatacctgtacatcaccaccattaccctctactttcggtaatcgacctaaggcttggttaagttgattgttgatgctactcgtatcaacccctgccaatgttagtaagggacgaacagagcccccctcttgatgaagcaatgcgctcatcaagtggatcggttcgatgaattgattatcacgccctaatgcaagagattgcgcgtcagcgagagcaagctggaatttattagtaagacgatccagacgcataacacctccaatactggtcagaatttgctactggaaactagataaggtcattccttaaatattcaaggtactctgaaagagttaattggaaactaaccactaaacaccaaaaatcatcctataacgccgattatctcagccagattaaagttgccatacgtccagtgttaccatcacggcgataggagaaaaagtttctttcctcagtggcagtacaaacagcccctccaaaaacttcatttataccaatagactgcaacttcaatttagccagtaaatagatatttgccaaaaatttattaccataaggtgtaaaggcttgttctagctcaggattggttacaacaaacgcatccataacttcacgacccacctcaaatttttcagggccaatggctggccctaaccatgcgcggatcatttcaggttttgcgctaaattgagtcacagtattttctagaacccctgtacataacccacgccatcccgcatgcgccgctgcaatttcattccccgcaatggtgcagaaaagaacaggcaggcaatctgctgtcatgacagcacaaacctgcccgggtatattcgtgtaaacagcatcagcctgattatctttcactggctgaccatccagattgataactcgagttccgtgtacctgttccaaccagacaggttgttgtggcaactgggcatattcaaccagcagttttctgttccgctccacacatttcgaatcatcaccaacatggttacccagattcaaactgtcataaggcggtaggcttactccacctaagcgggttgtgctgcaagcaccaacattatcaagctgtggccaatcaggaaaaatcagtggggtcatttacctaccagtccatctcatctttgaaagtttcagcatccgctttcatcacatcaatcaatttaaccatatcatctggtaattctgcatgccattccatctcaataccagaaatgggatggtaaagtcgtagcatggtggcatgcaatgcctgacgatcaaagttgcgcatcacttcgcgaaattcgtctgaagcaccttttaacggacgaggacggccaccgtataaaggatcaccaaccagaggatgcttgatatgtgccatatggacacggatctgatgtgtcctgccagtttccagtcgcagacgcagacgagtatgtgcccggaaatgttccataacccgataatgggtaactgccgattttcccataggatgcactgccatgtgtgtccgttttgtcggatggcgggatataggttcttctaccattccccctgctgtcatgcatcccaaggcgatcgcttcatattcacgggtaatttcacgcagttgtagggattccaccaagcgggtttgcgctggaacggtttttgcgataaccatcaatccagtcgtatctttatcgagacggtgtacaataccagcgcgggggacatctgcaattgcaggatagcgatataacaaggcattcagtacagtaccatcaggattacctgctccaggatgtacaaccaaatcacgcggtttgttaatcactagaatatcatcatcttcataaacaatattcaactcgatatcttgtggttcccaacgcgcatcttcttcaatgatggcatcaatggaaattacttcaccgcccagtactttttcttttggcttattgatcaatttaccattaacctgaactttattatccaaaatccattcttttatacgggatcttgaataatcagagaacaattcagccaaagcctgatctaaacgttgaccgagctgtgtttcagcgactgttgcattaagtcgtattttttgtgccatatataaattctgtattttacgttgagttttgacggcaaagccgtttcatttaaaataatatgctattgtagctctatcttttgctgggaacttcatggatagtctcccagaaaacactcagaggataatcaacacgtgatgattcgcatgaaatatctggtggcagcagccacattgagtatggttttatctggatgctccaacaataaggatgctgttcctgatatcccgcaatctcaaatttactcagccgggcaaaaacacctgcaagaaggtaactataaaggggctatcaaacaattggaatcccttgataaccgttatccttttggaccgtactcccaacagactcagcttgatttgatttatgcctattacaaatcagcagaattcccaatggctctcgcatccattgaccgtttcatgcgtctgaacccaacccatccgaatatcgactatgtgatatacttgcgtgctctgatatctcaagccttggatgacaatactctgcaaagcttttttggcatagatcgttcagatcgagatcctgaacatgcccgtgcctcattccgtgatttcaacctgctagtcagccgttatcctaacagtcagtatacgtccgatgctgccaagcgtttagtcttcctcaaagaacgtttggccaaatatgaacttgcggttgtaaaatattacactaaacgcagcgcttatgtggccgttgtcagtcgagttgaacagatgttacgggattatcctgatactcaagcgacccgagaagcacttccttacatggaagcttcctataaggaattgggtctgatggctgaagcagataaagtggcaaaattaattgcggctaacccagtataagatttaagaaaagtaaaaagcatcaacagcagctacggctgctgttatttttcatagttcaaatgccctttttacggcgctacgcttaatgaacctataacctgctttaattagtttcagcagcaactagccctaggcgtaatgtatcttaagattatcaaccgtcttgataataccataactgaccaataatgatgcataatgcccctcttagcaataaatattctctatatcttcctcaccaatcacacttctgttacttactgtcaaagcagcccaataaaagtgatttagatcattctttttatgtcaaagaaaggtatgctgaaactatcgaagacggagtaacataacgaggtaactatatgttagtgaacatcaccagcaaacaaatggaaattacccccgcaattcgtagccacatagaagaccgtctaaacaagttgaacaaatggcaagtcaacctaattagtccacatatcgtactcacaaaagaaccacaggggttcttagctgatgccacaataggtataccaaacaatacattagttgctagtgcaaaacatgaggatatgtacgctgccatcaacgaactactaacaaaattagagcgtcaactcaataaagtgcagcataagggagaagcacgccgtgcagatcacagcgttaaagactccaactttgacatagaagtttaatcacagcttaaccttatttaacgcgctcaatgagcgcgtttttattgccctacagagcctttctattgacactccacatcaaataagttaattaaagtatattattggcaccataaaaaagtaatacacttataaatgacatggctataaaactgtttttcttctttttcttttttaccttctcatgaggaggttttttcgttttaaaaaggataaaaagacgaacaaaaaacctccctatcaatgggaggtttttttttgcagaccatcatctatatccataataaaaacgtcaggaacatgctatggaacgaaatttagttaatatacgagaagaaatcagcagtattgatgcagatttactggacctgcttgggaaacgtcggcaattagcctgtgatattgcgcagactaaacttctcgaacatcgccctgttcgagataaagaccgtgagcgagaactacttaatgtgttaattaataaaggcaaaattcatggtctagatgggttctatattacccgcctgtttcaaatgatcattgaagattcagtattaacccagcaagcgttgcttcaacagcatctgaaccagacaccttacgactctgcacgcattacttttctagggccaaaaggttcctattcccacattgcagcccgtcaattttcggcgcgccatttcaatcagttgattgaatgtagttgtcacaaattcccagatattttttcgctggttgagattggtcaagcagattatggcatcctgcctctcgaaaataccagttctggagcaataaatgatgtttatgatttattacagcagacaccattattccttgttggggagataaccctgccaataaatcactgtttattgattggtaccgagactgatacgtcaaaaataaaaacagtttatagccattctcaacctttccagcaatgcaaccaatatctcaatcaatttcctcattggaagattgtctattgtgaaagcacggctgctgccatgcagaaagtagcagggctcaactcgtcagaagtggcagcgttaggtagtgaagcagggggggcactctataaattacgagttttggaaaacaatttggcaaatcagcaaaataatagtactcgctttattgttgttgccaaaaaacccattgatgtgtcaaatcaggttcctgccaaaaccacgtttatcatgtcaacaggacagcaggctggtgctctggtcgatacgcttattatcttgaaaaaacacgatattataatgagtaagttggaatcacgtcccataaacggcaaaccgtgggaagagatgttttatattgatgtacaagccaatcttcgctccatgaagatgcaacaggcacttaaagaattgtcagaaatcacccggttcttgaaagtcttgggatgttatccctcagaaaatgtgacttctatcgatccctgttaaaatagaaaaccggatgttttcatccggtttcacaatttggaatcgatgtaaaatgcactatatccggctatcactcgcctgctgcaaaagagactgactctctttcataaatcgagtggcttcatcaccaaaccactcattcacttggttaaaattcgcaataaaagccgacttatcctgactttccagcatttcaatcgcctgtccaaaactctggtgataacggcggatcagctcaatattttcaggactggacataatgatatcggcatataactgaggatcttgggcaaataatcgaccaaccatagccaattccaatcgatagattggggaggatagtgatatcagttgctgcaaatcgatatcctcttttgcaagatgccgaccataagaaaaagtagtgaaatgacgtagcgcttgaatgaaactcatatttttgtcgtgctgctctgcgctaatttgatgtaatcgcgcaccccatactgatatttgttccaaaaaccattggtatgcttcgggctgacgcccatcacaatacacgacaacctgtttggcaaaactgcccacatcggatccaaacataggatgcaaccctaaaacagggccttgatgaacatcaagcatcgcctttaacggcctttgtttaatagaggccaaatcaaccaaaacacactgttccggcaaaggaggtaaacggcggataacctcttctgtcagatgaatcggcacactgacgattaccatccctgcatctgccagtatatgttcagccttatcccaatctcctgactcaagaacccgaacttcgtagccagataaagtcagcaagcggctaaacagtctccccattttccctgagccaccaataataaccactggcatcagatgggtactgagttttttgaatcctttatcgttctcacttacgtaggactctcgcataatgcgccgcaaaatatcttcaattaaatctggcggaattcccatagcttcagcttcttggcggcgggaagccagcatggacgcttccctttctggtacgtaaatcggcaaacccagttgactcttaatttcgccaacttctgccactaaatacattcgcttcgccagtaacgccaataatgctttatctgcctcatcaatttgttcccgcaattgtgataattttgctaccatatcaattatcctgctttttccatcatcatgttacgttttgcaaaacgtggggctatttgttggtgtaattttcttaatacctgctccgtggtttgccagttaatacaggcatcagtcactgaaacaccatatttcatctcagaacgaagctgttctgaaggctgatttccttcgtgaatgttgctttccaacataataccaatgatagatcgatttccagacataatctgttcagcaacagaatccactacgatgctctgacgacgaaaatctttattggaattaccatggctgcaatcaatcattaacgatggcgttaaacctgccttgatcatttggttttcgcagtcagcaacatgctcagaactgtaattcggttcagcaccaccacgcaggataacatgcccatttgggttaccttgagtttgtagcagacagacttgccctgactgacttattcccatgaagcaatgtggcatggcagccgctttcatggcgttaattgcagtattcaaattaccatcagtcccatttttgaatccaacggagacagacaatcccgatgccatttcgcggtgagtttgtgattctgtcgttctcgccccgatagctgaccaactgaataggtctcccaagtattgaggattattaatatctagtgcttcattggccagtggtaatcccattttaactaaattcattaataaactgcgggcaatatgcagcccagcatctatatcaaacgaaccatccatatggggatcactgattaagcctttccaaccaactgtcgtacggggtttttcaaaatagacacgcataacaatatacaggcaatcacttaattcagcagaaagtactttcaggcgacgggcataatcgagggcagcgtccacatcatgaattgagcaggggccacacaccactaacaaacgaggatcacggtgctgaataatatcagcgatggtattacgggcatttgtgatggtatgcagatcgttgcgactcaatgggtatttctgtttcagttcctcaggtgtgataaaaatctgttcaccaagaatatgaatgttattaagtgcacctttttgcatgatcattttctatgccagccttgttttgttaagtttttttttgagtgtcaggcagacaacataccatgcatagtaaagaatacaatccaattgtgtaaataatttactattatcgtaaataattatttacatcaagagtaagtatactatcggtgactctatagcgttaacaattcctttgattttttatttccataaaaaaagattaattaatctaaatatttcatgaattgatatcataattatatttacaatggaaatactttattaaaaaataaatatctttataaatcattcaataaaaacaagatttaaattctgtctttatatatagatttcattaaaattaacatattattttaatgcttatataaaaccataaaataatatttataattaatggctaaataaaaaatcttaaagaccagagttattaatttttattcgtttattaaaaataaatataataattctagaatttatcataataatcaaataattattaatagacacgcgttatgctggcatgaaattgggactgatcggtgatattactctttttatactgacatttgtttttttttggctgagaccaagtaggctgcctgtagatgtgatgctcaccattcttgcggtaatctgttgtgtatctacttcgcaaattgcggatgaattatcgatgttccactctcaaagccaccacttttttattgatgccatttattctcgtctccacgttatttttggatctggctaatatattcattgttaacctatctctttttattttcgctatcgtgctcttaggaatcccatactgttcagctcaccttcatcacaaattataaagtactatcttaatcaaaatcatctgctcaatagtagtgccgaatatgaaattaatttttttctaaatcaatttctcaaagaaattttttcctgaagaagaagtgtatgaagaatatagttcaagtacgatggcaagactctacttttagacgagttttaattacaaaaaataccgtaccgtatagaaaaaataatgccttgtaataaataattagaggcctgcatatgcaggcctctataactttcggatgtagcgaaagcatattatctagcgttaagacgctctttaatacgagccgccttaccagaacgctcacgcaggtaatacagtttagctttacgaacggcaccacgacgtttaacactgatgctgtctacgacaggggagtgagtctggaatacacgctcaactccttcgccgttagaaatcttacgaacagtgaatgcagaatgcagaccgcggttacgaattgcaataaccacaccctcgaatgtctgcagacgctttttagaaccttcaacgacccataccttaacttctacggtgtcacccggacggaatgaaggtacgtcttgcttcatctgctcttgttcaatttgtttaataatgttgctcataataactctcttaccctagataaactgatatatcaaagacatgccttcacaggatatgcctggattaactcgttgcctgatcctgatattcctgttggaattcagacagcaacatcctctgctcgtcagtcagagctaggctttctagaagttcgggccttcttaaccaagttcggccaagcgattgtttcattcgccagcgattaatttcggcatggtttcccgacaataaaacagggggaacttccatcccatctaacacctcagggcgggtataatgtggacaatccaataatccatcagcaaacgagtcttcttctgccgatgcctgatgccccaatactcccggaataaaccgagatatagagtcaatcatcgtcattgcaggaagttctcccccgctgagaacgtaatccccgatagaccattcttcgtcaatttcggtttggataacacgctcatcaataccttcataacggccacaaacaagaatcaatttctcattttctgccagctcacaaactccctgttgatcgagtttgcgcccctgtggtgaaaggtaaatcacctttgcattaacgcctgccgctgctttggctgcatggatggcttcccgtaacggttgcaccatcattagcattcctggaccaccgccataaggacgattatcaacggtacgatgcctatcgtaggtaaaatccctaggactccagcattcaatactcaacaggccattttttacagcccgaccagttaccccgtaatcggttattgcgcggaacatttcaggaaacaggctaataaccccaatccacatacagcgtcccactcatttaaaccgttttaaccggagattaaaaactaggatcccaatctacttcaatagttttagtagcgagatcgactttcttgataacctgcccatcaagaaacggaactaaccgttccttgataccgaatgcatctttcaggtttgcttttattaccatcacatcgttagaacctgtttccatcatgtcgttgatagttccaaggttataacctgcaatacttattacctgacaacccataaggtctttccagtaataatcaccggtttccagttctggtaatttggtagaatccaccaccacttcacagttagtgaataaattcgcagcatcccgatcatcaatatctttgattttgatgatcagatcctgattgtggtatttccacgtttccagctcaacatgttgccactggcctgaacgctgaataaaccacggttgatattcaaaaatgtcttcggtacgttcggtggaagaaaacactctgagccaaccacgaatgccatatgtggaacccaatttccccaacactattggatcaacaggcggctccaggcccgtttgcttgctcatagttgccaccgcgacagattaagctgctttagctgattttttagcatctttgatcagtgcagaaacacgatcagacacagatgcacccagaccaacccaatgttcgatacgatccagatctaaacgcagagcttctgcttgccctgatgcgatcggattgaagaaaccaacgcgttcaatgaaacgaccatcacgcgcattacggctatcagtcacgactacttgataaaacggacgcttttttgcgccgccacgagctaaacgaattgttaccataacatcctcattagttaacaaaacaaccagacttcatcgaggaatgaagtccggctattcatataaaaagctcgaaaattttactcactttggcgcaaaaagcaatccaaagagtactttctttctcgactttgttaattatcgccccataaagccaggtggcagcatgcctttcatgcctttcatcattttggctaaaccacctttcttcatctttttcatcatacgttgcatttcatcaaactgtttcagcaaacggttaacatcctgcacctgagtaccagaccctgacgcaatccgacgtttgcgggaacctttgataatctccggtttttcacgctctttacgggtcattgaattgataatggcttccattttcaccagaactttgtcatccatttgggacttgacggcatcagggatctgcgacatgcccggcattttgctcaacatactggtcataccacccatattgcgcatttgcttgagctgatcaaggaagtcatttaaatcaaaaccatcaccttttttcagttttgatgcgagtttctctgcttgggttcggtcaactttgctttcaatttcctcaatcaatgaaagcacatctcccatacccagaatacgggatgcaatgcgatctggatggaaaggctccaatgcgtctgttttttcaccaaccccaaggaatttaattggttttccagtaatatgacgaatggaaagcgcagcaccaccgcgagcatcaccatcaactttggtcagaacaacccctgtcaatggcaatgcttcattaaatgctttcgccgtatttgctgcatcctgcccagtcattgcatcaacaacaaataaagtttcaacagggttgatggccgcatgaaccgctttaatttcgtccatcattgcttcatcaacatgcagacgacctgcagtatcgaccaacagcacatcatagaatttcagtttggcgtgctggatagccttattggcgatatcaactggtttttcctgtggatctgaaggaaaaaaatcaatatcaacagcttcagatagtgtttcaagctgtttgatcgctgctggacgatatacgtcaacagaaacgaccagtacttttttcttatttttttctttgagcagtttgcccaattttgcaacgctggttgttttacccgcgccttgcaaacccgccatcaggactacagcaggtggctgtgcagaaaggttcaactcactgtttacctctcccatcgccttaaccaattcattctgaacgattttgacgaattcctgtcctggagtcagacttttgttaacttcatgccctacggcattctctttgattcgtgaaataaaatcacgcacgacaggcaatgcaacatctgcttcgagcaaagccatgcgaacttcacgcaatgtatctttaatattatcttcagtcagccgtccgcggccactgatattgcgcaatgtgcgcgatagtctgtcagttaaattatcaaacattgtctcagctcagatatctacaaaaggggctacctgtaaggcaaatttagcgaattataacacgatgatgatccaatctctgcaaagagattaccaagtatgattaacaacggttggaggctacctcagctagcgttatacttaaattttaagttccatctaacattattgcgaaaacgacaaacgttatgccagtattttcaattattgctttacttgcttatctcattagcctgatgctcattgtgccgggtttattgcggcaacaaaacagttatcaaaagctggctctgcttttctctattatggccctgattaatcatgcgattgcattgaaatatcagatttttcatgtcagcagcggccaaaatctcacgttgttaaatttaggctcgattgtcagcttactcatgagcaccattatgactgtcgtggctttccgtggtcgggcatggtttctgcaacccatcgtttacagtttcgccatgacaaatttaatgctggccagtatggtgccaggagcgttcattacccatggggatctnctagagtcgaacctgcgagtctatgnaacgntagtcg

SEQ ID NO: 14944 - DNA, 18039 bp, Xenorhabdus bovienii
  unsure (1)..(18039): unsure at all n locations
  Genomic contig Name=Xb4151_4152.C403
ctgtgccagtaacaatagttaccaaaaataatattatatattctccgatattattgttatcactcgattcgcttaagtgggggataatccctaataaaggtgcggggatcatccgttccaacgtcgccaaatattctgtctgacgtttacccgcgggttcaatttcattggcaatccaaccggccaacctcagtccagaatgttgaatcgcttttgccgtcaataccgcatggttaatacatcccagtttgactcccactgtcaaaatcacaggcagttcttcctgaatcacccaatcagcaaaagtggtattttccgacaaaggtgtataccaaccgcctgcaccttcaaccaaaatccaatcagattttgccgtcaatctttccaaaccctgtgatatcacctcaaactcaatcggctgattaagtgcggcactcacaatatggggagatgtcggctcaacaaataccagtgggttgacttcttgataagtcaaagacacggaactgttgcgccgtaaggccagtgcatctccattgcgtattccttctgaggtgatctcactgcccgatgccacgggtttgtaacctgcggtttgatatccttgcttatttgctgcttgcagcaacgcgcaactgacgacagttttaccgacttcggtgtcggttccggtaagaaaatatttatttgtcacagtaaataacttcaaaagcaatctgantacttaatgggtaatcctcattattccgtggatacgcttcagccagagtgttcaggcgttttctggtcataagtccatgttggcgaccatgatgaaggtgcgtagcccctattcctttcagcgagttcagcaaagacagcagttgcgggtaatattggcaatattgttggcttattatcttgtgccgataggcttggcacgcgtcagtgatggcttgtaagggcaggaattggttgatatgccgatacgtgtcaacttgaccccacgccgcttccagctcgcacagtgaaccttgcacaagagtggagaataaaatgaggccaccgggacgggtaacccgatagaattcttgcagtgcacatggcagttcattacaccactgcacagccaaattactgaaacagatatctacactattatccgccagccccaagtgctcaatatccccttgcaggtagtgatcggcaacttgctgctcctgcgcatgatttaacataccagaagccaaatccagtgcgataacctgcttaccctgctgcttccagcgcgcactgaaaaaccccgttccacagcctgcatccaatacccgaataccgagattttctgcctgcgccagttccatcaggtattcacctgtttgctgttgcaatttagcagccgtatcgtaacgagaagcggcgcgcccaaaagcgcctgcaatcgcctgcttgtcaacggccttaacagccagatccatgcaacgcctccagtaatatctcaatatcctgttgtgtatggctcgccgtcagtgtgatgcgcaggcgggcactttccagtggaaccgttggcgggagaattggttttacccacactttttgctgtcttagcgtatgggatagggcaatacagcgttcattgtcaccaatgatcaaaggctgaatggccgtctctgaatccatcagggtaaaaggcaaatgatgtgcttcgcggcgaaaatatctgatgttgttttgtaatcgctgacgtaattcatctccttccttaatttgccgtaccgcttcagacagtgccaccgcctgtgcgggtggcatggaggtgctgtaaattaagtgtctggcatactggatcaggtattctgcggtttgttcatcacacagtaccgccgccccactcaatccgaacgccttaccaaaggtgacaatcaaaatttcgggtttgacattctgcgcccagcaactgccccgcccttgttcaccgtgaatcccgatgccgtgggcatcatctaccatcaaccaactgcccgtagattttgtttgctgagcaagggatgcaagcggcgcacaatccccatccatgctaaaaataccttccgtcactaccagagttttacccgcacaatcttttgccagattctgcttcagggaatttgggtcgttatgcagaaaacgtcgaaactgtgcgggagagtgcatggcggcttctatcagcgaagcatggctcaggcgatcagcaataacccggtcgtctttttccatcaaagccgctatcacaccttgattggccgcatagccagaaatgaatagtaaggcgcgggaataacccaaccattccgctaattgctgttccaatgtgtggtgaacggcggtgtaacctgtaacgtgccccgaacctccactgcctacgccgtattgttcagctccctgctgccaggcagcaataatctggggatgctgactcagcccaagatagtcgttgctggaaaagttcaggtattgaccgtctgaagtgtgtaataaacgcccatctgaacccagatggacttgtctgctacgccatagagatgttccccgacgttcggtcaatcgtcgggaaatcgtgtctgaccagttcattatactgccgcattatagaattgttcgtaatcaacattattgatgatggcttcagtcagattctgctgctgttgattgtcaccaaatgctgtctgagtctgttgaggattgatgcccagtctgcggaacagttgcagatctttgtcttcattcgggtttggcgtggtcagtaatttgcagccgtaaaaaatggagttagcacccgccataaagcacatcgcttgcgtctgctcattcatctgctcacgtcctgcggataaacgaacatgggatgctggcatcatgatccgagccacagcaatggtgcgaataaagtcgaaaggatcaacatcatcgttgttttccaacggggttccctttactttcaccagcatattaataggcacactttccggtggcttcggcaaattcgccagttgcaccagcagagccgcacggtcacggatttgttctcccagaccgacgatgccaccagaacagactttgatgcccgcatccctgacatttcccaacgtattcaaccgatcctgatagctgcgagtggtgatgacattgccgtaaaattccggagaggtgtccaggttatggttataatagtctaaaccagcctctgccagacgctgtgcctgagtttgattcaacatccccagagtcatacaggtttccatacctaattctttaacttccttgaccattgtctccagatacggcatatcacgctcgtgggggttcttccatgctgctcccatgcagaaacgggttgaaccggcatttttggccttgcgcgcagattcgatgacttgctcaacttccatcaaccgctctttttccaagcctgttttgtaacgggagctttgcggacaatatttgcagtcttctggacaggcgccggtttttattgaaagaagcgtactgacctgtacttgttgcggatcaaaatgttcacggtgtacctgctgtgcctgaaataacaattcgaaaaaaggttgatcaaacaaagcctgagcctgtttgaccgtccattgctgacgctcactcacaataacatcctccaatgtggaaaaatgttgtcagtttaaataacgccgctatcatgtcaaccaaaatgaaccaagaaaggtttacaacaaacttattatgaatccttccgatcttgaatttgacctacgccatatctggcacccatatacatcaatgacccatccactccccacttatcctgtggtttcagccgccggagttgaactggagctgtcagatggccgcaggctgatcgatggcatgtcttcatggtgggcggcgatccacggttataatcatcctgtgctcaatgaagcagcaaagtcgcagattgacaggatgtctcatgtgatgtttggcggtatcatccatcctcccgccattgaattatgtcagcaattagtcgcaatgacgcctgccgcactggagtgtgtttttctggcggattcaggatctgtcgctgtagaggttgccttgaaaatggcgctgcaatactggcaagccaaaggagaaaaacgccacagattcctgaccctgcgtcatggctatcatggtgatactttcggtgccatgtctgtctgtgatcccgacaattcgatgcataacctgtataaaggttatctccctaatcatctgtttgctgatgcaccacaatctcggtttgagggtgagtggcaacctgaggatatcacttcgttccggcagttattgctccaacaccacaatgaaatcgcggctgtcgttctggaaccgattgtgcagggcgcaggtgggatgcgtatttatcatcctgaatatctgcgtcaggttcgtaaactgtgtgatgaataccagatcttgctgattgccgatgaaatcgccactggatttgggcgaacgggcaaactattcgcctgcgagcatgcacagatcgagccggatattttgtgtctgggcaaggccttgacgggcggttatatgacattatcggcaacattagccactcgccatgtagctgaaactatcagtcaaggcgaagccggctgttttatgcacggcccgacgtttatgggaaatcctctggcttgcgccgttgccagcgccaatctgaaattgctctctgatagtcagtggcaaccgcgcattcaatccattgaggctcagttaaaagtagaattgctccctttgaaatcacacactaccgtcaaagatgttcgggtattgggtgcgattggggtcgtagagatgaaacagcccgttgatatggcttcgctacagcgccgctttgtacagcatggtgtctggatcaggccatttggccggttaatttatttaatgccaccttacattattcggtctgagcaattatctaaactgacaaatgcaattaatgatgtaataatttaaaaaataaagccagcattaataacatgctggccttatttatcattctctatattttaattatcatattattaataaaaaaccaaaaataataaaggcattatcaaaagacgctcactgataaatattatttaccgccgacaagtatattctatgacttacaggtaaatttcctgatatattccaatcaatcatcatgttaattaaagtaaaagaggaatgtattatgagcgacgaaaaatcaattatgccttctaacgaagaaatgcaagctacattttcattatctaaggagatgcatgaaaaggaaatatcacaccactcaactgttgcaagagaaatacctgagttagcccatttgtttgtaaaaaatcccaacgtgatttcatcaacgggttatggtgctggtctgatagaatatattagtggaagttttaatcttaatacattccaacaatatggaagttatccttttatccaaatatcatcccattcggctataattgggtatgcgccaaatgttggtcagcgggttaaatttaatggatatgttaatgccgggcatattattccaattattaattggaataatttttatttcgcaggcacagtacataatgttagatctattataaacgtacaactgaccatccaactttacattaatcaacagaatattttcatccgtctttttgatggaaatatttatttgggcgatttagtttctgtatatagacctaatgcaattattcctgtacctatggtaatatcaggcgttggttcatttagtttaatatgaaactgtattaattggttatttcataattcaatttttatacctaataaatttcaagttacagccaacaaagcagcaacttgaaagataaagggaaaatattgccgcgctaaaaatagcgcggctcaagtttacaatgccagcaccgtcacccacatcgggcctttgcccactggataacgtgctaattgcgttaattttccagaatatttatcaatacgtgacactgaaatatgatctgatttctgccctgaggcaatcaggaagctgccgctgtggtcaatcgcaaaaccacgaggctgactttctgtcggataatttccaactaatgtcaggtgatagccatcttctgaaacgcggaaatggctgatcaggctctctgaacgctcacaggtataaaggtggcgaccatccggtgtcatgtggatatccgcagaccagcgaacactagaaaaatcagccattaatgaatcaacagattgcacaatgcggtatttgtcccatttacgcagaacatctacagtcgcatctagctcattgatacaataaatcgccgatttttcaggatgaaaaaccatatgacgtgggcctgctcctgctactgtactgatttcatccgcccggttttctatcagataaccctgctcatccaaattgaaaatgcggatgtgatcttctttcaggcatggaaccagtaactggcggttttcccgatcaatattggcagaatggggtgcttgcaggccttccacgatctggacaggtgctttgacaatgccgttttcatcaatagggtgaacactgagtttgttgaaaccataggaagcagaatataaaaaacgccccgctctatccgtagaaatatgcgtagggctacccggcaacggcgcaatggcctgctgttcgagccgtccatcgaacccgattgcataagtgacgatactgaactgagggcgaattcccacatataagtgtttgccatcagggttaaccaccattggctgcacttcgccaggcacattcactgtctggagaagtgagagttcccctacaatattcagcgaccatacgtgaatctgactactattagggctggctgtataaaccacctgtttcattttctctccttaatgcttcatcaccatttcattgatctgtaacgattcgtgaaaaattgtgtttgttaaactgatcgcatgacggtttaattatattttgttaccgtataatatttgcttatatcatcgacaatttagaggcctaccatgtcatatcgcgttatcgcgctggatctcgacggcacagtgcttgatccacaaaaacgtattttgccagaatcactagctgccctgaatgaagcccgtcaagctggtgttaaggttttgattgtcactggccgccatcatgtcgctatccatccgttctatcaagcactacaactcgatactccggctatttgctgcaatgggacttattcatatgattaccatgcaaagaaagttctggattccaaccccctttccacccaagaagccgttcaggtgctttcttatttgcaaggaacggaaattcagcatctgatgtatgtcgatgatgccattttatatcaatttcatgacactatatcacgcacgctggcatggtctgattctctgcctgaacatcaacgccccaatctccagcaggtcaatagctttcaagacgccatctataatgtgaattgcatttggaaatttgccaccagctccccaaatgtggtgaaactgcgtgaaatcagtgaacagattgaggaaaaagtcggtcttgagtgcgaatggtcgtgggttgatcaagtggatattaccaaaaaaggcaatagcaaggggatgcgcttgaagcaatgggttgagtcacaaggcatatccatgaaagaagtgattgctttcggtgataattttaatgatatcagcatgctggaaacggctggtttgggcgttgctatggaaaatgcggctgacgcagtcaaagagcatgccgatattgttacgcgggataatacccagcctggcatcgctgaagtgattcgaaaatacgtgctttaaatcggttaaatcaaattaaacggagcgccagacaaccgcgctccttcaatttatgcagtatgtattataaaggttgattcagcgaaacgctttttatttgcgcatacagccattgacctgaccgcaggttaagttcttcccgcgcccaagaggtaattctcgcccataggaaatattcacgcaatgccagcttgacatcaacctgaccatcatcttcgaaaaattcaatgactttaacctgcaaggtattacgaatactactgactttcgggggttccaaaacgagagaaacgtccgatgcatcaacacgaatacgcagatctgtacccggagccgcatccattttaggcaaccagagagctttatctcctaccgccaccgctgtcatatgataacgctgatgatgctccatgacagagacggtcagtatgctgctaaggctctctttttgcagccacgggcgtaatatgctgtttgaccagacttcttccaatgtgcctgtcgctctgactttccccttgtccattacaatcacgttatctgccaatcgcagaatttcatccaaattgtggctgacatacaggagcggaattttgacatcggcggacagtttttcgagatacggcagtaattcacgcttgcggggtaaatccagcgaagccagcggctcatccatcagcaagatttcgggcgcggtcagtaatgcccgtccaatcgctacccgctgcttttccccgccggataaggtcatgggaaaacgtgacagtaagtgttcaatgcccagtaagccaatgatgttgtcaaactgtggtttcatgtctggcgacataccgtattgcaggttgcccttaacgcaataatgaggaaaaaggcgggcatcctgaaaaacataacccatccggcgtttttccggcggcagaaagattttctgctctatatccaccaaagtgcggccattcaggacaatccggcctctctgtggcctgctcaacccggcaataacattgatcagagacgttttgcccgcgccggaaagcccaaatatagccgtaatgctttctgttggcagagtggtatcgacctgcatgtgcaggttacccagacgttgctcaaactccagctctaacatgctgcccccagacgttttctgccccaacgggtcagccactcggaaagcatcaatgaaaccaatgccagcacgatcgcaatcacacataaacgcgccgctgccgtttctgcgcccggcgtttcaatcaatgtgtacatggcaaggggaatggtgcgagtttcccccggaatattcgatacaaacgtaattgttgcaccaaattcccccagagaacgggcaaaagccagaacagcaccgacaatcacacccggcaatgaaagtggcagggtaatggtgaaaaagaccttaagcgaactagctcccaatgtacgcgctgcctgttccagacgacgatcaatgctttccagcgccagccggatcgctctgaccatcaagggaaaagccacgactgccgaagccaacgccgctcccgtccaactaaatgcgaagctgatgccaaaccaatcataaagaaattcgccgatgacaccacggcgccccatgctgagcagcagcagatatcctacaaccactggcggtaataccagcggcagatggataatgctatccagcagggatttcccgaaaaactggcagcgagccagaacccatgccatcaatatccctaatggcaaactgaataacaccgagatacctgagatttttaaactcagtaaaatcgcctgccattcatattcacttaacatctccaaaagatcagttcctacagtggactgaaaccatagtgtttgaaaatgactgcggcttcaggggttttgagataatcataaaaatcacggacggcctgattttcatgacctttaataattgcgataggatattccactggtttatgactctctgatgggaatataccgactactttcactttcttgctggcaacggcatcagaaccatagacaattcccaacggtacttctgcccgctctaccagcgccataccactacgtacattgttagtacgtgccatcagtggattgaccacttcccatgctcccagagattgcagcgactctttggcataaatgccgacagggacatgatcgggatcacctacagccagacgcccatctgccagcagagatttccattttgtttctcgatcgatgtcgattttatccagcttgctctctttgggtgcaatcaagacaagttgattacctaacaaagtatgacgagtattgtcagcaatcagttttttgcctgcgacatagtccatccattgctgatcagcagaaacaaagatatcagcgggggcgccatgctcaatctgacgtgccagtgttgacgatgaggcataagaggcaacaatgtcaccctgttgttcttttttgtactgaacggcaatatcgttaagtgcattggtcaatgacgctgccgcaaaaacggtcactttttctgcactccagctattcccaaccagcgcaaaataaaccacagcccctgtcaacaattggtacaggctctttttcatttcgtattccacttatgataaccaatatggtgcgctgtatataacaagatacaacgttaaatgaaaatactattctgggattaatcggcaacttgtgagccacttttagcttttatgttaatccagtcagaaattgcagttcaggaaggaaacaaaagttgccagtaagcgggaattcaatcagatggacaggtaatgaggggaaaaagaaattacccggcagaaccgggtaacagaaacactaacggtaaaatcagatcaaggctgccgttcggtatttcctgttttggaaataacgttgaacactgcgccaagcccgtaaatcagccccaaaatcagtgccatcacaacaggaaccatgatcaacgcaaacgccatacttccaatcaactcaaacatgcaaacctcatatcatgagtgaccataattcagccaaaaaattaactgtgcaacattcggcgttatttttccttaatggaaaaacggtgcttcatgacacaggcggtgatctcactattctagacaataaaaaagtaacagtaaccgacgaaacgtgcgattcttacggtcatcctgtaagaaactctcaaatatttgcctgaaatgaatcactatgcaagccgaaatattgttaatactcaaattacagcaacgtcttttcgctgatcctcggcgaatcgaattgcttaagcagattaaaataacaggttctatcagtcagggagcaaaacaggccgggatcagctataaaagcgcctgggatgccatcaatgaaatgaatcatctcgcagatgaagtattggtagaacgtgctactggcggcaaaggtggcggaggggcgcaacttacgcactatggcgaacgcctgttacaactttatgatctactggaaagaattcaacaaaaggcattcgatgtgctgaaagaggattctctgcctctggatagcctgctcgcggctatttcccgtttttcgttgcaatccagcgcccggaaccaatttttcggtacgatagtcgaacgtgatcatgagaatatccagcaacatgtccgtatcttactggctgatggcaaaacatcgatctctgccgcgctgactgagcaaagcgcaaaccgactgaagctggtaaaagggaaagaagtgctggcattaattaaagcaccgtggataaccttaagcaaagagcctgtaacagcgacgccattcgataatgccttatccggccaagtcagtctgattgaaacaggaacagaacacagtgaagttatcctgacgcttgatgggggtgaatcactctgcgttacgctagccaatcaggaaatggagcgttcgggtcttcagcctaatgatttcgtcaccgcactctttaatgccgataaagtgattattgcaactctgtgttaatggtacatccctctgataaacctaagtgtcagggggaatgacaactcatctgatgcattctgtaaccaccttccaaaatgagccacccttaatgaataacagacggctacgcattgacattgaacattattccgattatttctggtgatcctctagttgatgttgcttaaaaaggaatagaaatgtctgagttgcaaataacacaaggtagtttccgtttaagtgacacccgtaccctgcggctgccgtcactgaaaattatttctggagaaaattgggcgtttgtcggcgcaaatggcagtgggaagtcttctctggctcgtgctctgtcggatgaattaattcaacttgcaggtgaacgccattgttcatttaatacacctgttcacctctctttcgaacaacttcaacaactgattgatgaagagtggcaacgcaacaatacagatttgctcagtgaagatgaggaagatactgggcgtaccgccgcagagatgattcagctccaccataaagataatgaattatgccttgaactggcagcgtattttggtatcaaggatttgctctcacgccgattcaaatatctctcgacgggagaagttcgcaaggtgttgctttgtcagacattaatggctaatcccgatctactcatccttgatgaacctttcgacgggctggatacttatgctcagaatcaactgtcccaattattaagatcgctggcaacaaaaggcatcacgttggttttaatactgacccgattccatgaaattcctgattttatcgaacagatcggtgtactggctgattgccacctgacacggacagggaagaaagagaatattctgtcagaatctctcgtggcacagttagcccacagcgaaacactaaaagacattcatcttcctgaaacagacgaataccgtgcagatgagcaactccccgaagatcaaccacgggtatcgatgtgcaatgttgttgttcagtacaatgacaaaccgatactgcatggtctgaactggcaaataaatccagatgaacactggcagatcatcggtgaaaatggtgcagggaaatccaccctcctcagcctgattacgggcgatcatccccaaggttacaacaataagctgattttattcggccggcagagaggtagtggcgaaaccatctgggatattaaacgccacattggttatgtcagtaacagcattcaccttgagtatcgtgtcagtacctgcgttcggaatgtcattctctctgggttcttcgattccatcgggctgtatcaggccgtttcagatcagcagcagcaactggctgatgagtggctggctttgttgggattctctgaaacaatcgcaaacagcccatttcacagcctatcatggggacagcaaagactcgttctgattgcccgtgccttggtgaaacatcccactttattgattctggatgagccattgcagggacttgatcctctcaatcgtcagttagtcctgcgttttattgatatcatgattgccaatggtgatacacaacttctgtttgtttcccatcatcaggaagatgcgccagaatgtattactcaccgcctgaaatttattcctgatggctatatttatcggtatgaaaccgaagatatctcccaacagtctttgtagtgccgccctatcagtgcaagtcctctcccgatttaacgtcgaaagagggctttcactcgaacctttttactaaaaaatagcaactgccagaaaatccccctccgcaatgaaaaaatgactactttttaaattttttttataatgacccagagttattttaactcatcataatttatttgaagtctattttttagactacttgtctaattcaccaaaaataacagggaattatatgtcttgggcgttacttgccgtttcattggcgcttttggatacacgtcgcattattgcattttccatcgcatttctagctttaatcgttgggatcagcactaacgtgcttacctttcccgcagttgctgcgcttattgtaattgctggtttaggtacagcacacgtttacctcaaaaaacatcctacattcagaattatcactgaggtgttactactcatctctgtagttttactgttcatgcattacattccgggatttaataacttgaaatacctagataaggtgcaggttggcccgctgagtgcacctttttcaatgtatttcaactttgacaaggcactgattccattcattctattattctgcatgccaagcctgttcactcgaaagcccgtggcagatgccttcccacatgtatgggcagcattgatagtcgcgatacctgcgctattgggtcttgccacagaattagggggattagccgttgagctgcatttacctagttggttccctgctttcgtcattgccaatattttctttgtctcattggcagaagaagcgctgtttcgtggctacctccagcaaaagctgagtcagtggatgaatccctattcggcactcgttatcacttcactgatttttggtgccgcccattttgccggtggtagtttattgatgattttcgcaactctggcagggttaatttatggtctggcatggatgtggagtggtcgtttatgggttgcagtagctttccacgtttcactcaatctaggccatctcctgtttttcacctatccggtaaaatcattactcatacagtagcaattaccaaacatgatttagaacaggggttcaagactattgtttgccgtttcggtctatcgcgccatataatgcccgcagcgaccattttattttgtattaaaaagcactaataggagtttaagctatggctgtaactaaactggttcttgtaaggcacggagagagcgagtggaacaaagagaaccgttttactggctggactgatgttgagttgtctgacaaaggccgtactgaagcacaacaggcgggtcaattactgaaacaagaaggtttcgcttttgatttcgcttacacttctgttttaaaacgtgctattcacactttgtggaacattctggaccaagtcgatcaacaatggctaccggttgagaaaaactggaaactgaatgaacgccactatggcgcactgcaaggtctggataaagctgaaactgccgctaagtacggggatgatcaagttaaattgtggcgccgtggcttcgcgattactccaccagatttggctaaagatgatgaacgttatcctggccacgatcctcgttacgcgaacttaaaaccagaagaacttcctgccacagaaagccttgcagccacgattgagcgtgttgttccttattgggaagacgttatcaaacctcgtgttgcaaatggtgaaaaaattatcatcgctgctcacggcaactctctgcgtgctttagtgaaatatttggatggtatgagtgaggaagaaattcttgagctgaatatcccaactgctgtgccgctggtttatgagtttgatgaaaacatgcgacctatcaagcactattatctgggcaatgctgacgagatcgctgcaaaagcagccgctgtagcaaaccaaggtaaagcgaaataatcttgtatccaagatttaggaaacgtaatactaaaaagccggaaatcactccggcttttttatgctgctttatccccttcgggctttgacagactgagataactgacgcagtaacatttctgtgtcatcccagccaatgcaggcatctgtcacactttgtccataaaccaaaggcttatcactatcgagattttggcttccttcaacgagatggctttcgaccatgacgccaataatcgcgcgttctccccttgcgatctgatcacaaacatcatcattaacgtccatttgtcttttgaactgcttcgaactgtttgcatggctgaaatcaatcatcacacgaggtgctaaaccagctttcattaattcctctttaacgacactgacatgctccgcactgtaattcggctctttgccaccacgcagaataatatggcaatcctgattacccgttgtgctgacaatcgctgagtgtccccatttagttacagaaagaaaacagtgaggtgagctggccgcgttgatagcatcaatggcaacttttattgtgccgtcagttccatttttaaagccaaccggacaagaaagccctgaagccagttcacggtgaacctgagattccgtcgtacgcgcccctatcgcgccccagctcatgagatcagcaagatactgaggcgttatcatatcaaggaactcacccgcagcaggcagccccatgtcgttaatatcgatcagaagcttgcgggcagtacgtaagccatcattaatatcaaagctacaatccatattcgggtcattaattaaccctttccaacctatcgtggtacggggtttttcaaaataaacccgcatcacaatttccaaatctgctttcaattctccacgtaacttattcaggcgttctgcatattccagtgctgcctttgggtcatgaattgaacacgggccaattactaccaatagacgatcatcttcaccagttaaaacgttatgaatagcttcacgggcttcacgaacggtagtagcggtatttcttgttgcaggaaatttttcgagtaatgcaactggtggcaataattctgttatttttttaattcttatatcgtcattctggtaattcattgtcctttcacctaatgtgtttacagttatttaagataattttgtgatctcaatctaactgttaggcgttgtgctgtaaataatctttatgagtaaaaaagagaagatttctttatggaagaagtttctttgagtaaaaatgatgttaattcaaatgaatgaacggatggaatttgaatacattgaatcaaaacactcaataacaggccgtagatagattgactacctatgacctgcggatagactttcatttatattttcagccgattacgacccattgggtttagcagccgtgatccacaggcgagcaccgttcagtgcaatacccgtcaatataatgtattgcaaggacatcgccagaacaccttggtggaaataaatcactacgctgatcacattgatgatcacccataccagccagttttccacgtgtttacgggtcatcagtaccattgccactatcgataatactgtcatcaccgaatcccagaatggaaatgcatccggctctaaggctggcatcgcaatattgaaccccataccctgcaaagcaaaaaccacaatttttgccatatagccaaagatttggtcgatattgaacatcattaccaagattacaaatatggaaactgcggcgacggcaattgtttgtttagggttgagccagcggatcttaagttctatctgtttctgttcattgacacgactccaggcataccaaccgtagatattagccgcgaagaaaaagatttgcaggagaagactggcgtagagttgaatttggaagaagataacggcaaagagaaaaacattaatcaatccaaacaggtaattaatgattttctcctgactggcaagccagatacataataaaccagctatcgtaccaacagcttcaatgtacgagagatcatagccgtctgcacctaatggaatatgtaccaatatgctcttaatactgaaaaaatccatcctttcctatccttatcataagtagtgtttagtatatcaatacaaaaaacgcaaaattacgatataaattgactattccttccatccatgttttacatactaaacaagatagcgagtctatacataaaagtctttaattattttaacgtttttaaaatgataatggataataaatgactcattttctgagtcaacacttacgagtcaggatgtgctgatttaccgacggagctaacaattcatctaaagcgtacttgaattgagattcagaatggtgggtcgtgcaggattcgaacctgcgaccaattgattaaaagtcaactgctctaccgactgagctaacgacccatctaaggagtgcttgaattgagattcagaatggtgggtcgtgcaggattcgaacctgcgaccaattgattaaaagtcaactgctctaccgaatgagctaacggggtccg

SEQ ID NO: 14945 - DNA, 20592 bp, Xenorhabdus bovienii
  unsure (1)..(20592): unsure at all n locations
  Genomic contig Name=Xb4151_4152.C404
tgtcgttccatcgacgataaaaatactaccaatagtgcgatttttcacgcgatcctcgcttctgaatatgttgaaaaatagttataagattggcaggttaaaggattgatttataactgtcaaattcagattacatcaagtgtaaataattaattacatgcttaaatgcggttggatgaagagactgctcgtgataggtgatacaaattcggtgtctcaaaacacgttgcattgattattaaaagtgtgagtggacagtctgtttttcaggatttagtggaagagggaagctggaacttgggagacacataacaagcaggggctatggtatgaaagtacaggtagcgtaaatgccgaaaaaaaacccgttatctggaagataacgggtttttagatggtgccggctaccggagtcgaactggtgacctactgattacaagtcagttgctctaccaactgagctaagccggcgaaatttggcggaaggatagagattcgaactctaggatggtttcccatcggcggttttcaagaccgctgccttcgaccgctcggccatccttccatggcgcgagattatgcctatatcgttctgatgtgtctagtccctgaaggaaaaaaaacgtatttttttactgtttgctcaatcttcgatctgtaatggtctttttattctctaacctgctagtattagcataatacaacggcttatttgattacgggttgatgtagaatcaaccaaaaaatatattcacactaaaggcaattattcaaagaatgtataaacaagcatctatcaagccatctactattccccgtttttacgcactatttattattttgctttttacgtctctatttttattcgggtataactattttgatagttggctcacagataaaaaatatgctattagcagtgtaacagttaagatgagattgcaaatcgaaaattatcgttatcatgccaatcatatctttgaacaatctaatattccgctctctgcctcctctcaggaggcaacatcattgtttaaattgcgtcccgatgtccattggctggaaagtcgttataagacagtcgatgcaattatttttggtcagtacaatcattcaagtattcaactagctcagcggttatctaactatctggaaattctctggggttcccgtaatgaatacgaatctatgtattatctcaatggtaaggataacaatttacttttggtaacaactcatcctattttaaaaccagaaatcaggtttaaggagagttatctgaccctgacgtctgaggccaaacgaactgaaatgttggctcaatcgatagcgctggatgaaaaagaaagcatttcagccatcaatgtgctgcgtggggagaatatttatttctatacttataaagctgcattcaatttgcctgggcaattaactaccgttatcgcctttgaactgcccattaataaccttttgccgattgatatgtcaccggcaaactttcgcttgaatttgaccaacttgcatgatgctgagggttccaataaagttgaggtttcactgaacggtttttggctagagttctcccagaatctcaatgccatgccatatgaattggtttatcaagttccactgaaagccctggttatagatttactgatcaggaatatgtggctcttgttctcaatattacttttcgcaatgttctcattgagtggtttgttctatatccgccgtagatatattacacctaatgcttcgatggatcatgagctgaaaattaaggactctttaggtaatgatatcatctccaatattcctatcggtttgttgatctacgatttttcatcaaatcggttaatcactagcaataaaattgcagaacagttaataccttatcttgatttgaataaagttaaggctatggcacaacaacatcatggcgtcattcaaacatctattgatgacgcgaattatgaagtcaagatgtataatagcaatctattacccgaaacatatctctttctgctgcaagatagagatcaggaggttatgataaatagacggctccagcttgccaatcgagaatatgataaaactgttcaggccagacgttcaatgctatcaaatattaataatgaaataaaaataccgattcagagcttaaatgagattgctgcccagttgaaacagatatcacaagatgaaaacatgcagaacttgctggataagttattggttaaatcggaatatattaccaaatgggttgaaaacatttcattactcaatgagctggagtctggtgactggcagtctgctactgaaatattttctttgtcttcacggttggagcatattctgaaagcttctctgtcgacattaaatgccaagggattgaaaatttattaccattttaattttcatcatgaatctttgttcattggtgatggtgtggcaataactaaaatcgtctcgctgttatttaattacgcaataacgacaaccagttatggaaaaatatcactgtccattaatagctctggcgaatatgacaattgcattcaaattgatctcattgataccggttcaggtcttagcgaaaaagatttaatcagtttgaattatcccttcttgaacaaatcagcagaagataagtattatacgaactctgggctaactttttatctatgtaatcagttgtgcaaaaagatgggagggaattttgaaattaaaagtaagttgggtttgggtacacattatgtcattaacctgcctctttcgcagcatagtgataacaatggcgaaacgcctcagcttttgcagggtgtgacagccttaattgatatcagtaatcctgaaatcagtaaaataatccacaattacttgaataattatggtgcgtcatacttcgataaaatcaaagggaatgttacagaagaatacgatattatctttacggatatgcagtgcaaagtagaaaaaccaactatattattagttgatggtttggctgatttcaagcagataaaacctaatctggttaagtgtaattataattttgttgatgcggttatcaatgcaatatcgttactggttgaagaaaatttcagtctagatgaatcttgctatgctcttgaaacccctaaatcagaatgcaatgttgtcagtagtgttgacaatattctcaagggctaccaaacacagttggcagatagtgattataggaaattatttatagagacagtaccgatggatattactaaactgtatactgatatggaacgacatgatttgacattactttcgcaaacggtacaccgccttaagggtgcgtttgctatgttagatttaaaattgctcaaattatcatgtgaggcgttggaacaacacatagcagacaataatgaaatagaaatcgaaaatagcatcagccgtattgattcttttgtcacgaagctgttgcagcaaggtaaccaagaatatgaataaccttaatgtcattattgccgatgaccatcccattgttttgtttggcatccgtaaatcactcgaacaaattgagtggattaatgttgtcgctgagtttgaaaattcaacgacactcattaacaatttaccgcacatagaagcggatgttctcataacagatctgtcaatgccaggcgacaaatacggtgatggcattaccctgataaaatatattaaacggcattacccaacactggctatcattgttcttactatgaacaataacccagctattttaagcgctgtgcttgaacttgatattgagggaattgtattaaagcagggagcacctactgatttgcccagagcactttctgctttgcaaaagggtaaaaaatttacacctgaaagtgtttctaaattgctggaaaaagtcaatgctaatggttatggagataaaccattatctccgaaagagagtgaagtactgcgtttatttgcggatggtcttcttgttactgatatcgctaaaaaacttaatcgcagtattaagaccattagcagccagaaaaaatcagctatgctgaaactgggtgtagataacgatattgcgctgcttaattatttatcatctgtcactattgaaaaagatatcggtagataataaatatgttatctttttataataaaaaaatcggtaattgttgttaccgatttttttattatccaatgggcaaatgaatttaagattgaatatcactgtattctattaatgtatctcttaatgttgccaatgagacgggttttgatagacaataatccattcctgcatccgcacaacgttgtttttcttctgccagggcattagcagtgatgccaatgatggggctggtatatcctttatccctcaggtatttcgtgagctcatatccgtccatatttggcatattcacgtctgtcagaataatatccgttgaattatttttcaggtgctcgatggcatcaataccatcattcgccgaggctgttctgaatcctattgtatttaattgttcgatcaataagtgtcggtttaaaggatgatcatcaacaaccaagatcttaatggtactcaagcggctatctgcccgaattgatgttgacattgatatagtggcaggggagatatgattattttttgatagcagtttatcgatcacactgtcaagctcgatgagttgataagtgttatgcaaccagtaatgttctcgaatttgttttggcggcccaatatgtttttctgatatctctatgtagtaacgtacagcaatgtctagtacatcaggctggtcaaggatcaccaattctgtgccatctattttacttttgtcatataaggcaatctgaaaatagttcttcgtaagaaaattctgtagatatttctctagataatcattgcgaacagccagtacaattttttgttgagtgcggtttttggaatacgctttggtatgatactttgctccatacaatggaaggcggatagaaaagatactaccaatatactgttgtgaaataaattcaatatcaccatccatcaaattgatcaatttttcgcaaatagctaatcccaatccagtaccttgcgagaaggtttgtttattggcgttgatttgaaaaaatggttcaaacaactgagtttgtaatttatcttcgattccaaccccggtatctttgatactgatatacaggtaactatgctttatagaaatggtaatgacaacactgccagtttctgtgaatttaattgcattattcagcagattggagataatttgctgcaaccttacgggatcattattgataatatcgggaatgtccggttcaatatagcagtataatcccaactcttttttcacaatgaggggaagataatttgagatcacatgcaatacaatttctttacaagagaatttcttggaatcaattttgagctgcttagattctattttggaaaaatcgagaatatcgctgatgatttttagtaacaatgatgatgcgttattcattgctgatagtagccgtgcagattctgatggcaatgtatgagattgcagcagttccagattgccaataatgccatacagtggtgttctcaattcatggctgactgttgccagaaacatggattttgcctgattagcctgttctgctgctgacgccatttcctgtaatgattgttccatttttacccgtgtactgatatctactagtacacagattgctacttcttcatttcgataacgtgaatgtacaaagctaatttgcaggtgattgttgttactggtgacaacatcaatatagctgctggttttatcacagataatatcgacgatacgtttttgatcttcatacgttagcattctggtgtaattatgtgccagttcattactgagaatattggcaccatcattaatccgtaaaatactgatgccaactggtgcagaggcaacaattttatggttaaattgctcatgctcttcaagacgaatagcattttcttcagcaggagaaaatattttacgttcaaataaccagacaaaaaaaataatcaggatcgtaaagataagattcaatacgatactgttaatgattgttacctttaattcactatagatatattttaatggtaatgaaaaaacaacgttgaatgaagatggtgctaagcgtcgttttaataataaattggaaaaaccttcatcataaccaaaataaggggtctgtatattatagtcagcataacgaaatttattatcattttttactgggtaatataattcaggctgattatagtggtttagcattgtaatagaaataggtcgatttcttgttggtagaaatgagtctaacctgatagcttgttcaatacctatcactgctgtcatttgcccattggtatagatcggcgcaaggatataaaaagtaccgctgtcagctcttgtgttaggcatgacccaaaagacattccgttcttttccttgttctttcaaaatgattagtttacggaaattttcgtagaccattttcttcagtgtttcaggttctgttatggtactgcgaactgaaaagctcaccatacacatactttgtgtaccaaccagaaagatctgattcaggcctcgcggagcggcaatattatctttccaaaataaaatcagattatttaatgagtccaaataactatgtgtgcttttacgtaagagatcacaatctgaattcatattcagaggagtatatgagaaagcagggttattatacggcagagtaatagttagatctttttcattcttttgtgataaatgtttctccgtcatatattggatatcccgcaaggtgttggtagtatgccgaatataagagaacattgtatcgtagttagtattatattcttgacgaatgtctgatttgacttcattaaaaatatttaccagataaaaactggttaataaggcgcctaatacccacagcataaagccaagcacccgaaaaaggtaacgggatatctttaatgacgttcgaaaagaagatagatatctcaaaagatcgcctgatgaagaaaatgattaataataactattaacagcatatactagtgtagcagggaatacaaagcagcatttggttcctgtaagttctttgtaaaaaaattgcacaaaaaaagcaggcattaaaatgcctgcttttttaatagttttatagaatagtcaaggaaaggtatatgttatacctgatcttctgattcgctattcccttcatcagaaggagacgttatattattttcttcgtcttcatcatcgtcaggttcagcaacacgttgcaaaccaacgaccttttcatcttctgttgtacggatcaaagtaacaccctgtgtgttacggccaacaacgctgacttcagaaacacgggtacgtactagtgtccccgcatcggtgatcatcatgatctgatcagtggtttcaacctgaattgcaccgataacatcaccgttgcgttcgctgaccttgatagaaatgacaccttgagtcgcacgggatttagtcggatattcgctctgagcagtacgtttaccgtagccattttcggtgacagtcagaatttcgccttctccacgagggatgatcagggagacgactttatcgcctgcactcagtttgataccacgaacccccgccgctgtacgtcccattgcacgtacacctttcacacggatagtaccgtcttccagagtctcttcatcttcttcgaggaaacgaacgactttacccttcgcagagaacagcatgacttcgttgctgccatcagtcaggtcaacaccgatcaattcatcaccgtcacttagttttaccgcgataataccggcactacgtggacgactgaattcactgagtttagttttcttaacagtcccacttgcggttgccatgaagatattcagcccatcttcatattcacgtactggcagaatggctgtaatgcgttcttcttgctccagtggcaataggttgacaatcggacgtccacgcgcgccacggcttgcttccggcaactggtagactttcatccagtacattttacctttgtttgaaaaacagaggatggtatcgtgtgtattggcgaccagcaaacgctcaaggaagtcttcttctttgatacgtgctgctgatttgcctttaccgccacgacgctgagcctcgtaatcggacaatggctgatatttcacatatccctgatgagacagcgttaccacaacatcttcctgattgatcaggtcttcaatattgatatccgctgagttttcagtgagttcagtacggcgggcatcgttatattgatctttgatggccagtagttcttcacgaatgacttctctcaaacgttctgggttttccagaatgaaaagcagttcaccgattaatttcagcagttcacgatattcatcgagcagtttttcatgttccagaccagtcagtttctgcaagcgcagatccaaaatggcctgtgcctgctgttcggtcaggtaatatttgccgtcatgaatgccatattccggctccagccattcagggcgtgcagcatcatcaccagcctgttccagcattgctgaaacattacccaattcccacgcttgggcaatcaggtttgctttggcttcggcaggggttgatgcccgacgaatcagctcgatggcagaatcgatattgaccagtgcgacagccagtgcttcaaggatatgtgcacgttcgcgggctttgcgcagttcaaagatagtccggcgtgtaacgacttcgcggcgatggttgataaacgcggaaagaatatctttcaggttaagcagtttaggctgcccctgatgcagagcaaccatgttgataccgaatgaaacctgcaactgcgtgagtgaatacaggttattcaggacaacctcagccacggcatcgcgcttcacttcgataacaatacgcatgccatctttatcggattcatcacgcagtgcactgattccttcaatgcgcttatctttcaccagctcggcaattttttcgatcagccgggccttgtttatttgatagggaatttcattgacgataatggtttcgcggccatttttttcgtcagtttcaatttttgcgcgggcgcgaatataaattttaccgcgaccggtacgataggcttcctgaatgccacggcgtccattgataatagccgctgtaggaaaatcaggccctgggatgtattccatcaggccttctatactgatattttcatcatcaatataagccagacagccatcaaccacctcagataagttatgaggtggaatgttggttgccataccaaccgcaattcctgatgagccattcaccagcaaattagggatacgggttggcatcacatcggggatctgttctgtaccatcatagttaggcacaaaattgacagtttctttttccaagtctgccagcagttcatgggcaattttcgccatgcgtacttcggtataacgcatcgcagccgcagaatcgccgtccactgacccgaagttgccctgaccgtcaaccagcatataacgcatggagaagggttgtgccagacgtacaatcgtgtcataaacagcgctgtcgccatgtgggtgatatttacctatcacatccccaacaacacgggctgattttttataggatttattccaatcatttcctaatacattcatcgcaaaaagtacgcggcgatgtactggcttcagtccatctcgaacatccggcagtgcgcgtccaacaataacggacatcgcataatccagatatgagcttttcagctcttcttcgatattgaccggtgtgatttctctggcaatgtcgctcatggagccactatccctcatactccgaattcaaaggtttaaattataccacaaattgacagttttataaaaaccagatgcgggtatttcaagattaaggcatgtataataccctcttatcacacatccccataatactgttacattttctgtggagcagctttctgtgaagcagttcttaggagcgatatcgctgatgaacgtcaaaacccccgattcacacatcccgtctcatcccaatgtggatcaacaggaaatcgaaaaatttgaagcggttgcttcccgctggtgggatcttgaaggagagttcaagccattgcaccggattaacccattgcgtttgaattatatcctgcaacgtgccggaggtcttttcggcaaaaaagtgctggatgttgggtgtggtggtgggattctgtcagaaagcatggcgcgtgaaggtgcggatgtgacggggctggacatggggtttgaacctttgcaggttgcccgattgcatgcactggaatccgatactccagtcacttatgtgcaggaaacggtagaaagtcatgctgaacagcatttgcattcttatgatgttgtgacatgcatggagatgctcgaacacgttccagatcctgaatccgtgattcgcgcctgtgccaaattagtcaaaccgggtggccatgttttcttctcaacgattaatcgtaatcgtaaagcctggctaatggctgtcattggtgctgaatatattttgaacatggtgccgaaagggacgcatgatgcgaaaaaatttattcgcccttctgaactgattggctggatagataagactcctctgaaagatcaacatattattggattacattacaacccgttgacagataaatttcgacttggacacaatgtagacgtgaactatatgcttcatactcaatcggtttaaacgtgacagttagggattaataaaacggcaactagatattatttttaagattttatttcccccgtttcgccgatagttttgtgaaagtaacatcaagtaactacgcaggttatcggctttttggcaaaattaatcctcaagttatccacaaaacttccctgttttgtgcacttgaaaaaatgcggatttaacattatcttgttattaccgttttaattaccccctatatattgtgtttctcgacgttccgttgctactagttcccgattggcctttagccatttcgggtacatcgtgctgtcaatatgtcaatgtcaagaaaggcgataaaggcgagatacgataaagagaaggtgtatttccccatgaaccagagtctgctagtaaccaagcgtgatggacataaagaacaaattgatctggataagatccacagggtcgttgcctgggctgccgaaggtctgaaaaatgtctcagtgtcacaagtagaactgcgttctcaaattcaattttacgatggcatcaaaacagccgatattcatgaaaccatgatcaaggcagcggctgatttgatttctggcgatgcgcctgattatcagtatctggcggctcgtttggccatcttccatctgcgcaaaaaggcttacggtcagttcgaaccacctgctctgcatgatcatgttgtacggatggtgaatttaggcaaatacgacaagcatttgctggaagactattccaaagaagaattcgagcaaatggacagttttattaaccatttgcgtgatatggacttctcctatgcagcagttaagcagcttgaagggaaatatctggtacagaaccgtgttaccggtgaaatttatgaaagtgctcaatttctctacattctggttgcagcgtgcctattttcaacttatccaaaagaaacgcgcctgagctacatccgtcgtttttacgatgcagtttcgacgtttaaaatttcgctgccaacgccaatcatggcgggggttcgcacaccaactcgccagttcagttcctgcgttctgattgagtgtggtgacagccttgactctatcaatgcaacatccagtgcgattgtaaaatacgtttcccagcgagcaggcattggcgtgaatgcaggccgcatccgtgctttgggtagccctatccgtgatggtgaagctttccatacgggctgtattccattctataaacattttcaaacagctgtgaaatcctgttcgcaggggggagtccgtggtggtgctgcgactttgttctacccgctgtggcatttggaagtagaaagcctgctggtactgaaaaacaaccgtggtgttgaaggtaaccgcgtgcgccatatggattatggtgtgcagctcaataaattgatgtatgaacgcctgatcaaaggggaagacattactctgttcagcccatctgatgtcccggggctgtatgatgctttctttgcggatcaagatgaatttgagcgtctgtacactcagtacgaaagtgacgtaactatccgtaaagagcgcattaaagccgtggagctgttctcactgatgatgcaggagcgtgcttcaaccggccgtatttacatccagaacgttgaccattgtaatacacacagcccatttgatccggcggttgcacctgtgcgtcagtcaaacttatgtttggaaattgcactgccaaccaagccaatgaataatatcaatgatgaaaatggtgagattgccctgtgtacactgtctgctttcaacctgggtgccattaataatctgacggaactggaagaattagcagaattggccgttcgagcactggattctttgctggattatcaagattatccaatcatcgcggctaaacaggggtcaatgggacgccgtacgctgggcattggtgtgattaacttcgcttattatctggcgaaaaacggtgtccgttattctgatggtagtgccaataacctgacacacaaaacatttgaagccattcagtattacctgctgaaagcctcgaatgggctggcgaaagagaagggtgcttgcccgtggtttggtgaaaccacttatgcacagggtattctgccaattgatacttacaaaaaaacactggatacactgacccgcgaacctctgcatatggattgggaaaccctgcgtaatgacatccggcagcatggcctgcgtaactcaacattgtcagcattgatgccgtcagagacttcttcgcagatctccaatgcgaccaacggtattgagccaccacgcggctatatcagtatcaaggcatcaaaagatggcatcttgcgtcaggttgtaccggaatataaccgtctgaaaggggcttatgagttgctgtggcaaatgccgggtaccgatggctacctacagctggtggggatcatgcagaaattcattgaccaatcgatttctgccaatactaactatgatcctgctcgtttcccgaacggcaaagttccgatgaatcagttgctgaaagatttactgctcgcttacaaatatggcgtgaaaacactgtattaccacaacacccgcgatggagcggaagatgttcagggtgatctggaagaggtcgttgagtctgctgattccgattgtgacggcggcgcgtgtaaaatttgatttgaggaagttatgtcttataccactttttcacaagtaaaaaataatcaactacaggaaccgatgtttttcggccagcctgtgaacgtagcgcgttatgatcagcagaaatatcctatttttgagaaactgattgaaaaacagctttcgttcttctggcgtcctgaagaagttgatgtttcccgtgatcgcattgactacaatgcattgccggatcatgaaaaacacattttcattagtaatctgaaatatcaaacgctgttggattccattcagggccgtagtccgaatgtggcattcctgccgctgatttccattccagaattagaaacctggattgaaacatggtcgttttcagaaacgattcattcgcgctcctatacgcatattatccgtaatatcgtcaatgatcctgccattgtgtttgatgatatcgtagccaacgagcagattttaaagcgcgccaaagatatttcggggtattacgacgttctgatcgaaatgactaactactatcatcagctgggcgaaggtacatacaatgtggcgggtaaaaacattacagttagcctgcgcgcattgaaaaaacagctttacctgtgtttgatgagtgttaacgctctggaagctattcgtttctacgtcagttttgcgtgttcattcgctttcgcagaacgcgaattgatggaaggaaatgccaaaatcatcaaactgatcgcgcgtgatgaagctctgcatttaacgggaacccagcatatgctgaacttgctgcgctctggtcaggatgaccctgaaatggcggaaattgccagagaatgtgagcagcagtgttacgatctgtttgtacaggcggctgaacaagaaaaagagtgggcagattatttattcaaagatggttctatgattggcctgaataaagatattctgtgtcagtatgtcgaatacatcaccaatattcgcatgcaggcggtgggtttgaagctaccatttgaagctcgctctaacccaatcccatggatcaatgcatggctggtttctgataatgttcaggtggctccacaggaagttgaagtcagctcttacttagtcggtcagattgactcggaagtcaatgctgaggatctcagcggtttcgaactctgatatggctgattacaaaattaccctgccgtcacggcagggtttatccgtctattattcttctggtttccaccgtaacctactggaagcactggaacaaggcaaagtacaacttgaataccaatgtcgtcagggatattgtggttcctgtcgggttcgtttggtgaaaggcaaggtaggctattcctgcaagccactggcatttgttaatgagggtgagatcttaccttgtagttgccatccactcactgatattgaaatcgaaccgtaatcttcctttaattggcggtatctatcagccgatgaataattgttaacctttccgataggatattatcttttttattaaatagtagtgataattctgtggcagatgaatttgattatcttattccaacagtggatttatcaaatcctgaattacaaaaacgagaacaagattatattgtattgttaaacagggcgagatctcatatttttgataggatagtttagttaatattattgattaggttaagctattaatatagatacttacttgatttatttgttttaattatcattatatttataatgataaaaaattaatataataatgtgttacagaaagaataataatctttcctatttgtcccttatctacttttttaatattaagatatttcttaaaatcacaaataaaataataattagatattttctttacaaacaataagttaaagttaatttcgttatatatagtcgaatggattgggcagttcagtgaatgttttaatagggctgatatcatatatttatttgaatttaaaagaaaatttaattttttggacgggtgttgatgtttttattttattgttgaatttataatatgtctcttgtatatttggcaggatttatttttttggaagaatgagaattttaatttatgaaaaaaacgttattaacagccgctattgcagcaggcttatctatttttgctttcggtgctaatgccagtaatagtggtaaaagtactatttctttggggtatgctcagactcagaacagtgccaatggtattaaagtatttaagagtgaaggtactgaatggaatacaaaacaacatggattgaatttaaaatatcgttatgagttagatgaccaccttggtgtggttggctcattgacctatacgctcaataggtttgaaaatgatcacgttggaaacgttaccaaatttaagtcggatagttactccttattagctgggccatcatatcgttttaatgattatattagcgcatatggaatgattggtgcagcccacaataaaattaagatacaagatgatagtgagtttgatataagcaagacatcactcgcttatggtgccggtttacaattcaatcctattgaaaacattgcagttgatgcatcgtaccaatattcaaaatttagtgatatcaaagttggaacatgggtgctgggtataggatatcgtttctaacttattgttaatttatattagttattgtatttattaaatatcatttaataaaatgattgcagcctgaactctttaaatcatagggttcaggattttttatataaagctccaaatcttaatgtaattattataattctcaaccataaaatatatttaactctgattttaactttaaattataaatatttattaagttcatataattatcctgtttttcatgaatatattggaagtgattctgaaaatatatttaatattaatgatttgtcttattcttattacttgaatgatgctcaaaattaacctttattcattttttatgtactgaatatatctatatttagatatgtagttatcacggtgatatttatggggaggattttctggtgttttggttgaattgtagtcaatctgagggggatggataatgcgatgaaaaatagtttataaaaaagccagctcttgcttttgaaccggcaatctctgcacttgcataacacttacataaagcgagttgttgacaggcggataacgacgttatgtacgtttgagaggaaagattttacagatttcatgatgatttcctttagggttataaattgtgacgcatttcacgaaaatataaattctgaaggagattttatgcgcaaaataaaaagagtcaaggtatttataaaaatattttttaaaatttaaaatatttttatgtttatgtgtaactcattgaaaaatttaacttaacgatgaactaaagcagaaaatgttcatgtcataacacgatattgataaaaccttattacgggatgcaaaaaatattaattgctggatttggctaataaactactggcttgatggtcaattgcgcatcgcagtgcctaaagccaacatttttacctttcctttattaaccaatcgattatatacgacttgcgttgcacgaataaaggtgttcatacgtaagataattatcatgttaagactcatcaaatttgggcttgataagcctgaaaaaaatatggattaaatatgtggtggtgtattttgtaatacgacacgatagccatcaatatcttcgaatgtttttccagttcgatcccaataaggattataagaggggacgagagaaaaaccggcttcttgcatcaattggctttgtttctgccattcagacacatcttcgatataaaaaaccaataaattatcttgtgtcggcgccttaccaacagatgtattgtggtgatgagtaaattcgagatgccaagaatgattggggtgccctaacattacaccatcaaaattatcatgatctctgaattcacctaatagagtaaattgcaatcctttgcaatacatatctttgattgcagacaaattgtctgttgctctggcaattctaaggacaggcgttgttttcattttttatagggttttatttaaaactgaatattatcagttaatattttaaattgatttagctaaatgtgctagcaagcagctagcacttattttttatcaacttaattttattgagaaaataatattaaacctaaaatattattttatatcagcatcaatgacttgataaaaagcattatcagtatctgaaattgtccaaacaccgagaatgacatggtatccagaacgctctggaacctcacatgtaattgagacattttgaaccggaagtttcccatgatcatcacgttcacaaaacggttttagatcaaattgcgcccgagtgagtggtttgttagggtcccaaccagatttagtaataaaaaattgccatgaggttgtactatgtctggcggttagcgtccacttaaagttgttttgacctttgttgactgtgacgtgatgccagcgctgagcgctttgttcgtttagaggactgaactggccaacgcccccgctggcaatttgaccatcaggtggccctgattccgggaaacctttaggcccttctacagattgcggttcatacatgatattgccgcagtctttgttggtacgctgataacataaaaaagctctactgggtggagaatctacatatccatggcgagacacggggtcagcagtactataaaatgggattgcaccaaaagtagtcaatcccaccaaaagtaatgactttttaatgttcatgatgaatttcctatgttgttccgtatttgattgttaaatacataaatttatctatatttattatcttaatcttgcgtataagagtattaattagcttcttattgtggtgcatataaatgtttataacaaacgtagtaagttataaatacttaatttatgatagaggtatgccagaaaaatatgttaattaatatattcaggaagtttgtttctgataactttgaaacaaatttttggataggagaaatcctatttttataggataattaaatataaaaaaacctccctataatagggaggacaagagcgaaatgagaagcaaatgagggtgtacaaaaaaataatacatttaagtacacacaaataaaatagactcaaatggcaaaatattcaataaacagacattaaacaaatcttaaagccaagagcgtatcccagtaggtattcattgttgatgtcagtttgaacactgctcaggttcaaaatggcaaataaaatagcttaatgggataggttctgagtatgccctgtattggtgggggcataagttaaaacgtgaaaaaatgatatcataaatttattacaatcaaacgcggattcggctaattattgcaatgtatccctgtcggagaagatgtttgaaatatggagctaacagctcgacaagccgagacgtcaggaaaagatttcaagctatctgatggtcgtggcttactagacgctataataatgtcgatgttttgtgtggtcggagtctatcactaaggaattgcgctgggtggaggctctatgggataactataaagtagagggagtggcatggatgatttactgtttttgttggccgaaagtgcctgtttatatgtacagtaattggcggtagtgtaaaaaaataaaattaaagcttgctaagtaaataaaagtagtgcttaatagcgtcatcggtttggaagtacagacctatttatgtaaagcaagtttaaagtagttcaccttttagcgctatcttcgataccacttcattgcgaatttcttctacttagtgcccataagtaaaacagaaaacaaaccttacaacgccttatggcaacttaaaaaattaaaggaattcaacatgtctaatacaatgactggtacagttaaatggttcaacagcgataaaggttttggctttatctctccaaaagatggaagcaaagatgtttttgttcatttctctgcaattcagagcaatgattataaaactttagatgaaggccaggaagtttctttctcagtagaaagtggcgctaaaggcccatcagcaactaacgtgattgctttatcttaaatcactgctgaacagaataagacgatagccttatgatagcgatgaaggtgtagaccagagcacataaggttattataaaagcctcgcagaaatgcgaggctttttcgtatctatcagtcgtagactgagaatttgcaactcgaccccagcaaaatttactgtagttctatatactgaaagactcaggaaaatattctaggctccgctccggcgtggtcttttttattttagggtgccaactgtctcttcaagtaaaattctataggataacacctgctgaaagttacgcattgggtggttaatgagcaactgtctttcactttacaccgtgtggaatgattcgtcccacggtctatttgtttttatcattgcattgagaatgaccagtaatttacgcatacacgcaacgatggcgactttgtttggcttgcctgcttcggtcaatctcttgtagaaagcgcagagaacggggttaaatctaattgccgttaacgtggccatatatagcattcgacgcaccattgctcttcctccaaagattgttcgtttcccccggaaaaatccagaatctcgattaaacggtgcaacaccaatcaaggcactaatttcccggcgtgttaacttacccaactccggtacatcagcgatcaaagtggctattgtggcaggcccaacgccttttactgtagataataaatcgagtttggaacgatgataggttttaatgtgtttagacaaggcagattcaatgaccttaagctgttcctgtataaagctgatcattaaagtgatgctttctcgaatgtctggatggcaattccccaacctttggcgttctgagatggaaagtacgaccaattggcgacgacgtgcgatcatggcttgcaagactcgttgctgagcagagggcaatatcctgactattttatcccggtctgttcgttgagataaaaccagggctaactgtgccagcacctgagcatctattntatcggntttggcttagttaccccatgccttaacaagtcacgggct

SEQ ID NO: 14946 - DNA, 15568 bp, Xenorhabdus bovienii
  Genomic contig Name=Xb4151_4152.C405
tcttgacctcaacatcatcaattttgatttcgagatccaaggatgtggtaaaaccactgccgttaaggttgtgagttactttcaccaacgtccaatgcgttccatcaatttccgtcttaaaatcctttagctgaataggtgtttcagggtagatatcagctcgtcctttcgccaatgtaatagagaactgcgccgccccccgctgcattttatcccaaacagcttttgcagcacgctccgcgttttccttgttagaataaatgcgggaaagcgtcagaacattttcctgagttcctgtcaaatattttgcggatttttgctgtgccgttgttgtcttatggtgctccgccgtcgattttctttgttctttagaagatggacttcccttggtatcgatattcttttttctatcaatatttccgttatccttgttttttcttttacgttctttttgtcctttttcaatataagcaggtttttcccttcctttttttttgtgatttttcttcgtcaaatcgatgccacctttcttttccagactcactccattggactgagctgacttagtaaggttcattccacgaggcgactcacttttatgttctttttcctctttaacgattcgaaattcttttttcttggaagagtctttctcttttaaggaaaggcttttgtctttttgaggaatattcttggctgacgattttttctcgctgcttccatattcaacaataattttaatttccccgttttttgattctacccgcctcaatttaaccgtctgtttagccgctgtgcgtgtatcctgccattgagcatcaacaccagtataagcttcacgatcagacagagaaaaccgatggctgtcccctgattcacgagtaatcaatacaagtggaatatcctgaccacttgaagttttattttgtccttgttgaacaaacagcaactcaccatttttgaccgaagcaatcgccccttcctgctttgccatccgagtcaaaaagctcacgtcagattcattggtctgatcaatgtgcatagagatccccttcaattcctcgctgattttaaatgtcagctggtttctcgcagcaatcgtactcacaatgctctctaacgtgtgtttatggtaagactcttcgcgtttaacattcaaattacctcgaaaatcagcactgcgggcacgaattgtcagccgatcaggcgcaccggtatgttcaatttcatcaacgacaaattttccctttggggttaaagaatcgccatgccaccccaattccaatgctagaatatcgcctcgggaaggaaatataagttgcccatccgcatcatccaactcaatatcgagctggtctgattccaaaccgcggttatctgtcagcgttaaagacattaaacgcgattggatgttccctgtaatatccttcttattagtttccaaccgaaaagctggcgcaccttctttaccagtgaccaaatcaaattggggaatccaatctgtgtttggtatcctcagtttaagatctagcattaggatgctccttaatttcacctatagcctttctcgtaagaccagaaggcttatccagtgatgtaggtggtttgccttttatatcagataattgatcctgtaaatcacccaacatttcaaacaaattgttatcaacgcgccgtaaggtcagtgtaaaactgatttttctggccgctccgcccgacataaattccgtttttgtctcatcaatgctttcgataacgaacattccataaattgcgccacttccatcaatgaaagaccacgccttacctctgtctgccatcaatgtcaatgcagtcagtgaaagagaaccgcctgtcagttcaggataaagttcccccgatagcgtaaccgtatcattatctgaaccaataaattgccatgcaggccgtgctcccacacggctattgaaagcatgtctccaactttgtttatattggaaactttggtatggcgttgttttcaacataaaaacaaataaaccaagtgcagccatcatgagaaatcttctcctctatcagaaagtgagctacgcatacgggcttgctggatacgttcccgttgttccaattcctgcctgaccacacgggcaatatcctgcgcggactgtccctgagcgccatagacatagatgttatattgtggtgctccgctaagctgcggtggcaggcttcgttctttcttcgcctgaacagcctcataagtatgagcaggcagactttgcgcatgcaacggtgcatcctgtgcggcaataggcaaagacattgaactaacggcaagtcccacggcagcgagcttcgccgtatttttccggctggttacattggctgggccgctaataatttcagggccacgctcacccgcaatgccgaatttcccggctgaaatagatccgcctgtatcatgtttagtaatttgtgccgcttgttgcgtagttgcgctattcgttatttcctgtgatgtttttacagctacttcctttttatcatcacctgaccaccatgatttgaatatgtcagtaatagaggtaattttccccttcaaggcttcccatttttcttgaatacccgttaacaagctgtcgatcatatccgaacccgctttctttaatttctctggaatagcttgaacatcactaacaatttcattccatctatctgaaattgattttttgatgctttcccagatttccaaagtattctgtttaacggattcccaagcaccactgatttgggctttgatattttcccaagtggcaagaacgctttgtttaatagattcccatttctcacttaataaggctttaatcgcttcccaaacttctgaagcgctttgtttaatagcatcccagttttggtaaataatgccgatcagtcctccattcatgaaaaagctcttgataccttcccatgcggcactgactatgtttttaattccctgccatacattgctacaaacatttttgataccttcccacaaggctgtgaattttggccccaacgttccccaattctgccaaatataaatagcagccattgcgataacaccaataatggcaagaatcgggttcgccatcatagcccgaccaatgaacattattgattttcctaatacactgaaagtactacttaaaaaagacaggccttttacaccaacatttgccagaatatttataccactacccaaaacaccaaaaactttttgaccaatattccctaatatttcaaggccttttctttggtttccaaaagtatctttacctcctttgttagatagcaaatcagcgccatcattaagtgagccaaaaactttgtttccggttttaccaaaaaaatccatagcggctcttagtgcttctaaagcctcagttcccaattgtgcgaataccttcaagccatctcttaaattctccatagcctgaatacccacttgagcaaatctattcagattggctcttaattcttccagagcctgaacaccaacctgagtaaatatatccagactggatttcaatttatccagcgcctgaacgcccagctgagcaaagaaactgaggctggcttttaactcttctaaagcctgcatacccaacttagcaaatacatccaggggagaggttaatttattcagagcctgaacgcccaactgcacaaatgcatccagtgtggattttaatttatccagcgcctgagttcccagttgcgcaaatatatccaatggtgctgttaatttattcagagcctgaacacccaactgcacaaatgcatccagtgtggattttaatttatccaacgcctgagttcccagttgcgcaaatatatccaggggtgctgttaatttattcagagcctgaacacccaactgcacaaatgcatccagtgtggattttaatttatccaacgcctgagttcccagctgcgcaaatatatccaggggtgcggttaatttattcagagcctgaacacccaactgcacaaatgcatccagtgtggattttaatttatccagcgcctgaattcctaattgtgcaaaaaaattcagactggcttttaattcttcaaaagcgttaagccccaactgtacaaatgcatccagactggattttaatttatccagcgcctgaattcccaattgagcaaaaaaattgaggctggcttttaattcttcaaaagcgttgagtcccaactgagcaaatacatccaggggagcggttaatttattcagagcctgaacacccaactgcacaaatgcatccagtgtggattttaatttatccaacgcctgagttcccagctgtgcaaatatatccaggggtgcggttaatttattcagagcctgaacacccaactgaacaaatgcatccagtgtggattttaatttatccagcgcctgagttcccagctgcgcaaatatatccaggggagcggttaatttattcagagcctgaacacccaactgcacaaatgcatccagtgtggattttaatttatccagcgcctgaacccctaattgtgcaaaaaaattcagactggcttttaattcttcaaaagcattaagtcctaactgtacaaatgcatccagactggattttaatttatccagcgcctgaattcctaactgtgcaaagaaattaaaattaactcttaaggacaccagagcctgaatccctagctgtgcaaaaatattcagactaacttttaaagatacaaaagcctgaatacccaactgcgtaaatatattcaaactgactcttaaaaaatcgaatgtttttataccaacatttccaaatagttgtatataaccaaccagagtttgaaatactacttttactgcaccagtagttacattcaaaaccgcattaattttattcagaatactaaataaaattgttatctttggattgatattaataaccaacttatctaacaatgtaaaattgttagtcatattccccgttgcaccaagattaaattcgttttttttactggatgaattttcctgtttgataatttgggtagtttgaataatattagctgattgactggcagcactaacctgcagcgttcttgtcgaattctgccgcgcagataaagattgtttaattgtttgattataggctttaagatcggtgcgtatacgcgcagtttcctgcgcataacccacgataggttttaagctctcaacggtcttattgagttttttgaactggttatgaattttatcgactgaattttccagctttttattatgccgttgaaaagatttaaaggaaccggtcagctttccaacggcactcagaaccttgtttagctgtgactgtatattactcattttctgcaccacttcttaaaatggcccgatgtcgccaatccaacagttccgacaatgacatttcatctgtcactgtcggtgaccagtgaaaaacggtggcgatatccgccaccaattcatcaacggttaattgttctgggaatcggacttgaccgacttcggtaacaaaaaattgaccacctccacactgagattaatcagatcaccgggtgacatcatcattaggtcatttttggtcaatacaggagtggtaacacgcggcaggacaagcagcatagaatccacatccatttccagcagcgcctgtaaacgtgcaccgcgcaatgcaccactggtaggcttgcgtaccatcacttccgtgatttcgccgttacctcgcgccaatggagcttccaattcgatggtgcgcagatcgtcattttgagtgttcagtgtttctgtcatggttcaaccttgtttatccgattaaaaacctgtcccagcaggtatggttcaaactccgatgagacaggaaataagttttaaaaaatctaattgctaaaaaagcgattaaaaaagaccgatattgcggcgatgctgctctagacgatcttctccgcccactttctcaaccatgttgatggtgtcgatttcaatcagctcttcgccatcccatgtcagtttgaaataagtgtttttcgcggtgattttggtctgagagttatcaccttgtttataagtgccgtgatcgaactcctggaagcggccacgcatcacaacttcaaccgcaaccacatcaccggtatcttcgcgctcaaaagaaccagcaaagcgcaacataacgccatctgctgtcgcaatgccccactgcttatacagttgagattcaataccgcccagagtgaattccgcatccaatgcgccttcatccagacccagatccaccattgcgctgccgttcatgccggcgccacgataagcttccagcttgcggcttaacttaggaagagtcagttcttccacgatcccctgatagttgttgccatcattgaacaaattcaggtatttaagtttgcgaggtaatgccatcagttagccccttatttattgatacttttagcgaaattcatcaggtaactatctgtaatgcgctggcgtaacatcatgttttccagtggcggtacaggtgtatagtcgtaatcgatggtcagtttgcctgctttcagcgtgtctttatcgttggctttttcgtcataccagcaacggccgtcgatgatgtaaccaccagatttcagttcgcggaacttggcattaataccttcaatgatgtcgcgtaccagtgatggtgtcagtggtttgtctattgcccacatatgtgcgtcagccatggtgtcagccagaacttgagcggtacgggtgtagctttcgaactggaacagtgcgtcatcagagcaagtacgggagccccagaaacggaagccgtttttgcggatcagcgtagtgatgccactcttgttcaacagatcagcgtcagttgcggtatcttgcagatcccagaagacgtcagcagacagaccggttacaccgttaacacccacgttggacagtgttttgtgccagccagtttcctcgtcgattttggcacgcaagcccagagcacgagcggttgcataagcgatagactcgctattggaaacagtatcccagctcaagaaatccggccaaatcagcatcagctcacgctgattgaagttgtcgcggtatttgatgacttcagagatatttttgctgccataagcactgacatacgccattgctttcagtttctgagcaacgctggccagttcaatcgcaaccgcttttgaatccagacctggaacacccagaatacgaggcttaacaccgagctggctttgcgccgccaacagtgcctgcataccggttttcttacctgcatcagtgacagtaccgatgatattagaaacggttacttcttcagattcgccctcagccacacgaacaacgacggtgacaggctgagcctgatcagcaatcgctttcagtgatgagtacaaagttccctttttccctgctttgccactggcgctcataacgtcagtaatcaaaactggagtgtttaatggaaatgttttttcgtctgcgtcaggaccagtacaaaccatacccacgatagcggtgctaactgtggtgatggtgcgagtaccttcattgatttcctgtacacggacgccgtgatgataatcttgtgccattttagcgttctcctgttaaggtgtgccgctatattgacggattgggtgggggaaatcattcgatgggaaatgtgtggcagtggatacaaatgcgttttgatatttttgttttaaatcagattattaaatgaataaatattaattatcagggtgtttttgaggatatttacaggtgttgttggatagaaatccaaattgctcaaataacacactcaaattgattatttttcatgctatatcagttcattatttatacttatccacatttttatagacaaattgctattttggttattttttgatagccaaaaatggcttattttggccgtttttttaagtcttctaggtgtatggggtgggattttgacgccggatcgttgggatcaatagattgtgaaaaacctcggtttggcggaaaccaaaaatcaggcccaggacgcagtgcccaattcaaggaaggtgaatgggaagacattgacgggggatgtgaccctgagtgcggaggatgttcagggagagccccgttttaaccagacgatagatctaacgggtttgagtagtgatcggtattatccggtatggtggaaattcccgtttaatgagcgtggagctaattcatggctgacaatacaccgtaattacgccgagaatcgggagaataaaaatccatttgggaaagatgtaactcatttagcagggctagaggtacaaatagaaggaagcgatacactctggggaggagatgctcagtacctgaatataaaacggatcaatcaacgttatcgtaataccgtcaaaaagattcagtatggcatgatgagtattgcaaggtctgttgatggtaagtaccctctatactatgattggaaatctggcgatatcacagaatgccgtgtatatagtggatgttatttacgaggaggattaacctatcatgttactagtaatttcaataacttagattattcccgtaaagaagatgaagtagaaatatggcatggcgtaagtgattctgataagcgggagattaaatggacggttaaatcttatgctattgatgatcctttattaggaaaagattatgatgatacagtaacgccttacggatctgatattacagatatgctatatcctgtaggaatagttgtatggtttgctcagaataaaaatccaaataatttatttccggggacatcgtggaaatatattggcgaaaatagaactgttcgcttggctgctgctaatggttcaaatgtgttatcaacgggtgggaatgatactaaatggttatctgtcaaccaaatacctaagcacagtcattcttttagcgcaaatactagtaatgcaggcggtcataatcatagtcgtggagatatgaacattactggttatctaccaagtgttattcaacatggggatgatgtttttggtggtgcttttgctagaaatgggcagaataaaccagccgtagactatactgaccactggaaagaacttactacatttgacgcatctcgtacttggactgggcatacatcatggggtggtgagcatattcataatgttagtggtacaacatcagaaattggtaaaggggaaggatttgatgttactaactcttatgttatgttaatggggtggtaccgtatttcttaatttggttttttatataatatagtattcaggggctcttgcccctgaatactaatttggctttttaggccagccaagtttgttaatacctgaaatatcaatatcaatcaatttaacactataaacttcccactcatttaatagtgaaatttcttcctttgaggccatattaagtctaaccttacgttccaattgaataattcttttttcggcttcctgtaacagcgattgtttttgattttctatttgctttaaatcatgttgtttctgttcattaagatcagttacccactgtttcccatcccatttatcgaataaagtcttaggttctagtagagttaattcaaaaggtatttcgccaattgactgtattttcataggttttagggttttgatgtgataggcagtttttccacggtaatccggtacattaatccatgactttccatcagtactacgacaaacagcgatatctaccgattctggtagttctggagcatctgaataagctccagcagacaggctaacgccaacgacaatgcgctccatatctgcacaaatatattctcttgtttcggtattagtccgataaaccattactcagccattagacgttgcaaaaccattttcatcaaattctggtgttttaatatcagttgtgtatttcattatgctgctctcactatatataaaaatgcgatgttacggggacgggtgctaaaccaccaagaagcccagtcagacactcttaaagctgctgtagagactattcctgatattcctgaatcagtatttccaccaggtattggttgattattaggagttttcgcggtattaggttgtgcttgagttgtaaaatcagcactatcgaaaggaatgccaatagcttctgcacgaactccccctacataatcaagaactaccgttcttatcagagttggtgattcataactgagcggaatacgttcactatcaacgggcagcactgacagcgtggaaacgacactgtgtgctattgaaccgtgtagactgtccggcagcaccagacattgactggcctaaagcgccagagtgattattaggggcacattgatctgcaccccaaaagttggacgctatacttcaacttaaggggtgctttttatgaagaagaaaagatattctcagacattcaagctgaaagtggttctgcactacttatcacacccagattgcggatacagtcgaaccgcatcacttttcggactgcatcgtaatttggtaaacaagtggattgatatttatcgcgttcatggtgagcatggactgaaaaaatcattgaacaggtcttattcttttgaatttaaaaagcatgtcgtactgaccatccaacacgaaggactttcattatctgaagccatgaaacgctttaaactgaaagatacagggatgatatctcgatggttggctttgtacagaaaagggggcattgagctactgaagccccgcaaaaggagcagaaaagcatgtacgcgcaacgctgccacccaatataaaccggagtccacaaaaagcgcaaaaccgccccctgaacttttggatgagttagcttatttacgggcggagaacgcctatctaaaaaagctcaccgccttaattgggaaggaagaaaacacatatcagcaaaaacaaaaattatcaccgaattgaggcaatttttcccgctgaaaactttactgaaggttgcagagatatcacgcagtacatcctactaccaccagaaaaagactcagcaaaaagataaatatgctgatgtaaaaatccatatctatgatatttatcatcagcataaaggtcggtacgggtacagacggataacgttagcactgagaaaacaacagattcatttaaatcataaatgcgtgcagcggttaatgcagacgatggggctgaaatcgcggataagggctaaaaaatactattcatacaaaagagaaaccggctctgttgcggataatctcttgcaccgtcaatttgaagcagaacagcctaatatgaaatgggtgacagatgtcacagaatttaaccaccgggggaaaagctgtacctgtcacccatgatggatctctttaatagagaaatagttgctttccgaacttcccgtaagccggtctttgatttggttaaaaatatgttatctgatgcaatggaaaagctgaaatcacatgagaaacccctgattcattccgacccgggttggcagtaccagatgattcattatcagaaccaaataacagaaaacgggctcatacaaagcatgtctcgcaaaggtaactgtttagataatgccgctatggagagtttttttggaatattgaaatctgagtgttatcacggagtggaatttagctcaatctatgagttggaaaagacgataaccgattatatttattactataatcatgacagaatcaaaattaaattgaatggattgagtccggttgagtacagaactcaatccattatggggatataatatatgtctaactttttggggtcagatcaatgtgcccctgattgttattttggcgctttaggccagtcaatgtcaggtgctgctgtggtgtccagtcgttgcagttcaatgctatacagctcccatgcatcaaaccatttttgctcatctggcgttgctatttccctgcgggtgatacgctctagccgcataatttgcgtatcaacctcatttaatagatacaggcgttttgttgcagtctgcacttgtaattcctctggcgtgggaggtggcgggcctaccaatatgggcagaccattagcgtcagcaataatccgtttcctgttcgcctagccattaaataactgacgatgtaattcatcgctgatcggtttcaaataatctggatagtcactcggtttatcatatggcctgtaaaaaaactggagtggctgcactgtaaaaataatcgctgtagattggttttattttatcatgtttaatgctggtattcataattatctcaatttaaagaaatggttaccttcaacagctaattacttttgatacttcacacggttatgattcacaagccatgtatgaggggcttgttgatacattgggagtaggaacatagattaaaaaatgtgaatgataacttgaacaataacattcctgtgagatttttgaatctcaatacgttagaattagcccaataaaatcagatactgccaagcagcatagaaaaacgagcactctctatgaatattttcgacctaaaatgcaaacttttcggatggcaagaaacaaacttcactgaatacgaaaagtcttatttttcttttggtggtaacttagccactcatcctctcgtattaaaatttatccatgaacgatataattttaaagaaaaatatttcataaataaaaatagaaattctattaacacatcaatatgtgtatgggataataaatacttagctaatgatcctgcttgtcctttatcaaatgaaataggtattgttgtaccaaatgatgaaatagtgataccttcaagtgaaaatgctcgttttctattaccgattaagtcgaagttcatctcaccattaaattcagaaaatattattaatttaactttcaaacataatgccaaaagatcattatgtttagctaagcctttatcagaaaaatcaaataaaaaatacaaatatagactaaatagctttatgaaatttggtggtgaattagtagatgttcaaatatttagtgcggatgaattaaccgatttttattctcaacttgtagaagaacgatgggggacatgtagttttgataaagaaatgataaatgagttatttcatttaataaaacctatgatttttggtaatgttttattttttaaaggccaaccttgcgcttttcatttcattacaaaaactcaattccatcatcacacaaatattgaatttattcaggctggaatggatagatctgctgaattagctaagtattctattggttcactactgatatggagtaatatatataaagctgtgaatgagtttgataacgttagattttcatttggtagaccatcacgagattataaattaagatggagtaacatttacccaataggcagaacgattacactgatttaaaataatttacctttgattccctaggtaattaaatcacctaggggtcattagaggaatattttacttcgcggattaaatatatttattaatccaataataaatatatttagtaattatttaagctgctctcactatatataaaaatgcaacgttacgaggacgtgtttctttaccaccactattactaactgggtatttttttctgccgaaatcagaaccagttccaaagaagtctgcccatactgaattacctgtttcgttccttatagcttcaaattcatgattgtgggatctaaactcatctgcctgccatgatagtgccttacgcccagaatcaacattacgtcctgcatccagaccacgaataaattcaccacgtagatcaggtaatacaccagatggatacgctaatgctaattgaggacacttagctttatcaaaactttcaccattacaaattaaataaccaggaggtggtgtttcttgtggccatggtaaaggaatgccaacaggaatattattggtgctagctatgtcatcagttgtcgctacaaccccatctttttgagggaaacgtaatacccattgattgttatgatctttatttcgttgaacgaaatagatgccttttccatcttcagttgtttctaaaaagatataatctccagtattttgatggacataattaattctcccataaccagcatgtctaatggtgtgttctaaataagaacttattgtaccagggcaatacatttcaccacttttatttaaaatccattctccaccaccatcatagccattatttatatgtattccatcaccacctttgtctttatatatccaagcacgtgtttgcccatcattatctctaagtgaaaaatgctgtcttccatctccttgagagataacaacatttgaagcaactaattcaccattaagtcttccacctgtgattggataagcatttttcgctaaattgatggtttctgagtaatcatgcgcataaggcagcaccgtatcgtcataatcttttcctaatagaggatcatcaatagcataagatttaaccgtccatttaatctcccgcttatcagaatcacttacgccatgccatatttctacttcatcttctttacgggaataatctaagttattgaaattactagtaacatgataggttaatcctcctcgtaaataacatccactatatacacggcattctgtgatatcgccagatttccaatcatagtatagagggtacttaccatcaacagaccttgcaatactcatcatgccatactgaatctttttgacggtattacgataacgttgattgatccgttttatattcaggtactgagcatctcctccccagagtgtatcgcttccttctatttgtacctctagccctgctaaatgagttacatctttcccaaatggatttttattctcccgattctcggcgtaattacggtgtattgtcagccatgaattagctccacgctcattaaacgggaatttccaccataccggataataccgatcactactcaaacccgttagatctatcgtctggttaaaacggggctctccctgaacatcctccgcactcagggtcacatcccccgtcaatgtcttcccattcaccttccttgaattgggcactgcgtcctgggcctgatttttggtttccgccaaaccgaggtttttcacaatctattgatcccaacgatccggcgtcaaaatcccaccccatacacctagaagacttaaaaaaacggccaaaataagccatttttggctatcaaaaaataaccaaaatagcaatttgtctataaaaatgtggataagtataaataatgaactgatatagcatgaaaaataatcaatttgagtgtgttatttgagcaatttggatttctatccaacaacacctgtaaatatcctcaaaaacaccctgataattaatatttattcatttaataatctgatttaaaacaaaaatatcaaaacgcatttgtatccactgccacacatttcccatcgaatgatttcccccacccaatccgtcaatatagcggcacaccttaacaggagaacgctaaaatggggtaacgagctcgaattcgcagtaggg

SEQ ID NO: 14947 - DNA, 22824 bp, Xenorhabdus bovienii
  Genomic contig Name=Xb4151_4152.C406
aaaatattggccttaaaaggtggttgctatggctaaaactaaaaatacttccctttttatagaacagcttagtgaaattcagcgctatgttacgcaaaaagcaggaaccgaaccgccattttcaggaaaactactgcataacaaaaaaagtggcatttatcactgcctgtgctgccgtcagccattatttatttctgacactaaatttgattctggctgtggatggccaagcttttaccagccgttcaatgataaatccatcaattgtattgatgattattctcacaacatgcatcgaatagaagtgcgttgcagtcactgtcaggcacatttagggcatgtttttcctgatggccccaaaccgacaggagagcgtttttgcatcaattctgcggcactgcgcttcattgacgaggaaactggggatgaaacagaaggttagctttgttactgggcctgttttttgacaaaacagcaacgtaaatcagtaattaaagaagaaacgattcagcataatgtacgtagccgtaaggaaatatcgatgaagttggatgatttactttccgccatgacacctgaaatttatcagagattggttcaggctgttgaattaggcaagtggcaggatggtgtaccgctaacgccggaacagaaagagcacagtttacagatggtgatgctttggcaagccaagcataaccacgatcctgaacatatgacgattggtacggatggccaaattaccataaaaagtaaacaagagttgaaggtcatgttccagtcagaaatggtcgtgaaaccacagccagaagaatgaagaaataacctcgtcttgtgcagtgatacgacgaggttatattctgaaatattatgtccagaagtatttattggttgccggtttaaaaaagtgttgttaattcatgcagtgggattagcttagcgcctttagttgccatttccttaagtgctttcaggctgtcattatcctgaagattgacgccacgacaaccatcagtaatcacgtaggtttcataaccttgttccagtgcatccagtactgtaaattttacgcagtaatctgtagcgatacccgacataatcagtcgttgaatattttgctccgccagccacccatgtagccgggttgcgctcttatggtcattatcaaaaaaggcactgtagctgtctatctgcggattttcacccttacggaaaatttcttgaatagcggattgattcaacgcaggatgaaaatctgcgcccgattgcccttgtacacaatgaacgggccaccatatttgaggaatgccattgagcaacccagattctccaacaggctgacaggcattgactgcaaaactcatatgattggcgggatgccagtcctgacttgcgataatagtaatattgtttttctggcagaggctgatagccttattcgctattgcgatgacctcttcactctctttgactgccagtgctccccctgagcagaagtcattttgcaggtcgataagtaataatgctgttttcattatacctccgatttctttttctattatttatctgaatagctcaattcgccacgtagattctgttgcataaggtggcggatctcttcggattcatagggctggctcaataaatagtgcaatttggtcagggtggcttcaaaagtcatatcatagccactgattacacctgatgtagccagagcgtggccggttgcataacctttcatgttgacgcgcccagaaatgcattgtgttaaattgaccacgataataccccgttcagtggcttcccttaagatcttcaataaatcagcacgttgtggagcattaccaacaccataggagcgcaatatcaatgccttgacaggttgcatcaggatattttcaacaacttggctggataatcccggatagatggtcacaacaccaataggctgtgatgtgatctggtgtacggtaaacccaccatgactggcaggtatcgggcttgtattgaacgtacggatgttgatcccagcttcgatcagtggctgacagttgggggatgagaaggcttcaaagccatcagcatgggctttaattgttcggttcccgcgaaacagtttattgctgaaaaataaaccgacctcgttgatgggatagttagcagctagatacagagcattaagtaaatttgtctgaccatcagaacgcagagcttccagtggaatttgtgaccctgtcacgatcacaggctttttaagattttcaaacatgaaagagagtgctgctgcggtaaaagccatggtgtctgtaccatgcaggatcacaaagccatcgtagtcatggtaattctggtagatatcgttggcgataattccccagtcgtttggactcatatcagaagaatcaatcagaggttggtgttcacggattgtaaaggttggcatttctggacggtgaaactccggcatctgtgagagttgtcgttgtaaatgaccagaaacagggatgtagccattaggggagcgctgcattccaattgtgccgccagtgtaaacaacgtaaatagatttcttctgcatgttaacgcctcaataaaaatactcagccggattatagggagtatatggaataaaaaaagcctgatgtaaggatcaggctttaaatttggtgatattgtctgacgttacttctagcggatatctgcacagttcaggcagaacgtatagatattctgaggatcattcatacggttataaaatacagcttgctgcttcatatcttgcgcaatttgggcaattggagccggcagcattgattgcagggtatttggcaacagtgcttgtgctgatgaggaaaactccagcatgagtttttcagagaatgagagttctggttgcatccaattcaatgatactgttttgataccagccaattgagcagctttattgactgcatcatcaaagtcacctaactgatcgaccagaccatttttcttggcatcactgccactccagactcgaccctgagcgatttctttaatttcgttctgtgtcttctggcgagattgtgcgaccaattcgataaatttatgatagccactttcaatagacagttgcataacatcagaaaacatagggtttattcctttggtaactgaaatgtctgccagcggatacgttgaaataccgtctgtatttacaccaagataatttaagcctttttcgtaagtattgagaacaccaaaaacaccgatagagcctgtcagcgtatttttgtcagcgatgatgtagttagctggggttgaaatccaataaccccctgaggcagcaagtccacccatggacacaacaatcggtttttgattttctttaacagtatgaccttctttattttttactgttgtgccttcacggatagcgacgagttcactgcggataagttcagatgcactgatactaccaccggggctgttcacgcgtaacacaatggcttttatatttggattcaaccgtgcctcgcgaagttgttccgctatggtatcaccacccgctatgccttctgattgtctgccatccatgattgcaccttcggcaataattacggcaatgttgctattgctttgatcagaatttttgattggctgctgtgcgatataatcatagaggctgatgtaattgaaatgtttgtttttctcatcccaaccaaatttgttgcttaattctgtttcaataacattccgaggtttaatttcgtcaactaacttattttttgcagcgtacagtgcactatctccacccgcttgacggaattcttcaataaactgggtaggttccggcagcactctaacggcagggatttttctgttaactgcaatcgtattgcggtaattgttccaaagttcattcagccagagactatctgcttggcgtgcttcttctgacatattgtcccgtgtcattggctctaccgctgatttatatgtgccgacacggaaaatatgggtggaaactttcagactgtccaataatgacttgtaatacagatgattggttgagaaaccatgaagagacactgctccatgtggagaaaggtacactttattggcatagctggctaaataatattgtggttggctataactatcactgatggcgataacggttttaccagctgccttaaactcattgatagccttaccaatatattgcatggagggctgatcggcaccgagaaaattatccagttttaagaccataccagtaattttagcgtcatgttttgcccgtcgaatactgtcaacaatgtcgaacagagacgtttcctgtgagctgctactagacacgccgataagatcccggccaaattgatctaatggactgcgggcggagacttgatccacaacaataccagacagatcaacatataaggctccgcgataatcatcaacggatttggattgttgctgataaactagaacaccagtagctactacaataactagtaggataaaaatcagatttgaaataagttggcgagcgaaatttagcagtttccaactccatttaaataatgctgttataaacttccataaaatacgcatgtcgtctccaagtatgagagcaaatagggttatcctaatcagctaatccgtaaatgtcagccggaaatcacaggaatgactgaaaaaatagtttctgtactttcatttagtaacgaataaacagagaatgttgagccgtgacagattatcttattcaggagaaaattatgaatgctttggaacttttattaaatcgtcgttcagcttcacgtttgaccacgcccgctcccgaaggaaatgagctggagtatattctggcagcagggatgagagcgccagatcatggggcattgcgtccttggcattttgtcgtcatgcagggcgagggtattgataaattcagtaaattgttggaaaaatcagcgattgagaatgctttgggccaagaagttgaggaaaaagcgagaaatgcaccttatcgtgcacccatggttatcactgttatcgccaaagttgttgaaaatacgaaaatacctgcatgggagcaagtcgtagcggctggttgtgcggtacatgccatgcaaatggcggctgtggctcaggggtttggtggaatatggcgttcaggatcatggacagaagatcccgttgtcaaagcaggtctgggatgtggagagaatgataaaatcgtcgggttcctctatttgggaacacctgtactcaaagcacctgaaaaagtagcattaccggatttgactaactttgttagttacttctaagtgaaatcagctatgccaactgaaatccgtctgactcagtatagtcatggtgctgggtgtggctgtaaaatctcacccaaagtgctggagactattctgcgcagtgagtggccaaaatttttcgacccaaatctgctggtgggaaacgaaacccgtgacgatgctgccgtatacgatatcggcaatggtactggtatcatcagtaccacggatttcttcatgcctattgtcgatgacccatttgattttggccgcattgcaggcactaatgccatcagtgatatctatgcgatgggcggaaagccagtcaggcgattgcgattttgggctggccaactgctaaactattcccagaaatcgcgcaaaaagttattgaaggagatcgggccgtatgtaaattgacagttatggacatttgattggggagatgacagcgcgtcagcgccatctcttgtgtgatccacaaacttcgggtggtttattgctggcagtactgccagatgccgtggaagaggcgaaagccattgcacgaagccacaacattgatttaattgccattggtgaactgactgaaccacactcagacagggcattgattgaagttattgaataaaattccatgcgtctttttattgcagaaaaacccagcctcgcgcgagctattgcagatattttgccgaaaccccatcgtcggggggatgggtttatcgaatgcggtaacaaccaatttgtgacttggtgtgtaggccatctattagagcaggccgagccagatacctacgatagccgttatgcgcgttgggtcttgtctgatttaccgatcattcctgaaaaatggcggttgaagccacgggctgctgtggctaaacagctcaacacgattaaatcccttctggaaaaagcggacgaagttattcacgcaggtgaccctgatcgcgaagggcagttactggtggacgaagtgctggattttctgaatcttagggatgataaaaaacagaacgtccagcgctgtctgattaatgacctgaaccctcaggcggtaatcaaggcggttgaacgtctgagaagtaatcgggaattcattcccctgtgtgtttccgcactcgccagagccagagccgactggctctatggcattaacatgacccgtgcttatacattattggggcagaatgctggctatcagggagtgttatctgtcggacgtgtccagacaccggttttgggactggttgttcgtcgtgacgaagaaatagagcactttgtgccgaaagatttctttgaagttaaggcgtacattgttacgccaaacgaggaacaatttacggccttatggcagcctagtgaatcctgcattgattttcaagatgaagaaggacggctcatacaccagccattggcagagcatgtagtggctcgtattacgggccagcctgcttatgttactgcctatcaggataagcgggaatcagaaacggcaccgttgccattttctctttcttctttgcagattgaagcggccaagcgttttggtttaagtgctcagaatgtactggatatctgtcagcgactttatgaaacccataaactgatcacctatccgcgttctgattgccgttatttgcctgaagagcatttcgtcgggcgtcatgctgtcttgaatgccatttcgatacattcttctgatttacttccgcaggatgcactggagagtgataagaagaatcgttgctgggatgataagaaagttgatgcacaccatgcgattgttccgactgctcgaagcagccaagtcaatttgacagaaaatgaaaggcaaatttatggtttgattgccagacagtatctgatgcagtttttacctgatgcggtattccgtaaatgtacgattgaacttgatattgcgggtggcaaattcattgctaaagcgcgttttctggccgaagcaggttggagaactcttcttggcaacaaggagcgggatgaggaaaatgaaggcactccattgcctgttgttgccaagggggatgagcttttgtgtgaaaaaggggaagtggtggaaaggcagactcaaccgccgcgcccttttagcgatgcgactttactatctgctatgacaggtattgcacgatttgtacaggataagtcactgaagaaggtgctacgtgcgacggatggattaggtacagaggcaacaagagccggtattattgaactgctgttcaaacgggaattcttgtacaaaaaagggcgtaatattcatgcaacacctgctggacgagcacttattcatgtattgccggatatggcagtattaccggatatgactgcacattgggaatccaaattaacgcagatcagtgagaaacagtttcgttatcaggattttatgctgccccttcaggaaacattacagcagttaatctggcaggcgaagcagtatcggaacttgaaagcttttagggacttgcctcctgttcctatgaaaggcaaaaaagggaaaacaaaacaggtaaaaaagggcaaagaaaaagtgaataaaacggagtaagagtaaccagaatgaaaacacagcaccgttattgaaggtgctgtgttttcatgtctgaaaactatattccaaactccgcccagaccggtgcatgatcagatggtttttccatgctgcggatagcgtaatctatgccagaagagaggcaccgttctgccaatgggcggctggcaagcagcaaatcaatgcgcagccctcgattatcatcaaacccttttgagcgatagtcaaaccaagagaactggtcactggcttctggatgctgtgcccggaatgtgtcgattaagccccagtctttaagacgtcccatccattctctttcttccggtaaaaaggaacacttccccgtttttaaccagcgtttctggttattttctccgatcccaatatcgagatcagttgggctgatattcatatcacccataatgagaatatgtgaatctggagattggtttttttccagatagcgattcaggtcctgataaaatttttcttttgctggaaacttaaccggatgttcacggctttcgccttgaggaaagtaaccgttgattatggtcattaagccttgcggcgtttcgatatcagccatgatgatgcgcctctgtgcgtcatcatcatcagtaggaaagcctttacgaacagtaacgggttgctgacgggtgagcagggcaacaccgtagtgggatttttggccgtgatagaagatgtggtaaccaagtttgctaacttcttctaaaggaaacatttcatcatgaacttttgtttcctgcaatccgataacatctggttggtgctgttcaacgatggcagcaagttggtgaggacgcgcccgcaggccattaatattgaatgagacaaatttcatatcgttataatcaccattagaataagctgtttttcaatgttaacagatataaataagaatgtaactatttattaaataataatttttggctgattacttggatatttagctattttactcctatatgacatactatactgaatataatactctcattacctgaaattttgagtgagtaatcgttttaaataatgaaaaccatagaattaataaatggtaagttaatggatgaataacggtctgttagttataattggttatattcaacatttgatattataatttttgaaagtgtttttattttataaatttattttgtgtcacgcattacaaaaaataattaatgaaaaagtagaagagttaatcaatctctgatagaaaattaaacgtgtaggtcatgcttatatttattaatggcttacaatcacggtggaatattcatcatgctatagatgaataatatagttcatctaaaccgcattattgcatcagggactggtatttttatataaatgccatttgaaaaacatttgtttttattgtacaaaattataccttcataatatcaagtttgatttagcggttacctgatgagaaggccatttcaaggaaattattttagccacaagttacataggaacggtgaattatgtttttttctcgtaaattagaagcattcatggcggtggtggaaatgggttctttaagcaaagcggcaagagtgatgaaccgtactactcccccagtcgctaaatcaattaaagacttcgaagcgacgttaggaaagcgcttatttaaaagggagaagtttgggatgattctgaccaaagacggagtggaactatataatgacctaaaagaactttatttgaaagagaaagaaattacaaagaaacacatcagcgggagtatttgtaatgttgtaaatatataccatgattggggtaagaaaaagcatctaatttcgctttataaagcagcagacagaaataatgctcaagttaatatattacgcttcagttatgataacatcgatgaaatagttgactatgagggcaatacgataattttaagctcagaaaaagtactcagtgatcgattcagccttgtccgaaaaattgaaggaccaaatttagggatctgctgccgtaaggaattattggatgaggttcacggcgactttactcaattgctgaaaaagagaacatggttatgtgacccagtactctataaaggtaatttgataaagaatttagaagaagaaatgataaaaaatggagagaaagtcaatatacggcaaatggatagtatcgagtgctgtcttaattttattcagtcaacagattatatctttattacagattcccactctggtgcattggaagagggagaaagcttaggctttattccaatatcacgaactgatgcagttaatcagtgttatgtctacaaatcaaaatctcattcaagtgtgttaaatcgctttatagactctgttagcgatatggagtaatcagattgcataagcggagtgaaatatcatacccaaactccgctcttggtgcttattcaaatacgctaattttgtaatattcatctgctctttgagcgaattacttgttctttccccatgcggacacctgttgattgtggcagttgatgaaagtaacagaacatctatttgatggtgtgggggaaggataattcgttacttctttccccttcctacggatcaacgagtttcgcatattgttatcttacttcacatactgttatttcgctgtgattaattcgagccttgatcgaaggtttttagcttactcaaagtgggaatttattgacttttggatttattggatattaagaatatttcttggatggtggtgggggaaggattcgaaccttcgaagtctgtgacggcagatttacagtctgctccctttggccgctcgggaaccccaccaaatttttaaattgtatgctatcgttgacagcggacggcataatatcagataagccgccgctgtaaagtagataattgaaaataaagtatcaaatgctgattttttaaacttgatgctcaaatcccgttccatcaggtcagatcatcaacagcaataagtacctgacagataaaaaatactttatcttttatcagagaataacagtacgattaccatacacaaaaacccgctgagaaaagacccagtgcaatgcctgactcagcacatttttttcaacatccaatcctgcgcgcttcatctcctcggcagtataggtatgatccacatttatcacatcctgtgtgatgattgggccttcatccaagttatcattcacataatgtgcagtagcacctattattttgacgccacgctcataagcctgatgataggggcgggcaccaataaaagcaggcaagaatgaatggtgaatgttgatgatttggttcggataatgctgaacaaatgctggcgtcaagacacgcatatacttagcgagtacaacataatcgggtttatattgttcgatttgaaccatcaatgcttcgtcatgttgttctcgggttaaaccatcatgactaatgtagtggaacggaatatcaaattgttccaccaagtgttgcaggatcgtatggttgccgataacggcagcaatctcgacatccaatccgccataagcgctttttactaagatgtcaccgatacaatgagcttcttttgtcaccataatgacaatacggcgacgacctgctgtatttaattcacggtttgaacccgcaggcaaggcatcatccaaatcggctagaaatgtttcatcattgaaaataccttccagctctgtgcgcataaaaaaacggccagtacgatgatctacaaattcattattttgaacaatattcaattgatgcttgtagcaaatgttcgtgatctttgcgattaatcctttggcatcaggacagattgtacgcaagatttttttttgtatgtttgcgttttgcatggattacatgatccttaaaggttcttcactgtgtgtgagttgttgtgtttgatatttggatattgatctagccacagcactttttgtattttttgcctgaaccacatggacaaggactattacggcctgtttggggacgtatgccatctaaataaaaccaatgccggtcaatgcgcaaaaaacgggagcgctcatggatcaattgtctatcttgctttccttgctcaataaagcaggctgaaaattcgacataggcttcgttattatgttgcccttcacttgtctcaataacatttagacctagccactgtacactcgcaaaactttgttctatttcagaacgccagctttcagcttgacaatccgggtgccaagttgcgatgagataatctgcattttttgttgcataagcactatatctggaacgcatcaaagattcggcatctggagcggagtggtgattttcaagataggggccgcagcaatgtacgaaaagagagtcgctgccacaagggcatatttttgtcaaaataactccagttgtttaaatagttgctgttaatatgaccgatactgcaaagatatgtaagagtacaaatagtaatgacctattggactatcattggctgatgatacccgaatatgggtaatagccgcaatgcttggtaaggggctactgttgtggaaaaggtattgcaggataagaggatattagttgtagaggatgaacccgttttttgctccttattaacagattacctaaactctctgggtgcgataacgatgtgtgcatcaaatggagaaatggcattacagatggttgatagagagataaaacctgaactcattttctgcgatttaagcatgcctattatggatggcattgaatttatgagccatatggcgatgaagggattgactattcccatcattattgtttccgcaacaagtaagatgacggagatagatgatgcgctgcgccttggagctaaagacattctgttaaagccgatagccaatctcaatgaggtaaaggaaatggctttggattatttacatccgaaggtatttatgtctgatgcgatagagcaaaaccgcctgattcaggaactgtcgagactaaaacaaaatacggaatcagtctggtgtttattaaaacaactacagccaccggtctcccaaactattgctaactgtagggtaaattaccgcttattaaacacagtaggtaaaatgggtttggtttttgacatcacagcactttctgataatgaaatgattttctattgtctggatattagccgttcgaaagataatggtgctgtatctgcactgctattgagagtagttttcaataatttattgaaaaaacgaaagtttcataaaaaaagtggtctgccagatatgcaagagatcatgaactgggtgaaccggatattaaatgatacggagatttcagaaccacttccattattattgggttattacaatacgcataataaaaccatcttaatgtcatcagcaggattaagtgcgcgtattcagtctggtaatcatcaacagcagttgggtagagggattcctcttggtacgttgaagataattcattcacatcaggtatgtgaacatagttctctttggcaatgccgcatatggaataacaaaaatcaaataaaactgatgttttctccaccattttatcagtgatcctataacatttatgcaccactctcaggcgatattaaatattgaattatgggaatgtgattaaacgccagcgtgctgtatatctagctgagttagctggtatacttgagcgcatcattttttacgcctgcttacgcgggcgattttcttcacacatccgtttttttagaaagttagtgctaatgtttaagctgcaaaaggagttttttcagcgaaaacctagccgtaggagacaatataatgtcaattataaacaaaaagataaaaaaagctgttatccctgttgctggtttgggaacaagaatgttgccggcgaccaaagccattcctaaagaaatgctcccgctggttgataaaccacttattcagtatgtcgttaatgaatgtattaaggcgggtattaatgaaattattctggttacgcattcatccaaaaactctatagaaaaccattttgataccagttttgaattggaagcgatccttgaaaggagggtcaagcgccagttgctagatgaggtacaatcgatttgcccaaatcatgtgacaattatgcagacccgtcaggggatcgcaaaaggattgggccatgcggtgttatgtgctaagccactgattggtgatgaaccatttgctgttattctgccagatgtcattttggatgaatacagtacagatttgtcgaaatataatttgagtgaaatgttgtcacgctttaatagcagtggagcgagccagatattggttgaacccgttcctttggaaagcgtcgcagattatggtgttgttgattgccttggcgaaaatctgcaacctggtgacagcaagcctattgctcgtgttgttgaaaaacccaaaccggaagaagccccatcgaatctttccatcgttggtcgctatgtgttgtctgaaaaaatctggccattattggcgaaaactgcaccgggtgcaggagatgaaattcagctgacagatgccattgctatgctgatggaaaaagaacccgttgaagcttatcatttgcaaggccgcagtcatgattgtggtaataaattgggttatatgcaggcattcgtcgaatatggtatgaaacataaggacttaggtacagcattcaaggattggatcatgacattgcagaatcagatcgaaaaataatctcttggtaatttaaggtgtgatatgaaagttactgtatttggtattggctacgtgggcttggttcaagcaactgtatttgctgaagtcgggcatgatgtactttgtgtcgatgttgatgcaaaaaaagtcgaaaacctgaaaaatggccagatccctatttttgagccaggtttagtaccgcttgtgaagaaaaattttacggaagggcgcctgaattttacaacggatgctaaagccggtgttgcacatggcaaattacagtttattgcagtaggaacgcctcctgatgaagatggatcagcagatcttcaatatgtcactgctgtagcccgtactattgcggaaaacatggatggctacaaagttgttgttgataaatcaacggtacctgtaggtacggctgataaagtcagagcagtgatgcaaacggcattaactcaacgcagcgcagattttccatttgatgttgtctccaaccccgagtttttgaaggaaggggcagcgatttctgactgtatgcgtcctgagcgtattattattggctgtgataatgacaatgtgattgatgtgatgcgcgaactgtatgagccatttaatcgtaatcatgatcgtatgattgtcatggacatccgcagtgcagagttgactaaatatgcagctaactgcatgttggcaactaagatcagttttatgaatgaaattgcaaacttggcagaaatgttaggggctgatattgagcatgtacgtcagggaataggttctgattcgcgtattggctatcatttcatttatccaggatgcggatatggtggttcatgtttcccgaaagatgttcaggcattgatccggacttccgagcagattggatatacacctaaaatacttcaggcggtggaactggttaacgaaaaacaaaagagtaagctgcctacttttgttaaacgccattttggtgatgatttatcaggtaaaacattcgcaatttggggattatcatttaaacctaatacggatgatatgcgtgaggcatcaagtcgcgtattgatggaagcattgtgggaaagcggtgctaaagtgcaggcatatgatccagaagctatgcaggaagctcaacgtatttatggccagcgtgatgatctttctcttatgggaacaaaagaagcggcattaaaagatgcggatgctttgattatctgtacagaatggcagaatttcagagcgcctgatttcgatatagtgaaggattcaatgaaatcgccaataatttttgatgggcgcaatctttacgatccagaacgcctgcaatcgcgtggattcacttactatggcattggtcgtggcgcctctatcaatccagttgtttgagttatgatatgaaatttttagtgacaggttccgctggttttattggttttcatgttagccagcggttattgagtatggggcatgaagttgtcggtatcgataacatcaatgattattatgatgttaatttgaagcagtcgagattaaatttattactccctcatacgaattttcaatttgaaaaattagatctggcagacagaattgcaatctcggaattgtttgttaaacaccaatttcagcgagtcatccatctgggagcccagccgggggttcgttattcaatacaaaacccaatggcatatattgacgccaatatcgttggtcatatcaatattcttgaaggatgtcgtcataatcgtgttgagcacttattatatgcatcttcaagttcagtgtatggattaaataaaaagcaaccgttttccactaatgattcggttgatcatcctgtttctttatatgcggcgacgaaaaaagctgatgagttaatgtctcacagctattctcatctctatcaactaccaacaacgggattgcggtttttcactgtatacgggccgtggggacgccctgatatggctttatttaagttcactaaagctatgttagaggggcggtcaattgatgtttataatcatggtaatatggtgagggatttcacatatattgatgatattgtcgaatctataatcagattgcaagatatcattcctattcctaataaagactggttagttgaagatggggagatatcttctagctctgctccgtatcgtatttacaatattggtaacggtcagccgacaaaattgggtgattttattgaagctattgaagcgtcattagggattaacgccaagaagaactttatggaaattcaggatggtgatgtattatcaacttgtgcggactcaaacacactttatgataagattggcttttcacctgatactccagtgaaggaaggggtgaaacggtttgtcgattggtatttggatttttaccagaaatcggaacaatgaaaaggcagtaaaaaggagcgaaccgctccttttttataattctatgttaataaaaaactaagttagtgttaaatttgttttcagcacatcgcaaatatgcaggcgatttggccgttaatataacactctgtgcctttacatcagccaataaataacttagttagatatattaatcataaaacaaaaatacccttgatagggtatttttgttattaagtttacaaaacaactgattagatcaagaaatcttccagctttttgccttcttcatcaattgcttttttgattacagctggtgtacggccttggccagtccaagttttagtttcaccttcgtcaaagtatgaatatttggctggacgtgtagcacgcttagatttgctagtggctttaccgcttaaagcatctactaaatcgcttaattcaatgccgtctttctccagcatttcacgatattcttgaagcttacggctgcgctcttctatttgtgcgcgagcttggctgtcttcgtcacgacgttcttcaacaacaatcgttagtttttccaacatttcttctaaggtagtaagttcacattctcttgcttgtgcgcgcaaggtacggatgttatttaaggattttaaattttcgctcattgtcctggtctcaaattataatgatgatagccgatgtacggataataatagaatgctattttattttctgcaatagtgaatttactttctcaggctaaaacatatcattttaaaatgcaattcttttagcaatcgatatattgcgttttaatcctgctattgggtttatcatttctcaataaccgtttgaggtggattactacaaagttgagtgggagataaacttctacgtataaaactaatttatagtcaatccgtaaggaatgttaactgttcttctcaaaataaggtgaaagacaaggataagatgaaagtttttttatgggtaatccattagttatgattatagtgattgaattgaacaaaagtaaaccactttgattattaatatgcaaagaatggaaagaaaaataactatttctttttgatgttaatttcgttcgtttatcatgccgaatgtgcttatggagttgattttatatacacaaatgtgatgatcatcatgaaaataatcttttcttatttgttctaatttctttctgctacgtcgaattcgtcaataacaggggataatttcaggcggaatttgtggtaaacttgcagagttttatcacctgattaaatttgacaagaggatggacgggccaatggctcagctttatttttatcattctgccatgaatgcagggaaatcaacttctttattgcagtcctcctataactataacgaaagaggaatgagaacgctgatttttacagcagaaatcgatacgcgatttggtaaagggcgggtcagttcccgtattggtctatctgtcgatgccttattgttttcaccggagacaaatatcgctgaacttatcagatgtgaaaacgagatgaaaaaagttcattgtgtcttgattgatgaatgtcattttttaacaaaaaaacacgtcgaacaactgtgtgaaatcgttgattatgacgatatccctgtcctttgttacggattacgaaccgatttccaaggtgagttattcagtggaagccaatatcttctcgcttggtcagataaattggttgaattgaaaactatttgccattgtggaagaaaagccagccgcgtactgcgttttggcagtgacggaaaggttgtttatgatggtgcacaggttgatattggaggcaatgaaaaatacgtctccgtgtgtcgtaggcactatactgacgttattcgtgaagctcagacaaaaaaaattccatgaatctggcgtctttatgtttgcattatcatgaagccagaaaatgaaattataaaaaggcgcagaggatggtttctgcaccttttaaattacatcacatcatcatttatttattttttctgtttggtttttctgcttcctgagatatggcatattctgtgaattcacgaccgtaaaaagaatccagcatcaattgcttcaactcagaaattagtggataacgcgggttggcgcctgtgcattgatcatcaaaagcgtcttctgcgagtttatcgattttcgttagaaaatcggtttcctgaacgcctgtttcacgaattgatactggaatacctaattgagattttagctcttccagccaagccagtaatttttcaatcttggcggcagtgttatcccctgataccgtcaaccccagatgctctgcaatttcagcatagcggcgtcgtgcctgtggacggtcatattgactgaatgcagtttgttttgttggattgtcgttagcgttgtagcgaataacgttacagatcaacaacgcattcgccaatccatgtgggatatggaactcagagcccagtttatgagccatagaatggcagactcccagaaaagcattggcaaaggcaattccggcaatggttgccgcattatggacacgttcgcgggcaactgggtttttagcaccttcatggtaactggcaggcagaaaatccttcaatagcttcagcgcttgcaatgcttgaccatcagagtattcattagccaagacagagacataagcttcgagtgcatgggtaacggcatccaatccaccaaaggcacacagcgactttggcatattcataacaaggtttgcatcgacaatcgccatatcaggtgtcagtgcataatctgccaatggatatttctgtccagtgatatcatcggtaacaaccgcaaaaggtgttacctctgaacctgttccagaggtggttgtaatcgctaccatttttgctttcacgcccattttggggaatttataaatgcgtttgcggatatccataaaacgcagtgccaattcttcaaagtgagtttctggatgctcatacataacccacataattttggctgcatccataggtgaaccccctcctagggcaatgatgacatcaggtttaaacagatgcatttgttcggcgcccttgcggacgatgcctaaagtagggtcggcttcaacttcgaagaaaatctcagtttctattccgtgagatttcaatacgttgataacctgatcggtgtagccgttattaaacaagaaacggtctgtcacgatgaaagcacgtttcgcgccatctgtagcaacttcttccagtgctacgggcagggagccacggcgaaaatagattgatttgggaagtttatgccacaacatattctcggctcttttggcgacagttttcgtattgatcaggtgttttggccccacgttttcggaaatggagtttcctccccaagagccgcaacccagtgttagagaaggggagagtttgaaattgtaaagatcgccgattcccccctgagatgctggtgtatttatcagaatacgggcagtcttcatcttgtcgccgaaatattcgatacgttcggattgattatcctgatcagtatagagagaggaggtgtgaccaataccacccatttcaaccagtttttctgctttttcaacggcatcttcaaagtttttaccacggtacatagcaagcagtggcgaaagtttttcatgggcaaaaggttctgtttcgtccaccaaagtgacttcaccgataagaattttagtttcatcaggaacgcaaatacctgccatttcagcaatcttggttgcaggttggccaacgatggcggcattcagactgccattttttaaaatgatatcttgaacggcttgaagctcctctccttgcaggagataaccaccgtgggttgagaaacgttcacggacttgatcataaacgttatcgacgacaattacagattgctcagaagcacaaattacgccgttatcgaaagttttggacatcaggatcgatgctacggcgcgtttgatatccgcagattcatcgatcaccactggcgtattacccgcaccaacaccaattgcaggcttgcctgagctataggctgcttttaccatgccgggcccacccgttgccaaaataagattaatatcagggtgatgcattaaagcattggatagttcaacagaaggttcatctatccaaccgatgatatcttttggtgcgccggctgcaacagcagcttgaagaacgatttctgctgccctattggttgcttttttggcgcgtggatggggcgaaaaaataataccattacgggttttcaggctgataagtgctttgaaaatcgcggttgacgttggatttgtggttggaacaataccgcaaatcaagccaataggttcagcgatggttatcgtaccgaaggtattgtcttcagataaaattccacaggttttatcatctttataggcgttataaatatattcagaagcgaagtgatttttgatcactttatcttccacaatacccataccagattcagctacagctaactttgccaatggaatacgggcatctgctgccgcgagagcagccgcacggaaaattcggtcaatttgttcttgggaaaaattggtgaattctctctgggctttttttacacgagcaattaattcattgagttcggcaatctgagttacagccataaaattactcctgataaatgttaaattttttaaggaaattagcggcgagatgattcatctattaaacaatatagtgagatgcatcgtttgaaattcaatcatgaacatcgctaattaccttaaaaaaattacctaaattaatgagttgatatattaattatgcaccttgcctgaaatttaatgttgagcacagcttatcacttgctggcttttttttagtgatctaaatcactaaaacatatagctgactccattcagctatatgcctttatgagaataattatcaattgatggataaatgtgaatttaaatatcttggattcacatattaagcgcaacaccgtaatggacgaagtaaatgagagggtattcctttaaataactcattcggtgttttgtaatctcgtgttttacgaggacgattatttaatcggtttgccacaaggttaatctcccgctctgacaccttattaaaatcagttccttttgggaagtaatctctgattaatccattcgtgttctcatttatccctctttcccagggggaatacgggtgagcaaaataaatttttgtctctaaatttttactgatcagttcgtgttcggcaaattcgaggccgttatcaaaggtcattgttttaattttatgttttatcagtgataaatgtcttgttgccgcttttgcgaccccttctgctgttttattttcaagtttaattataatagtaaataacgattttcgttcaactaatgtcaataatgcacttttatgatttttacccacgatagtatctccttcccaatcaccaatacgctggctttttatcaacaaggtttggggcgcttatcaatactgactctggtttttaattttttcctctggcggcttcataacttccatagcgtttacgatacggttttttcgcaagcctaagatgttgccagaaattaccagtcattaagtttatccttagaaatcaatcgagaaacttttcgtgatgcaaaagatattgtattttcccttttgaagagaaccgactgtttgttcaggactaagtcttgccaagtaacttttgagccactttctgctctgtttcattttactgctttgtgcacacttcgggcgcgctacggccggggcttcctctagagttcgaacctgcagggcatgcaaagatattct

SEQ ID NO: 14948 - DNA, 25413 bp, Xenorhabdus bovienii
  Genomic contig Name=Xb4151_4152.C407
taacataggttctcctgactcagctacatctctaaaaaaatacccctgagggccagaatgtcacacagtgtaaactctttttatcaaatgagatagccttgacaggatattttacgcaaacgattgcatgcagatggcaacaaggtatccggactaggtatctggtcatacgggttactgatttccaatctgttattgatatttgtgaccttagtcagaccttgtggtgatacaaatcgctttttcacagatatagaggtgagtgtttacccctgatcttgctatagattggcattttcacttgattcacatgtgacaaatttcactaggggctgttgatgttttatgttcataaatcaaaacaccctctctcttttctatttacaaaaagcgccaaaagctataagttgtatttaaaatgcatgttataaatttcaacgctatttgagaaaaattcaggagcttcctatgttggatagccaagttatcgctaccgtaaaatccaccatcccactgatcgtttctaccggcccaaaactgaccgcacatttttatgaacgtatgttcaaacacaatcctgaattgaaagatattttcaacatgagcaaccagctaaacggtgctcagcgtgaagcgcttttcaatgctctttgtgcttacgcttccaatatcgataatttacaggcgctattacctgccgtagaaaaaattgctcataaacataccagcctgaatattcagcctgagcattatcagattgttggcactcacctgctggcaacacttgatgagatgtttcatccaggcgatgaagtcctgaatgcatggggtaaggcttacgaggtattggcagatgtctttatcaatcgagaagaagatatttatcaaagaggtgaatctgaggaaggcggttggcgtggattacgtcaattccgtgtcaacaagaagcaaccgcagagtgacgttattaccagcttcgagtttgtgcccgctgatgggggtaaggtcatagattacaaagcagggcaatatttaggcatctacctggacactcccgtttttgaaaaccgagaaatacgtcagtattcactgacaacagcaccaaacaaccacagctaccaaatcgcgattaaacgtgaagcacaaggtaaagtatcaaactatatgcatgataatgtgcaggaaggcgataccatattactggcaccaccacgcggtgactttttccttgatgtccaatcagatacacccgttacactgatttctgctggtgtcgggctgactccgatgatgagtatgctgcaacatctgcataaccaacaccatgtcggtacagtgaattggttccatgccacagagcatggcggttatcatgctttcgcagataaagtgaatacgattacccaatccatgaccaatttacatactcaagtttggtatcgcgagccaagaaacgaagatcaacaaggcgcagattaccagcatatgggactcatggatttatctgtcgtgaaagattcaatcactgaggaaggaatgcaattctatttctgtggccccgtcgtattcatgcaatatatcgcccaacagctcttggcaatcggcattgataaacagcatattcattatgaatgttttggcccacataaagtactttaacgctgtgttattactcgattaaatgataaaccattcagggcgtatctttactacatacgcccgttatcacttcagccgtttttgttaaatcgcttcttcgtcctgttcaccagtacgaatacgcacaacacgggcaacatcaaagacgaaaattttaccatcgccgattttgcccgtttgcgcagtctgaatgatagtttcgacgcaggtatcaacaatatcatccggtactacaatttctattttgacctttggcagaaaatccaccatatattctgcaccgcgatataattcagtatgccctttctggcgaccaaatcccttcacttctgtcacggtcataccagtgatacccacttctgccagcgcttcacgcacatcatccagcttgaaaggtttgataattgcatcaatctttttcatgaagttttcctgttattaccagtttttacgcccaaaaccagaagtaatcgggtagcgcctgtctttaccaaaatcacgctctgtaatacgtgggccgataggtgcctgccggcgtttatactcgttgatatcaaccaaccggatcaccttacgaacgatggcttcgtcaaaaccttgagcaactaagtcagccacggatttatctttttctacatatccttcaagaatagcgtccaacatgtcatatggcggcaaactatcctgatcaagttgatcaggtgccagttctgcggatggtggtcgatcaatcacacgttgaggaatggcaggagatactgtattacggtatttcgacaacgcaaataccatagttttaggtacgtctttcaatgcattaaagccacccgccatatcgccatacagggtcgagtaccctaccgccgattcactcttgttactggttgtcagtaccagacggcggcgtttgttcgacatcgccatcagaatgactgcgcggcaacgtgcctgcaaattctcctctgtcgtgtctttttctgtccccgcaaacatcggttcgagttgcgccataaacgcatcaaacatcggttcaatggataccacatcaaattcaacacccagtaattccgcttgttctctggcatcatgaatgctcatttcggaggtatagcggaatggcatcatcactgcctgtacgtgatctttacccaaggcatccaccgcaatcgccagtgtcaggccagagtcaattccgcctgataagcccagtaatgcacctttaaaaccatttttatgcacataatcacgaacagaaagcactagtgccttgtagatttgcgcaagcggcgacaattgagggatcaaatttgccattggctcaatattcatctcattgaaacggcactgctcaatctgttcttcaaaagccgccatccgatgggtaattttgccatttgcatcaaagactttcgagcaaccgtcaaagattagctgatcttgtccccccacctgattgagatagatgatcggcaattgagttcgctgacagtgcgattgaatcaatgtgctgcgaatattcggtttttcccggttataaggcgaagcgttaagggaaagaatgatatccgatcctgcttgtttcaacgcgtcaatcggcgcatcaaaccacaaatcttcgcagattaataaaccgagattatagcctttgaatggtacaacacagctttgatcacccgctttgaaataacgatcttcatcaaaaacgccatagttaggcagtaattgtttgaaataacgggcaataatttcgcctttccaaaacagagaaagtgcgttgtaagtcttaccgtcctgttgccacggatgaccaaccagaatagcgacctgagagcttgcctcctgcaaacgtaccaattgttcacggcaacgttgatgcagatcagcacgaaacagtagatcttcaggaaaatagcccgacagcgccaattcagaaaacataaccagatcagcaccttttttctgctgttcctgtactgtctgcaacatacgttcgctgttaccttcgatgtctcccaccagccaatttagctgggcaagaacgatattaagagtacgactcatagattgcggctctcctgggccataattcatctctctgtcttatcaagacagtgtatctctatataatttatatccagtgtaagaacttctggagtggcagaaaagttattccttaaaatcgttggcatccaattcgtgacgagccagcaatttataaaactccgtccggttacgtcctgccatacgggcagcatgggtgacgttgcctttggtcatttgcagcaatttacgcaggtagtgcaactcaaattgcccacgagcctccacaaatgtcggcaatgccgtgttttccccttccagcgcctgcatgaccagtgcatcactaatcaccggtgcagtcgtcagtgcgacacactgctcgataacgttgaccaactgacgtacattgcccggccagctcgctgccatcagacatttcatcgcattagtcgaaaaactgcggacaaaaggtttatggcgtttggcagatgcacgtaacaggtgattagccaataaaggaatatcttcagcccgttcgttcagggcaggaattttcatgttgacgacgttcagtcgatagtagagatcttcgcggaattcattacgctgcatcgccttgggtaagtcacggtgagtggcggaaataattctgacatcgatgtctatatcacggttactccccaatgggcgaactttgcgttcctgtaaaactctcaatagtttgacttgcagtgccaaaggcatatcaccgatttcatcaaggaataatgttcctccctgcgccgccagaaacagcccttcccgactgctgaccgcaccagtaaatgcgcctttggcgtggccgaataattcagactccagcaattgttcaggcaaagcgccacagttgatcgcaataaaaggtttcttcactctggggcttacccgatggatagcttgagccaacacttctttacccgttccgctttgtccattaatcaggacgctgacatctgattgagcgaccatttttgcctgttccagcaaacgcagcatcaaggggcttcgcgttacaatctgttcgcaccactgcccatctatggccggttttgacagttccaacgcagcatcaatggctttataaagagcgtcacgatcaacgggtttagtcaagaaactaaatacaccttgctgtgtcgccgcaacagcatcgggaatagaaccgtgagccgtcagaataatcactggcataccgggatgctgcttctggatttccgcaaacaatgccatgccatccatctcatccatgcgtaagtcactgatgactaaatccactttttctttcgccaatagacgcaacgcttcatgaccactctctgccgtcgtgacacgaaacccttcgctggtcagacgcattcccaatagttttagtaagcctggatcatcgtcaactaaaagaagacgggcgggattgcgcacagtcattattattcaactcctttttcttctgggagattggcttctgattcggttttctggtgcatttccggcttagcttccggttttaattgctcagaggcttctacattgcttaaatgctctgtttcacccaatgtggcaacactgctctgatcttgtttgcgcgaggaaagctggcgttcaatatcagtcaaattttccagcttgcgggaaattgaacgaagatcatgctccaaacgtgcccgtatttctttcagtcgatcaattttactgtcactatcaaactgcaatcgctggaatttcaacctttcttctgcaaggttaattttcaaatattgctgttcccgccacaattgcagtagcggcctcaatgcagacggaaattgtggactatatcggttgaggttttctacaattttgcgacgttcaatcagcgtaggagtggctcgattcatcaagatactttgtttgaaaacgtgcccccaatcagtcggtgcagccggcgtaaaacgtttggcagtatcgcgggcttccagcgaggatagtcgatccgtgcaatccatcaccttcaaccaataaagaccgttttccattgccgctggtttgacgatattccatattccatcacatcccttaagccggtaatccgtaacccgctgttctggcataatggcttgggctattgtcaataactcatcatttccggtagtttcagcgcatcctgacagcaaatagggaataaacaatagtatcatgacacggaaacgcaaggctgaagcccgctcaagaaaatgctgcatgacagcaggttttttcatcggttgaatcacaatattctgctgctccgtcttcatcataaaacggtaagtaaacctgttatacatattatttagtcattctctgcggttaatggcagttcaattcgaaaacatacgtcagcaaattcgggttctatcagatgcagttctccccccatctgtttaatacaatcttgcgcaatactcaagccaagaccgcttcctttgaccgcgcctttgcgttgcagctttccttgataaaatggctcaaaaatcatgctcttctctaattcagggataggcgtccccgtattagcaatgtcaatctgaatatttttacctacttgccgactggaaatccagatgttaccggattcagcaccatagtgcactgcattggagtagagattatcaatcacccccattaatagtttaggctctgcccaacaaaaaaatgtatccaattgaatttcagtattaatattttttgcacgtgctggcaactgatgtgacaatacgacgctatcgacaatttcttttaaagatacaatctgatgctcgacagagctatctgccaatctgcggttatattcgagcaactgttcaatgagccgttgtaaatgtttactactgctgtccagaatactcaccacttctttttgatctgccgtcagtggccctgctatttcatctgccagtaattctgtgccttcacgcatactcgcaagaggcgtttttaattcgtgggagatatgacgtaaaaattcgtgacgctgagattcaagccaagacaaacgttcactcagccagataatacgctgcgccagtgatcgcaattcccggggtccctgaaaggattcaatctgattatccagtgtttgtcccgcccccagccgattaatcatattctcgatccctttcactggcccgataatcatacgggtaaaaagggtgatcaaaaaagcgctcagcaggaataagattaggctctgccagccaaataactgccctttgtctgcaatatctttttgtagttgctcaccacgaataaagatgatgttacgggtttcttgcaccaggagattattggctgtggaaaattgttcaagccgcttgtttgccaccggttctggcatgccattactacaggaaattttggtaagaccggacagtaattgattaaaccgctgggtatattccttattagccagcatcatcatctgattgccaagcatgttgaggtactgtcggtattgacgttgatagagcttttcaagcctgacatcccccaatacacaatactggcgatagctccgttccatctcaagggctacgcctatcatcgcttcgctacggcgggcatctgccaaagtcgtgcggttaatttcggcagcttgtgtactgagttgatcaagactttgataagcctgataagccagtactaagagtggcaataacaccagccagaaagccattaacaccaattggcgcaatgaacggggaaataaacgccatttattcaaagaaatcatctcataacctgtaattacattgatgctaaccgacatgaggcggagaaaaaagcctaccagatgatgaattctattgttactttttctcgtttttgaaaatagtggattattgagagctatgcgggtgcatatacaaacggatgcctgcatgaacacaatggataggagttacctgtaataatgacggcgggatagtatcttatctactatcccgccagtgaggatccttcatactgcttgatgagtatgtaggtggtgcctcactccacgtgtcgcccgtagtttgataaggcccgaaagcgagtatcattaagttggacggtaggcaccttacttcggcatcattctaggcttatgtggcatatttccacctaattgtgggccgacataaaaaggtgaatgagcaactacattctattaagcatattacatgccaacattcaaataaaaatattaatttattgattttattgaaaataaaaataacatattcatatacgccgctttgtgatgaatatattttgatatcagcgatatatttttgtcgccaatttatgacacttaactgcataaaatgattttattaataaaatcaaatcattaaatgtctcttatttgagacgcattaagaggccattgtcgcgatatagagacaatgagagtgtatgttgcatcgcagaaaacaccggaatagtcccccttatctccccactgttttgttttatttagcaaaaactttgagagcttacgcaacattcgtaaacaaccactcctcattgctaaaccacaaaacccgttttacgcgggttttgtggtttttaacttaagaccctaataaatcttcagggacttatataaagggagaatgataacgaaagaaattaacctaactgcctgcgcgcattacggaaaatacgcatccatgggccgtcttccccccactctttgggatgccaagaatggctgacagtacggaataccctttcaggatgcggcatcatcgccgtcactcgtccatcaaggctagtcaccgcagtaataccgttcacagagccattcgggttagcaggatagttttctgtcgccagaccgtagttatcaacaaaacgtaatgcaacctgctggtgtttttccagttcagccaagctctggctattcctgaattcaacctgcccttcaccatgagcaaccgcaattggcaaacgggaacccgtcattccttgcaaaaatagtgaaggactatctgccacttccactaaactgaaacgtgcttcatagcgttctgaacgattacgtacaaaacgcggccagtgctcagtgcccggaatcaattcatgtaagttggagatcatctggcagccgttacacacgccaagggctaaagtatccggtcttgcgaaaaagttcgcaaaatcatcccgtacctgtgaattaaacagaatagactttgcccaaccttcgcccgcacccagtacatcaccgtatgagaagccgccacaggcaaccagtgtctggaattgatccagcgtaatccgcccactcagcaagtcactcatgtgaacgtccacagcgtcaaaaccagcacgatggaatgccgccgccatttcgacatgagagttcacaccttgttcgcgcaatactgcaactctcggccgcacttgtttcgaaatataacaagcagcaatatcttctgccggatcgaaggttaactttacattcaagccgggatcgttcacattctgtttcgtctgatgttcttggtcagcacactctgggttgtcacgcaagcgctgcatctgccacgtcgtttccgcccaccataagcgcaatgtgctgcgattttggcgatagacatccatatcgttgctggagatcacgaaatcctctcccgcctgagccagccccaaatagtgtacgcattctctcagtccataatcagccagcagtttttcaacctgttctctgtcggtctgacgaatttgaatcactgcgcccaattcttcactaaacagtgctgccaaaatatcttcatcgaatgcactgatatcggcacgcagtccacaatgacccgcaaaagccatttctgccagtgtcaccaacaagccaccatcagagcgatcgtgataggccagcagcttttgttctgaaattaattgctgaatcgcattaaagaaacctgcgagttgctcagtactgcgaacatctgcggttttgtcaccaagctgacgataaacttgcgccagtgctgttcctcccaacgcattttgcccttgccccagatcaatcagtagcagtgcgttatcatcatcggtagataactctggtgtcacggtacaacgaacatcctccacccgtgcaaatgcagtgataaccaatgaaagcggtgcggccatttcacgttcttcaccgttttggttccagcaagttttcatcgacatggaatctttgccgacaggaatcgttaatcccagcgccggacacagttcttcgcccactgctttgaccgcagcatataatccggcatcttccccggcatggcctgatgctgacatccagttagccgataacttcacccgtttcagatcttgtacataggcagaggcgatattggtcagcgcttccccgaccgccatacgcgctgatgctgcaaaattcaatagagcgataggcgcgcgttcacctattgacatcgcttcaccataatagctgtccaaactggccgtagtaacagcgcaatccgccactggaatttgccacgggccaatcatttggtcacgagcaaccatcccagtaattgaacgatcgccaatcgtaatcaggaatgttttctctgccactgccggtaagtgcaagactcgttttactgcttcagctaaatcaatatctctgcgttctaaactatgaccctgcgctttcagggtcatcacatttttcagcatctttggcgtcttgccgagtaaaacatccagcggcatattgataggttgattatcaaaatgattgtcattcagtagcaaatgacgttcttccgtcgcctctccaatcactgcgtacggagcacgttcacgacggcagatttcctcaaactgtacaagttgttctggtgccactgccatgacataacgttcctgagattcattacaccatacctgcaatggactcattcccggttcatcattgagaatgttgcgcaactcaaagcgaccaccccggccgccatcgctgactaactcaggcattgcatttgacaacccacccgcacccacatcatgaatgaacaaaatcggatttttatcccctaattgccaacaactatcgatcacttcctgacaacgtcgttccatttctgcgttgtcacgctgcactgatgcaaaatccagctctgcatcagattggcctgatgtcattgaggaagcagcaccgccacccaaaccgatattcatgcttgggccacccagtacgatcagcttcgcgccaatagaaatatcgcctttctggatatgttcttcacggatattcccgatccctcccgccagcatgatgggcttgtgataaccacgcaattctgcgccattatgggaattcaccttttcttcataagttctgaaataccctagcaacgctggacgcccaaattcattgttgaatgcggcacctcccaacgggccttccagcatgatatccagcgcactgacaatccgatcaggcttaccgaaatcttcttcccacggttgttcaaatccgggaattttcagattagataccgaaaaaccaaccaatccggccttgggttttgcacctcgccctgttgccccttcatcccgaatttccccgcctgatcccgttgccgcaccgggccaaggagaaatggcggttggatggttatgtgtttcaactttcatcaatatgtgggcgggttcctggtggtaatcatacacaccactttcaggatgagggaaaaagcgcccaatctgcgaaccttccatcacggcggcattgtctttataagcagagaaaacataatccggcgtctgttcaaacgtgtttttgatcatcttgaacagtgaattaggttgttcctgaccatcaatcacccaatccgcattgaaaattttgtggcggcaatgctcagagttcgcctgcgcaaacatgtagagttcaacatcagtcgggttgcggcctaatgtctgaaaggctctcaccagataatcaatttcgtctgctgccaaagccaatcccaattcaatattggctgattccaatgcagcacgccctgactgcaagatatcgatctgtttcagtggtgcaggctgttggtgagaaaacagggcttcagcctgttcagattgagtgaacacactttccatcattcgatcatgcagtaatgcagacagctcctgccactgcccatcgctcatttcatcactctggatataataggcaatccccctttccaagcgggtaatctgtttcagaccacaattgtgcacaatctctgtcgctttcgatgaccagggagatatcgtgcccggacgaggagtcaccagcaatagttgacctttagggtcatgttcatccaaagaggggccatattttaataaccgatttaatttctcccgctcatctcctgtgataggcgaattaatttctgcaaaatgcacatattccgcataaatctctgtaacgggaagctgctgatcttggcactgggaaaggagcttagtaatacgaaacgctgataaagcgggcgatccacgcagaatttccatagtaataggttctctcatcttagaagcaaagcctgactgatgccacagggggaaacgccgacattatagaggaatgtttcctttgacgaaaccgtttgcgtgactgttattcaatcgaataatacaattagtagaatttaaaaattgattcaataaggttgcacatcccagttttgttacgcaaaatgctcaattactggaaatttaaccattctatatttcacatttcttacggaacctaccgcactgacgagagataactatttgagcaatatcaagataaattattttgtcatcgtcattatcgcgctcctctctgctgcaatcattggccgtaatatcagttggcccaacaaacagcaggagcagataaacaggattctggcacggggagagcttcggattagtaccatcagctcccctctgatttctgcgaacagcaaaaatgaagcaacggggtttgactatgaattagccaaacggtttgctgaatatctaggcgtaaaacttgtcattcattttcgcactaatattaaccagatttttgatgacttaaacaacgataacgcagattttctcgctgctggccttatttataatgaggagcggttagaccaggcacgcattggccctgcctattattcagtctcacagcaactgatttaccgcaaagatacaccccgcccacgcacgtttggcgatttaaacggcacactggttgtcactgaaggatctgcccatgccagagaactcaaaaaatataaagaagagtcttatcccaatttaacttgggaagatacatcacgcgataacacactagaactacttgagcaggtgtccgaaggcaaaattaactatacgatcagcgattcgatcagtttttctctgcaacagcgtattcatcctaatttggcccttgcttttgaagtaaatggggaacgtcctctgacttggtatttgaagcgcagtgatgactataccctttactctgctatgctcgattttttcaatcagatgtcagaaaacgatgtgataccacagctggaagaaaagtatttcagccatatctaccaattcgattattttgatactatttcattcattcgcgctatcaatagcacattaccgatatatcagcctatttttgagaaatacgctggctcacttgactggcaattagttgcagccatcgcatggcaagagtcacattggaacccgcaggcaacttcacccacaggtgttcgcggtatgatgatgcttactcgcccgaccgcagaatgggtcaagatcagtgatcgacttgatccggaggaaagtgtaaaagggggtatggtttatctgcattatctgatggagcggttgccgaaaaccattcctgaagatgaacgtatctggttcgccctagctgcttataacatgggttatgggcatattctcgatgtccggaaactcacggcagaacaaaaaggtaatcctgaccgttggctggatatcaaatctcgccttgatctgttaagcaagaaaaaattctataccaacacaacatatggctatgcccgcggacatgaagcatatcgctatgtcgaaaacattcggcgttattaccagagtctggaagggtacttgcgagcaaaagataaacacagcaagaaagcagaatatgaaacaccgattgataagatcatcgtgcctctttcagatagggaaggaaataaagccgtggttaatgaaaaaacgccggaagtcaaaacaccgacgtaatctcaaaaagttccttagcaagaaccgactatagcgtttcctgctgttgtatttttagtttttttaatgccttatgctgttctctgcgttgtttaaagaacgtactcaacatcgtggcacattcttgcgccagtacgccagccgtgatttcaatctgatgattcatgcccggatgccgtaggatatcaatcaatgacccggctgcgccggttttcatatcacttgcaccatataccagccgctgtatccggctatgcaccatcgcgcctgcacacataacacagggttccagagtgacgtatagggttgtattcaacaaacggtaattctgcaattcgatgccaccacgccgcagagcaatgatttctgcgtgggcagtgggatcatgctcggtaatcggatgattatagccttctgcaataattttattattggcaaccagcacagccccgacgggaatttcgtcctgagattgtgcctgcattgccagctccattgcccgccgcatccagtattcatcactatatatttctgtcactacaagttctcttacttatgaaaatctcgctaattataactgttagtcattaatattgattcactcatctcaatttgcttatgtgacctgaatttcattcaaaaaagcctcaagaaagtgttccatgcgttctgtcctttcacgagccatttgtctacccgtttccgtttgaaagccagattctattttcaatatcttggtataaaaatgatcgagcgtataggcagagtcattatattcacggtgttttgccagaggatcgtgaaaattatacagtgcggaacccatacgaccggcaatgtaaaaacaacgagcaacaccaaccattccaatggaatccaatcgatcagcatcttgtacaattttggcttccaatgttctgggagttaaaccggctgagaaactatgagcttcaatggcatggcagacagcagcgatatcttctccaccccaccctaaatttttcagtatcaatgcggctttttctgcggccatatgagaagcaagatgtcgattgggatcatttttttcaacactgacgcaatcgtgtaataaaactgcggccaatacccactgtaaatttccagattcaacctcacaaattctcttcgcgtttcgccatactcgatgcaaatgggcaatatcatgagcgccataatcaccttctactgcaataggcaaaagttgttgggctaaatcttcaaatggtgaaaaaaataacatagacaaaacctctcaatgaatgaaaattaaaggacaactatccatgttgacaggccttaaccatctgacactagcaacctcaaatcttgagcataatctcaatttctatataaacctgttagagtctactccccatgtccgctggtgagggagaatcaatttatcttctcgccactgacgaacatcaacttggagcccgtccatgttggttcccttgcaagttgccttaatacattgcgtaaaacaccttacaaaggattagagtggtattaatgtctccccatcaatacccactactggactgctgcctccataaatgtgcagccacaagagccttccaaggagaaaaccctgacagccatgcttctgtttgctcagcgttgaccttgtcttcctgcctgagtaaatattggaggttgcgccttacagctacatcgccatgtagtgaaccatttaaataattaaatccgcgcgacaaagcgtaattgattgtccacataccaattcctttaatggcgagcagattatccgtaagccgtttaattccaccttctattatggctaatttcaactcacccgaatcaattaattggctaacattcagcaacgcattggctttactgacagaaaaaccacattggcgtagatcgtgttctgaacactgaattatttgctcatgagtcggatgacacaacaatcctgaagaatgtttaacgccaatagcctgaataaatcgcctacggatagaaattgccgcacttaagctaatttgctgaccaatgattgcccaactaagtgcctcaaaaggtgttgctgactgataaattcgtaaccccgcctgtctggtaaccaactcgccaataaccggatcagcttgatacatagattcaaattcttcaacaggctgcaacaatcccagcatatgtgaagctagcatggataaagcctcctcggattgatgtgcgtcatcaccatcaacctcaagctgaatctgcgcccggtgtttattaatagatacagtcagtaaagccggatttccgtgccaaataattccctttttcattcgactttgttgcactatttcagaagcacccttttcatctctgtgatgaaaggccaaaaaatcttgaacgtgataattactcggtaatattatttccgtaaaagagcttagtttcatgacaaaaactccagagacacacagaatcgaaagatattatcacaatcattcacaacaacttagttggaagaaagcctataattatccaccgtatcccgtaatccgagattattaacaaactccggtttgttcggaatgtctgcgccgttctggttcttctccagacgagaattagcattctgatttgcattggccgcactttggttcgcggtgtttgcgttggtgatagcgtttccggcatctgttcttgcttggttatcgcgccttggcaatatccatcgtgatcataaatcgttcttcatcaggatgtttcttgtcgttaaagcatcccaaattcatcataatttgatattgatcaccagctctccagtaggttgtttcagaacattttaaactgcgaagttgggttcgcaattctggcgtattagccagaggtgggaacgtcctatcataaacaggtatccaacctgctttacgccactgattttgtaaatctagtacaattttgatcacatcatcgaagagtaatggctcaatttgtggagatatgcgtacactctcgattattccattattatacttaacaacaaaaaaccgggcagctggtgtcataaatccatattttggatcggtaaaacgtaagcgtgcgtccatttttggaacgttataccaaattttacctggaagagcgggattaatagcagcactggaacgttgtcgcatatcttcgtaaggttcaccaatcattagggctatctcaggttcatgagaataaaagatttggtaaatgtagatacctgccagccctagaatgacgaataacacgaagattaagccaccgtgccgccagtctatacgctgtaagagattcattttacacctctccctgcctcaatatcttgtaaagatttttcaatcaaatgccggtctctaccacgcagcaattcatcaaaacgctccgctgcattaagtacgaaaggcatacgctgatctgcatcggcaagattagccacatcatcgctaaatttgatagttctttcattatcaatgaattggcattgactagccaacgttaactcaacaggttgtgccacattatcaggtaaaaagcctgtgacataggagaattggttaccccacaagaacactattaattgctcgtcactgtacattgtggtttgcaatatattgatttgctcgtgataggcgagatgtacaacaccttgagcaatatttcctgcttctatcgcctcaaaagcgagtagaatatcgtcatagggaaggccaaacttcaaattattttgtcctattggccacaatattggaaattggctattaccgtagatatcttggcgtaaatttaggcaagttttgaggtcttccaatccacgttgcttgcagaaagcatgaagctggtatacatccaaaaatagcgtcgtatttcccagtgccatcttttcatacacatagttgaatgaatactgtgacaaacttgatattccctgaaggccgggtacataggaagatattgataatctattgtttttactggcttgccttgcttcttccacagcttgagcaaaatcctcaactttattttctgcttgcgccttcagctttggatgaagaaagtaaaatggattatccattgtgttttctagctcacttgcgcacgcgtcggtcggcatcattattagcttgtatctgttcatgcatatcatgacgacagcatctagcataagcctgattaatacgtttgttccgttctatgggatctgcaatcagtttaccaccgggtgcgacggtatcttctgcctctttctgataaaccactgtgtcgttggtctattcgttgtaatagactcattttatatctcatcctgaagtaatatcctgaataatagtgggcgtgagaaaataatattctcacgcccatgtaattttgcgttatcgcttgcttaccatggcttggaaatcaccaatgtgatcaaatagcgttcttcatcaggatgcctatcatctttgaaacgccctacgtccatcatgatttgatactgctcaccagcttgccaataggttgttcctgggtttttcatcttgcgaaggctatcatgtaattctggtgtattaaccaagggtgggtactccctggtacgagtaggtatccaacccgctttgcgccactgatcttgtaaatccaacacaatcttgatcgcatcctcgtagagtaatggctctatttgtggcgacatgcgtacactagtgatgattccatcatcatacaaaatagtaaagaatcgggcagtaggcgtgacaaatccatatttcgggtcgataaagcgtaaacgtgcatctgtttttgggatattatgccaaattttacctggaaggtcgggatcaatagcggcactggaacgctgtcgcatcgcctcataaggttcgccgatcatcagggctatctcaggttcgcgagaataaaagacttggtagatatagatacctgccagtcctagaatgacgaataacacgaagattaaaccactgtgccgccagtctatacgctgtaagaggctcattttacacctccccatgacgcaatatcttgtagagactctccgatcaaagatcgtttactgccacgtagcagttcatcaaaacgatctgctgcctttaaaacaaaaggcatacgttgctttacatctgataaatcagctatagggttatagtcgctaaacgtaatagttcttttattatcgatacgtttgcactggctggccaatgttagctcaacaggttgtgttacactagaaggcaaaatatttgtgacataggcgaactggttgccatttaatgcaaatactaaatcagaatcactatacattgtgggttgtaatatattgatttgttcgtgattggcgagatgtacaacacctttagcaatattccctgcttctatcgcttcaaaggcgagtagaatatctggatagtcacgaccaaaacgcaacttatcttgccctattggccatagtattgggaattggctgctgtagtcaattttttggcgtacacctagtactacagtcgtatgcttcattgtggcatgataacgcctgacattttttcctgaaatacggggaggtgttcaatgcacttaccgactcacgcctgggaacaggaactgctctcactccatacccgtctggctccgttgtttcaccatcacgccccacagcaacgcagcctcgcttatctccggggactgctcagtgacgttgagcgtaaaaatggctggcaactggcggaatggataggcgaacgtacgcctgatggggttcagcatctgctggagcgcgcccactgggatgttgatatcgcccgcgatattttgcgcgactatgtcacagagcatttgggggatgaacacggggtgctcattgtggatgaaaccggctttatcaaaaaaggcacgcattctgccggtgtgcaacgtcaatacagtggcaccgccggtcgcgtcgaaaacagtcaaacaggcgtctttctctgttatgccggtcagggcggtcatgcctttattgaccgggcgttatacctgcccagacaatggacggatgaccggccccgctgtgaagctgccggcattcctgacgccgtcccctttgccactaaaccccaactcgcccggcagatgctggaacgcgcattcgaggccggcgtgctctgccgctgggtgacggcagatgccatttatggtcaggatcgccgcctgcgttgctggctggaatcccgatatcaaccgtttgtgctggcgatccccaaaaatgaaccgttgtggtggcaagggccaacttttgtcagagcggacaagattgtagacaatctgacacctcagcgatgggaaacccattcggcggggtggggagcgaaaggcgaacgtcagtatgactggattcgggtgccgctctggcgtttacaactcagtgagaaagaacgggaatatggccattatctgctggttcgtcgcagccgggatgaaaaacaggaacgggcttactatatcgtgtatgcgcgcagagaccaggcggctctgaaacccctggatcaggtggcaggttgccgctgggaaattgaatgtggttttgaggaaacaaagggagaatgcggtctggattccgtttgaaacggaaggattgaattaaaaggtgagaaatccccacttttagataacttgttgatttttcttaattatctctaaggacaggaatttcggttttctgacggaaataaaggatatcaatggattgggaggaaggccacgcattgcgcagccttgaatctaaatgtaaggtagggttaacgccagttgcaatagaagcgcttggtttggcctgtttgtttcaatatagtgcttaattttagcgcgtcctcactattataacgcgcattgtatatacgcttgccgattttttcataagaatcataaggagcgccaagatcataggttacattatcaacagtgacataaaaattgccctgaaataaggggggaacgctatttggctcaccttgcctcttatcagagggtattctaaacgacaacgacaacgacaacgacaacgacaacgacaaaaaattaggcgaattccaatagaaattggatatatttttaatatctattttgttctgtattactcttaaagtaccaaagaatccgcgtggaccatccgatgccttgccactcatatatccccagccttgagtaccatcatcaagttcaccagtcgctgaattaagatcaaaaaccagcatataatcttccaaattcatttcgggattaataacgtcagacatactatttccttatatttataagttattggaagcaatgcaggattgaacttccgtccgctgtaacagcccgaatatagtaaccaatgcttatagttgaatgaattgattggggttgtgtgggggattgtacaagtgggtaatttggggtttgaaggtcggtgaatattgtctctatcacaccaaattttatcagtagaggaacagattttattgatcccccgtttgttattttatgtcatcctgccatcaaaatatgccactcacctaatcgttaaaacgagcttagtcaaaacgcattctccagtattgatgaacctattttagggatgttcactggcggagaagtaacccgccttcatgttatttagcaatgcttattgttgattaaatgagggaataaatatgcaagataagaagcctgatatatcagaattaaaagatactacattagagcagcaatcttatgaagaccttggttatacagtgatacctattggtgttcctgttccttggccatcagaaatcccaccagacggttggcttaaatgcaatggtgaagtatttgatacagtaaaatacccaaaactcgcccttgcctatccatccggcagattacctgatttaagaggtgaatttatccgtggttgggatgatgagcgtggcgcggattctaatcgcaatgttttatcttggcaggaaggttcttatttagttcaagaagtgtacaatccgcctgatcgtatcgttaatttttcacttgatgagaggaaggatttaaattgggatattccagacacagaggtgatcaaattgcgtggcaaagcagtaacagcagataaaagtggaacctggagtatagataaaagatacctaggcgtaacccgcccccgcaacatagcattcaattacatagtcagagcagcttaattctgagctaacaattaaacccgcaactttctgcgggttcatatcaatcatgcaaatcacccaccaataatataacaaaagatactgtttagaatttaaataataacttctagttgatctctaagagaattaattatgtccataatctcacagattaagcattttctgatcaacagattagtggaggtgatttagtgtggcgcgccatacattttggggtaattgtggagcatttgaactgtatgtagcttggtagtttaaatttgcgttcaactgtttttatgtgtttaatatatttttcaggtaaatatacaatcaaatggatgcctataatttttcaaagagactgaaacacataggtatactggttatagattatgactaataaaccgtcagcaaaaaaagtaaaaaagttaagggttggattttataccagcagtgacgcaacaaggaaaagtggagtctccatagcgatggaggcatttgagcggctttacaacgaatgcacttcaaataattgcaatcataaaatattagactcctatcatatacaggatcttaagcaataacgcgttattttaggtagaaaaaaggcttcatttatgatctgataatcgtcgccaaactcatatcaaaaccacggatgaagcctgtgacgattatcgctataaaacaccagttaatgcaattcttcagtgacatttctttgcagcatattgctttccaatgtgcgtttatgaaacgtatcagaaatatcgagccccacgtgttgatcctcagccttatcgctgcactgagcacgggtaaaatcacgtctattgcccagttacaccaaaaatttaatggcctgtgcccggataaaaagcaaccagtcagttaccgccccttttataaccagctccgtaaagcggcttttgtcgaatttgtcaaaatattggtcagatttgccatggcgcaatgggtggagaaacaggtctcctcaccccaaaaactcatgaaatttaaacaggttattctccaggatgggagttcgttcaaagtccattctgccctggccgatgtttttccctatcgcttcaggacaacgggggccgcggtggaatgtcacatgacaatgtccttgctgactcagtcaccggtaaaaatgaccgtgaccgcagataccgcccctgagcgggcttacctgcctgtaccggcgatgttacgtgaccaattattattggccgatgccggttatgtcgactttgcgtattttgagcaagtgtcactttccggtggttcgtttattgtcaggggaagcaagtcccttaatcctcagatagtggtggcccgcaatggtcaggggaaattattgcccaagctgctcaataagccgctgaaatccatcactcgccgaaccaaccgttccgaagtgctggatctgatttgtcggcgtaatggctatgaatttcgcttaattcgtcgctggtttgccgaagaaaaacgcttttgtctctggttgagcaacttgtccgtggaagagtttacggctaatgacatcatggatatttatcgttgccgctggcaagtagaactgctgttcaaagagttaaaatcacacacaaactggcatcgatttgccacgagaaaagaaacgttagtcacgggcctcatttggctgagtttgctggctctgttgctcagacgttcgctggccagcagattattccccgccgtttcattgctcaaagcagcccaaaatacggaagtctggctgtggcccataatcgaaaacctactccaacgggcgtggtcggaaaccggtttttggctggaaaaagcccaagcgtatttatgtcagaacgcgttcaaaacaccacaaagaaaatcatgtaaatacaaaacattggatgcgtgttttgaaaggcttaattcttaagcgcctgtatatgaacctgacctattcaatatgctccgtaaacaactcatcaactgaacatcttttttgcctccttatcgcttttgctccgccccatttgtgttctatagggtttaaatccggactataagcgggaagccattccagttgacatctgctgtctgctatcgcttgtgtcgtgtcattccgtttatggaaaggcgcattatccatcactatcactgctccgtgtggaagctttggccgcaaatcttgcgtcatccacgcataaaaaacatcggcattaatattcccggtaaataagcttaaggtgacgaaggtattttcgagaatggcgccaatgacgttgatacagccttttgcgggtcatgtattaaatgattagattaggtattaaaaataatgttcacgttcaataaaggttcctatcactttatcgtgcatttcttccgattttgaatacccaatggtttttctattcagccttttgattcgggtacgatgcgttaaattcgttctctctatacgctgagtaaacgcctttccagtcaagtgctcttcctcgggaagtgggtcgtaaacaacatagtcatccgtgcagtaaaaccgaatagtaaaggaagataagagggtaagcagcttgtctaacgtttttcgactgcgatcgccaaaaacatgagccactattcgcttcaggcggggttcccaagcataccaaagccagcgttggtttttcttattgccgacaaacgaccattgctcgtcgatttcacagacaatctggatgccacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctgataggtatacgccaactgaaagaccttacagcagctataacagcgataacgaggatgtccgccatttcctttcccatgtcctttgacctgttctgatttgtggcaataacggcaatagacatcaactttggccatacttcatccttaaaaagccggaagcatatcacagcaactaaccatttaatacatgaccattttatcgagttataatagcctttttgtgtggttcggattaattgtctggggaatgtcttttggtggtgcgccgacaattattgcaaacggggtaccgagctcgaatcgtatc

SEQ ID NO: 14949 - DNA, 24243 bp, Xenorhabdus bovienii
  Genomic contig Name=Xb4151_4152.C408
atgggtgttagtttcgagacagttatttcaagaaaggggaacaatatgattaagtgtcctctgtgtgggcagtcagcgcatactcgtagcagcttcgagcactcaagccagacaaaggagcgttataaccaatgtcagaacatcaattgtggagcaacgttcgtcagccatgaaacgtttgtgcgttttattgctaagccaggtgacgtcgaaaatgttacaccacatccaagggtgaaaacgaagagacaacctcgtcagaaagctgacgcacaataaataatgaaaaaggacattgctccagtttttgccaccgttacggtggcttttatggatgatggactgtattttattctcgaatagagaaccttaaaggcatgaagccagagaacagcgagtgaattaacaatcctcatgtaacgcctgcttgtcaaagaagcaggcgttaaagtctatgacagggttatttttgggactttgcctgtaagatcctttgcatctcatccttgatgtgtagtttttcttttttcaggcgcacaactttatcgctatagccggttccatttgggccttctagctgtgatatctcgtggttaagtcggttatgtttttcaaacagggattggaaacgcgggttagattctttcaggttggacactaaatcacgatattctggaaacatagaacctcctagacgaaatttactactgctcaatatgagtgtagcagcccattgtaagatcagatttgagagatatcacataaaaaagatcggggaacaactttatatctttttgactgttaataataatttattatttttataaatgaatgaatttctcatttaaataatagtggtaaaaatcagtctcttgacaaaaaagcataacttattcctatcgttgagcatgttatgattcaattccgttgttaaacatatcaagaggtgataaatgaaaaagtatctacttcctttagccgctatgatggtttcggtttctacttttgctcaggctgataagaaacttgaagatgtcgccccttatcctaaggcttcagaaggaatggtacgcaatgtcattgaccttgcgccagaagaggatgaaggcgattacatggttgagcttatgattggtcaggatataaaagtagactgtaatcatcactggtttggtgggcaacttgaaacaaaaaccttggaagggtggggatacgattattatgtattgaataaagtcaccggcccggcgtcaaccaaaatggcttgtccagggcaaaaagaaaccgtgcgctttgttcaagtgcagttaggcaaagatgcgcttatacgctataacagcaaattacctatcgtggtatatacgccaaaatcaatgacagtcaaatatcgtatttggcaggcattggatgatatcgataatgcagtaatcagataaattattgattaggtaaatcaacaacctgggttttataaatatctgactcaggttgttatgtttattatattattgtcataaagttttcggctaatttatctttaacggataatggttattttttaacattaattttcaccaggttgacaataaaaccgtttcaaatgaaataactcttaaatcatcgcctgtcatattcgccagtcctttattttctgcctgtggttccttgcgcatatttaaaaatattaactaaactttgtttggattattttgcattcaggcgaatatcattgaggaatcatagaatgtttaaaaaattatcggcagagtttttgggtactttttggttggtgtttggcggatgtggcagtgctgttttagccgcagcgttcccacaactggggattggttttgtgggggtatctctggcttttggtttcacggtagtaacaatggcttatgccgtagggcatatttctggagggcactttaatccggctgttacattaggattatttgctgggggacgcatttcagcaaaagatgttattccttatatcattgctcaagtgattgggggaattgctgccgcggccgtactttatcttattgccagcggtaaaagtggttttgatgcaacggcaagtggtttcgcatccaacggttatggtgaacattcacccggcggtttttcattacaggctgccattatcattgaactggtattaaccgcatttttcctgattgtgatcctcggaacaaccgataaaaatgcatcagtagggtttgcgccactggccattggtttggcattgacacttatccatttaatcagtatccctgtgacaaatacgtcggttaacccggcaagaagtacggcagttgctatttttcaaggcacatgggcgttgaatcaactttggctgttctggctgatcccattaattggtggtgctatcggtggcttgatataccgtacgttattacagaaagattgatatcttatcattttgaacagccatgctattgcgtggctttttatcatatttatggtaaatttttctacagattacgtttttaaaaaaggaaaaatgatggagcaaaatataacgtgggaacaaggtgaatactgggttaccacggataaaacaaaatttgatattcattttgttcataataatcttacccaattatattgggcgcgtgggattacgtttgagaaagtcagaacagggatagagcatagcttatgttttgccttgttccattgcgataaagaaattggtttcgcgcgattaattacagatttttcaacgtttgcttatctttgtgatgtctttattgtgccggactatcagaagagagggttggggcgttggttgatggaatgtgttttacagcatccgattatttctcatgtgaaacgggtcatgttggtgacctcttcggcgggagggctttatgaaaaatttggttttgagcctgtcagggtgcaggattttgtttggacgttagagaaaacgaaagcgtctgagtaaatgaaaaggcaatttatggtcgatcggtatcctgtgaacccactcaaaagtgggtggatcataaaaatgaagatttttatcagatccgcgttgacttcttgcagaaccaaaagttgagatatcacttttgcagccagttaataattaatttccttagtgatagtaatgtaatgtgatttaaggagtttattctttatagtggggattattgcattattttcttctggtaattcaggagattcgctatctatcatttctattctcatgtaataaacaatattaatggtataaataatatagctcttaaaaacgtttttatgttgaaaaaatgtatttaaagagtattagatttaatttatgtcataaaatcaaaaaaattgaattaatttattaaattttttagttattttagatgtttgtgatgttatatatttatcgacagaattcttatgaagatataacacgtgtaataaaataagatatatgcaatatatattgttatttgtgtaatatacgtgacgttgttgtgtgtcttatgttaaatatttgatggtatatattgtggtgaattaatatgtgattttattatctgttttatcaagagcttatcacgattggcttcttatgccagatgaatggcttgaaaaattaataggctattaaagatgtaaagttaagaccctcaatatgttcagtttaatttatatattaggttggttataccttatattttttgatatttccttttttctatgtgggatttttattgaattatatattaagagtgtaacagtgaacatttgatttatggagtctttacaatctgcaaataggcattgttggtaatgaagtgagtgtaataaattaggaaaaaatatggaacatattgacatagaaaaggtgtcgggcaaaattttacatgaattgttgcaatatagacgccgtttctcagaatctgaacatacgattgaatatgaagaacaaaaagtctctgaagttcagctgccacgcattcgtgcgtttgttgaacagggcaaagctgttgaatgtattcttcctgcatttccgacaaaatcgccgaacccccgtaaagtactgggtacaatgcctgatatggcagaaaaattatcactgatttttctgaattctctgtgtcagcgcattcaactttattatccaccaggtgcaaatattgttatttgttctgatggacatgtattcagtgatcttatccacgtcgacgatgaaaccattacccattatcaattggagattgaaaagttgctgcatgaactgggcgcaaccaatctttcagtttttaatctcggcaacgttgaatcactcacccaatataccagcaattatgatcaactgcgtgagctgctggtgaatggttatgcttcttcgacggaagaaattaaggccacgcttaaagagagtgaagaagggcttcagctctatcgggcgattactcgttttctctatgaagatagtctgttgccgggatatgacggttcgaaaacagccttgcagaaagatgcgcgtcaacgagcggttggcgttatccagcgtagttgggcttggggaaatctgctggctgaacagtttccactggctattcgcctttctatccatccgcagcccgttgacagtattaaaatcggtattcatatgatgcctacccgggatgattggctcacgccgtggcatggtgtcgcagccaatattaacggtcaatttgtgctgatgaaaagtgatgaagtgaaaaagatgcaggggaaattggtcgagatccgtggtgtccccagccattacatgattgaagccgtatctgagcaaaatcagcagacagaaccgctggttgccgctttgcaggaacagtaataaaggttatctgagagttattcgccgttataccgcatttttgagagagggcattatgagcatagatgaactggattgtcgcattgaaccgatcatgccttttggactactgattacgcccaatgcccctcagcaggacatcactacgttgtctattgataccctgcgcgagctggcacgtacccacaaactggttgtattacgtggtttttcttctggttttacggatccggaaaagttgacggaatacactggccgttggggagaaataatgatgtggccgtttggcgccatattggatgttatggagcgtcctgatccttctgatcatgttctggacagcacccatgtgccactacattgggatgggatgtataagccgacaattccggagtttcagatatttcactgcgtttctgcgcctgaggcaagtcaaggagggcgaaccacgtttgttgatactgagcaattgattgccgatgcgagtgatgatgaacgccatgaatggaaaaacaccacgataacttaccgtacaagcagagtgacgcattatggtggagaggtggtttcaccgctgatttgtcttcatcctgatggtaaaaaatgggtgatgcgttacaacgaacccatgacaggaaaagacgataaatatgctgaccatcatttattgacgatccatgggctgtcaattgaacagcaaaaagaatttgaaaaaaatctgtttaacagattgtatgactcacgttatttctatgctcatcaatggcagtcaggtgatttagtcattagtgataattttactttgctgcatggtagggaagcgtttattactcattctccccgacatctccagcgggtgcatgttcatggaacaccagtttgtgagaatctcagtttccgaactatttccaattcagattctggtgtagctgaagttgagttgaaggaggtttaattaatggctcgtattgttttggctgcgattgcaactccaggccatgtttttcccatttgttccattgccaggcatttgatagagcaggggcacgaagcgacaatattcactggctctatttttcggcagcaggcagaagcgttaggggcaagcttcgtcgccttcgatcagcaggttgatgttgattaccgtaatctggaagagaaatttcctgagagagggcagcatcctcccggaaatcatcagatgacacatgcccttaagcaattttttgctggccctatacctgtgctgtaccgtcagttggagcagttggttaaaggcgctgatttactgattgtggacaatacgttctatgcggtactcccactgctacagaaacctgcccatgatcgtattcctattattgcgattggggtgacaccgttgtcatggtcgactcgggataccatcttctgggggccgcgtattcctcctgaattattgcctgctgatttgatgcgtgagcaattggtggatgaggaaacggctcagttgattggacaggtacgggatgcattcaacaccgctctgttggaagtagcatctcctcctctgacacaagatcataatgatgtcgttatcagtcgagctgatcgtttcctgcaattggcgaccaaatcgtttgaatttcctcgtgatgatttaccggaaacggtggattttatcggcgcgctgggtgttgaagtacaggatgacaaaacccagttggagtggtcagatgaaagtctgccgcttgtcttagtcacacagggaacgctggcgaatgttgatttcagccagttactattacctaccttgcgtgcattggcgacgttgccagtacgtgtgctggcaattacggcaggaaggccagtcgaaatgttgggtgaagagatccctgacaatgccagggtggtggaataccttaactttgaacactggcttcctcgttcagcaattttcattaccaatggtgggtatggttctcttaatgcggccattcgtcacggtgtgccgctggtggttgctggtacaggagatggtaagctggaagctgttgcccgtgttatctggtcacgatgcggtattagtctgaatacagatacaccgagtgaaaaacagttatatcaagcggtgacccggatactttcttctcctgaatggcattatcagtcacagagaattaaggcagattatgatgctcataatgctttggaattgatcactcgtcatgttaatgaattgattgctgaatcagtttgagtcattaatcgaagatagtatatataatcggttaaaccgccacgaatatctccatttctaagtggaaaatattaagtggcggtttattttttagttgaaaaatttaattaaagatattaatgctgagaagtgtcaggctttttcccgtacaccttcaacggaaataaccaattcaacttcctgagattttggccctaaattagccttaatatcaaaatccttcaatttaattttaccattagcttcaaaacccgtacggtatccaccccaaggatctttaccttctcccattaatttggcattcagcgtcacaggtttggtgacaccatttaatgttagatcaccgataactgtgtatttttctccctcttggctgatcttagttgaagtaaatttggcttctggatatttttccgtgtttaaaaaattaggcttgcgcaggtgtttatcgcgctcggcatggttggtatctacgctatttgtcttaataacgacattaactttgttcgtttctggattttgcggatcgaaagcaaaatccccgtcaaattttctgaaattaccgtaaagccagctcatacccaaatgttggatacgaaattcaataaaggcgtgttggccaatcgtatcgattttatagttagcggctattgcagagcctgtactcattaataaagcgcctgcgctcaggccaattaacatcttttttaacatattgattctccagaggttatttttagtcagggttgaagccaaatattctttttaaggtactatcgcggtcaataaaatgatgcttcaatgcagcaagtgtgtgcagcagggagagcaccacaacaacccaagcgagataaaggtggataatgccagcggtatctgcctgtatgccctgttctgatagcgtggcggggatattaaaccatccaaaaacgctgataggttgcccgtcagccgtagaaataagatatccgctgcctaaaatgccaaacagagccagatatagcgtgaaatgagccagtttggaactgattcgcgtcaaatagctgtaacttgtcagaggttttggtggcggagaaataaaccgccagataagacgaataaccatgacaaaaaaaattaaactcccaatacttttatggagttctggtgcctgatgataccaagtatcgtaatagcttaatgtcaccatccataacccaagtgcaaacataccgtaaacagcgagtgcaactaaccaatggatgaaaacagaaacatgaccaaagcgcgtggacgtattttttaaaagcataccgtttccttattcttgatcactgaaaattctctgtgaacataagtgagaaagtttaggtattatagtatattaaaacgctactttatttttacgaattttcgataaataatttgtttaagaatgtcaaattatatcacttggattcacatattaagcgcaacaccgtaatggacgaagtaaatgagagggtattcctttaaataactcattcggtgttttgtaatctcgtgttttacgaggacgattatttaatcggtttgccacaaggttaatctcccgctctgacaccttattaaaatcagttccttttgggaagtcatctctgattaatccattcgtgttctcatttatccctctttcccagggggaatacgggtgagcaaaataaatttttgtctctaaatttttactgatcagttcgtgttcggcaaattcgaggccgttatcaaaggtcattgttttaattttatgttttatcagtgataaatgtcttgttgccgcttttgcgaccccttctgctgttttattttcaagtttaattataatagtaaataacgattttcgttcaactaatgtcaataatgcacttttatgatttttacccacgatagtatctccttcccaatcaccaatacgctgctttttatcaacaagtttggggcgcttatcaatactgactctgtttttaatttttcctctgcgctcataacttccatagcgtttacgatacggttttttcgcaatcctaagatgttgccataaattaccatcattaagtttatccttataaatcaatcgataaactgtttcatgatgcaaagatattatattttcccttttgagataaccgactgtttgttcaggacttaaatcttgccaaattaactgtttgatccacatttctatctctggtttcacttttactgcttttgtagcacactgtcggcgcgctacggccttaagctgagcttgttcaggcgtatatttctttgcctcccgatttcgtctcaattcccggctaatcgttgatgggtttcgattgagtgactttgaaatctcccgttgtgaaaaaccggcttctttcaggctgaaaatctgatatctttctgtttcggtcagttgtttataggccatagcgcattttcctttggcaagaaagatgcctactatagcaactgaccgcctttcttagaaattgcacttattatgcgaatccaagtcaataatataatcatattatgatcctgatgatgaaataaaaagcatttaattcatttgttgattgtgatttaatgttaggttattaatattcatgataattatgtgtatatttaaaattgatattatttagttgtattttttctatatttatttttgttttaaaagcattaattaagtgaataataattaatgtgtaaatttaaatttattcacttatccataaagtgacagttattttttattatagaatatgttcaattataggaatgacttattgctaaatatatttttagtgtgaacattatcactctatgaaataattttttgaaaaacagatgggtgattattatttaaattggcaaaaataaaaagcgttttcctgtatgccattgtttactcttatggcaagagattgtaatgttttcgcgtagtcacactctttgatcactatagcgggaaatacgatgtacacattgtggatagccaataaaaattattcttcttggtcactgcgtccgtggattttgctgaaggcgctggagatcccatttaacgagcagcttagttattttgaagataataaaagtagttatgaaaaattcaaagcattctcacccactgggcttgttccttgtctggtagagggtgaaattaccgtttgggattcactggctattgctgaataccttgcagaacaccatacacaggtttggccacaagatcgcatcgccagagcgtgggcaagaagtgcttcggcagaaatgcactctggttttgccacattgcgccaaacttgcgcgatgaattgttcaaaacagtttgaattggaggaaatttcccctgagttacagtgtgatattgaccgccttgatgctctttggtcagacgggttaacgaaatttggcggtgaatggctggctgggagtacattcactgcggttgatgcgtttttcgctccagtggctttccgtgctcagacctatgggctgaaattttctgctgtcagtcaggcatgggttgatcgaatgcttaagcatccggcaatggtggaatgggctgaggcggcagcaaaagagcctgaaatgaagcattaattattgatgttattttataaaaaaagctccgtattgatacggagcggaaatgggaaaaagtagctgtaaaaatgttaataggtagtacaggtacatagtaatcctatgcaattaaacgcggaataaacaaaagagttatagtgcggaggaggttcagtgagagggagtaacaaatgacttccgctggagagaatacctagtatggcctatcgataatgaatctttgtcaaacaggccataccaaatatcagtttttgtcattgggagacaccttatattttttattggctgtggcctgatgagaaacgacatcccggatcatctccagcgaggcagagttctcaattaatgcaatatcgttcggctcccgtccttcacaaatcgcctgcatggtgcggcgcagcattttccctgagcgggttttgggaagctgggtaacaaaatagacccgtgccggacgcccgacactgccgagctgcttatcgaccaaatccatcaatgctttttccagcgctgcgaaatggtcagcactctggattttccgcccttccttaagtaccgcaaaggcaaccgcggcttgtccttttacttcatctttgatgccaatcacggctacttctgccacgtcttcatggctggtaatgcactcttcgatttctcgtgttcctaagcgatgccctgagatattaatcacatcatccgaacgccccagaataaaatagtaaccgtcgctgtcacggatgccccagtcgaacgtagaataaatctgctgggcaaaatgcttccagtaagtatttataaaacgcgtatcatcaccataaacggtctgaatacaaccgggaggcagggggcctttggcgaccaacatccctttttcattatcgccacattcctgaccagttagttcgttgatcagtttgacgttgaagccgtacattggaaaaccggggctgccaaaacgactcggccggtcatccaatccacgcgcaatcgccataatcggccagccggtttcggtctgccaataattatcaatgaccggaacgttgatgatttccgcaacccagcgggcggtatgttcatcaagcggctcaccggccaaatataatgcctcaagtgatgaaatatcgtattttgcaatacaatctgtgggatattttttcagaacacggattgcagttggcgcagaaaacattctgttaacccgatgtttttccacgatctgccaccaaatactcgcatcagggcgggtcggcagcccttcatacatgatggttgccatgccagcgataagtggggcatagacaatgtaagagtggccaaccacccagccgatatccgatgtgcaaaagaaaacgccgcctggtttgccgccaaaaatggtatccatcgaggtcgccagtgctactgcatagccgccgacatcacgttgtacgcctttgggcgtgcccgttgtgcccgatgtatatagcacacaggaggtttcattggattccatccatgtgacaggaatatctgcatcaaggtgtatttgccgcaggctggcgaaatcgatatcccgtccttccagccaatttattgcggccagaccgcggttcaccatcaagacatggcgtggtgtgtgctgtgccagttcaatcgcttcatccagcaggggtttatagggaataatcttgcccccccgcgatcccgcgtccgcagagacgaccagcaccggctctgcgttatccagtcgtgtggcgagactgtgggaagcaaagccgccaaacacgacggaatgaatcgccccgatacgggcgcaggcgagcaggacgaacagcgcttctgcgaccattggcatataaaccaccacgcgatcacctttttttactcccagtgagagcatcatggccgcggctcggttgacttcctgatataattcttgataggtgaaaacttcttcactattggtttcggttgaaatggcaatcagtgccttggcatcgggttgggtttccagccagcgatccagtgcgttgtagcatagattggttttcccaccgctgaaccagcgggcaaaaggcgggttattgtaatccaatacctgtgcaaaaggatgctgccagtgtattcgtcgggcctgttctgcccaaaaggcattgggatcatcaatcgaatactgataaaaatcttggaatgacataatctctcctggcgctatgcagatgagaagcggttcttgcaggcagaaccgccgatagcttcgtcgattagataacgtataaatcgagatattcgtttacgggcatgttttccaataaagtgcggtcaagcgaaaccgacaggatttttcgttgctgggtgtccggaaattgccgtgccagattggtactgaattttttcagtagcaatgggatgccatctttgcggcggcgcgcatgtccaatcgggaactcgactttcacttcatcaagccggctgccatcgttaaatgttatggtcagggcgttggcaatcgaacgtttctcaggggtatggtaatcacgggtgaaatcgggatcttcgacacatatcatcttttcccgcaaaacatcaatgcgtggatcggcagccacattatcctcataatcggccgccgtcagacgacctaacaataatggaatggcgaccatgtattgtatacagtgatctctgtccgccggattattcaatgaaccctgtttatcaataatccggatacaggcttcgtgggtacggatagtgattcgggcaatgtcttcgacctgcttacctgctgctttcaattgctgatgcagagtcatggccgcttctaccgccgtttgtgagtggaattcggcaggaaaagcgattttgaacagcacgttttccatcacatacgtgccatagggacgttggaatttgaacggttgcccattgaacaggacatcataaaatccccacgtttttgccgttaatactgagggatatcccatctcgcctttttgcgccatcagcgccagtcgcacggcacgagaagtggcatcaccggcagcccaggatttgcgggaacccgtgttaggggcatggcggtaggttctcagggattgtccgtccacccaagcaagcgaaacggcactcagtatttcttcacgcgctaaacctaacatctgggcaaccaccgctgttgaagcgactttaaccaacaccacgtgatccagtccgactttattgaacgcattttccaatgccagacagccctgaatttcatgggctttaatcatgccggtcagcacatcttttatggtcaggggctgttttccattggcaaccgctgttcgggacagccagtcggcgatggcaagaatacccccaaggttgtccgatggatgcccccattctgccgccagccaggtatcgttgaaatccagccaacggatcagggtgccaatattaaaggcggcctgaaccggatcgagttggaactgagttcccggtacgcgcacaccattcggaaccacggtacccggtacaatcggccccaataattttttgcaggcaggatattccagtgcttccagcccacagcccagtgtatccaaaaaacagtaatgggcagtttcgtaggcaacgggggatgttatggtgtcgtccatgacataatccacaatatccacaatcacctgatcgtaatcagggcggttgttgacaacagaggtagacataatcaatccttctcaataatcgaataaaacatgaatacaaaaaacaccgcataaaatagtgctacttgcgttggtcgattggcgtaaacggcaggttttcagggccggtatagttggctgaagggcggataattttgttatctatgcgttgttcaataatgtgagcggcccaacccgccgtacgggcaatcacaaacagtggggtaaacatggcggtaggaacccccatcatgtgataagacaccgccgagaaccaatcaaggttcgggaacatttttttgttatcccgcattacagactcaatgcgatctgcaatatcaaacatctgagtggtgccggcttccttggaaagatgcagggaaatctctttaatcaccttatggcgcggatcggagacggtataaaccggatgaccaaagccaataatgacttcttttctttccagccgggtaaggatatcggcttcggctttgtcgggagagtcataacgctgctgaatttcgaatgaaacttcattggcaccgccatgttttgacccgcgcagggcgccaattccaccgataatagcggagtacgtatctgatcctgtgccggcaatcacgcgactggtaaatgtcgaagcattaaattcatgttcagcatacagaaccaaagaggcatgcatcgccttttcccatgaatcacgcggtttttgtccatgtaaaagatgcagaaaatgcccgccgatggaatcatcatcagtttcaacatcaatccggcgtccgttatggctgtagtgataccaataaagcaggatagagccgagggatgccagcaaacgatcggcgatatcacgggcgccggtaagattatgatcttctttttccggtagagtacaaccaaagacagaaacgcccgtacgcattacatccatcggatgggcgaccgcaggcaaagcttccaatgcggctttgacgctgcttggcaggccacgcaaggctttcagtttggttttgtaagcggccagctctgcgcgggaagggagcctttcatggatgagtagataagcaatttcttcgaattcacaatacgtggctaaatcgagaatatcatagccacggtaatgtaaatcgctgccgtttttgccaacagtacagagcgccgtattaccggcagtcacgccggacaaggcaacggattttttcggtttaaatgttgccgcttcaggagatccagtcatcgtattctgtttactcatgagtatcacctctggtttttctgggaaaacagggcatccaatttctgctcaaaatcgtaataattaatgctttcataaagctcattacgggtttgcatcagatcgatcacgtttttctgtgtgccgtcacggcggagtgtggtgtagacctgctctgccgctcgattcatcgcccgaaatgcagagagcgggtaaagtgcgatagcgacgtctacactagctaattcttcggtcgtaaagagtggggtggcaccaaactcggtgatattggccagtatgggaacctgcgttcttgcggcaaatacctgatacatttgcagttctgttatcgcctcaggaaacagcatatctgcaccggctgcaatataagcttcggctctgtcaagagcggattccaacccttccacggccagcgcatctgtgcgcgccataatcacaaaatgctcatcggtgcgggcatcaacggcagctttgatacgatcgaccatctcctctttggagacaatttctttatttggacgatgcccacaacgtttggcacctacctgatcttcaatatggagacccgcagcccctgccttaataatagaacaaacggtgcgggcgacattgaatgcagaagaaccaaaaccaatatcggcatctaccagtagcggtaaatcgcatacatcggtgatacgccggatatcggtcagcacatcatccagcgtcgaaatgcccagatccggcagacctaacgaacctgctgaaacaccgccaccagaaagataaatggctttgtagcccgctcgtttcgccagcaaagcatggtttgcattgatagttccgaccacctgtaacggagattcggcctctattgcccggcgaaaagccagaccagcagaagaaaatgccatatataactccattgttactaaaatgaaactaattcgtattgaattgttatttgagcaaaatttgtgccaatgattgagaaacagggtgcgtatcggagatgtgcaatagggggtgttgatattttttattttaaattaatgaaatagcgccatttatgcgtgttgcatgataattgtacatctattgagcataatgtatacttgtttcatattgaatcaataatgtttcatttttgtttcaagtctgaaaaatgaaacattatggtggcttatcaaaaatcgaaaagagcaggaaggggggaacaaatggcgtcaggatatacaggggagcgtgataacaacaaaccggtgatctggacagtatcggtttcccggctttttgacctttttcgtgacatcacgccggaatttgatcatcaggctgatatcacaccgattaatcttggttttgaacaggcggttcagcatattcgtaaacgtctggaaacagagcactgtgatgccgtgatttgtgccggctcgaatggcgcctatctaaaaagtcgtttatccgtaccagtgattatcgccaaatccagtggttttgatttcatgcaggcactggcacgagcgaggcaaatcagcgcccggattggcgtcatcacttatcagaataccctgccagcattggaagaatttcagcagcgtttcaacttgcggattgaacagcgcagctatgtgacggaagaagatgccagaacgcaggttaatgcgctgaaagccatcggtatcaaggtcattgtgggggcagggctgattaccgatctggcttatgaagccgagctggtgggggtgtttctctattctgccgacactatccggcaggcatttcatgatgcgttggaaatggccagaatgactaagctcaatctgggggggagttcgccttatcctacggaggataagttgcgcattcgtcatacgcttaacgatattataggtgattctgctgtggtagagcatgtacgcaacacgattatgctgtatgcccgctcgacggccacagtgttgattcaaggggaaagtggtacgggaaaagagctggtggcacaggcgattcatcatgaatacagcctgcgttatgggcagtctgtgggtaaacatccgcgtccctttgttgcggtcaactgtggtgccattaccgagtcattactggaggcagagctgtttggctatgaagaaggcgcttttacaggctcccgacgagggggacgggcgggtttgtttgaaattgcgcacagaggaacgttgtttctggatgaaataggcgaaatgccattgccactgcaaacgcggttattgagagtgctggaggagaaatccgtcgtcagggtcgggggatatcgtccgattgcggttgatgttcggatcatttgtgccactcattgtgatttagatacgtgggtgcgagaagggcgttttcggacagatctcttctaccgcttgagtgtgctgagaattaatgtgccagcattacgtgaaagagggagtgatattgggctactggccgtggagtatctgcggcgggcatttgcggcgcttaacttgcctgtttcatcgtcaaaaatacgggaactttctgcttgtcatgcagcgctgcaatcttaccattggccgggtaatgtgcgggaactgcgtaatttgatggagaggattgcactatacttaagtgcccatcccgaacaggcattgacacctgctttgatcttatcgctttcacctgagcggcagattgatatcagttcggtgaagagcaacgcgaaaactttcgagattgaacctccttcttcaatggcagtttcttcctctgtccatgatattgtggcgagatttgcgggtaatcgacaggcggcggcagaatatctgggaattagccgcacgacgttatggcgaaggttaaagcaagaaccggagaaagattaaatggaaaagccctattgggataattatcaccaatgtgacattttaaaatgcaacatattcctgtggtatccaacctgtttcgccggattttttgtgagccaaaaaccggttttgtgtttaatatgttgaacttggtgactctagtattatctacgatcaagttcataaggtgattttagtgttataagcagaaattggctcaacacaataaaactcacaatacacatattgaatacatgacccgtaaactcagtgagtaaaccagataccagaatacacactgagcaataatatcaacaggataatgtaaatgtttgaaagcatttcgtattaaacacatgagcagatcacagagtaaaagacagaatattacctgtcctcaccttatgtgacagaaccactctctcaccttaatttcaagtggttgtctttttttccggtaatggcaaaggaatattttctatgccgtatcgtcctgcaatttctggacaggttactgtttgacctatgttttccacaaatgttgtattcaaatcaataggagcatcaattgccttaccaccttcaaaaaacatttgttccattcctggaggtgaaagaataatgagcattcgtgtatttttatctgtttcattacgaaaaccgcggatttgcccaacagaaaaatttaaaaaagcgccttgctttccatacattgtttcagtctgcgtataaaaaaccatttcaccttctagtatgaagaaagcttcttcctctaatttatggaaatgaaatggagcacctttccctggttcaacaatgatttcaaccagactgtaacgactgttggtttctacaccagtagctataactcgataaaaattaccttctgataacagccattgtccttcttttgcgtttttgtgagaaaatttgagcagctcgctgtgcattttatttcacctatattcaagtaattaatataatcatttattacttgaatgtatcagataattgcataatgtaaaaccctgaaacaggcgctgtgtggatgtatgtcaccgaggcaggctgctggacgcatgcccgccgcaagttttttaaactctactccggctccagaagatctagccagctccggactagtactatagccgtaacctctttgtaatcatcagcttatcctggctccgataatgacattgttgtgcggagtattgatgtcgccgccgccagtctgaccaatgtaaaatctgctcgacggtgtttcccgttttttccatcaatcttgacagcagcttacgcagttccgccatactgagggctaccagccccgtcggcgttttttttctcctgtattcgcaaaactgccagcactgcatgggccagaagcgataaggtgatgtgccgataccaactgtgccattgccgcacttcgtaatgatccagaccgcattctcccttcgtttcctcaaaaccccattcaatttcccagcggcaacctgccacctgagccagggttttcagagccgcctggtctctgcgcgcatacacgatatagtaagcccgtgcctgtttttcatcccggctgcgacgaacccgcagataatggccatattcccgttctttctcactgagttgtaaacgccagagcggtacccgaacccagtcatactgacgttcgcctttcgctccccaccccgccgaatgggtttcccatcgctgaggtgtcagattgtctaccatcttgtccgctctgacaaaagttggcccttgccaccacaacggttcatttttggggatcgccagcacaaacggttgatatcgggattccagccagcagcgcaggcggcgatcctgaccataaacggcatctgccgggcgagttggggtttagtggcaaaggggacggcgtcaggaatgccggcagcttcacagcggggccggtcatccgtccattgtctgggcaggtataacgcccggtcaataaaggcatgaccgccctgaccggcataacagagaaagacgcctgtttgactgttttcgacgcgaccggcggtgccactgtattgacgttgcacaccggcagaatgcgtgccttttttgataaagccggtttcatccacaatgagcaccccgtgttcatcccccaaatgctctgtgacatagtcgcgcaaaatatcgcgggcgatatcaacatcccagtgggcgcgctccagcagatgctgaaccccgttcgcctatccattccgccagttgccagccatttttacgctcaacgtcactgagcagtccccggagataagcgaggctgcgttgctgtgggccgggatggtgaaacaacggagccagacgggtatggagtgagagcagttcctgttcccaagcgtgagtcggtaagtgcattgaacacctccccgtatttcaggaaaaaatgtcaggcgttatcatgccacaatggggcgtacggctgtagtactagatgctgtcgtcatgatatgcataaacagatacaagctaataatgatgccaaccgacgcgtgcgcaagtgagctagaaaacacaatggataatccattttactttcttcatccaaagctgaaggcacaagcagaaaataaagttgagaattttgctcaagctgtggaagaagcaaggcaagccagtaaaaacaatagattatcaatatcttcctatgtacccggccttcagggaatatcaagtttgtcacagtattcattcaactatgtgtatgaaaagatggcactgggaaatacgacgctatttttggatgtataccagcttcatgctttctacaagcaacgtggattggaagacctcaaaacttgcctaaatttacgccaagatatctacggtaatagccaatttccaatattgtggccaataggacaaaataatttgaagtttggccttccctatgacgatattctactcgcttttgaggcgatagaagcaggaaatattgctcaaggtgttgtacatctcgcctatcacgagcaaatcaatatattgcaaaccacaatgtacagtgacgagcaattaatagtgttcttgtggggtaaccaattctcctatgtcacaggctttttacctgataatgtggcacaacctgttgagttaacgttggctagtcaatgccaattcattgataataaaagaactataaaatttagcgatgaggtagctaatctcgccgatgtagatcagcgtatgcctttcgtacttaaggcagcagatcgttttgattaacttctacgcggtagtaaacgatctgtgatcgatgagtctctacaagatattgcctcatggggaggtgtaaaatgagtctcttacagcgtatagattggcgacacggtagtctaatcttagtgttgtttgtcattctaggatcggctggtatctatctctatcatttcttctactccagtgaacctgagatagccttggtgattggtgaaccttacgaggctatgcgacaacgctctagtgccgctattgatcccgacctttctggcaaaatttggtacaatatcccaaaaacggatgcgcgtttacgctttactgacccacaatatggatttgttacaccaaccgctcggttttttactgtttcatacaataaaggaatagttgagagtgtacgtatgtctccacaaatcgagccgttactttacgatgatacaattaagatagtgttgaatttacaaaaccagtggcgcaaatcgggttgggtacttactcaagctaggggatttcctgctttagcggatacaccagaatggcatgatactcttcgccgtaggaaaaacggtgctggaacgacctattggcaagctggagataagtatcaaatcatgctgaatttaaggcgtttcaaagatgatcgacatcctaacgaagaacgatatttgataacgttggcaattgccaagccgtgggtagattttaatccttaaatttgtctctacaatttagagaaaaccgcagtaaattccttgccctatgggggcaagggatataaggcaaattttgatgagatgctacatgatagcaaccgaatgtagaatgagcttgttacaacgtataggtcagtggcgtagtggtctaatcttggcgatattaatcattctaggtctggtcaccatttatctctaccaagtcttttattctcgtgaaccagagatagccttggtgattggcgaaccttacgaggcgatgcggcaacgttccagcgctaaaattagcccaccctatgataatagcatcgggttcagaatcccaaaaacggatgcacgcttacgctttaccgatccgaaatacggatttattaccccccctgcacgatttttttactgtttcctataataaaggaatcatcgagaacgtgcgcatgtctccacaaatcgaaccgttactctatgacgatgcgatcaagattgtgctggatttacaagatcagtggcgcaaaacggggtgggtgctgactagagaataccaacctttagtaaatacaccagaattgcatgatagccttcgccgaatgaaaggcactggaatgaccttttggcaagcaggcgatctatatcaggctatgctgaatatggcgcgtttcaaagatgatcggcatcctagcgaagaacgatatttgattacattgcagattgccgagccgtgggtaaagccataacgtaatctcaggtaggtgtgagaatattatcttctcacacccacaattcaggatattacttcaggatgagatataaaatgagtctgttacaacgaataggccaacgacggagtggtttaaccttcgctttattaatcattctgagtttaatcgccgcttatctctaccatgccttttattcccgcgaacccgccgaaatagctttggtgatcggtgagccttatgaggaaatgcgacaacgttctaggtcgtgtcccttaattatataaccgcttgtaaaagagtcgaatacagcctaatttcaccatggataaatagtttcgggcggttaatgagcaactgtctttcactttacaccgtgtggaatgattcgtcccacggtctatttgtttttatcattgcattgagaatgaccagtaatttacgcatacacgcaacgatggcgactttgtttggcttgcctgcttcggtcaatctcttgtagaaagcgcagagaacggggttaaatctaattgccgttaacgtggccatatatagcattcgacgcaccattgctcttcctccaaagattgttcgtttcccccggaaaaatccagaatctcgattaaacggtgcaacaccaatcaaggcactaatttcccggcgtgttaacttacccaactccggtacatcagcgatcaaagtggctattgtggcaggcccaacgccttttactgtagataataaatcgagtttggaacgatgataggttttaatgtgtttagacaaggcagattcaatgaccttaagctgttcctgtataaagctgatcattaaagtgatgctttctcgaatgtctggatggcaattccccaacctttggcgttctgagatggaaagtacgaccaattggcgacgacgtgcgatcatggcttgcaagactcgttgctgagcagagggcaatatcctgactattttatcccggtctgttcgttgagataaaaccagggctaactgtgccagcacctgagcatctattttatcggttttggctaagttacccattgcctta

SEQ ID NO: 14950 - DNA, 36522 bp, Xenorhabdus bovienii
  Genomic contig Name=Xb4151_4152.C409
ataggccgccctcggcgctactgacaaaacacgcagtcgcaatcttcatcaattggaggaataaggtattaaaggcggaaaaagaattcaaccggcgcgcccaaatcgcattaatgaagagattcgcgcctctgaagttcgtttaacaggattagatggcgaacagattggtattgtcagtctgagagaagctcttgagaaagctgaggaagctggtgttgatttagttgaaatcagcccaaatgccgaaccgccggtttgtcgtatcatggactacggcaagttcctctatgagaagagtaaatcagtcaaagaacagaaaaagaaacaaaaggttattcaggttaaggaaatcaaattccgtcctggtacagatgaaggcgactatcaggtcaaactacgcaacctgattcgttttctggaagatggcgataaagctaaaatcaccctgcgtttccgtggacgtgaaatggcgcatcagcagattggtatcgaaatgcttaaccgcattcgtgaagatctgagtgaactggctgtggtcgaatctttcccatcgaggatcgaaggccgccagatgatcatggtgctcgctcctaagaagaaatagtcaggcagtcaagtaatgggctccagtcagtttttggttggagtctattcgccttactaattcgttgtaatcaacaatgcgaagtggaaattaaaatgccaaagattaaaacagtacgcggcgcggctaaacgcttcaagaaaactgccagtggtggtttcaagcgtaagcacgctaaccttcgtcacattctgactaaaaaatcaactaaacgtaagcgtcatttacgtccaaaaggcatggtctccaaaggagatttgggcctggttgttgcttgtctgccatacgcataagcaaatttttagattagaattcagagacgataggagaagtatatggctcgcgtaaaacgtggtgttattgcccgtgcacgtcacaagaaaattttaaaacaagcgaaaggttactacggtgcccgttcgcgcgtttaccgtgttgctttccaggcagttatcaaagctggtcagtacgcttaccgtgaccgccgtcagcgtaaacgtcaattccgccaattgtggattgcacgtatcaacgctgctgcacgtcagaacggcatgtcttacagccgtttcatcaatggcctgaaaaaggcttcgattgaaatcgaccgtaagattctggctgacatcgctgtattcgacaaagtagcatttgctgctttggttgaaaaagcgaagggcgctctggcataagtcaggttagaagagggagcaagctccctcttttactttcccccaaaatatggcttactattgattgggttaataaggacataatggagagaatggcaatgatgaaattagctttttttcgtttctttttttactttagcgcctgaaatcggggggctttgagcgtaagaaaagaaacgaaaaaaagcgcttgagcctccaatgtggaggcttttttatttttatgacctcactaatagctatttggggcatagtcgataacaactactaaagggccatctggccgaaggaagaggaaaacgatgtcacatcttactgagctggttgcaaaggcagaagcagccgtagaggaagcccaggatgttgccgcgttggatttggtgcgagttgaatacctgggaaaaaaaggccatttaaccctccagatgtcatcgctgcgtgacttaccagccgacgaacgtccagcggcaggggctgttattaatcaggcaaaacaggaagtgcaggaagcattgaatgctcgcaaggctaaactggaagctgatgttctgaatgcacgtttggcagcagaaaaaatcgatatttcattgcctggccgtcgtatggaaaatggtggattacatcctgttacccgcacgattgaacgtattgaaactttctttggcgaattgggtttttctgttgaatctggcccagaaatcgaagatgactatcataacttcgatgccctgaatattccggcacatcaccctgctcgtgctgatcatgatacattctggtttgatgcaacgcgcttgctgcgtacacaaacttcaggagtacagatccgtactatgaaagaacgccagccgccgatccgtatcattgcaccaggtcgcgtataccgaaatgattatgaccagacacatactccaatgttccatcaggtagaagggctgattgttgataaagatatcagctttactaatctgaaaggtacattacatgactttttgaataactttttcgaagaagagatgcaagttcgtttccgtccttcctatttcccatttacggaaccttccgcagaagtcgatgtgatgggtaaaaatggtaagtggctggaaatattgggttgcggcatggtacatccaaatgtattgcgcagtgttggtatcgaccctgaaatctattctggttttgcttttggtatggggatggaacgcttaactatgttgcgttacggcgtcacagatttacgtgctttcttcgaaaacgacttgcgtttcctcaaacaatttaaataaggcaggaatatctcatgaaattcagtgaactctggttacgcgagtggactaaccctgccatcagcagtgaagcattgtctgatcaaatcaccatggcaggtttagaagttgatggtgttgaaaaagtggcaggtcaatttcacggtgttgttgtgggtgaagtcgttgaatgtggccaacatccaaacgcagataaattgcgtgtcacaaaagttaatgtaggtggcgatcgcctgctggatattgtttgtggagcaccaaattgccgtcagggactacgtgtcgccgttgctacagtgggcgcggtattaccgggtgatttcaagattaaagctgcgaaattgcgcggagagccatcagaagggatgctttgttctttctctgaactgggtattgcagatgatcatgatggcattattgaactgcctgcggatgcaccgattggtattgatctgcgagattatatcaaattgaatgatagtgccattgaaatcagcattacacctaaccgtgcagattgtttaagcatcatgggagttgctcgtgacgttgctgttatcaataaactgtcaatgacagagccacagatcgaggctgtaaaactcactacagaagccacattccctatccgtgtcgacgcaccagaagcctgcccacgctacttggggcgcgttatcaagaatgtaaacgtcaaggctacaacaccactgtggatgcgtgaaaaactgcgtcgtggtggtattcgttctattgacccaattgttgatgttactaattatgtactgttagagttgggacaaccactgcatgcattcgatttggaacgcttaagtggctcaattattgttcgtctggctgagcagggtgaaaaattaacactgctagatggtaacgaaatagaactttctgctgatacactcgttattgctgatgaaaagcaagcccttgcaatggcaggaatttttggcggtcagtattctggtgtgaattctgaaacacagcatattttactggagtgtgctttctttgcaccattagcgattacaggtcgtgctcgttgttatggcctgcatactgatgcttcccatcgttttgaacgtggcgtagatccacaacttcagcataaagcgatggaatatgccacccaattgctgattgccatttgtggtggggaagccggagaaatcattgatgttaccagtggttcttatttgccaaaatcggcgactattactctgaatcgcaagaaattggatcgcctgattggtcatcatatcgttgatgacgaagtcacggatattctgacacgtttaggctgtcaggtgacagtgcagagcaatagctggcaggctgttgtacctagctggcgttttgatatgcagattgaagaagatctggttgaagaaattgcacgtatttacggttacaataacataccagacgtgcctgtgcgcgctgatcttgtgatgactgcacaccgtgaagctaatctgccattgaaacgcgtcaaaacgatgctggtggataaaggttatcaagaagcgattacctacagttttgttgatccaaagattcagcaatatttgcatccgcaggaagaagcattaatcctgccaaatccgatttcggctgacatgtcggctatgcgcttgtcattgttgacaggattattgaccactgttgtttataaccagaaccgtcagcagaaccgtatccgcttatttgaaactggcttgcgttttgtgcctgatgaaaatgctgaacatggtattcgtcaggaattgatgcttggtggtgtgatagcaggaaatcgttttgaagaacactggatgcttgaaaaacaagcagttgacttctttgatcttaagggcgatttagaatccgttttagaattgactggtatgctatctagcatttcatttagggcggaggaacatcctgctttacaccctggacaaagcgctgggatttatctggaaaataattatattggttatataggtgttgttcatccagaattggagcgcaaatttgacttaaatggtcgtaccgtgatattcgaattattgtgggccagtctggtggaccgcgtgattcctgaaatgaaggaagtttctcgcttcccatccaatcgccgtgatatcgccatagttgtgcctgaaaatgtagccgcagaagatgttcttgctgaatgtaagaaagttggcgtaaatcatatagttggcataaacttatttgacgtgtattgtggtaaaggtgtcgcggaaggccacaagagccttgctattagcttaatcttgcaggataccgtgcgtacactggaagaaaaagagattgctgcgaccgtcaacaaatgcgttgctgcattagaacagcgattcaaagcatccttgagggactgaacttatggcgcttactaaagctgaaatgtcagaaaatctgtttgagaaactgggtattagcaaacgtgatgctaaggatctagtggaaatattctttgaagaagtgcgtcattctttagagaatggggagcaggttaaattatctggatttggcaactttgatttacgagacaaaaatcaacgtccaggtcgtaatccgaagacgggtgaagatattccaattacggcccgccgtgttgtcacgtttcgcccaggtcaaaagttgaaaaatcgggtggaaaaagctttaccaaaagaataaaacatataaaaaaggccgcatttttgtgcggtctttttcttacctttaatatcctgttgtatacagtgggatacatttcttttttctggtgccgccaatgcactctgtttatgaattaatcactctccagaaaaaacgtgactatcgtgtgatagcactcctatccatcttatttattatgttatttattttgtcattgtgtgcaggagaattatggttctggcctgatcaatggctgtctgactcggcccgattatttatctggcaattgaggttgcccagagcgattgcggtgatagtggttggtgcgagtttggctgtgtccggcgctgtcatgcaggcgttatttgaaaacccgctggcagagccgggattattggggatcagtaatggcgctggagttgttgtggtatgtctgatccttgtctttcatggcattgctccattgtggttattaagtattggtgcggttcttggggcgttcgctatgactgctattttgttgggcttttccagaaaacatcaagtgacgaatacacggttgctattgattggcgtcgccttcggagtgatgtttggcgctatgatgacatggatggtttacttcagtaccagtctggatttacgtcagttgatgtattggatgatgggtagcttcagcggtattgactggcgccagaaatggttggttattgcactggttcccgctattttctggctgagtcaacaagggaaagtccttaattacctatcgcttggtgagttacaggctcaacagctgggaatatcacataataagtggcgtaatttatttatatcgatagttggattgttggttggtttgagcgttgctttggcaggggcgattagtttcattggtttggtgattccacatatcttaaggttaactggtctgacagatcataagaccttgcttcccgcttgtgcgctggcgggaagtagtggtttattattggcagatctattttcccgcttgtcattatcccatgcggaagtgccgattggagtggtcacagtaaccttgggagcaccaatttttatatggctactattaaaaacacatcatagataaatatattcgatgagtgtcatgggagaaacaaaatgacctgtcaaccgattttagaattgaataatattacggttgacaagagactgaccacattgtctgaatctgttatagcaaaagagcaaattcatctggtcgggctgaatggttcagggaaaagcacgctgctttcagcaattgcaggaattttaccttacagtggcaagattcatctgaacggcagaaacctgcgtgattatcgacagtacgagttggcgaaatatcgggcatggttttctcaatcagtttctgttcctatcatgccagtttaccagtatctggatatgtatcgtcctgattcagcgccattggatcagagtgaaagtgtgttatatgaactttgtcggcagctaaaactcacttcattgctgtcttcttcaattgggcagctatcaggaggtgaatggcagcgtgtcaggctggcaggagtctttttgcagatatggccagagttgaatccgaatggaaaattattactccttgatgaaccgacaaacaacctcgatattacacagcaaacagttttggatcagttaatcaaacaattttgttcactgggcggctcggtcttaatgagcagccatgatcttaatcacacttatgaacaagctaccagtgtatggttattgtcgcatggaaaattgttagtatctggaataccacaaaatgttatgactaatcaaaatttatcagaaatttttgaagtaaatattagacatatccaaaataccagctataaactatggagggttgatcatctttaaatttctattagtaaatattgtcttaatttattgcttttaatctctttttagtattgtgattgaccctgattttgtctatccgttgatgtttcgttgaacaaacgtcatttaaaatttttgggaattataaaacgaatcaggctacgcaaagcgattatggataattttctgccattctctcgtccagcaattggacatgaagagatagaagcaatagaacaggttttacgttcaggttggattacgacagggccacaaaaccaccagttagagcaggatttttctcgtatgtttggttgcagacacgcgattgcattatgttctgctacggcggggatgcatttggttctgctggcattgggcatcggcccaggtgatgaagttatcaccccttcccagacttgggtttccactatcaacatgatttgtcttctgggcgcagagcctgttatggtcgatgttgaccgtgatacgctgatggtcagtgcggaaacagtcagaaaagcgattacaccaaacactaaagctattatacctgtccattatgcgggagcaccttgtgatcttgatgccctgcgtattgttgctgacgaagctaatatccctctgattgaagatgctgctcatgctgtaggaacccgttataaaaatgagtgggtgggagagcgaggaacagcaatcttctcttttcatgccattaaaaacatgacatgcgctgaaggcggcatgttcgttacggataatgacgagcttgcacaacgggttcgctgcctaaaatttcatggattggctgtcgatgcatttgatcggcagcttcagggcaggaaacctcaggcagaagtcattgagcccggttttaaatataatttatcagacatccatgcggcgatggcggttgtacagttaggcaaactggaatccatgaatgcccgtcgcggggagttagtagctcggtatgctgctgctctgagcaattcaccgttacaaatgttgagtgttcctgaatatgaacacgggcatacccatcatttattcatggtgcgtgttgaccaagatgtctgtggtattgatcgcgatacttttatggcacgtttaaaagaaagaaatattggtacaggcttgcatttcagggctgcacatacacaaaaatattatcgggaacgttttccgatgctgtctttgcctgcatcggagtggaactcggcaacactttgctcgttgccactttttccagatatgaataatgacgatgtagatcgtgtcgtgaattcaatcactgaaattctttcggagcatagaaatagtgacatttgaaaaaattaagaaagtctcggttgttattccagtttataacgaagaagaaagtctaccccaattattggaaagaacgatcgctgcgtgccaacaacttgagcagaaatatgaattaattctggtggatgatggcagccgtgacagctctgccgatattttaactcaggcggcggaaactcccgaaaatcacgttattgctattttacttaaccgtaattatgggcaacattctgcaatcatggcgggatttcatcaggctgatggtgatcttgtcatcacacttgatgcagacttgcagaatccaccagaagagatcccccgtctggtgaaaacggcagaagaaggatatgacgttgtgggaacacgtcgtgccaatcgtcaggattcttggttccgtaaaactgcgtccaaaataattaatgtgatgataactaaggctacaggccgttcgatgggtgattacggctgcatgctgcgcgcttatcgccgtcatatcgtacatgcgatgctgcaatgccatgaacgcagtacatttattcccattctcgctaacacatttgcccgtagaacgactgaaattgatgtaactcatgcagaacgtgagtttggggattctaagtacagtttcatgaagctgatcaatctgatgtatgacctgttgacctgcctgacaaccgcaccactacggttattgagtgttgtgggaagcattattgctgtgacaggttttctgctggcggtattactgatcactttgcgcctcattttcggatcaatatgggctgctgaaggtgtatttactctatttgccatccttttcatgttcattggtgcacaattcgttgcgatgggattgctcggtgaatacgttggccgaatatataacgatgttcgcgcccgcccgcgttattttattcaaaaagtagtcggagttagaaagatcaacgacaatcaggaaaaaagctaatgaaagcagtaatttttgcctatcatgatattggttgtgtcggacttaatgcgctggttaaagcaggctttgacattcaggctgtatttacacacactgatgacccgaatgaaaaccattttttctcttctgttgcacgcattggtgccgatttgggattgcctgtatttgcgccagaaaatgtaaatcatccgctttggattgagcgcatccgtgagatgaagccggatgttatcttttctttttattatcgcaacatgcttagtcaggatcttttatctttagcagaaaaaggtgcgtttaacctgcacggttcattattgccgaaatatcgtggtcgtgctcccgttaactgggcggtgttaaatggtgaaaccgagacaggcgtgacactgcatagaatggtgatgaagccggatgcaggagatatcgttgcacagcaggctgtactgattggtgaaaccgatacttcactggacgtgcatggcaaaatccgtgaggcagccgttgaattactggatagtatcttacctcaaataaaatcaagtcattatttatccatcccacaggacgaaaatcaggccacttattttggtcgtcgtacggctgaagatggcgaaattgattggcataaatctgctaaagagattaataacctggttagggcggtaactgagccatatcctggggcatttacgttccttggcgagcgtaaaattacggtttggcgttcgcgtccactcattcaggttcatgacaaacttccaggaacggtgctttctactactccatttgtcattgcctgtggagaaggtgcactggaaattaccagtggccagggcgaatccggtctttatgttcaaggaagccgactggtgctggaaatgggcattgtgacagatgttcgagtcggctcgaaagcaaccgcacaaattagtcgtcgtaagcgtgtgctgattctgggagttaatggatttatcggcaatcacctgacggaacgtttgttagacgatgaaaagtatgacatctatgggatggatattgggtcttctgccattgagcggtttatcggcaatccccgttttcattttattgaaggagatgtcagtatccatacagaatggattgaatatcacattaaaaaatgtgatgtcattcttccattagtggcgattgcaacacctattgaatatacccgcaatccactccgtgtctttgaactggattttgaagagaatctgaaaattgttcgctattgtgtgaaatacaataaacgcattattttcccgtcaacatctgaagtctatggcatgtgtgacgacaaggaatttgatgaagatacttcgcgcctgattgtcgggccaatcaataaacaacgctggatctattcagtatccaaacagttacttgaccgggttatttgggcatacggtgtaaaagaaggtttgaaattcactttattccgtccatttaactggatggggccaagattggataacctgaattcggcgcgtattggtagctcaagagcgatcactcagttgattttgaatctggtagaaggctcaccgatcaaattggttgatggaggagaacagaaacgttgtttcactgatatcaatgacggaattgaagctctgttcagaatcatcgaaaaccgtgatggactgtgtgacgggcaaattattaatatcggtaacccaaccaacgaggccagcattcgccaactcgctgaaatgttactggagagctttgaaaaacatgaattgcgcggaaatttccctccgtttgccggattcaaaaagatcgaaagcagtagctactatggtcagggctatcaagatgttgaacatcgtaaacccagcatcaagaatgcggagcgtctgctgggatggaaaccaaccattgatatgaaacaaaccattgatgaaacgctagatttcttcttgtgtggggaagttgaagaattaaccagggaagactaaaactgttggaaataatgcgatgaagaaagttggtttgagaattgatgtggatacttatcaaggcacaaaggaaggtgtaccccaattgcttgaaattttgcagcgacaccacattcaggccagctttttcttcagtgtagggccggataacatggggcgccatttgtggcgcctactgcgaccaaaatttctttggaaaatgttgagatcaaatgctgtgtccctttatggtttggatatcttactggcgggtacggcgtggccagggaagaagatcgcaaaaaatttagggtatttgatgaaacaggcagtggatgctggtcatgaaattggtctgcatgcatgggatcatcaaggctggcaagccaaagtagagcgctggtcagaagctgaattagcagagcaggtgcagctaggtattgatgcattgaaaaaagcaacagggcaagcgattacgtgctcggcagttgcaggatggcgggcggatgaacgcgtactgacggttaaacagagatttggttttgattacaatagtgattgtcgtggaacacatccattcaggccactattacctgatggaaccattggcactgtgcaaatccctgtcacattaccgacctatgatgaagttgttggaacacaggtcagcgatgcagatttcaatcgctttatccttgacgcaatgaaaaatgatcttggtgtttctgtttatactattcatacagaagttgagggcatgtcgaagtctccacagtttgaaaccttactgaatatgctccatcagcaagatattcagttttgtaaattaagtcatttactacctgaaaatagagaaacgcttcctattgggaaaattgttcgttcagattttcctggtcgtgaaggctggttaggttgtcaacaaaaggtataacgcaaacatgttgaatagttgggcaagtagagttggagcctttttgatggctcttttttttattcttacttatttattacccctgaatggccgccttttgtggcagccggatgaaactcgatatgctgaaatcagccgggaaatgttacaacgcggagattggattgttccttatttcttcgatatccgctattttgagaaaccggtagcaggttattggtttaataatattagccaatggatttttggagacaacaacttcgccgttcgttttggctcagtgttcagtaccttactcagcgcatttcttctttatctattagcgatgatgatgtggaaaaaccgtcagattgcctttgtttccagtctgatttacatctccatgtttattgttttttctattggctcttatagcgttcttgaccccatgttctctttatgggtcactgcggggattgtcagctgctattgggcacttaaagctggcagtactcgtgagcgaatgctggcatggtctgccttagggctggcttgtggcatggcgtttatgactaaaggctttttagcattagccttgcccgtcatttccatgatacctatcacgatataccagaaacgtttttgggaaatggttcgctttgggccacttgctgttattttcgctattttgattagtttgccgtgggtgattgcgattgccctgcgggaacctgattattggcattattttttctgggtagagcatatacaacgttttgcatcagataaggcacagcatattgcaccgatgtggtattacctgccaatactggtgttgggtgtacttccttggcttggattattgcctggttccttgatgaaaagctggaaagagaaaaaaagccatccagaaatgtttttcttgctttgttggttcatcattccattcgtcttttttagtattgcaaaaggaaaattgccgacttacgttttgccatttatcgggcccttggcactgatgatggcaaaatacagtattgattgtgtcagtaatggcaagatgaaagcgctgaaaataaatgggttggtgaatgttctctttggcattattgcgatattggtgttgctcgttatgcagacactcttaaatcgccccttttatcaacccagcgaatggtcaaaatggctattgggaacggtggcttttggtgcctggggaatcatcggttacctgtgtttcattcataatggtaaacgttggttgtgggcagccgcctgttcattggtactcagtttgtcatttagtagcacattgcccaacaggactatcgattctaaattacctcagaatttcattaggcaaaatgtgcaagaactgactgacagtaaatatattttatctgaggcagtaggcttgggagctgcagtagcatgggaattaaaacgcagtgacatttacatgtttgatcgcacaggcgagttagaatacggtcttgcctatcctgacagccaataccgatatgtagcacaagaaaaattccctgcgtggctggagaaagcgcgtaaagaaggtcaagtagcgattgttttcctattgtcttcaaaaggaggtcttcctgagttgcctaaacctgatcttgtgcgccgtagtgaccgttttgttcttgtgatttataaaaaacaatcatgaccagcaatttagcattattgatattagttagcctgctgacctgtgccggacagctatgccagaaacaagccgtcacctgttggcagaaaacagatacccaccataagggggtatctgtggcgatctggctgacgggtgctattcttttgttggggatagggatgatattctggctgcgactgctgcaatatttgccactgagtattgcatatcccatgcttagtattaattttgtcgtagtaactctggtcgggcaattcctgtatcaggaaaaagtggggctaaaacactggataggcgtttttgcgattatgttcggaattttattgatgagtctaaatcaatgagaggttatctttggggactaacgagtgtgctattgatcactgtggcacaactattgttaaaatggggagctgctcgtttacctgagctttcgttatcaacatattggttggatatagattggatttgggcacatcataatcctttgttgatggttatggcaggattggcaggttatgcattatccatgttatgttggctttttgttctgcaatacctgccattgaataaagcttatccgatgatcagtttgagctacgtttttgtttatttaatggcagctttattgccttggtttaatgaaaccctctcatggttgaaaacggctggagttctttttattttattgggagtctggcttattagccgaccagatgccaaatgatctcattaatggtcgtgattctaatggttagatattgtgataaacttcacctccaaatccgaagagatgcacgataaagtgataggaacgttcattgagcgtaactactctatttcataagaaatctaactattgggttcatgaccgtctgttaggggtaatgttagtgagctaaggccacttcgctatagatagccaaccaccaccttcgggtgattttttgctatatggagggcagacaacaccctccgtaggtaaggtgaatcatttagtcgggtcggtaaactaattgacgtatttgatagtaaagtccgggaatgagtttacgaactgaattttgtaatcaggggatgaatttaccattttccatttacccggcgagttagcggaactggtgacgattttgactttcaggtcaggtgacgagctaacgaccttaaccttatagtccgcaccagagctaacaactttaatgttcccataaattttagacacatcgactttggttttagcacaagcaccaaacgaaagtaatgcggctaacaggatcgctaattttttcatatgaactcctgtgattagcaattagcaaattcattatagatgattcaaataatgacagcccaatagtacaccgggttatttgtttggggaatgaaatggaagagaaaaaaaaaggggcaataaattcaatatattgctcttcatttttataataaaagtgaccagcaacttgtatttgcatctgaattttttgtttgttgtagggattgacaaggacatcacttcacttggcgctgccaaaaaggcaatacaggaaattgcggggtaatcatgcctaatctcaaagatctatccaaccaactggcactgatacgaaaacaaattccgttcgctatggctcaggtactgaccagcgttgcgcatgatgatgtatggcaacgtaagaaatccaaatcgaagaagagtaagcgccgccggtttggtgatgctctgccagtcgagccaatactcagttatcaggaacgggcgcaacaaatggctcaatcgttgatgcctgctgctatcagtcaggcattgagcgaggcgatacaaacagctaaatagtttacgtcacttatttttcggtagataggcagagatatcgcaactttgatgcatacggatttcagcaaaggaaagtaatttagctccttttttgcatcttgaacatggtcaaccagttttttagcattaagttgttgcactatccgacgatttaaatttgacgctctcccgatatacagacattcatgtgtatcagcaaattttcgccagaaggcatagatgccggctgttttaggggtttcttttatgagttcatgactatctttaaattcaatgttattaagattaattacatcgtgccaatctaaattgatagttgctccttaaacttcattatcaatcatgtgaatttccttttaatagttccggcatatcttatacgggaatgagatagaaattgaatcacataaatcttttggatccttcctgagacttttatataacgggagcattgcgcgccgcgttaccgtctgcgcgggggcgtttttctatgctatagtaggctataattgaagttctcctatccgggtccccgaattaatggggtgctgatgggcgtgccgttagtacaaaaacagcctaaaataatcttaaatgcacgaaaatcagcaaaaatagcagttcagtaaattcaatgtgatagtaagcaatggcgggggcttcgcgtgagatttaggtatttatttttatcatttaatctactcttaattggctgtaccaatcctgtttctaaatccaatttacctccattgcggacagcactttctgatccaattatggtcattgctcagttaaaagagcaacttaatcaatggcacggtacgccttatcgatatggtggaatagatcagcgtggtgttgattgctctggctttgtttaccgtacatttcacgatcgttttaatattcaccttccgcgtacaacaaacgaacaaaccaaattaggcacccagattagtaaagatgatttgatgccgggtgatctggtatttttcaagacaggcagtggcgagagtggtttgcatgtaggtatttatgatatcaacgacgagttcattcatgcatcgaccagtaaaggcgttatacgttcttctcttggtaatgtgtattggcgacgtgttttttggcaagcccgcaggatgtaaccccgtctttagccatcaaattcagtagtgctttatgatatcttaacgctctgtttttttgccggagacaaatatgtctacattacgcctgctgttgtctgattcccatgatccttggtttaatcttgcagttgaagaatgtattttccgacagatgtcaccagatcagcgcgtcttgtttttatggcgtaacgccaatacggttgtggtagggcgcgctcagaacccatggaaagagtgcaatacacggagaatggagcaggatggaataaaattggctcggcgcagtagtggtgggggcgctgtttttcatgatttgggtaatacctgttttacctttatggcaggtaagccagaatataataaaactgtttccactcaaatcattctggaaggattaaaaaaagcgggcatccatgcgatggtttctggtcgtaatgacttaattttatcatcccctgaaggtgagcgtaaaatttcaggctcggcgtatcgcgaaaccaaagacagaggttttcatcatggtacgttgttgattaatgcagatttgaaccgccttgccgattatcttaatcctgatcctaaaaaattacaggcgaaaggtataacgtctgttcgttccagagtgacgaatttatcggaattattacctgatatcacacatgaaaaagtgtgtggtggaattaccgaagcattttttgaatatttcggtgaagtagccaagtcagaactcatttcgccgcaggccgtacctgatttaccgggatttactgacgtttttgccaagcagggtagttgggaatggaattttggtcaggcacccgagttcagtcatacattggataaccgtttctgttggggaggaattgaactccatgttgatattgaacacggtactattggtcgttgccagattttcactgatagcctggaacctgcgccattcgagttattggctgaaaagcttgttggtgtactgtatcaaccacaggcagttgggcaagtgattcaacaaatcagagaacaatattccttactggataaagaattacagcagttgtatcactggttggttgacgaattgaaatgagtgaatagccagacatggcatgaaggcaaaaaaatggtcaacaatagggaagttgaccataaaagggtgacacttactataaatatggtttagaaatttggctttgaaacattatttgggctattttttattacactgcgtctttattattcgcaatgtaagaaagtcttaaactcgggtaactgcccacttgccctgaatttagcgggtgttgtattaaaatgcttcttaaatattcgggtaaatgtagcctgagaactaaaaccatattgcaaagcaatatcaagaatcggcaagctatcttcatgcaaagactttgctgcttcatggagacgacgtctacgcacatattgacccagtgtacagcctttcagttccttaaaaattcgctgtaaatgccattttgaatagccacttttatgtgcaatggcatctattttgataccttcagtacgttgaagctggctttctagccatctgacaatatcgttgatgacactttctaacatatttacctcccacataggtgggccttttgctgaaaagataccgataaataaataataacttacgttattttgtgggacattttaagaatttcttttgaatcgtatacgcaaaatgtgcgatttcaatttaatcagcattatgtgttgttcattttttcttttatgaattaatggtgcgcatcagatgtttatttgtttttaagtacagtgatattatagctacgttattaattataaatgaggctgtaatgcaatcgaatttgcttaagcgagtggtattacccataacaggactgttttttgttggttttatcaggacatctgcgggaatacctaacataacgtgtaaattgcggatcatgggtaatgtttgattacgcttacggttcagaacctcataaacacggtcgatttgccaatcgctggttctaagtctttaactgttaggtcgggcaacccgaaagttttccttgaaggagatataagcgctaatattaatataacagctaatttttattggtataatgttgcagatgacttctcttaataataaaataataaaataataaaataataaaataataaaataataaaataataaaataataaaataataaaataataaaataataaaataacctaatgcattgattttaatatatttattattgtgatcggaattgcaatccatctattttacttattacctaccctgcgtaaaagagtaatataaatacattaaaacctcttactcatctgtttatctttgatgtatagcagtaaaaataattctttataatctaaagttgatagaatcacgatagttcgtatgctattagtaactatcatctcagtactccattaacggtgaagcaataacgaatcaaaaatattgacgaaatatttttagtaatttcatcagaaggagcacgtcatgaagattatcaatatattattttgtgcagctttatattgtttgttgatatccccagtccgggcagatgagaaaatggttaatgcagaaaaacaacagattctttctgctgactataatatggaatttaaaaattcctcttcttctgtaaatgatttcatgatagccaaacgaagcaccgactgtatgtatgatagtggtgcagatcagataagggttgagcctggtaaccagcaaagtactcatttacaagacaacgataatttatttagtgcttgtacacttaggcctaaatgggttgagtgggcggtttctagtggctcgacgagttgtgctttgagatttgagcgtgggtttgatggaggatggtatacagtaattaaagggtgtccgaatatagtcaaaagcgcgacttgtggagatgctgactgcaatcagaataacgtttacggaagctcatcgtatatggatataagtgtggaattgcttattcggtaaatttagatgttttttgtgttactccacgaaaaaggaatagccttcccatttaactcattgataatcctaaaatccaccaatggtcaaagttggatatggctgaatgtgtagatcctcgttgtttaggcaaattttgtgaataccaacaaaatttgccttttcaatatggttaccgagattggttattgccggagataaacttgtggctgataggtttcaggatgctgagtaacccctaaatcagcccgataccattgtttaagaatatcatcgcgaagcacatcctgcggggaaccagacgccaccagttttcctttgtgtaacaggataattttgtctgcatagagtgaagccaaatttaaatcatgcagtacacagcaaacagccagagggcgctgacgtgtcaggcgatgtaccagccgtaatgtatgttgctggtggtaaagatccaatgctgatgtgggttcatccagaaatagacaagattctgttggctctggatgccaaagctgtgtcagtactcttgccagttgaacccgctgttgttcccctccagataactgctgataatttcgatgtcttagctcttcacattctgtcagcataatcgcttcatcaatggccgtttttctgtgggtattttcatgtggcacacggcccatggcaatgatttcttccacactgaagggaaaagaaagagaactgtattgccgcataacggcacgaatacgtgcaagttgctgggttggccaacgggagattggaacgccttttaacaggcattcgcctgaattggacggaatatagcctgttaataagcgtaacagcgtagatttcccggccccattggggccaataattgcaacaacttcccctttctgaagggaaagtgaaatatccttgataatctgacgatgcccaatgaaatagtttaaatttctggcttcaagtaaattttccgacattactgattccattataaacggcctcctgatggtttaagaatcaaccataaaaaatagggagcaccgatcaaaccggtgataagtcctactggtatttctgcaggagaaactaatgttctagccagtgtatcagcacttaacagcaggcatgctccgcccagtaccgagattggcagaagccaagtatggtcaccgccaaaccgtagtctgacaaggtgtggaatcaccagaccgataaaaccaatgacaccgctcaaagcgacagcacagccaatcagcagggcactcagcaataataattgatacttagtacgttggacattaataccgagatagtgagcttcttcatcgcctaattgaagcagattgagttttcgtgattgactgaatgccaaaatgcaaacaggaataatgagagacgcggcgataatcagtgttggccattcaatttggctcaatgaacccatcatccaaatcgaaaattggcgcaattgctgatcattactgacatagctcaacacaccgataaacgacatacaaagggcattgatggcaataccggcaagtaataatttggatagattaccgtggttatatttatttaacgaaaatatcaggaatgaaaccagtaaactgccgataaaagccgcaataatatggccatataacgcgatactggcaggtagcgtaaaaggcagaacaatcaccgttgctacggtaagtgcagcaccactactgatccctaataagccaggatcggcaaggggattgcggaacaatccctgcatcacggcaccggacacagccagcgcaccgccaaccaaaatagccagcagaatgcgcggtaagcggatatttaaccaaatctgccactgtgggtcatccaatgaggactcccacagggttttaaaagaaagtggcaatgcccccatattggctgagctgattgctaacaagaatagcaacaagccgagagccatcaagccgaaactgggggagtgggaacgactcattgcactttctccgccgcctcgcggacttgtttcatgacggctggagtttggatgccaaatccaagcagacccatttcatccacaataataacctgttttttcttgcctgccggagtgaaatttaatcccggaagctgccagagtttatccatacctcccagcgttttcagcccctcagtactgactagcagcaaatcaggctggctggcaatgactccttcttgagataggggacgatatcctttaaatccctgcatggcattctgtgcacctatactacggataatctggtctgcggctgtctgttgaccggctgccattggcatgatcccgccgtggctcatgacaaagatcaccttagtgggaatatttgacgtgttgatttcggctaactgttgtcgatattgggagatcagcatttcaccgcttttttcctgattgaccgcctttgcaacggtcaaaattttttcagaaacggcttctaacgaggctttgctggtcactttaataacttttacacctgaattttcgacttgcttaagtgcgagagacggttgcgccgattcacttacaatcaccagtgatgggcgcatggataggatcccttctgaattcagcattcgcatatatcccacatcgggtagtgagagtaatgctttagggttttggctggtgctatcccttgcgacaacattctgcccttcgccaagtgcaaaaacaatttcagacacatcaccaccaattgtgacaatgcgttcagcagagaatgcattgccagagatggcaaacataaatgttagaagccactttttcatactatgcaagtttccttttctgattccagtttaggcagtgcggcaatctgcttacgccaatgtgcctgttcaggcgtaccttcggtacgctggccgtacaattgtgcgatttggttaccttcggcatcaaatagctcaaggctggtgacaaaaccatcagttgttggcttacgtgttacccagctttctacaatagcactttcaatcaggtgcaaagtgaaatcacgattgaaaatgttgacccatttctgaggagaattttcttcctgataaggcatcaaacgttccagtttacccgtgaaaatctggatacaaccacgatttccgacaaaaatcatgatttcattttgatcgttatgcgcggtttcaatgatttgagtcagtgatgaattttcaacacggtaggccagatcattaccgacagcattgaaaatttgctgacggtttaggttatgacggctcatcatcataaaaaattggtgaacattagtcatagcacgccattcttcatccaattgagctttcagttgttctgtgacttctttgtgctcagatactttttcaggttgaatttccagagctggattttcatcggtctgatatttttcgatcaaggcttcccatgcagccatatcggtatctttggttgtgtacactttatgcagagcatcaccttggcggtcaaagaattgaatactgtgacgcaggccatttttggctggttcaaccagagagaaaacgcaggcccaatggtcgaagaatagtcgcagatcaagttctcgtgggttgagaatcaaaccgacatgtgggctgaactgtgtattttcgtaacgacctacctgttcgtgaacggcaaaatcattacgggtaatggctttagtttctccgaccgttgccagctcttgaagcagggcaggagcatcaacgttcaaacgttttgcgtcgataccaacacgactatgcaataattctccttcgctgacattgaggtaagcagcgagatcacgtgcatatttagctttgttatccgctttggcctgtaggtaacgttcataaagtgactgattcacaattgctggctccttaaaaactgtgtttaaaaatagtgtgttaaaaacgtattaaaaaaaccgggtggttgttatctaccactggtagctgatgaacagtttaccgttgcggccatcctgtggggcgcccaatggcgagtaatattctttgtcgaacgcgtttccaagtacgacagaagttgttagcccttttaattttccatcgccgtgataactgacatagaaatcattgattccgtagcctgcgtattgagagagtttctgaccgcgctcatttttatcaccattaatccctctgaactgagtatgttgggtaaatttaccgatccaaccaagggaaaaaccggtgttagatagagggatatctagcatgctgctcaaagtatcgggactgaggtcggcgatagattctcctgtttcttcgttttttcccattgttcggttgtaagcgagattccatgagaaccaatttgattcataactcattgaagcatcccagccccaaattttggttttagggatattgattgacgttgtagatctcatatccggcattgtcacgatggaagtgatgtaatccttcgcttgagtgtcaaaataactgactttgaatttcaactcatcgttactggagaataaatcatcgaaacgcagtccaaagccagattccagagtttcattgctttctggacgcaggttaggattaggtttccagtaattagtgaatcccggctttcctctcattgctggcatgtggaagtgcttagaatcgttatacatttcacccatggttggagcacgaaatgcctgagaataggaagtgaataacattgaccaaggagttggcgtaatgctgacagcgccttttgatgaccatttattggcactgatatcgtcatatttagcatttgaagcgttgtaattgtcgtaacgtgtaccgacgatgaatgaaacaggcaaatcacgcagggttatttcatcttgaacccaaccggatgcaaaacggatatcggcatcagggaaactttctgtattgccgtttggcttctgtttctgtttgtaagcctcgccaccgtacgtgaattgatgaactgaaaaagtgtttgcacccagatgtgaacggttctctaatttaacgccgtaagtttcttgtttgcgaccttcaaaacctttctctttggtttttgcattaatagtgacgtccgagtaatagatatccgctttggtattcagccagttgtactcagccggattgagtcgataagtcagttgtgcatcatgttgtgtcgtggtgcgatctgctctcgggttatcgtttttagcattatctgtgatagcttgtgggtttttaggctcatgggactgattgcggtaatagcgaagttcgctactgagtgattggctatcattgatattccatttcccttttgccagcatattaccaatggtttcgtcattatgaccgattaggctgttaccatagcgaatattgccaacatcacggctactgaatgcaaataacccatcgagttgctctgtcttaccaaatgcagcaccaccaaatcccaggctatgatcacctgttgctgcgcgactgaaaacacgaaagccagtattttttccctcttgcaataaatcggctgcatcaactgtctgataggcaataacgcctcccagtgcaccactgccataaagtagggcggatggaccacgaacgacttcgacctgtttaatcaagcttggatcgagaaataaaccattgagatgcccagtatcggtgccctgacgaataccatcaacaagcgttaaaacaccttttttagaataaccgcgcatactgatgtcttgtccattggtgcgcccagaaccagaaacgttaataccaggaaggttacgcagtaaatcatgggcattgcctgccactctattgttggctgagtttccttcaatgactgttaccatcataggcgcttcaaaactatcgcgctcattgccagtcgcgtaaacagtcaaagtatctttggatgatttattttcttcagcaaggattgttgttgcatgagcagaagataacccagtcaaaatgaccacacttaatgatgataattttaggtttggtaatttaattgggttcatacaggttaatctccataatttaacggtgttttgtgcataaaaataacccatcaccacgatattgatcaggcgagtttgctggggttttatttgttcgaataaagctacgagttttggtctggcgtaatggcataagccattttgccgattaatttttatggtacgtgattatcccaataatttctgactgtcggcacaccagtacaatcgttttttacgggatcactgaatagttcaagaagaatctgctgttgcaggagatttgcgtggtagtactggtaataagctaattttcccatggtcaaatcttaataataactattctaatatcgagaataattatcgtttcaaatttgactaacttcaagttatttttttaaagcttgcggtgataatttaatctattgatttatattaatatttttgaattttatctggctcttgcaagaaacaggagtcagataaaagaggtattcaagtacgatctttgaccgctctggacagaatattgataaactgttcggtatcttgccagctaagacagggatcagtaatggactgcccgtaggttaaaggttctccatgtactactttttgagtaccttctatcaagaaactttcagccatgacacccgcaatagatgttgaacccgattgaatttgctggccgatatctttcgcgatatctagctggcggcgatggatcttttgacagttaccgtggctacaatccacaatcaggcgttcagttaattgatattcatgtaatttctggcaggcggcagcaatatcttctgctttgtaattaggctttttaccgccccgcataatgatatgcccatggggatttccgttggtctggtaaatagtcatccgcccatctttgtcaggagacaagaacatatgtttggcacgtgctgcgcgtatcgcatcgatagcgatatgcgtatttccgtctgtcccatttttaaatccaacggggcatgacagagcagatgccatttcccgatgaatttggctttctgtcgttctggctccgatggcaccccagctaattaaatcggcaatatattgccctgtgaccatatccaaaaattcagtggccgttggcatacccagttcattaatatcatttaatagcttacgggcgagagagattcccttattaacctgacaggagccatctaacaaaggatctgaaattaaccctttccagccaataacagtacggggtttctcgaaataggttctcattactatttccagactgtgctggtatttttcacgtaatacttgcaggcgggcggcataatcaagagccgcatcaacatcgtgtattgaacaagggccaataatgaccagtaaacgcgggtcattgcctgtaagaatggattcaattcgcttacgtgacaatgtcacattttgccggattttttctgatataggatattgttcagcaagtgctttgggtgtaatcaaacgaccaatggaacgggttcttaattcatctgttttgtgcatatattttctcgaattctacttcacattaaagcagtgtctgtaatgattgaaatcacaataactcaacacccggtaaattcaacaagtaataatgacatttgcccgagaaagtatcgtgcaaagatattgtgaaaaaagtaccgtagaaaatgctggaggtttcgggatcagaacatgcggcgtttcaatcccatactgtcaataattttggttgaaatttcttcgacagaataattggtggtatttaaatagttaattttattcttacgaaacaatgcttcaacttcagcaagttctaatcggcattgtcgcaatgaggcataacgactattttcacgtctttcttctcgaatagcagcaagtctttctgggctgatggtcaggccgaataatttatgttgaaagggttttaaggcagcaggtaattgtagattgtccatatcgtctgcggtgaaaggataatttgctgcctgaataccgaattgcatggcaagatagaggctggtaggggttttaccgcagcgggatacgcccagaataatcacttgagcctgttcaagattacgtaatgaaacgccatcatcgtgagcgagagcataatcaatggctgcaatacgagcatcatattgccccagattctttttggataaaccgtgggtacggtgtaattctggcttgggttccagcccgatttcctgttgcagtggagccaccagtgtctggacaatatcctgacagaaaccgtcactgcttgtgatgatacttttgacttcatccgaaataatggaataaaaaaccagtggcttaagctgtgtttcttgatatatcgcgtttatctgagttttgatttcttctgctctcattttactgtttacaaaaggcagagtataagaagtgactgtaatcggaaattgggacaatacggcatgtccaagtacttcagctgtaattgccgtaccatcggaaataaaaaacacactgcgttccagagtttcattttcctgtgttttggaggtatggttttctgtcattgtatctttcttttattgttaggttgacggtgtattatcgaatttgtgaagttgttggctgaatcgtttttatcacaaactagaactatagataacattcccgattatacccgcaaaaaaataatattgctgggttgatcgattcacctttccatatatgacaaaacaatgtgctaggctattttacgctgtaaagaacagccttaattttccgatttgtacttccgaatgtaaaaaggatagtttcaatgtccaacaatggcctcaccccatgcaatgtgctctggtataaccaattaggcatgaatgatgttaatcgagtcggtggtaaaaacgcctctcttggtgagatgatcaccaatctggctgaacttggtgtgtctgtccccaatggttttgctacgaccgcacaggcatttaatgattttctggaacaaagcggcgtcaaccagcgtatttatcagttgctggatgaaaccaatgttgatgatgttaatcaattggccaaggctggcgcacagattcgtcggtgggtgattgatacgccatttacggcacagctggaaaacgatatccaagatgcctacctgcaattgtctgaaggtgagcccggtgcctcttttgctgtgcgatcttccgccacagcagaagacatgccagatgcctcttttgcaggacaacaggaaactttcttgaatgtgcagggcattgatgccgttatggttgccatcaagcatgtctttgcgtcactttttaacgatcgggccatttcttatcgtgtccatcagggatatgaccatcgcggtgtcgcgctctctgcgggagtacaacgcatggtacgctctgatttagcatcgtctggtgtgatgtttacgattgatactgaatctggttttgatcaagttgtgttcattacgtctgcttatggcctcggtgagatggtcgtgcagggagcagtgaatcctgatgaattttatgtccataaacccacactgcaaaacaatcgccctgcgatagtgcgtcgtaatttgggatcaaagagaatacgcatggtttatgcggacagtaaagagcatggaaagcaggtacgtacagaagatctgtcagatgtgctacgcaatcgtttctctttgacggatgacgaagtagaagcgctggccagacaagcgctgttgattgaaaaacattatggccgtccaatggacattgaatgggcgaaagatggaaataatggcaagttatatattgtacaagctcgccctgaaaccgttcgatcaaatcaacaggtgatggagcgctatcaactcaacacacagggttcggtattggtagaaggtcgtgctatcggacatcgtatcggtgctggtacggttaaggtcattcataaccttagtgagatggatcgtattcaggctggtgatgtgttggttactgatatgactgatccagattgggaaccgataatgaaaaaagcggctgcgattgtcaccaatcgtggagggcgtacctgccacgcagctattattgcccgtgaactgggtattcctgctgtggtaggttgtggtgatgctactgaacgcttgaaggaaggacaagaagtaacgatttcctgtgctgaaggggataccggtttcgtttaccaaaataaattggattttagcatccaaagctcccaagttgatgaattgccaaaactggatgttaaaatcatgatgaacgtgggtaatcctgatcgtgcatttgattttgcctgcttgccaaatgaaggtgttggtctggctcgtctggaattcatcattaaccgaatgattggtgttcatccccgtgctttgctcgaattttcccaacagacacccgaattgcaagagcaaattaacgcgttgatggtcggctatgacgatccggttgaattttatattggacggttaacggaaggcgttgcgacactggcagccgcattttggccgaagcgtgtgattgttcgtttgtctgatttcaaatccaatgaatatgcaaatttagtgggtggggaacgatacgaaccgaatgaagaaaaccctatgttaggtttccgcggggctggtcgctatgtttctgacagtttccgcgcatgttttgcactggagtgtgaagccatcaagcgggtgcggaatgttatggggttaactaatgttgaagtgatggtcccgtttgtacgcacggtagcacaagcagaagctgttgtggcagaattggctgcgcagggcttgaaacgtggtgaaaatgggttgaaagtcatcatgatgtgtgagattccatcgaatgcattattggcagaacaatttctcgaacattttgacggtttttcaattggctcaaatgatatgactcagctagcactgggattggatcgtgattctggtgtggtgtctgagttatttgatgagcgtaatgatgccgtaaaacaattactttctatggcaattcaagcggctaagcgtcaaggtaagtatgtcggtatctgtggacaaggtccttcggatcacgaggattttgctgagtggttagtgaaagaaggcattgacagtttatcgttgaatccagataccgtggtaaaaacctggatttcgttggctgaaaacaattaatagaaaataatttaagcctgaattaaaaagcctgttggaatatttacaggcttttttgttttgtgtagcacaatctttttttgacatggatgaataatataattgaggaatcacagtaaaaactccaaaaaaaaaagcctatcatgggctgacaggcaaagactacacacagcaatatttattacgtcactcgctccagcttttggcgtgtataggctggaacagtaattcttaggaaacgtttgtttcgatgaaaagaatactaatttaataaatgagtttattcattaagaatcctcttaataaataggagccggaaaagaaaaacgagggatataacttttttgcaacaaattacatggtttttttattaacattttggtatgaatttatatttatgatagaactgtgggtttgtattcatcaatatgataattgcgcgaaaaaataatattttcgcgcagctgtttaattattctatatgatctttttggaagtatttttcagtgtcttctgtcttattttcaggtttaggaacttcattcatccatgccagcagtaagcgataagagacagccaatacaacggggccaataaatagcccaatcaaacccagtgaaagtatgccaccgattacacctgtgagtattaaaaccatgggcaaatctgccccaagtcgaataaggaaagggcgaagaacgccatccattgtggtcaagaccaggctccagataactagaacagttccccaagttgtttcacctgtccaataaagccacgcgatagacggaacgagcaccaatagaggccccagctgggcaacacagcatataaacattaatacagtcagtatcattgcatagggaatgcctgcaattgctaatccaattccaccggcgattgcttgtaccagtgccgtgacaaccacaccaagagcaaccgcacgaatagactgggcagccagcagtacgactgcatcaccacgttggtctgccagccggatggcaaaatgacggatacttaacatgacctgttcacctttccaataaagcagaacactgaacagcaccatgagtacaagatggaacaagaaacggccagcgttggctgcttgggtaaaaaaccatgttgccgttttaccaatatagggtggaattttggtgagaagaatgttgcttccatcagcaaccgtgtcctgccatttaacatataaatcttcacctatgaccgggatccggctgagccattctagttgaggtaattgaaacgtcgagggggattttgcccattcaatcaatggagtgctgttttccagcaaactactaaccaataatgcaattgggataacaaataataaaactagcagcaatgtcataatagaaacggcaatccagcgttttccccatagatgttgttgtaatttttctaataatggccaagttgcaataacgaccattccggaccaaatgaaccccaggacaaatggacttaaaacccaaaagcaggtcgcaatgagcagtagaataaagaacagcacaaatagcagcttgggtaaatcctggcgtgattgcgatttttccatgaaattatttctcttttgcaattgaaagtactgttggcagtaacgatagtaagtaaatataacgttatttcacagattgctcaaaattgataaagattgtgatatcgttgaaagcttgcctactcagaaagctgtctgagtcacctgatccaagatagtatataaatgaagcaatgtggacactaattagagaaggggcacaagccaatgatcccacgtataccacaagccccccatgtcagtgaactggcacaggaatatttgactgcactgaaggaagttggttttacaggcgatactgtcagcagttatgccgatagattgactatggcgacggataacagtatttatcaattattgccacaagcagttatctttccgcgctctagtgctgatgttgctctgctggcgagagttgctggagaagaacgtttttattccctgacatttactcctcgcgggggaggaacgggtaccaacggacaatcacttaataatggtattgtggtggatatgtcccgttatatgaaccgtattcttgagatcaacccagaacaagggtgggttaaagtcgaagccggtgtcataaaagatcaactcaatcaatatctaaaacctttcggttattttttctctcccgaattatcaaccagtaaccgtgctacgttaggcggtatgattaatactgatgcttctggtcagggatcactggtttatggcaaaacttctgatcatgtacttggtgtccgcgccgttttattgggtggggaaatgtttgatacccgtcctatgagtacgttattcgcggaatcgattgctcaagaagaatctgtcattggacagatctataaaacggtgcttgaacgttgccgtgagcaacggaagttaatcgtcgaaaaattcccgaagctcaatcgttttctgaccggatatgatttgcgtcatgtttacagtgatgatatgcaaacatttgacttgacccgaattttgactggttctgaaggaacattggcttttattacggaagcaacactggatattacgccactgccaaaagtcaggcggttggtgaatgccaaatatgattcctttgattcagccctgcgcaatgctcctttcatggtggaagccaaagcgctttcggttgagactgtggattccacagtgctcaatttggcacgtgaagatattatttggcactcagtaaaggaattgattacggatgtagctgataaagatatgcaggggctgaatattgtcgaattcagtggcaatgatgaacagcaaattgaccagcaggtttatgatctttgtcagcgccttgatgaattgatggaggaaaaccagaccggcatcattggttatcaaatttgccatcatttagtggatattgagcgtatttatgccatgaggaaaaagtctgttgggttactcggtaatagcaaagggaacgccaaaccgatcccgtttgtcgaagatacctgtgtacctcctcagcatcttgccgattttatcactgaattccgtcagctcctcgatagccatcagcttaactatggtatgtttgggcatgtcgatgcgggtgtcttacatgttcggcctgcgttggatatgtgtgatccacaacaggaaatcttgatgaagcagatttccgatgaaattgttcgtctgacagccaaatatggcggcctgctatggggagaacatggcaaaggttttcgggcggaatacagtccagacttttttggcgatattttgtatgacgaattgcgtcggataaaagcggcatttgatccgctgaatcgtcttaatccgggaaagatctgctcaccgattgacactgacgccccaatgatgaaggtagatgcggccaagcgcggaacttatgaccgtactattcctgttaatgtcagaacggcatttcgtggagccatggaatgtaatggcaatggactatgcttcaatttcgatgtcaaaagcccaatgtgtccttcaatgaaggtaagtcaacatcgcattcactcacccaaaggcagggcgacgcttgtcagagaatggttgcggcttctgactgaacagggggtgaaccctaagttgttggagcaggggcttgatcaagcgcatcctagcctgcgggggttaattgacaagacgcgctatagctggcaggcctggcggggtgaatatgatttctcgcatgaagtgaaagaggctatgtcaggctgtctggcctgtaaagcctgttcgacacagtgcccaattaagattgatgtaccttcatttcgttcgagttttctgtcgctttatcacagccgttatctgcgtccgctgcgtgatcatattgttgccaatgttgaaagcagtactccgttgatggcaaaggtgcctcaagtatttaacttttttttgaaacaaccgtgggtacagaaaatcagccagcacaccattggtatggttgatctgccgctactttcctatccaacactgcaacagcagctttcaggccactatgccgcaagaacgacactggaacagctcgaaacactgtcacaatctcaacgtaagcagcatgtgcttatcgtccaagatcctttcacgagttaccacgatgcaaaagttgtcgctgattttgtgcgattgaccgaaaaactaggatatcaacctgtgctattaccgttctcacctaatggaaaagcacaacatgttaaaggattcttgactaaatttgccaagactgctgagaagacagccagttttcttaatcgaatagcttgcctgaatattcctatggtgggaattgatcctgcgctggtgctgtgttaccgagatgaatacaaagatattcttggtgagcgacggggtaactttagcgtccaattggtacatgaatggctcatggatattctgccagagacaccagcacaagagaaacgtgacgattcaacatccagctatgactggtatttactggggcattgtacagaagtgacagcgttacccaacagcggtaagcaatggacggatattttccgtcattttggctgtcaattgaataatgtcagcgtgggatgctgtggtatggccggtacatatggtcatgaaaaaaagaatattgataactcgatcggtatctataaactttcatgggctccggcgctgggcaatcttggtctggaacgttgtctcagcactggctattcatgccgtagtcaggtgaaacgcatggaaggacaaacagttaaacatccattacaagccttattggagataataccgtgatttggaaacgtactacagatgtgaacgcgcttaatcaatttaatcgcgagtgcatgctaggacatataggaatagaaattacccagattggtgaagattttattgaaggaacaatgcctgtcgatcagcgcactaaacagccgtttggtctcttacatggtggggcatctgtggtgctggctgaatcgctcggttctcttgcagggtatctctgtttagagggtgagcagaaagttgtgggagtagagatcaatgccaaccatatcaaagcggtgagtaaaggtgctgttaaaggtgtttgtaaacctgttcatcttgggcgctctcaccaagtctggcagattgacatctataatgaacggcaacagttatgctgcacatctcgcctgacaaccgcagtcttgtcgtagattcttatcttatgacacccgttcatgagtt

SEQ ID NO: 14951 - DNA, 25080 bp, Xenorhabdus bovienii
  unsure (1)..(25080): unsure at all n locations
  Genomic contig Name=Xb4151_4152.C410
cgaatttaatacagttcttccattgcatggtggtctattactcaataacatcgctgataattgttatccactcttactgctgttgaggttttttatgtctactgttttacgccaatacttaaatctctatccacaggttggtcaaagagtcatgttagattcttcttctattgtgattggagatgtcagattagcgaatgatgtaagtatttggccccttgtggttatccgtggtgatgtaaattatgtttcaattggtgcacgtacaaatattcaggatggttccgttttgcatgttactcataaatcacctgataatcccgctggcttcccattgataataggagaagaggtcactgttggtcataaaacgatgctgcatggctgtaagattggaaaccgagtactggttggcataggttctattctacttgatggcgctattattgaagatgatgttgttattggggcgggaactcttgtccctccaggaaagaaattagaaagcggatatctgtatataggcagccccgccaaacaagtgagaaaactcaaacctgaagaactggaagggctactttattccgctaataactacacctactggaaagataattatttagcagacacgtcagagggcaaggagtaacgcccaaattgatcatcatgcccactcaagatggcggcttcaaatttctcttctagatcccagcgatgtcggtgaaataagtccagtgggtgatgatctttaccataacgttcagctagctcatcggaactaatcatacattgtaccaataacccatcgaccatagctgggaaaatcactttgctttccatctcattccattcttcacgatcaggaaattgaatagcttgattcatgcgtgtaactctcgcctcaaagcggttaaaactgattctatttcagggaatactccatgccacaattcaaaagcattcgcagcttgccacaccaacattcctaatccatcagccaaacgtgaaataccattttgccgggcaaaatcaaggaatggagttaatccgtgttggtaatacatatcgtaacaagcaatatcattgcaaaaaatcagcggtgatacctcaggaatctgcccatcaataccagaagcagtcgcattgatgatgatatcgaaatctggggaaagaagggattccatttcaattggctgaatatcgcccaattgggaaaatttatctgcaattatctgcgcacgcgcgaatgtacggttcgtgatagtgacggcacatcctagttctaataaaggagataacactccttttgctgcaccaccagccccaataatcagaatatgccggcccttagtaatgaaacctaaccgctgtaaatctgccagtaacccgaccccatcagtattatcaccaaggagacgattaccttcaatcaattttaatgtgttaaccgcaccactaattcttgctcgctcagtcaattcatctgagcgctgataagccctttctttaaaaggtacagtaatattcgctcctagaccgccccgttcaaaaaaacgatccaaagtttgttcaaaatgttctatcggagcaagcacccgcccatatagatgatcaatccccgtctgatcagcaaataatcgatgaatgtaaggagatttactgtgtgcaatagggttaccaaaaaccgcaaatttatccattattccctacccttgtcgatataatttgccggttaaggcatctctgatttctgatggatttttacgtccccctacttctccttccaaaacaggaactcggtttccaaattgttgacgaacttcttccgcactccgacatggctctagtccgcttaaatttgcacttgtcgatacaagggctttcccataaaaagagcataattgtttaaccagaggatgatctgtgacccgaaccgccagtgttgaaaattgccctgttaaccattttggtgtcgtcgttttcgctggtattacccatgtcacgggaccaggccaaaatgaaaatactgtttctttctgtatatcattaagttgctcatcatcaatataaaggcataacctttcatagctatcagcaatgagaattagccctttttcccacggtcgatttttcagcgataataattcgttcactgctttctcgctgtcaggatcacaacccaatccaaaaacggcctctgtcggataagcaatcactttttcttcttttaacgcagtgataatcacatcaaatgcaggtgagactttgttactcattatatttctcaatttcattgatttgcggcttgctacacagtttactggcacaaaacaactttacgccttgagccgttctcttttctattaacaatgggtaatggcagaaaagacattctccggataccggcttattgttaagtacaaactgacactctgggtatcggttgcaggcatgaaatgttttaccaaaacgtgacttacgctggaataattttccttgttgacattgggggcaattaatcgatgtgtcatcgggtttatcgatcaattctgtgtgttcacattcaggataatgactgcaaccaatgaacatgccataacgtccttgtcgcaaaaccagagtaaagccacacttcgggcaaacttgcccatccaattctttaacaatatgtccatctccttgagtctttagaggacgaacgtaatggcatgatggatagctggaacacgcataaaataaaccatgagttccattacggatcactaattcagcgccacactcagggcaatgttctgtttcttttatctcaaagggaactttcttagacatatctcactcgttgaatcacagccacaataatgttggaaaaagtataaattaaacagatcaatttacccgaatatagccaccagcaacaacggcgacttttcccatgagttccagctccaaaagtctagtcatgacttctgtgacaggaagacaagagcgttgagcaatcacatcaactggagtaacttcgtgacttacgttaaccagcacatcagcaaatggcaactctatttggtcaacttgcacgcgttcttctttttctatattcaaccatcgaaacgcgccattaatatgttccattatatccgttggattcactgccaaataagccccctgctttatcaaccaatgattgccctcacttgaaggagtgcctaatgcaccaggtaatgcaaaaatatctcgcccctgttcaagcgcacaacgcgctgtaatcaacgaaccactcttttcataagcttctacaataagaagagcgagactcaagccactaatgatccgattgcgccttggaaaatttttagctttaggtggcatttcagggaaaaactcagaaactaatgcaccattttcttcaataaaccgcgccagagagtcatgccgatagggataaattttttcaagcccactgccaagtacagcaatggtttttccgccagcactaagcgctgcctgatggcaaatcccatcaataccgattgccaacccactggttatcacaactccatttttcgctaattcaccagcaaagattttcccccatttctcaccataaaaacttgctgacctactacccaccattgccacctgcttttgggataacacagttacatcccctgacacaaaaagcataagtggaggagagtgtatctgttttaataaaggtgggtatgcgggatgagagaaggtcaacaaatggttgcccggccgctccaaccacgtaaagcaaatagccagctcagtagagttagccttagtaaactgtaaacactgtgtgggagacaaaccacacgccttaagttcattattactatagttttgagttctcaatagatgttctataatagacacagctttaatcgttgaaagatgggaaaccatcttcattcgcaaccatatttccatctctttcataatgtcatcctgacctgattgataacttgactggccttgattaatttatggtcgatactgtcaatctaaataggaaatgtctagaataggcacaaattatcactcacttcttggatacagatctaaacatatatgtcagttttacaagtattacattacccagacgagcgacttcgcacaattgcaaagccagttgaaaaagtcgatgcaggaattcagagcatcattgatgatatgttcgaaacaatgtatgcagaagaaggtatcggtttagctgcaacacaagtcgatattcatcagcgaattatagtcattgatgtctctgagaatcgtgatcaacgccttgtcctcatcaaccccgaattgatgaatgaagttggtgcaacaggaattgaggaaggatgtttatctgtccctgaacaacgcgcatttgtaccacgttttgagcaagtaaaaattaaagctttagattatcacgggcagcagtttgagttggaagctgacgacctgctagcaatctgtattcaacatgaaatggatcatctggtaggtaaactttttatcgattatctgtcaccattgaaacgccagcgtattcgccagaaagttgaaaaaattgaccgtctgagagctaaagaaaaataaactttatcattacaggaaataacagtgtctgattctttacgtattatttttgccggaaatcctgatttcgcggttcaccatttggctgctttattaaaatctcaacatcaagttgtcggagttctcacccgaccagacaaaccggcaggaagaggtaaaaaactgacaccaagtcctgtaaaagcattggctgaagaacatagtatttctgttttccagccaaaaaccttacgcacagaagaaagccagcaatggatcatgcatcagcaggcagatattatgatcgttgttgcgtatggcctgattctgcctcaagccgttctggacataccacgcttaggatgcctgaatgtccatggttctttgttaccacgctggcgtggcgccgctccgattcagcgtgcaatctgggcgggagatcaagaaactggcataacaattatgcaaatggatgctggtcttgataccggtaatatgctactaaaagcagcttgcccaattacaaatcaagataccagctccagcctgtatgaaaaacttgccaatattggtcctgatgcattacttaacacattagatctgataatattaggaaattgccaaccaagcattcaggatggtactttagcaacttacgctgaaaaactcagtaaagatgaagccaaaatggactggcatttacctgccattcagcttgaacgttgtgtccgctcatttaacccatggccgatgagcttctttctcattgatgaataccccattaaggtatggcacgctgaagccattgctgaacaaactactcactcccctggaaccatcattaaggcagataagaaaggtattcaaattgcaacctctgatggaatattaaatatcacacaattgcaagcatcaggtaagaaagcaatgccagccgccgatttcttaaactcaaaacgtgattggtttacaccgggtaacaaaatcaaatgaaattaatttgcctgtatactctgagcatacgggcgtcttcctttttataatgctgacaaccgtcagctttttttgaccatatcatgaaaaatacatataacctgcgaaacatcgccgcaaaagcgatccatcaagtactggaacaagggcagtcactcagcactgttattcctgaactccaacaaagagtttctgacaaagataaagctcttctccaagaactctgttttggcgtaataagggtattacctcaactagaatggttcattggtcagttgatggcaaagccattgaaaggcaaacaacgcatttttcactatctaatcatggttggaatctatcagctcacttatactcgtatacctgcacatgcagcgcttgccgaaaccgtcaatggcgcgatcagtttaaaacgtccgcaattaaaaggcttaattaatggcgttctccgccaatttcagcgccaacaacagacattagtcgagcaagttaataatgtcagctgccatttacatcccaaatggctgttagatcatattcaaaaagcctatccacaggactggcaaaagattattgacgcaaataatcaaaaacctcccatgtggttacgagttaatcagcgctatcatagtgctaatcaatatctagctctgttgcaagaagctaatatagacgcagagctagatgaaaatcatcccagcgctattcgcttgctaaatccttgccctgttaacactctacccggattcgatcaaggatgggtgactattcaagatcgctctgctcaagggtgtgctgaattattaacgccatgtgacggagaatctatactggatctgtgtgctgcccctggaggaaaaaccacccatatccttgagatagcgccaaagtcaaaagtacttgccgtcgatattgatgaacagagaattaaacgagtgaaagaaaatttacagcgccttaatttgcatgctgtcgtcaaaacaggtgatggacgttttccacatgaatgggcaacaggggaacagttcgatcgcattcttcttgatgcaccatgctcagcaacaggtgttattcgtcgtcaccctgacataaaatggctgcgtcgaaatgaagatattgaccaattggttacgctacaaactgaaatccttgatgccatttggccatatttaaagaaacatggcactctggtttatgcaacctgctccattttacctcatgaaaatagccaacaaataaaagcattcttaggacgccacacagatgctgcattatcagatacaggcacgcttgacaaaccagggatacaaattattcctgaaacaacaggtggtgacggcttcttttatgcccgactaactaagtattgacgtatcttcctcgtcaaaatatcggatcagcagggattttgtgactttactaaaatatcaaaaaataggaatacagcttctaacacgaagagaatactatgaaaataattattctgggtgctggtcaggttggtggaacattagctgaaaatttggttgatgaaaataatgatattactgtcgttgataccgatactgatcgcttacgccagttacaggacaaattcgatctacgggttgtaaatggtcacggctcccaccccagagtattgagggaagcaggtgcagaagatgccgatatgttggtagccgtcacaaattcagatgaaaccaacatgattgcgtgccagatcgcttactccttatttaatacccccaataaagtcgctcggatacgttcatcagaatatatctatgaatcagagaaattatttcaacccaatgatatccctattgattatctgatatctcctgagcaattggttattgattacatctataaattaattcaataccccggagcattacaagttgtcaattttgcggaaggccgtgtcagtatcgtcgcggtcaaagcctactatgggggttcactagtgggtaatgcattatcctcgcttcgagagcatatgccacatatcgatagcaaagttgctgcaatatttcgtcaagaccgcccgatcaggccacaaggctccacaattattgaagcgggagatgaagtattttttgttgccgcatcacaacatatcagagcggtgatgagtgaattacaacgccttgaaaaaccatataaacgtctcatgattgttggaggtgggaacgtcggtgcaggtttagcgctgcgacttgagaaagattacagcgtcaagctgattgaacataatcaagaaagagctacaaagctagcagagctcttgcacgatactatcgttttctacggtgatgcctctgatcaagagcttctgtcagaagaacatattgaacaagtcgatgttttcattgcattaactaacgatgacgaagccaacattatgtcagccatgcttgcaaaacgaatgggagccaaaaaagcgatggttcttattcaacgcagtgcatatgttgatttagtacaaggtggtgttattgatatcgccatctcacctcagcaagctaccatttctgcattacttggccatgtccgtaaagcagatatcgtcagtgtatcttcattaagaaggggagtagccgaagctattgaagccatagcacatggtgacgagcatacttccaaagtagttggacgcaagattggtgatattagactaccaccaggcacgataattggcgcaattgtccgcggtgaagaagtaatcattgccaatgattacagcatcatccaacaaggcgaccatgtaatcatgtttattaccgataaaaaatttgttcctgaagtggaaaaactattccagccgagcccttttttcctgtaagaaacacctgctttgctaaatcagataatacttcccgctcaataaattagaaggccaatgataacaacttgaaaaaattatcatcattggcctcccaaccactacttttgccatgtttttctttacgactataacttcctttaccctttttgtttgcttctactctctgcctaaataaagggtcgtgcaacagtgcctctatagcattatctttgatgacgccttttttatggcggtatgtcgtcataatgtcctctaatgacattcaattggttaatgattgagcaatcatactctcagcacccgaaataataaagaaaaattatttattagttgctccttcttccaaaatttccaatatggaacaatatgtgctggtatgcgcactaccacaacatgcatcactcaacatttttaaagaattgcgcattttttgcatttccaataatttatcttcgacctcctgtaatctagaatcaacaatttgtttcgattcttgacatgtatgatgctcaggatcaacacgaatagacagtaactctacaatcgcttccagtgtaaaacccgattgttttgcataacgaataaaacgtaatcgttgtaaatcctgttcggtataaagtctataaccgccttctgttctttcctcatgagccatcaaaccttgtttttcataaaaacgaatagtatcaggcgtgacactcgctaatttagccaactgaccaatgcgatacatagtgaatcacctaacaaataggaaataagttcaatactatcagaataggttaagagagcaccagcacaggtgaaatttgcagattaacttgtagaaaacaagatagataattattggaaggaaaaataaagagcaataaaaaaccgggtgttatcccggttttttatgcttctacagattactctgcagatgctgcttctgtctgagactcaacggtgcggtcaacaagctcgatgtatgccatcggagcattgtcaccagcacggaagccacacttcaggatacgagtgtaaccacctgcacggctcgcaaaacgcggacccagttcattaaacagttttgccacgatttcgttatcacgagtacgggcgaatgccagacgacgattagctacgctgtcggtcttggcaagagtaatcagcggctcaacgacgcgacgcagttctttcgctttaggcagagtcgtcttgatgatctcatgacgaaccaaagaacctgccatgttgcggaacatagcttggcgatggctgctgttgcggttcaattgacgaccactcttacgatggcgcatgaccttatccttctcagtaaaaccttaacctgtgatcaagttattcatcagcaatacttgctggtggccagttttccagacgcatgcccagagaaagtccacgcgaagccagtacgtctttaatctcagtaagagattttttacccagattaggtgtcttaagtaactcaacctcggtacgctgtaccagatcaccgatgtagtggatagcttctgccttaaggcagttagcagagcggacagtcaattccagatcgtcaacagggcgcagcaggatcggatcaaactctggcttctcttctttaacttctggttgacgtacatcacgtaaatcaacaaaagcttccagttgttcggccagaatggtagctgcacggcgaatcgcctcttcaggatcgattgtgccgttagtctccatttcgataaccagcttatccaagtcagtacgctgttctacacgagctgcttcaacattgtaggcaatacgctctactgggctatagcaagcatctactaacaaacgaccgatagggcgctcatcttcttccgaatgaattcgggcagaagccggcacataaccacgaccgcgctgaactttaatacgcatgctaatggaagcacttccgtcagtcagatggcagattacgtgctgcggcttgacgatttcaacatcaccatcatggatgatgtcggctgcagtcacagggccaatgccagatttattcaaggtaaggataacttcatctttaccctgaactttcaccgctagccctttcagattgaggagaatctccaggatatcttcctgtacgccttctttggtgctgtactcatgcagtacaccatcaatctcaacctcagtcaccgcacaacccggcatagacgaaagcagaatacggcgcagtgcgttgccaagagtatggccaaagccacgctctaatggctcaagggtcaccttggcgtgcgtcgaactgacttgctcgatatctaccaggcgcggttttagaaactctgtcacagaaccctgcattgtgtcctctctttggtgctaagctttacttagagtaaagctcgacgatcaggtgttcgttaatgtcagcggatagatcagtacgttcaggaatacgtttgaacacaccttccatcttcgcagcatcaacttccaaccaagttggtttctcacgctgctcagccagctctaaagctgccttaatacgagcctgcttcttcgctttttcacgaacgctgactacgtcattcggggatacctgataagaagcgatattgacaacgcaaccatttaccatgatagccttatggctcaccatctgacgtgattcagcacgagtcgcgccgaagcccatacgataaacgacgttatctaagcgaccttccagcagagtcaacaggttttcacctgtgttgcctttcagacgagtcgcttctttatagtagttacggaattgacgttccagaacgccgtaagtacgacgaactttttgtttttcacgtaactgcacaccatagtcagacagacgcggtttacgtgcgccgtgctggcctggtgcctgttctaatttacacttggtgtcaatcgcgcgaacgccagacttcaggaaaaggtctgtaccctcgcgacggctcagcttgagcttaggacccaaatatcttgccattttctttctccaacaatcctaaaaacgaagacgtcttattaaacttaaacgcgacgttttttcggtgggcgacaaccgttatgaggaatcggagtcacatcagtaatattagtgatgcggaaaccagccgcgtttaatgcgcgaatagttgactcacggccaggaccaggtcctttaaccataacttccaggttcttaattccgtattcttttactgcttcagcacagcgctctgctgcaacctgagccgcaaacggagtagatttacgagaaccacggaaaccggaaccacctgcagttgcccaacccaaagcattaccctgacgatcagtaatagtaacgattgtgttgttgaaagaagcatggatatgagccacaccgtcagagacttgttttcttacacgcttacgtgcacgaataggtgcttttgccattattcaataccccgattatttcttgatcggcttacgcggacccttacgggtacgtgcattggtcttagtacgctgaccgcgaactggcagaccacgacgatgacgcaaaccacgatagcaaccaaggtccatcagacgtttgatactcagggtcacttcacgacgcagatcaccttctacaacgtatttggcaacttcgtcacgcagcttgtcaatttgctcttcagacagctcactgatcttaacattttcagcaatacacgctgcttcacagatttgctgtgagcgggttttaccgatgccgtaaatcgaggttaacgcgattacggtatgtttctgatcaggaatgttaatgcctgctatacgggccactatgcactcctacaatatttattcactgcaacatcattctgaaaagcccgttttcaggatactcaaataatgttgctgtcagataaaaaagattggctggctaatttagccagctcaacccaactttgcaagaaaaatatgcgattaaattagccttggcgttgtttatgcttaggctctgcactgcagattacacgtacgataccgttacgtttaactattttgcagttgcggcataatttcttgacggaagcacgaactttcatttttactctccgtaacttctcaagcaaaccgattaacggttatacccttttaggtttgccttcttcaatgcagactcatattgactcgacatcatcagagtttgcacttgagccataaagtccatgatgacgacaactacaatcagtaaggaagtaccaccaaaataaaatggaactttcattgcgtcacgcatgaactccgggattaagcagataaaggtaatgtataacgcaccaactaaggtcaggcgagtcattaccttatcgatatacttagccgtttgctctcccggacgaattcctggtacaaatgcaccggacttcttcaggttatctgctgtttctcttggattaaacaccaaagccgtgtagaagaaacagaagaagatgattgcagatgcgtacaataacacataaagcggttgacctggctgcaaatacatagaaatagttgtcagccaattccagcctgttccaccaccaaaccaagaggctatggtaccagggaacaaaataatactagaagcaaaaattgcagggataaccccagccatattcactttcaacggtaaatgtgtactttgtgccgcataaactcttcgaccttgttgacgcttagcatagttaacaacgatacggcgttgaccacgctccatgaaaacaacgaagaaagttacggcaaacactaatactgcaaccaacagcaacaggaggaagtgcagatcgccttgccgagcttgctcgatggtgtgaccaattgcaggcggtaaacccgcaacgataccagcaaagattatgattgaaataccgttaccgatacctcgttcagtaatctgctcacccagccacatcaggaacatggttcccgtgaccaaacttacaacagccgtgaaatagaacgcaaagccagggttaataactaaaccttgcattccaggcatattcggcaacccagtagcaataccgattgactggaatattgccagcactaacgtaccataacgggtgtattgactgatcttacgacgaccagcttccccttccttcttaatctctgctaaacggggattaaccacagttagcaactggataatgatagatgcagaaatatacggcattatacccagtgcgaagatagaagcacggcttaaagcaccaccagagaacatgttaaacatttcaatgatggtgcctcgttgctgttcgagcaatttggcaagcacagtggcatcaataccagggattggaataaaagagccaatacggaaaacaatcagagctccaataacaaacaaaagtctgcgttttaactcgcttaatccgcctttagcactttgaaaatctaatcctggttgtttagccatctgttacttattcctcaattttaccgccagcagcttcaattgcagcacgggcgcctttcgtaacacgtaagccacgcacagttactgcgcgattgacttcgccagaaagcataacttttgcgaattcaatttgagggccaacaatgttagcagctttcagtgcattcagatcgataacatcgccttcaacatgggcaaaatcagacagacgaatttctgcagtgatcattgccttacgtgaagtaaaaccaaattttggcaggcgacggtataaaggcatttggccgccttcaaaaccacgacgaacaccaccgccagaacgagatttctgacctttgtgtccacgaccgccggttttacctaggccagaaccgataccacgacctacacgtttagatgcgtgcttagcaccttcagccggagacagagtatttaagcgcatctgttactcctcaactttaaccatataggaaaccaagttgaccataccacgaaccgctggtgtatcttcgcgttcaacagtatgaccaatgcgacgcagacctaaaccagtcagagttgccttatgcttaggcaaacgaccaattgagctgcgaacctgagtaattttaatagtcttagccatggtcattacccctgaatttcttcgacggatttgccacgcttagctgcgaccatttctggagacttcatgctgtctaaagcgtccagagttgcacgaaccacgttgatcgggttagtggaaccgtaggttttagccagtacgttacgaactccagccacttccagaacagcacgcatcgcgccaccggcgatgatacctgtaccttcgtgagcaggctgcatgaacacgcgagaaccggtgtgtccacctttcactgggtggtgcagggtgccgctgttaagtgcgacgtttttcatattgcgacgtgctttttccatcgctttctggatcgctgccggaacttcgcgtgctttgccgtagccaaaaccaacgcgaccgttaccatcaccaactacagtcagtgctgtaaagctgaaaatacggccacctttgacggttttagatacgcggtttaccgcgatcagcttttcctgcagttcgccagcttgtttttcgatgtgagccatcttacacctctaccttagaactgaaggccagcttcacgggcagcatctgccagtgcctggactctaccatgatattggaaaccagaacggtcaaaggatacatttttgatacctttttccagagcacgttcagcaacaattttaccaactactgctgcggcttctttgtttccagtaaatttcagttgttcactaatagctttttctgtagtagaagcggccaccagagtttcagaaccatttggtgcgataacctgcgcataaatatggcgaggggtacggtgtaccaccaggcgagttgcacccagttcctggagcttgcggcgtgcgcgggtcgcacgacggatacgagctgctttcttatccatagtgttaccttacttcttcttagcctctttggtacgcacgacttcatcggcgtaacgaacacccttgcctttatatggctcaggacgacgataggcacgcagatctgccgcaacctgaccaatcacctgcttatcagcacctttcagtacgatttcagtttgtgacgggcattccgcagttatgcctgctggcagttgatgctcaaccggatgcgagaagcctaaagacaaactaacagcgttgcctttaactgccgcacggtaacctacacccaccagctgaagcttcttggtgaagccttcgttaacaccgataaccattgcattcagcagagaacgagttgtacctgcctgtgcccaagcatcagcaaaaccttcgcgtggagcgaaagtcagttggccatccgcatgtttaacttcaactgcattgtggattttacgacttagttcgccgtttttacccttaatcgaaataacctgaccgttgagtttaacctctacgccggcaggaatgacgacgggtgcttttgcaacacgagacattctttcctcccgaattaagctacgtagcagagaatctcgccacccagaccagcttggcgagctgcacgatcagtcattacacctttagaggtagaaataacagcgatacccaaaccagccataacttttggcagctcatcttttttcttatagatgcgcagacttgggcggcttacacgctgaatgctttctacaacagccttaccttggaagtatttcagagtgacttccagttctggcttagtgtcgccttcgattttaaaatcttcaatgtaaccttcttccttcagcacgttggcaattgccactttcagcttggaggaaggcatggtgaccgcaactttattcgcggcctgaccgttacggatacgggtcagcatatccgcgatcggatcttgcatgctcatctgtctttactcccgtgattcaattggtgacaattaccagctagcctttttaaggcccgggatttcaccgcgcatagcggcttcacggactttaatacggctcaacccaaacttccgcaaaaatgcatgcggacgcccagtctgacggcagcggttacgctgacgacaagggctggaatcacgtggcagtgtttgcagcttgagaacagcattccaacggtcttcgtcagatgcgtttacatcagagatgatcgctttcagttcaacgcgttttgcgaagaatttctcagctaatttcgcacgttttacatcacgcgctttcattgattgcttagccatgaataccctgccttacttgcggaacgggaagttaaacgcagccaacagtgcccggccttcatcatcagatttcgcagtagtggtgatagtaatatctaaaccacgtacacgatccactttatcataatcgatttcagggaagatgatttgctcacgcacacccatgctgtagttaccacgaccatcaaatgatttagcggataaaccacggaagtcacgaatacgtggtacagcaatagaaatcaggcgctcaaagaactcccacatacgttcgccacgcagggttactttacagccgattggatagccctgacggattttgaagcctgcaactgatttgcgtgctttggtgatcaatggtttctgaccagagattgctgtcaagtcagctgctgcattgtccagcagttttttgtcagcgatagcttcaccaacacccatgttcagggtgatcttctcgacccgagggacttgcatgacagaatggtaaccgaactgactcatcagtttctggactacctcgtctttgtagtaatcatgcagtttcgccatcgtatactccaaattacttgatagtttcgttattagatttgaagaaacgaacttttttgccgtcttcaaacctaaaacctacacggtcagccttgctggttgctgcattaaagattgcaacgttagaaacattaatagctgcttctttttcaacgatgccacctggttgattcagtgccggaaccggcttctgatgtttcttaaccagattgataccttcaacgataattttaccagaagaaagaacctgttttactttaccgcgcttacctttatctttgccagtcagcacgataatttcgtcatcacgacggattttcgctgccatagtttcgctccttacagtacttcaggtgccagggagataattttcatgaacttttcattacgaagttcacgagttaccggcccaaaaatacgcgtaccgataacttgctcactattgttgttcaacaatacacaagcattgctatcaaagcgaatgacagaaccgtccgggcgacgaacacccttcttggtgcgcaccactaccgctttcaggacatcaccttttttgactttaccacgaggaattgcttccttgatggtaatcttgataacatcaccgacgtttgcgtagcgacggtgcgagccacctagaaccttgatacacattacgcgacgtgcaccggagttgtcggccacgttcagcatagtctgttcttggatcattttagtgctccgctaaatgtcaactactactgagcccacttcagatacaaagaggccgtattcaatatcccatattacgagggcgcggcattataacaccacatccacgctatggacagaaaaataaacggcccgttactttttgagccgtttattttgtgtgagatagcagcttattataaaaccgctttctcaacgacgcgaactaaagtccaagatttagtcttagacagtggacgggtttcgcggatttccaccacatcgccaattccacattcattgctctcgtcatgtacgtgcagtttagtcgtacgtttgatgaatttaccatacagagggtgtttcaccacacgttcaatagcaacaacaatggacttttccattttatcgctaataacacgaccttgcagagtacggattttatcggtcattacgcacccgccttctcagtcagtaaagtcttaacgcgtgcaatattacgacgcacttgtttcaacaggtgagactgttgcagctggccacttgccgcctgcatacggagattaaattgctcacgtaacaggttcagcagctcagtgttcagctcttcaacgcttttatcgcgcagctcttgtgctttcattacatcaccgtcttagttacaaaggtggttttgataggcagtttcgctgctgccagcttgaatgcttcacgagccagctcttcaggcacaccgtccatttcatacaggactttaccgggctggatcaaggcaacccaatactctacgttacctttacctttacccatacgcacttcgagtggcttttcggtgataggtttgtctgggaatacacggatccagattttaccttgacgcttaattgcacgggtcatagcacgacgtgccgcttcaatctgacgagcagtcagacgaccacgacccacagctttcagaccgaaagtgccgaagctaacatccgcacctgcagccagaccacggttgcggcctttatgcaccttacggaatttcgtacgctttggttgtaacatcagcgactctccttacttgcggcctttacgctgctgctttttaggttgagcagccggtttttccgcctgttcaactgcagccataccacccaggatctcacctttgaagatccataccttaacgccgattacaccataagtggtgtgcgcttctgaagtgttataatcgatgtctgcacgcagagtgtgcagaggtacacgaccttcacggtaccattcagtacgcgcaatctcagcaccgcctaaacgaccactgacttccactttgatgcctttagcgcccagacgcatagcattttgtacagcacgtttcatcgcacgacggaacattacacgacgttccaattgtgaactaatgctgtccgcaactaattttgcgtccaattcaggcttgcgcacttcggcaatattaatctgcgcaggaacaccagcgatctccgctacagtcttacgcagtttttcaacgtcttcacctttcttaccgataacgatacctgggcgggcagtgtgaattgtcacacggatgctttttgcaggacgttcgataacgatacgtgaaatagatgccttaaccagttctttgttcaagtactggcgcactttaaaatcgctgtccaggttgtcagcgaattctttggtattcgcataccaggtagagttccaaggtttgacaatccccagacgaataccattaggatgtactttctgacccattgctagtctccagagtctcagcgatcggacacaaccacagtaatgtggctggtgcgctttaggatacgatctgcacggcctttggcacgaggcataatacgcttcatggttgggccttcgtctacgaaaattttcgtgactttcagatcatcgatgtcagcgccatcgttgtgttctgcgttagcaatagcagactcaagtactttcttcactaaaccagcagctttcttgttggtatagagcagagtttccagagcttgcgacactttcttaccgcggatcaggtcagccacgaggcgaaccttctgagcagaagaacgagcgtggcgatgtttagcgatagtttccatctcttcctcctaccttagcgctttttagcctttttatcggccgcatggccgcgataagtacgggtcggcgcgaattcacccagtttgtgaccaaccatttcgtcggaaacaaaaactggaacgtgctgacgaccattatggacagcgatggtcaaaccgatcatgttaggaaagatcgttgaacgacgggaccaagtcttaataggctttttgtctccgctttccaccgctttctctaccttcttcagcaagtgcaggtcaataaatggacctttcttgagagaacgtggcatggtttatcctctaattattatttagaacggcggcgtacgatgtattgatcagtacgtttgttactacgggtcttcttacctttggtctggatgccccatggagttacagggtgtttaccaaagttacgaccttcaccaccaccatgtggatggtctactgggttcatcgccgtaccacgaacggtaggacggataccacgccagcggcttgcaccagctttacccagaacgcgtaacatgtgctctgcgttaccaacttcacctaaagtagcgcgacagtcagacagcactttacgcatttcaccagaacgcagacgcaaggttacataggaaccgtcacgtgcaacgatctgagcgtaagtacctgctgaacgagccagctgaccacctttacctggtttcatttctatgttgtgaacagtagaaccaaccgggatattgcgcattggcagagcattaccggccttgattgctgaatcagcaccagactggatttgatcacctgctttcagacccttaggtgcaaggatgtaacgacgctcaccgtctctatacagaactagtgcgatgttcgctgaacggtttggatcatattccagacgttcaacaacagcagggataccatctttgttgcgtttaaagtcaaccagacgataatgctgtttatggccaccaccaatgtgacgagtggtaatacgaccattgttgttacgaccaccagttttgttgtttttttccaacaacggagcataaggtttgcccttatgcagctcagggttaaccactttaacaacgtggcgacggcccggagacgtaggtttacatttaacaattgccattgttctttactcctccgacttactcagcgccgccgccgaagtccaagttctggccttctttcagggtgacgtaagcttttttccagtcgctacgacgaccaatacgctgaccgtggcgtttaactttacctttaactagcaaagtgtttacaccttcaacttcaacttcgaagagtttctgtacggcagctttgatctctgctttagtcgcgtctttcgcaactttgagaacgatggtgttgcttttttccatcgctgtagaagctttttcagatacgtgcggcgcgcacagtattttcagcagacgttcttcacggatcatgccagcatctcctcaacctgctttacagcatcagcagtcataaccactttgtcgaaggcgatcaggcttactgggtcgatacctgctgcatcacgaacgtcaaccttatacaggttacgagctgctaagaacaggttctcatcaacttcgccagtgacaatcagcacgtcttgcagagccatttctttcagtttctgtaccagcagcttagttttaggtgcttcaacagagaacttctcgacaacgatcagacgttcttgacgtaccagttcagataagatgctttttagagcaccgcggtacatctttttattaactttttgactgtggtcctgtggcttcgctgcaaaagttacaccaccagagcgccagattggactcttaatagaacctgcacgtgcacgaccagtacctttctgacgccatggttttttacctgaaccagaaacttcagcacgagttttctgagcacgagtaccttgacgagcaccagctgcgtacgcaacaactacttgatgcacaagcgcttcattgaagtcacgcccgaaggtagtttcggaaacagtcagcgcgctttgcgcgtctttcattaccaattccattcctatctcctcgacgttacgccttaacagccggttttacgatcaggtcactgccagttgcacctggaacagcacctttgaccagcagcaggttacgctcagcgtcaacacgtactacatctaggctctgaacagttacacgttcattacccatttggcctgccattttcttacctttgaataccttgcccggggtctggttctgaccgatagaacccggaacacgatgagacaaggagttgccatgggtagcatcttgagtacggaagttccagcgtttaacaggtacccgcgaaacctttacctttagatgtaccagtaacgtcgacttttttaacgttagcgaaaatttcaacgctaatgctttgacccactgtgtactcttcgtcgtctaatgacagacggaactcacgcagagtacggccagcttcaacgccagctttagcgaaatgacctgcttcaggtttattaacgcggttagcttttttgctaccagtcgttacctgaattgcgcgataaccgtcactctcttggtctttaacctgagttatgcggttctcttcgatttcgataacacttacagggatagaaacgccatcttcagtgaagatgcgagtcatgcccacttttttaccgactaaaccaatcattgtttcaacctctcaatcgttcaatgacctgattaacccaggctgatctgcacgtctacaccagcagccagatccagacgcatcagagcatcaacggttttctcggttggctcaacgatgtcaaccagacgtttgtgagtgcgaatctcgtactgatcacgcgcatctttgttaacatgcggagaaatcagaacggtaaaacgctccttacgagtcggcagcgggatcggaccgcgaacttgcgcaccagtgcgcttagcggtctctacgatttccgcagttgattgatcgattaaacggtgatcaaatgctttcaggcggatacggattctttggttctgcatgagaccagagctccaactattttataaacgtaaataattactactcacacccatttcgattgatgggggagtgtaatcgttcaatgtataacccccatatcgggagtattttaacatggcggtaaattaccgctcattactgatgataaatcagtcctactctactgcgtaggtaagctcgcttattatacgtgaatttgctgacaatgcaagataagggtgaaagctattcaaaagataggcaaggaggggaaaacgccctatgcaaatttatagggcgttaatattatttcgttattcttcaacaagttgagattggatataattttgtattcccactcgattgatcaagtccagttgggtttccaaccagtctatgtgattctcttcgtcagaaagaacctcaatcatcaagtctctgcttacataatcataagctgaatcggcatatgcaattgcctctctcagatccttggcaccgcgtatctctagtgctagatcggattgcagcatttcttctatatcctcaccgatattgagtttgcccaaatcctgtagatttggcaaaccttccagaaacaagatacgctcaatatacttatcagcgtgtttcatctcctcaatagattcacgatattcaacttcatttagacgcattaacccccagtttttaaacattcgggcatgtaaaaaatactggttgatggcaacaagttcattgccaagaagtttattaagatgtgcaattatctttttatcacctttcatagctagctcctccacttccagtacctatagtgtagtactagttcagcagagtaattgcaagataattgtgtttattttaagcgaaattatttatgggagacagttgggcaatctcctcattcattatttcacgtgcttgacgtatacattttccacaattgctccctacaggcacaaagtccctcagctctctgatagaacgaacatgttgctggcaaacaatattgcgtatcgttttatcgcttatagcattacagagacagatatacatggaagcactcttctaactatttaggctaggcacaatagatatgactctacctttcatctttcaagttactaccttgttggtcactctcactcacctcagtcatatcgctatctatgctcttagagatttgttcgcttgccatcaattacaacttgggtatggagcatagtcatatttataaaataatagatactgccaaatagtaaatagaaataactctcatttcaattattgtttttattttgtttatagataaaaaatctatggtccccaccttttttgcaacactgatttttgattgatgttggcttgcttaaatctatccggcgtcactatgggcagggatgcccgcgcctcgatgagttccgcacctgataagcctaaaaaaccgcacggcttcagagagccattttttatgtcaggattccatcaggtcgataagccgttcatgtcatcaataatcagtcttcgcaaaaccagattgggaactgctttaattaacgattaacctgccagtcagactggcgtcgtcgttacctttcgaacacagtttgccgtgttgtgattgcccaggctatccgggctaatttgttggccagcgcacaggccacaacatttgagtgttttcgctcaagctgagcctttacccattcagccagccttcctgactgataatcgattctctggataaagactctggcgcactggacaagtaaccgtcgcagatttttgtctccgcgtttacttatccctaaaagcgtatttttgccacccgtgctgtactggcgtggtaccagaccggttgaagcagcaaaatcccggctacagccatactgcttaccatcgcccagctgcgatgataagacgctggcagttatcggacccacgcccggtattgtctgaagacgctgtcctgtttcatcacgtctcagctcctgctccagtgccgtctcaaggggatcctnctagagtcaactgcgaggtcatgcacgaaggagtc
